(12) United States Patent
Bogorad et al.

(10) Patent No.: US 11,083,799 B2
(45) Date of Patent: Aug. 10, 2021

(54) MATERIALS AND METHODS FOR TREATMENT OF HEREDITARY HAEMOCHROMATOSIS

(71) Applicant: CRISPR Therapeutics AG, Zug (CH)

(72) Inventors: Roman Lvovitch Bogorad, Cambridge, MA (US); Chad Albert Cowan, Cambridge, MA (US); Ante Sven Lundberg, Cambridge, MA (US)

(73) Assignee: CRISPR THERAPEUTICS AG, Zug (CH)

( * ) Notice: Subject to any disclaimer, the term of this patent is extended or adjusted under 35 U.S.C. 154(b) by 365 days.

(21) Appl. No.: 16/084,531

(22) PCT Filed: Mar. 16, 2017

(86) PCT No.: PCT/IB2017/000317
§ 371 (c)(1),
(2) Date: Sep. 12, 2018

(87) PCT Pub. No.: WO2017/158422
PCT Pub. Date: Sep. 21, 2017

(65) Prior Publication Data
US 2019/0076551 A1 Mar. 14, 2019

Related U.S. Application Data

(60) Provisional application No. 62/323,890, filed on Apr. 18, 2016, provisional application No. 62/309,136, filed on Mar. 16, 2016.

(51) Int. Cl.
| | |
|---|---|
| *A61K 48/00* | (2006.01) |
| *C12N 15/90* | (2006.01) |
| *C12N 15/113* | (2010.01) |
| *C12N 15/10* | (2006.01) |
| *A61K 9/00* | (2006.01) |
| *C12N 5/0775* | (2010.01) |
| *C12N 5/071* | (2010.01) |

(52) U.S. Cl.
CPC ........ *A61K 48/0058* (2013.01); *A61K 9/0019* (2013.01); *A61K 48/005* (2013.01); *A61K 48/0066* (2013.01); *A61K 48/0075* (2013.01); *C12N 5/067* (2013.01); *C12N 5/0663* (2013.01); *C12N 15/102* (2013.01); *C12N 15/1138* (2013.01); *C12N 15/907* (2013.01); *C12N 2310/20* (2017.05)

(58) Field of Classification Search
None
See application file for complete search history.

(56) References Cited

U.S. PATENT DOCUMENTS

| | | |
|---|---|---|
| 3,687,808 A | 8/1972 | Merigan et al. |
| 4,469,863 A | 9/1984 | Ts et al. |
| 4,476,301 A | 10/1984 | Imbach et al. |
| 4,587,044 A | 5/1986 | Miller et al. |
| 4,605,735 A | 8/1986 | Miyoshi et al. |
| 4,667,025 A | 5/1987 | Miyoshi et al. |
| 4,762,779 A | 8/1988 | Snitman |
| 4,789,737 A | 12/1988 | Miyoshi et al. |
| 4,824,941 A | 4/1989 | Gordon et al. |
| 4,828,979 A | 5/1989 | Klevan et al. |
| 4,835,263 A | 5/1989 | Nguyen et al. |
| 4,845,205 A | 7/1989 | Huynh et al. |
| 4,876,335 A | 10/1989 | Yamane et al. |
| 4,904,582 A | 2/1990 | Tullis |
| 4,948,882 A | 8/1990 | Ruth |
| 4,958,013 A | 9/1990 | Letsinger |
| 5,023,243 A | 6/1991 | Tullis |
| 5,034,506 A | 7/1991 | Summerton et al. |
| 5,082,830 A | 1/1992 | Brakel et al. |
| 5,109,124 A | 4/1992 | Ramachandran et al. |
| 5,112,963 A | 5/1992 | Pieles et al. |
| 5,118,802 A | 6/1992 | Smith et al. |
| 5,130,302 A | 7/1992 | Spielvogel et al. |
| 5,134,066 A | 7/1992 | Rogers et al. |
| 5,138,045 A | 8/1992 | Cook et al. |
| 5,166,315 A | 11/1992 | Summerton et al. |
| 5,173,414 A | 12/1992 | Lebkowski et al. |
| 5,175,273 A | 12/1992 | Bischofberger et al. |
| 5,177,196 A | 1/1993 | Meyer et al. |
| 5,185,444 A | 2/1993 | Summerton et al. |
| 5,188,897 A | 2/1993 | Suhadolnik et al. |
| 5,214,134 A | 5/1993 | Weis et al. |
| 5,214,136 A | 5/1993 | Lin et al. |
| 5,216,141 A | 6/1993 | Benner |
| 5,218,105 A | 6/1993 | Cook et al. |

(Continued)

FOREIGN PATENT DOCUMENTS

| | | |
|---|---|---|
| WO | 1993/07883 A1 | 4/1993 |
| WO | 1995/13365 A1 | 5/1995 |

(Continued)

OTHER PUBLICATIONS

Sanghvi, Antisense research and applications, Crooke, S.T. and Lebleu, B., eds., CRC Press, Boca Raton, 276-278 (1993).
Sapranauskas et al., The *Streptococcus thermophilus* CRISPR/Cas system provides immunity in *Escherichia coli*, Nucl. Acids Res., 39(21):9275-9282 (2011).
Sawitza et al., Bile acids induce hepatic differentiation of mesenchymal stem cells, Sci. Rep., 5:13320 (2015).

(Continued)

*Primary Examiner* — Ileana Popa
(74) *Attorney, Agent, or Firm* — Marshall, Gerstein & Borun LLP

(57) ABSTRACT

Materials and methods for treating a patient with hereditary hemochromatosis (HHC), both ex vivo and in vivo, and materials and methods for modulating the expression, function, or activity of a haemochromatosis (HFE) gene in a cell by genome editing.

16 Claims, 8 Drawing Sheets

Specification includes a Sequence Listing.

(56) References Cited

U.S. PATENT DOCUMENTS

| | | |
|---|---|---|
| 5,235,033 A | 8/1993 | Summerton et al. |
| 5,245,022 A | 9/1993 | Weis et al. |
| 5,254,469 A | 10/1993 | Warren et al. |
| 5,258,506 A | 11/1993 | Urdea et al. |
| 5,262,536 A | 11/1993 | Hobbs, Jr. |
| 5,264,423 A | 11/1993 | Cohen et al. |
| 5,264,562 A | 11/1993 | Matteucci |
| 5,264,564 A | 11/1993 | Matteucci |
| 5,272,250 A | 12/1993 | Spielvogel et al. |
| 5,276,019 A | 1/1994 | Cohen et al. |
| 5,278,302 A | 1/1994 | Caruthers et al. |
| 5,286,717 A | 2/1994 | Cohen et al. |
| 5,292,873 A | 3/1994 | Rokita et al. |
| 5,317,098 A | 5/1994 | Shizuya et al. |
| 5,321,131 A | 6/1994 | Agrawal et al. |
| 5,367,066 A | 11/1994 | Urdea et al. |
| 5,371,241 A | 12/1994 | Brush |
| 5,391,723 A | 2/1995 | Priest |
| 5,399,676 A | 3/1995 | Froehler |
| 5,405,938 A | 4/1995 | Summerton et al. |
| 5,405,939 A | 4/1995 | Suhadolnik et al. |
| 5,414,077 A | 5/1995 | Lin et al. |
| 5,416,203 A | 5/1995 | Letsinger |
| 5,432,272 A | 7/1995 | Benner |
| 5,434,257 A | 7/1995 | Matteucci et al. |
| 5,451,463 A | 9/1995 | Nelson et al. |
| 5,453,496 A | 9/1995 | Caruthers et al. |
| 5,455,233 A | 10/1995 | Spielvogel et al. |
| 5,457,187 A | 10/1995 | Gmeiner et al. |
| 5,459,255 A | 10/1995 | Cook et al. |
| 5,466,677 A | 11/1995 | Baxter et al. |
| 5,470,967 A | 11/1995 | Huie et al. |
| 5,476,925 A | 12/1995 | Letsinger et al. |
| 5,484,908 A | 1/1996 | Froehler et al. |
| 5,486,603 A | 1/1996 | Buhr |
| 5,489,677 A | 2/1996 | Sanghvi et al. |
| 5,502,177 A | 3/1996 | Matteucci et al. |
| 5,510,475 A | 4/1996 | Agrawal et al. |
| 5,512,439 A | 4/1996 | Hornes et al. |
| 5,512,667 A | 4/1996 | Reed et al. |
| 5,514,785 A | 5/1996 | Van et al. |
| 5,519,126 A | 5/1996 | Hecht |
| 5,525,465 A | 6/1996 | Haralambidis et al. |
| 5,525,711 A | 6/1996 | Hawkins et al. |
| 5,536,821 A | 7/1996 | Agrawal et al. |
| 5,539,082 A | 7/1996 | Nielsen et al. |
| 5,541,306 A | 7/1996 | Agrawal et al. |
| 5,541,307 A | 7/1996 | Cook et al. |
| 5,541,313 A | 7/1996 | Ruth |
| 5,545,730 A | 8/1996 | Urdea et al. |
| 5,550,111 A | 8/1996 | Suhadolnik et al. |
| 5,552,538 A | 9/1996 | Urdea et al. |
| 5,552,540 A | 9/1996 | Haralambidis |
| 5,561,225 A | 10/1996 | Maddry et al. |
| 5,563,253 A | 10/1996 | Agrawal et al. |
| 5,565,552 A | 10/1996 | Magda et al. |
| 5,567,810 A | 10/1996 | Weis et al. |
| 5,571,799 A | 11/1996 | Tkachuk et al. |
| 5,574,142 A | 11/1996 | Meyer et al. |
| 5,578,717 A | 11/1996 | Urdea et al. |
| 5,578,718 A | 11/1996 | Cook et al. |
| 5,580,731 A | 12/1996 | Chang et al. |
| 5,585,481 A | 12/1996 | Arnold et al. |
| 5,587,361 A | 12/1996 | Cook et al. |
| 5,587,371 A | 12/1996 | Sessler et al. |
| 5,587,469 A | 12/1996 | Cook et al. |
| 5,591,584 A | 1/1997 | Chang et al. |
| 5,595,726 A | 1/1997 | Magda et al. |
| 5,596,086 A | 1/1997 | Matteucci et al. |
| 5,596,091 A | 1/1997 | Switzer |
| 5,597,696 A | 1/1997 | Linn et al. |
| 5,599,923 A | 2/1997 | Sessler et al. |
| 5,599,928 A | 2/1997 | Hemmi et al. |
| 5,602,240 A | 2/1997 | Mesmaeker et al. |
| 5,608,046 A | 3/1997 | Cook et al. |
| 5,610,289 A | 3/1997 | Cook et al. |
| 5,614,617 A | 3/1997 | Cook et al. |
| 5,618,704 A | 4/1997 | Sanghvi et al. |
| 5,623,070 A | 4/1997 | Cook et al. |
| 5,625,050 A | 4/1997 | Beaton et al. |
| 5,633,360 A | 5/1997 | Bischofberger et al. |
| 5,658,776 A | 8/1997 | Flotte et al. |
| 5,663,312 A | 9/1997 | Chaturvedula |
| 5,677,437 A | 10/1997 | Teng et al. |
| 5,677,439 A | 10/1997 | Weis et al. |
| 5,681,941 A | 10/1997 | Cook et al. |
| 5,688,941 A | 11/1997 | Cook et al. |
| 5,714,331 A | 2/1998 | Buchardt et al. |
| 5,719,262 A | 2/1998 | Buchardt et al. |
| 5,750,692 A | 5/1998 | Cook et al. |
| 5,763,588 A | 6/1998 | Matteucci et al. |
| 5,786,211 A | 7/1998 | Johnson |
| 5,830,653 A | 11/1998 | Froehler et al. |
| 5,871,982 A | 2/1999 | Wilson et al. |
| 6,005,096 A | 12/1999 | Matteucci et al. |
| 6,258,595 B1 | 7/2001 | Gao et al. |
| 6,287,860 B1 | 9/2001 | Monia et al. |
| 2003/0158403 A1 | 8/2003 | Manoharan et al. |
| 2014/0068797 A1 | 3/2014 | Doudna et al. |
| 2016/0067228 A1 | 3/2016 | Kishimoto |

FOREIGN PATENT DOCUMENTS

| | | |
|---|---|---|
| WO | 1995/13392 A1 | 5/1995 |
| WO | 1996/17947 A1 | 6/1996 |
| WO | 1997/06243 A1 | 2/1997 |
| WO | 1997/08298 A1 | 3/1997 |
| WO | 1997/09441 A2 | 3/1997 |
| WO | 1997/21825 A1 | 6/1997 |
| WO | 1999/11764 A2 | 3/1999 |
| WO | 2001/83692 A2 | 11/2001 |
| WO | 2013/176772 A1 | 11/2013 |
| WO | 2014/071219 A1 | 5/2014 |
| WO | 2015/048577 A2 | 4/2015 |
| WO | 2015/089419 A2 | 6/2015 |

OTHER PUBLICATIONS

Segal et al., Toward controlling gene expression at will: selection and design of zinc finger domains recognizing each of the 5'-GNN-3' DNA target sequences, Proc. Natl. Acad. Sci. USA., 96(6):2758-63 (1999).

Senapathy et al., Molecular cloning of adeno-associated virus variant genomes and generation of infectious virus by recombination in mammalian cells, J. Biol. Chem., 259:4661-4666 (1984).

Shea et al., Synthesis, hybridization properties and antiviral activity of lipid-oligodeoxynucleotide conjugates, Nucl. Acids Res., 18(13):3777-3783 (1990).

Shi et al., A combined chemical and genetic approach for the generation of induced pluripotent stem cells, Cell-Stem Cell, 2(6):525-528 (2008).

Soutschek et al., Therapeutic silencing of an endogenous gene by systemic administration of modified siRNAs, Nature, 432(7014):173-178 (2004).

Steentoft et al., Precision genome editing: a small revolution for glycobiology, Glycobiology, 24(8):663-80 (2014).

Stem-Ginossar et al., Host immune system gene targeting by a viral miRNA, Science, 317(5836):376-381 (2007).

Svinarchuk et al., Inhibition of HIV proliferation in MT-4 cells by antisense oligonucleotide conjugated to lipophilic groups, Biochimie, 75(1-2):49-54 (1993).

Takahashi et al., Induction of Pluripotent Stem Cells from Adult Human Fibroblasts by Defined Factors, Cell, 131(4):861-872 (2007).

Takahashi et al., Induction of pluripotent stem cells from mouse embryonic and adult fibroblast cultures by defined factors, Cell, 126(4): 663-76 (2006).

Tratschin et al., A human parvovirus, adeno-associated virus, as a eucaryotic vector: transient expression and encapsidation of the procaryotic gene for chloramphenicol acetyltransferase, Mol. Cell. Biol., 4(10):2072-81 (1984).

(56) References Cited

OTHER PUBLICATIONS

Tratschin et al., Use of adeno-associated virus as a mammalian DNA cloning vector: transduction of neomycin resistance into mammalian tissue culture cells, Mol. Cell. Biol., 5(11):3251-3260 (1985).
Tsai et al., Dimeric CRISPR RNA-guided FokI nucleases for highly specific genome editing, Nat. Biotech., 32(6):569-576 (2014).
Volkov et al., Selective protection of nuclease-sensitive sites in siRNA prolongs silencing effect, Oligonucleotides, 19(2):191-202 (2009).
Wang et al., Cyclohexene Nucleic Acids (CeNA): Serum Stable Oligonucleotides that Activate RNase H and Increase Duplex Stability with Complementary RNA, J. Am. Chem. Soc., 122(36):8595-8602 (2000).
Wang et al., Rapid and efficient assembly of transcription activator-like effector genes by USER cloning, J. Genet. Genomics., 41(6):339-47 (2014).
Warren et al., Highly efficient reprogramming to pluripotency and directed differentiation of human cells with synthetic modified mRNA, Cell Stem Cell, 7(5):618-30 (2010).
Weber et al., A Modular Cloning System for Standardized Assembly of Multigene Constructs, PLoS One, 6(2):e16765 (2011).
Weber et al., Methylation of human microRNA genes in normal and neoplastic cells, Cell Cycle., 6(9):1001-1005 (2007).
Whitehead et al., Silencing or stimulation? siRNA delivery and the immune system, Annual Review of Chemical and Biomolecular Engineering, 2:77-96 (2011).
Winkler, Oligonucleotide conjugates for therapeutic applications, Ther. Deliv., 4(7):791-809 (2013).
Wolfs et al., MegaTevs: single-chain dual nucleases for efficient gene disruption, Nucleic Acids Res., 42(13):8816-29 (2014).
Zhao et al., Sequence-specific inhibition of microRNA via CRISPR/CRISPRi system, Sci. Rep., 4:3943 (2014).
International Application No. PCT/IB2017/000317, International Preliminary Report on Patentability, dated Sep. 27, 2018.
International Application No. PCT/IB2017/000317, International Search Report and Written Opinion, dated Jun. 30, 2017.
Jinek et al., A programmable dual-RNA-guided DNA endonuclease in adaptive bacterial immunity, Science, 337(6096):816-821 (2012).
Judge et al., Design of noninflammatory synthetic siRNA mediating potent gene silencing in vivo, Mol. Ther., 13:494-505 (2006).
Judge et al., Overcoming the innate immune response to small interfering RNA, Hum. Gene. Ther., 19(2):111-124 (2008).
Kabanov et al., A new class of antivirals: antisense oligonucleotides combined with a hydrophobic substituent effectively inhibit influenza virus reproduction and synthesis of virus-specific proteins in MDCK cells, FEBS. Lett., 259:327-330 (1990).
Kanasty et al., Action and reaction: the biological response to siRNA and its delivery vehicles, Mol. Ther., 20(3):513-524 (2012).
Kariko et al., Suppression of RNA recognition by Toll-like receptors: the impact of nucleoside modification and the evolutionary origin of RNA, Immunity, 23:165-175 (2005).
Kleinstiver et al., The I-TevI nuclease and linker domains contribute to the specificity of monomeric TALENs, G3 (Bethesda), 4(6):1155-1165 (2014).
Kole et al., RNA therapeutics: beyond RNA interference and antisense oligonucleotides, Nat. Rev. Drug Discov., 11:125-140 (2012).
Kormann et al., Expression of therapeutic proteins after delivery of chemically modified mRNA in mice, Nat. Biotechnol., 29:154-157 (2011).
Kornberg, DNA replication, W. H. freeman & Co., San Francisco, 75-77 (1980).
Lacerra et al., Restoration of hemoglobin A synthesis in erythroid cells from peripheral blood of thalassemic patients, Proc. Natl. Acad. Sci., 97:9591-9596 (2000).
Laughlin et al., Cloning of infectious adeno-associated virus genomes in bacterial plasmids, Gene., 23:65-73 (1983).

Lebkowski et al., Adeno-Associated Virus: a Vector System for Efficient Introduction and Integration of DNA into a Variety of Mammalian Cell Types, Mol. Cell. Biol., 8:3988-3996 (1988).
Letsinger et al., Cholesteryl-conjugated oligonucleotides: synthesis, properties, and activity as inhibitors of replication of human immunodeficiency virus in cell culture, Proc. Natl. Acad. Sci. USA, 86:6553-6556 (1989).
Li et al., Modularly assembled designer TAL effector nucleases for targeted gene knockout and gene replacement in eukaryotes, Nucleic Acids Res., 39(14):6315-6325(2011).
Liu et al., Validated zinc finger protein designs for all 16 GNN DNA triplet targets, J. Biol. Chem., 277(6):3850-3856 (2002).
Ma et al., Highly efficient differentiation of functional hepatocytes from human induced pluripotent stem cells, Stem. Cells Transl. Med., 2:409-419 (2013).
Ma et al., Pol III promoters to express small RNAs: Delineation of transcription initiation, Mol. Ther. Nucleic Acids, 3:e161 (2014).
Maherali et al., Guidelines and techniques for the generation of induced pluripotent stem cells, Cell Stem Cell, 3(6):595-605 (2008).
Mak et al., The crystal structure of TAL effector PthXo1 bound to its DNA target, Science, 335(6069):716-719 (2012).
Manoharan et al., Chemical modifications to improve uptake and bioavailability of antisense oligonucleotides, Ann. N. Y. Acad. Sci., 660:306-309 (1992).
Manoharan et al., Cholic acid-oligonucleotide conjugates for antisense applications, Bioorg. Med. Chem. Let., 4:1053-1060 (1994).
Manoharan et al., Introduction of a lipophilic thioether tether in the minor groove of nucleic acids for antisense applications, Bioorg. Med. Chem. Let., 3:2765-2770 (1993).
Manoharan et al., Lipidic nucleic acids, Tetrahedron Lett., 36:3651-3654 (1995).
Manoharan et al., Oligonucleotide conjugates: Alteration of the pharmacokinetic properties of antisense agents, Nucleosides & Nucleotides, 14: 969-973 (1995).
Maresca et al., Obligate ligation-gated recombination (ObLiGaRe): custom-designed nuclease-mediated targeted integration through nonhomologous end joining, Genome. Res., 23:539-546 (2013).
Marson et al., Wnt signaling promotes reprogramming of somatic cells to pluripotency, Cell Stem. Cell., 3:132-135 (2008).
Martin et al., A new access to 2'-O-alkylated ribonucleosides and properties of 2'-O-alkylated oligoribonucleotides, Helv. Chim. Acta., 78:486-504 (1995).
McLaughlin et al., Adeno-associated virus general transduction vectors: analysis of proviral structures, J. Virol., 62(6):1963-73 (1988).
De Mesmaeker et al., Antisense Oligonucleotides, Ace. Chem. Res., 28:366-374 (1995).
Mishra et al., Improved leishmanicidal effect of phosphorotioate antisense oligonucleotides by LDL-mediated delivery, Biochim Biophys. Acta., 1264(2):229-237 (1995).
Montosi et al., Wild-type HFE protein normalizes transferrin iron accumulation in macrophages from subjects with hereditary hemochromatosis, Blood., 1125 (2000).
Moscou et al., A simple cipher governs DNA recognition by TAL effectors, Science, 326(5959):1501 (2009).
Muzyczka, Use of adeno-associated virus as a general transduction vector for mammalian cells, Curr. Topics in Microbial. and Immunol., 158:97-129 (1992).
Nasevicius et al., Effective targeted gene 'knockdown' in zebrafish, Nat. Genet., 26(2):216-220 (2000).
Nielsen et al., Sequence-selective recognition of DNA by strand displacement with a thymine-substituted polyamide, Science, 254(5037):1497-500 (1991).
Oberhauser et al., Effective incorporation of 2'-O-methyl-oligoribonucleotides into liposomes and enhanced cell association through modification with thiocholesterol, Nucl. Acids Res., 20(3):533-538 (1992).
Paul et al., Increased viral titer through concentration of viral harvests from retroviral packaging lines, Human Gene. Ther., 4(5):609-615 (1993).
Paulk et al., In vivo selection of transplanted hepatocytes by pharmacological inhibition of fumarylacetoacetate hydrolase in wild-type mice, Mol. Ther., 20(10):1981-1987 (2012).

(56) References Cited

OTHER PUBLICATIONS

Peer et al., Special delivery: targeted therapy with small RNAs, Gene Therapy, 18(12):1127-1133 (2011).
Peng et al., Potential pitfalls of CRISPR/Cas9-mediated genome editing, Feb. J. 283(7):1218-1231 (2015).
Perrin et al., An experimental rabies vaccine produced with a new BHK-21 suspension cell culture process: use of serum-free medium and perfusion-reactor system, Vaccine, 13(13):1244-1250 (1995).
Pittinger et al., Multilineage potential of adult human mesenchymal stem cells, Science, 284(5411):143-147 (1999).
Posadas et al., MicroRNAs and their roles in developmental canalization, Curr. Opin. Genet. Dev., 27:1-6 (2014).
Saj et al., Control of microRNA biogenesis and transcription by cell signaling pathways, Curr. Opin. Genet. Dev., 21(4):504-510 (2011).
Samulski et al., Cloning of adeno-associated virus into pBR322: rescue of intact virus from the recombinant plasmid in human cells, Proc. Natl. Acad. Sci. USA., 79:2077-2081 (1982).
Samulski et al., Helper-free stocks of recombinant adeno-associated viruses: normal integration does not require viral gene expression, J. Virol., 63(9):3822-3828 (1989).
Sanghvi, Antisense research and applications, Crooke, S.T. and Lebleu, B., eds., Chapter 15, 289-302, CRC Press, (1993).
Angart et al., Design of siRNA therapeutics from the molecular scale, Pharmaceuticals (Basel), 6(4):440-468 (2013).
Anonymous: Headlines: Genome Editing Technology Promises New Ways to Treat Diseases, Dec. 3, 2013, XP055377434.
Arredondo et al., HFE inhibits apicaliron uptake by intestinal epithelial (Caco-2) Cells, Fed. Proc., 15(7):1276-1278 (2001).
Barrett et al., Reliable generation of induced pluripotent stem cells from human lymphoblastoid cell lines, Stem Cells Trans. Med., 3:1429-1434 (2014).
Bartel, MicroRNAs: target recognition and regulatory functions, Cell, 136:215-233 (2009).
Behlke, Chemical modification of siRNAs for in vivo use, Oligonucleotides, 18(4):305-319 (2008).
Belfort et al., Homing endonucleases: from genetic anomalies to programmable genomic clippers, Methods Mol. Biol., 1123:1-26 (2014).
Boch, Breaking the code of DNA binding specificity of TAL-type III effectors, Science, 326(5959):1509-1512 (2009).
Boissel et al., Assembly and characterization of megaTALs for hyperspecific genome engineering applications, Methods Mol. Biol., 1239:171-196 (2015).
Boissel et al., MegaTALs: a rare-cleaving nuclease architecture for therapeutic genome engineering, Nucleic Acids Res., 42:2591-2601 (2014).
Braasch et al., Novel antisense and peptide nucleic acid strategies for controlling gene expression, Biochemistry, 41(14):4503-4510 (2002).
Bramsen et al., Development of therapeutic-grade small interfering RNAs by chemical engineering, Front Genet., 3:154 (2012).
Budniatzky et al., Concise review: reprogramming strategies for cardiovascular regenerative medicine: from induced pluripotent stem cells to direct reprogramming, Stem Cells Transl. Med., 3(4):448-457 (2014).
Burnett et al., Current progress of siRNA/shRNA therapeutics in clinical trials, Biotechnol J., 6(9):1130-1146 (2011).
Canver et al., BCL11A enhancer dissection by Cas9-mediated in situ saturating mutagenesis, Nature, 527(7577):192-197 (2015).
Carter, Adeno-associated virus vectors, Curr. Opin. Biotechnol., 3(5):1533-539 (1992).
Cekaite et al., Gene expression analysis in blood cells in response to unmodified and 2'-modified siRNAs reveals TLR-dependent and independent effects, J. Mol. Biol., 365:90-108 (2007).
Cermak et al., Efficient design and assembly of custom TALEN and other TAL effector-based constructs for DNA targeting, Nucleic Acids Res., 39(12):e82 (2011).
Cermak et al., Efficient design and assembly of custom TALENs using the Golden Gate platform, Methods Mol. Biol., 1239:133-159 (2015).
Chen et al., Global microRNA depletion suppresses tumor angiogenesis, Genes Dev., 28:1054-1067 (2014).
Chernolovskaya et al., Chemical modification of siRNA, Curr. Opin. Mol. Ther., 12(2):158-167 (2010).
Chu et al., Increasing the efficiency of homology-directed repair for CRISPR-Cas9-induced precise gene editing in mammalian cells, Nat. Bio., 33(5):543-548 (2015).
Clark et al., A stable cell line carrying adenovirus-inducible rep and cap genes allows for infectivity titration of adeno-associated virus vectors, Gene Ther., 3:1124-1132 (1996).
Crooke et al., Pharmacokinetic properties of several novel oligonucleotide analogs in mice, J. Pharmacol. Exp. Ther., 277:923-937 (1996).
Database EMBL [Online], *H.sapiens* HFE gene, exon 2 & 3, XP002770764, retrieved from EBI accession No. EM STD:Y09800 Database accession No. Y09800 (1997).
Database EMBL [Online], Human hereditary haemochromatosis protein (HLA-H) gene, partial cds, XP002770763 (1999).
Deleavey et al., Chemical modification of siRNA, Curr. Protec. Nucleic Acid Chem. Chapter 16:Unit 16.3 (2009).
Deltcheva et al., CRISPR RNA maturation by trans-encoded small RNA and host factor RNase III, Nature, 471:602-607 (2011).
Dreier et al., Development of zinc finger domains for recognition of the 5'-ANN-3' family of DNA sequences and their use in the construction of artificial transcription factors, J. Biol. Chem., 276(31):29466-29478 (2001).
Dreier et al., Development of zinc finger domains for recognition of the 5'-CNN-3' family DNA sequences and their use in the construction of artificial transcription factors, J. Biol. Chem., 280(42):35588-35597 (2005).
Dreier et al., Insights into the molecular recognition of the 5'-GNN-3' family of DNA sequences by zinc finger domains, J. Mol. Biol., 303(4):489-502 (2000).
Duan et al., Differentiation and characterization of metabolically functioning hepatocytes from human embryonic stem cells, Stem. Cells, 28:674-686 (2010).
Englisch et al., Angewandle chemie, International edition, 30:613 (1991).
Ezquer et al., Hereditary hemochromatosis: An opportunity for gene therapy, Biol Res., 39(1):113-124 (2006).
Flotte et al., Gene expression from adeno-associated virus vectors in airway epithelial cells, Am. J. Respir. Cell Mol. Biol., 7:349-356 (1992).
Focosi et al., Induced pluripotent stem cells in hematology: current and future applications, Blood Cancer J., 4:e211 (2014).
Fonfara et al., Phylogeny of Cas9 determines functional exchangeability of dual-RNA and Cas9 among orthologous type II CRISPR-Cas systems, Nucleic Acids Res., 42:2577-2590 (2014).
Fucini et al., Adenosine modification may be preferred for reducing siRNA immune stimulation, Nucleic Acid Ther., 22(3):205-210 (2012).
Gaglione et al., Recent progress in chemically modified siRNAs, Mini. Rev. Med. Chem., 10(7):578-595 (2010).
Gebeyehu et al., Novel biotinylated nucleotide—analogs for labeling and colorimetric detection of DNA, Nucl. Acids Res., 15:4513-4534 (1997).
Goeddel, Gene expression technology: Methods in enzymology, Academic Press, San Diego, CA, 185 (1990).
Graham et al., Resources for the design of CRISPR gene editing experiments, Gen. Biol., 16(1):260 (2015).
Guilinger et al., Fusion of catalytically inactive Cas9 to FokI nuclease improves the specificity of genome modification, Nat. Biotechnol., 32:577-582 (2014).
Hafez et al., Homing endonucleases: DNA scissors on a mission, Genome., 55(8):553-569 (2012).
Heasman, Morpholino oligos: making sense of antisense?, Dev. Biol., 243:209-214 (2002).
Hermonat et al., Use of adeno-associated virus as a mammalian DNA cloning vector: transduction of neomycin resistance into mammalian tissue culture cells, Proc. Natl. Acad. Sci. USA, 81:6466-6470 (1984).

(56) References Cited

OTHER PUBLICATIONS

Herranz et al., MicroRNAs and gene regulatory networks: managing the impact of noise in biological systems, Genes Dev., 24:1339-1344 (2010).

Herrera et al., Isolation and characterization of a stem cell population from adult human liver, Stem. Cells, 24:2840-2850 (2006).

Hu et al., Physiological roles of asialoglycoprotein receptors (ASGPRs) variants and recent advances in hepatic-targeted delivery of therapeutic molecules via ASGPRs, Protein Pept. Lett., 21(10):1025-1030 (2014).

Huangfu et al., Induction of pluripotent stem cells by defined factors is greatly improved by small-molecule compounds, Nat. Biotechnol., 26(7):795-797 (2008).

FIGURE 2A

| SEQ ID NO. | Name | Guide sequence | Indel | R2 |
|---|---|---|---|---|
| 3610 | Hfe_T168 | CCCAAGGACCAAATGATCTC | 87.8 | 0.9424 |
| 973 | Hfe_T303 | TCTCTGCACTACCTCTTCAT | 84.2 | 0.9302 |
| 378 | Hfe_T101 | GAGCCTAGGCAATAGCTGTA | 81.8 | 0.9935 |
| 1029 | Hfe_T386 | CTGGAAGTCTGAGGTCTTGT | 81.1 | 0.9646 |
| 3598 | Hfe_T450 | ACAGCCCAGGATGACCTGCA | 80.8 | 0.9891 |
| 3634 | Hfe_T552 | GAAATTCTACTGGAAACCCA | 80.6 | 0.9161 |
| 1142 | Hfe_T418 | ATCCCTGGTTGGAGTTTCAG | 77.4 | 0.9757 |
| 388 | Hfe_T18 | GGAGATTTAACGGGGACGTG | 75.8 | 0.9711 |
| 1121 | Hfe_T342 | AGAGGTGTTTTGGACCAACA | 75.4 | 0.9755 |
| 3678 | Hfe_T131 | CTCATACCATCAGCTGTGTC | 74 | 0.9497 |
| 1137 | Hfe_T210 | GTTGCAGGGCACGGAATCCC | 72 | 0.9835 |
| 3531 | Hfe_T322 | TTCCCTTTGAGCCATATGCA | 72 | 0.987 |
| 3654 | Hfe_T448 | GCTCTGAGGCACCCATGAAG | 71.9 | 0.8865 |
| 1045 | Hfe_T446 | GATCATTTGGTCCTTGGGGA | 71.9 | 0.8994 |
| 1096 | Hfe_T528 | GTGGGAAAGGCACAAGATTC | 71.2 | 0.95 |
| 3558 | Hfe_T120 | ACTCTGCCACTAGAGTATAG | 71.2 | 0.987 |
| 3585 | Hfe_T404 | CTCTCCAATCCAGTGTGTCA | 70.4 | 0.9483 |
| 1102 | Hfe_T318 | GATTCGGGCCAGGCAGAACA | 68.8 | 0.9597 |
| 1028 | Hfe_T429 | GCTGGAAGTCTGAGGTCTTG | 68.2 | 0.926 |
| 3552 | Hfe_T327 | CACCTCTGAAACTCCAACCA | 68.1 | 0.9655 |
| 3604 | Hfe_T232 | GCCTTGTTAACTGCAACCAA | 67.1 | 0.9584 |
| 1067 | Hfe_T48 | GCAAGAAGACAACAGTACCG | 67 | 0.9869 |
| 1071 | Hfe_T89 | ACCGAGGGCTACTGGAAGTA | 66.6 | 0.9729 |
| 3389 | Hfe_T174 | CAAGGTTATCCAGCCCTGGT | 66.6 | 0.929 |
| 1128 | Hfe_T355 | CCTATACTCTAGTGGCAGAG | 66.4 | 0.9802 |
| 1033 | Hfe_T636 | TCTGAGGTCTTGTGGGAGCA | 66.1 | 0.95 |
| 1158 | Hfe_T294 | ATGAGACAGCCACAAGTCAT | 65.3 | 0.9659 |
| 401 | Hfe_T118 | CCTGATGCTTTTGCAGACCG | 63.1 | 0.9016 |
| 1074 | Hfe_T23 | ACTGGAAGTACGGGTATGAT | 63 | 0.9888 |
| 3556 | Hfe_T205 | CCACTCTGCCACTAGAGTAT | 62.4 | 0.9433 |
| 1053 | Hfe_T376 | TCCTTTGGTTGCAGTTAACA | 62.2 | 0.9786 |
| 1125 | Hfe_T98 | CTTCTGCCCCTATACTCTAG | 62.1 | 0.9535 |
| 1164 | Hfe_T361 | GGCTCAAAGGGAAGTGTCTA | 61.2 | 0.9765 |
| 419 | Hfe_T113 | GGCGAACTAGGGGCGCGGCG | 60.5 | 0.9172 |
| 1103 | Hfe_T313 | CAGGCAGAACAGGGCCTACC | 58.7 | 0.97 |
| 1062 | Hfe_T396 | CACACCCTGCAGGTCATCCT | 57.6 | 0.8972 |
| 969 | Hfe_T207 | CCTCCTACTACACATGGTTA | 57 | 0.8523 |
| 3646 | Hfe_T281 | GTAGCCCAAAGCTTCAAACA | 56.9 | 0.9661 |
| 1077 | Hfe_T521 | TGAATTCTGCCCTGACACAC | 55.5 | 0.9609 |
| 3417 | Hfe_T93 | CACCAAAGGAGGCACTTGAC | 55.5 | 0.9631 |
| 1258 | Hfe_T92 | CTGTGTTAGAGTCCAATCTT | 54.6 | 0.9603 |
| 982 | Hfe_T44 | GTTTGAAGCTTTGGGCTACG | 54.4 | 0.9355 |
| 3592 | Hfe_T144 | CCCGTACTTCCAGTAGCCCT | 54 | 0.969 |

FIGURE 2B

| 1297 | Hfe_T133 | TAAAGACGTATTGCCCAATG | 53.6 | 0.921515 |
|---|---|---|---|---|
| 1049 | Hfe_T553 | CCTTGGGGATGGTGGAAATA | 53.3 | 0.867 |
| 3584 | Hfe_T211 | GCTCTCCAATCCAGTGTGTC | 53.1 | 0.9729 |
| 404 | Hfe_T34 | TTGCAGACCGCGGTCCTGCA | 52.5 | 0.9849 |
| 3624 | Hfe_T374 | CTCTCCACGTACCCTTGCTG | 51.2 | 0.931235 |
| 4100 | Hfe_T402 | AAATCTCCGCTTCTTTTGGG | 50 | 0.9745 |
| 988 | Hfe_T106 | GTGTGGAGCCCCGAACTCCA | 49.4 | 0.8118 |
| 3671 | Hfe_T352 | TTAACCATGTGTAGTAGGAG | 48.5 | 0.958 |
| 418 | Hfe_T122 | GGGCGAACTAGGGGCGCGGC | 48.3 | 0.9544 |
| 1266 | Hfe_T193 | TCCTTCCTCCAACCTATAGA | 48.3 | 0.9701 |
| 3394 | Hfe_T186 | GTCTTTAGGTTCGAACTCCT | 47.9 | 0.94095 |
| 1091 | Hfe_T375 | CTGGCCCACCAAGCTGGAGT | 47.3 | 0.9541 |
| 1050 | Hfe_T216 | GAAATAGGGACCTATTCCTT | 47.2 | 0.9693 |
| 1305 | Hfe_T85 | ATAACCTTGGCTGTACCCCC | 45.4 | 0.9204 |
| 3573 | Hfe_T405 | CAGGTAGGCCCTGTTCTGCC | 44.8 | 0.98 |
| 3669 | Hfe_T171 | CCTTAACCATGTGTAGTAGG | 44.3 | 0.6955 |
| 3561 | Hfe_T82 | GTGTTTCCACCATACCTTGT | 44.3 | 0.9722 |
| 3557 | Hfe_T111 | CACTCTGCCACTAGAGTATA | 43.9 | 0.9821 |
| 3670 | Hfe_T233 | CTTAACCATGTGTAGTAGGA | 43.7 | 0.7979 |
| 4082 | Hfe_T152 | CAAGCGCCCTGCAGGACCG | 43.5 | 0.9762 |
| 964 | Hfe_T132 | CTGATGGTATGAGTTGATGC | 43.1 | 0.9767 |
| 1068 | Hfe_T175 | CAAGAAGACAACAGTACCGA | 42.4 | 0.9767 |
| 1302 | Hfe_T125 | AATGGGGATGGGACCTACCA | 42.4 | 0.7329 |
| 1304 | Hfe_T134 | CTACCAGGGCTGGATAACCT | 41.8 | 0.9301 |
| 4112 | Hfe_T240 | TCACCCTACAGCTATTGCCT | 41 | 0.89 |
| 3638 | Hfe_T91 | CTGGAAACCCATGGAGTTCG | 41 | 0.9804 |
| 3621 | Hfe_T411 | AAGCTCTGACAACCTCAGGA | 40.9 | 0.9218 |
| 1072 | Hfe_T50 | CCGAGGGCTACTGGAAGTAC | 40.2 | 0.6684 |
| 377 | Hfe_T252 | TGAGCCTAGGCAATAGCTGT | 40.1 | 0.9425 |
| 3639 | Hfe_T151 | ATGGAGTTCGGGGCTCCACA | 39.8 | 0.88 |
| 1301 | Hfe_T801 | CAATGGGGATGGGACCTACC | 39.4 | 0.6802 |
| 1044 | Hfe_T346 | CTGAGATCATTTGGTCCTTG | 38.9 | 0.9744 |
| 1084 | Hfe_T531 | ATTGGAGAGCAGCAGAACCC | 38.8 | 0.9713 |
| 3382 | Hfe_T829 | TATCTCTGCTCTTCCCCAGG | 37.7 | 0.7093 |
| 3577 | Hfe_T508 | CTTTCCCACTCCAGCTTGGT | 36.4 | 0.9467 |
| 3381 | Hfe_T731 | ATATCTCTGCTCTTCCCCAG | 36.2 | 0.893 |
| 1123 | Hfe_T299 | TTTGGACCAACAAGGTATGG | 36 | 0.9765 |
| 3572 | Hfe_T493 | AGGGCAGTCCCTCTCCAGGT | 35.7 | 0.9646 |
| 1306 | Hfe_T155 | TAACCTTGGCTGTACCCCCT | 35.7 | 0.9735 |
| 3438 | Hfe_T235 | CACTTCCTTCTATAGGTTGG | 34.5 | 0.9751 |
| 989 | Hfe_T33 | TGTGGAGCCCCGAACTCCAT | 34.3 | 0.9707 |
| 1073 | Hfe_T57 | TACTGGAAGTACGGGTATGA | 33.6 | 0.9811 |
| 3391 | Hfe_T366 | TGGTAGGTCCCATCCCCATT | 33.2 | 0.9 |
| 1078 | Hfe_T206 | TCTGCCCTGACACACTGGAT | 32.9 | 0.978 |
| 1015 | Hfe_T687 | CAGCAAGGGTACGTGGAGAG | 32.8 | 0.983247 |
| 387 | Hfe_T88 | AAAGAAGCGGAGATTTAACG | 32.5 | 0.9703 |

FIGURE 2C

| 1056 | Hfe_T329 | GGTTGCAGTTAACAAGGCTG | 32.5 | 0.9843 |
|---|---|---|---|---|
| 3651 | Hfe_T667 | AAGACCAAGGTCCTGCTCTG | 31.2 | 0.9779 |
| 1032 | Hfe_T441 | GTCTGAGGTCTTGTGGGAGC | 29.9 | 0.9606 |
| 1043 | Hfe_T290 | CCTGAGATCATTTGGTCCTT | 29.5 | 0.9851 |
| 3395 | Hfe_T198 | TCGAACTCCTTGGCATCCAT | 29.5 | 0.888574 |
| 3667 | Hfe_T59 | AGGCCTTAACCATGTGTAGT | 29.3 | 0.9848 |
| 981 | Hfe_T740 | CTTTCCTTGTTTGAAGCTTT | 28.7 | 0.9881 |
| 972 | Hfe_T547 | CTCTCTGCACTACCTCTTCA | 27.2 | 0.9813 |
| 409 | Hfe_T5 | CGCTTGCTGCGTGAGTCCGA | 27.1 | 0.9692 |
| 4117 | Hfe_T338 | AGATGCCCAGTAAAACTTCC | 27.1 | 0.9784 |
| 977 | Hfe_T458 | CTTCATGGGTGCCTCAGAGC | 26.3 | 0.9734 |
| 1298 | Hfe_T87 | GACGTATTGCCCAATGGGGA | 26 | 0.9275 |
| 1307 | Hfe_T242 | AACCTTGGCTGTACCCCTG | 25.8 | 0.9403 |
| 386 | Hfe_T238 | AAAAGAAGCGGAGATTTAAC | 25.6 | 0.9817 |
| 1122 | Hfe_T104 | TGTTTTGGACCAACAAGGTA | 25.6 | 0.9848 |
| 3636 | Hfe_T234 | TACTGGAAACCCATGGAGTT | 25.2 | 0.9859 |
| 1161 | Hfe_T204 | TCTCCATGCATATGGCTCAA | 25.1 | 0.9901 |
| 3637 | Hfe_T388 | ACTGGAAACCCATGGAGTTC | 25 | 0.9768 |
| 408 | Hfe_T11 | GCGCTTGCTGCGTGAGTCCG | 24.9 | 0.9789 |
| 1101 | Hfe_T277 | AGATTCGGGCCAGGCAGAAC | 24.8 | 0.9752 |
| 3659 | Hfe_T385 | TAGTGCAGAGAGTGTGAACC | 24.5 | 0.9784 |
| 1000 | Hfe_T694 | CAGCTGAGTCAGAGTCTGAA | 24.4 | 0.9765 |
| 1010 | Hfe_T608 | ACAACCACAGCAAGGGTACG | 23.8 | 0.983922 |
| 3632 | Hfe_T494 | GACTCAGCTGCAGCCACATC | 23 | 0.9874 |
| 986 | Hfe_T4 | TGATGATGAGAGTCGCCGTG | 21.2 | 0.982672 |
| 1303 | Hfe_T324 | GGGATGGGACCTACCAGGGC | 21 | 0.8973 |
| 1014 | Hfe_T721 | ACAGCAAGGGTACGTGGAGA | 20.9 | 0.984502 |
| 1002 | Hfe_T762 | TGAGTCAGAGTCTGAAAGGG | 20.7 | 0.9824 |
| 1069 | Hfe_T84 | ACAACAGTACCGAGGGCTAC | 20.6 | 0.9906 |
| 1003 | Hfe_T579 | GAGTCAGAGTCTGAAAGGGT | 20.3 | 0.9881 |
| 3642 | Hfe_T102 | CATCATAGAACACGAACAGC | 16.6 | 0.986739 |
| 3633 | Hfe_T372 | CATCTGGCTTGAAATTCTAC | 16 | 0.9752 |
| 1296 | Hfe_T36 | CTAAAGACGTATTGCCCAAT | 15.5 | 0.982383 |
| 4099 | Hfe_T285 | TAAATCTCCGCTTCTTTTGG | 13.5 | 0.9745 |
| 379 | Hfe_T158 | AATAGCTGTAGGGTGACTTC | 13.1 | 0.9711 |
| 1054 | Hfe_T188 | TTGGTTGCAGTTAACAAGGC | 12.1 | 0.991 |
| 4106 | Hfe_T377 | TTTTGGGGGCGGGGAAACG | 11.9 | 0.9857 |
| 417 | Hfe_T68 | CGGGCGAACTAGGGGCGCGG | 11.6 | 0.9755 |
| 3448 | Hfe_T224 | ACCATTTTGTGTCCTAAGAT | 11.2 | 0.9896 |
| 1076 | Hfe_T66 | GAAGTACGGGTATGATGGGC | 10.9 | 0.9931 |
| 4091 | Hfe_T239 | CAGGAGGAGAAGCGCCGGCC | 10.6 | 0.9673 |
| 1299 | Hfe_T45 | ACGTATTGCCCAATGGGGAT | 10 | 0.8588 |
| 1098 | Hfe_T179 | AAAGGCACAAGATTCGGGCC | 9.3 | 0.99 |
| 1138 | Hfe_T112 | CAGGGCACGGAATCCCTGGT | 9.3 | 0.9924 |
| 3431 | Hfe_T83 | GGGATCTGTTTACCCTTGCC | 9.1 | 0.9914 |
| 428 | Hfe_T264 | TGGGAGTTTGCTAACTTTGG | 9 | 0.9745 |

FIGURE 2D

| 3390 | Hfe_T167 | CTGGTAGGTCCCATCCCCAT | 8.8 | 0.9509 |
|---|---|---|---|---|
| 4092 | Hfe_T100 | AGAAGCGCCGGCCTGGCTCG | 8.6 | 0.9814 |
| 1041 | Hfe_T658 | ATTTGCTTCCTGAGATCATT | 8.1 | 0.9779 |
| 3385 | Hfe_T331 | TTCCCCAGGGGTACAGCCA | 8.1 | 0.9394 |
| 4077 | Hfe_T61 | CCTAGTTCGCCCGCAGCCCT | 6.9 | 0.9816 |
| 3387 | Hfe_T140 | CAGCCAAGGTTATCCAGCCC | 6.6 | 0.9707 |
| 4098 | Hfe_T398 | TTAAATCTCCGCTTCTTTTG | 6.4 | 0.993 |
| 403 | Hfe_T27 | TTTGCAGACCGCGGTCCTGC | 6.3 | 0.9882 |
| 1162 | Hfe_T231 | CTCCATGCATATGGCTCAAA | 5.5 | 0.991 |
| 1295 | Hfe_T41 | CCTAAAGACGTATTGCCCAA | 5.2 | 0.973203 |
| 405 | Hfe_T146 | TGCAGACCGCGGTCCTGCAG | 5 | 0.984 |
| 978 | Hfe_T622 | GGTGCCTCAGAGCAGGACCT | 5 | 0.9777 |
| 4093 | Hfe_T99 | GAAGCGCCGGCCTGGCTCGC | 4.9 | 0.9876 |
| 1042 | Hfe_T359 | TCCTGAGATCATTTGGTCCT | 4.9 | 0.976 |
| 399 | Hfe_T117 | AATGGGCCCGCGAGCCAGGC | 4.5 | 0.9907 |
| 3393 | Hfe_T39 | CCATTGGGCAATACGTCTTT | 4.1 | 0.928031 |
| 391 | Hfe_T229 | CGGGGACGTGCGGCCAGAGC | 4 | 0.9881 |
| 1090 | Hfe_T472 | CCTGGCCCACCAAGCTGGAG | 3.8 | 0.9884 |
| 423 | Hfe_T274 | ACTAGCTTTTTCTTTGCGCT | 3.4 | 0.9889 |
| 1278 | Hfe_T371 | TCAAGTGCCTCCTTTGGTGA | 3.3 | 0.9931 |
| 3619 | Hfe_T530 | TGAAAAGCTCTGACAACCTC | 2.7 | 0.984237 |
| 4096 | Hfe_T108 | CGTTAAATCTCCGCTTCTTT | 2.1 | 0.9908 |
| 980 | Hfe_T732 | TCTTTCCTTGTTTGAAGCTT | 2.1 | 0.9923 |
| 1005 | Hfe_T397 | TGTTGACTTCTGGACTATTA | 1.8 | 0.991 |
| 4085 | Hfe_T24 | CCGCGGTCTGCAAAAGCATC | 1.7 | 0.99 |
| 3433 | Hfe_T243 | TTTACCCTTGCCAGGAAGAC | 1 | 0.9923 |
| 1004 | Hfe_T558 | ACATGTTCACTGTTGACTTC | 0.9 | 0.9902 |
| 4102 | Hfe_T278 | CTCCGCTTCTTTTGGGGGGC | 0.7 | 0.992 |
| 398 | Hfe_T60 | GGGAAATGGGCCCGCGAGCC | 0.5 | 0.9912 |
| 1013 | Hfe_T566 | CACAGCAAGGGTACGTGGAG | 0.5 | 0.992518 |
| 3601 | Hfe_T537 | ACCTGCAGGGTGTGGGACTC | 0 | 0.9908 |
| 1088 | Hfe_T542 | CAGGGCCTGGCCCACCAAGC | 0 | 0.9866 |
| 3450 | Hfe_T311 | GACTCTAACACAGTGTCACT | 0 | 0.9904 |

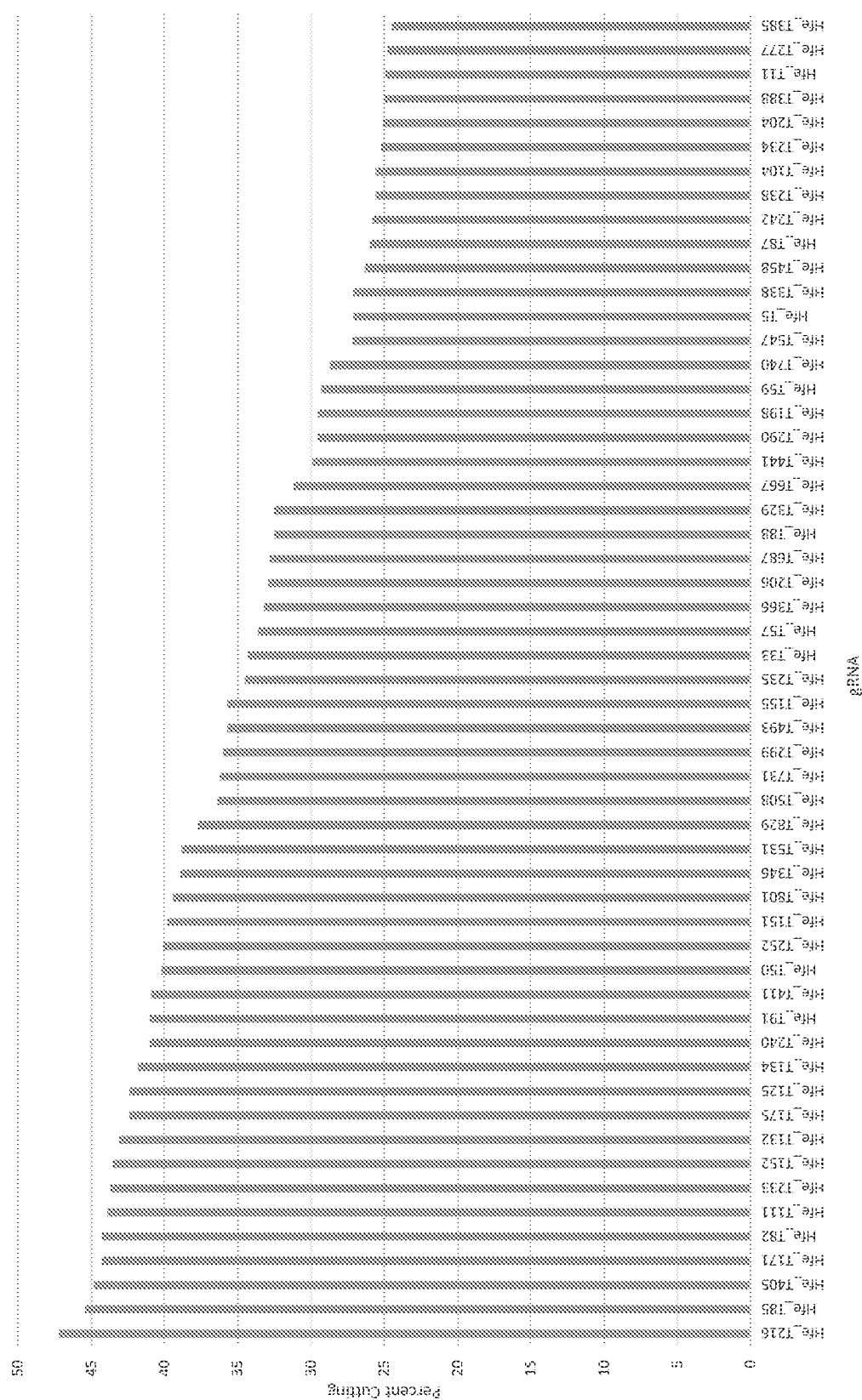

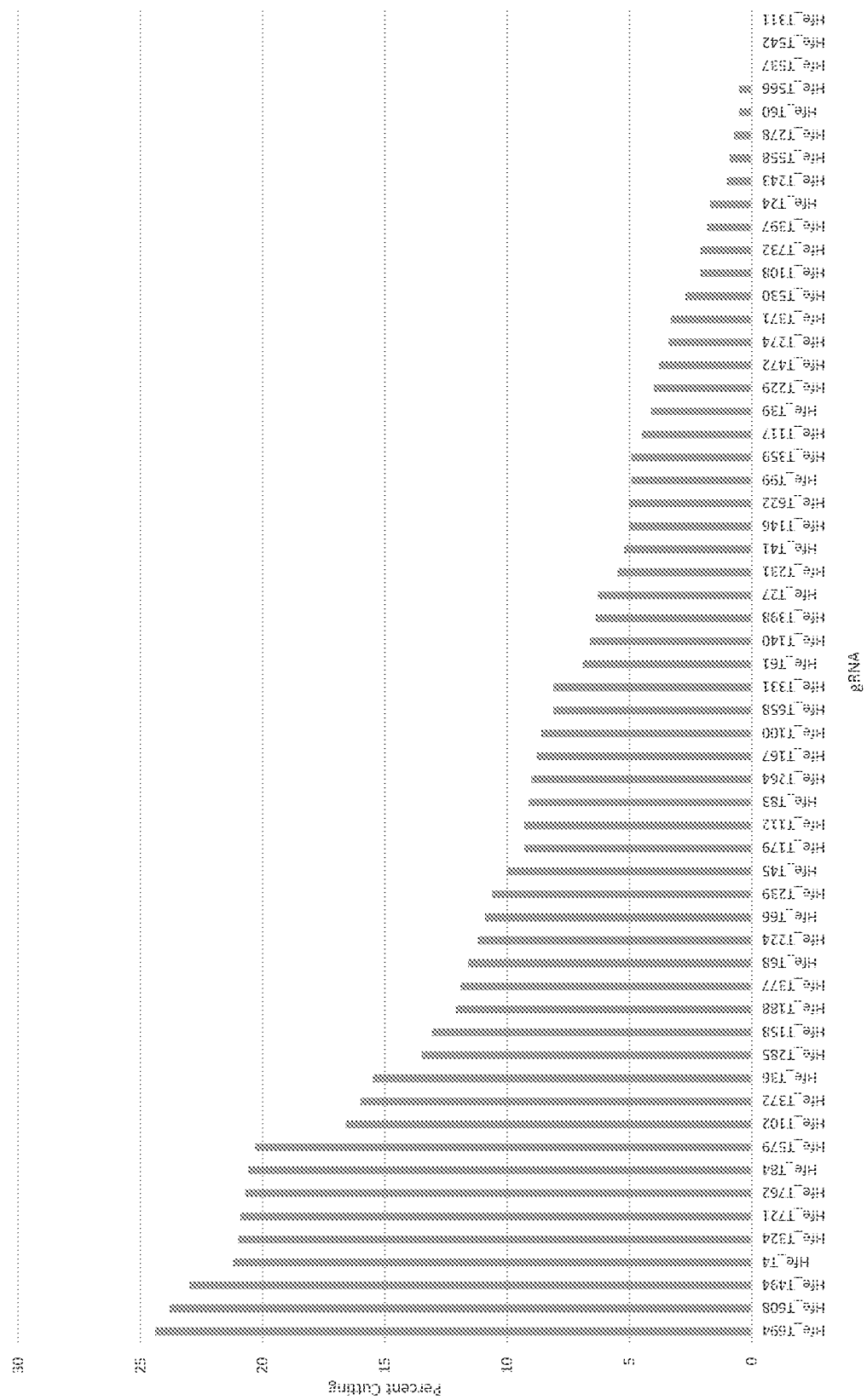

MATERIALS AND METHODS FOR TREATMENT OF HEREDITARY HAEMOCHROMATOSIS

RELATED APPLICATIONS

This application is a national stage filing under 35 U.S.C. § 371 of International Patent Application Serial No. PCT/IB2017/000317, filed Mar. 16, 2017, which claims priority to U.S. Provisional Application Ser. No. 62/323,890, filed Apr. 18, 2016, and U.S. Provisional Application Ser. No. 62/309,136, filed Mar. 16, 2016, the contents of each of which are incorporated by reference herein in their entirety.

FIELD

The present application provides materials and methods for treating a patient with hereditary haemochromatosis (HHC), both ex vivo and in vivo. In addition, the present application provides materials and methods for modulating the expression, function, and/or activity of a haemochromatosis (HFE) gene in a cell by genome editing.

INCORPORATION BY REFERENCE OF SEQUENCE LISTING

This application contains a Sequence Listing in computer readable form (filename: 160073PCT sequence listing_ST25: 13,042,115 bytes—ASCII text file; created Mar. 13, 2017), which is incorporated herein by reference in its entirety and forms part of the disclosure.

BACKGROUND

HHC is characterized by excessive storage of iron in the liver, skin, pancreas, heart, joints, and testes. It remains the most common, identified, genetic disorder in Caucasians. Although its geographic distribution is worldwide, it is most common in populations of northern European origin, particularly Nordic or Celtic ancestry, in which it occurs with a prevalence of approximately 1 per 220-250 individuals. The pathophysiologic predisposition to increased, inappropriate absorption of dietary iron may lead to the development of life-threatening complications such as cirrhosis, hepatocellular carcinoma (HCC), diabetes, and heart disease.

In 1996, HFE, a gene involved in HHC, was located on Chromosome 6 (6p21.3 region) and found to contain 7 exons spanning 12 kb.

It was discovered that the HFE gene has multiple allelic variants. One known mutation is a G-to-A missense mutation leading to the substitution of tyrosine for cysteine at amino acid position 282 of the protein product (C282Y). C282Y homozygotes account for 80-85% of typical patients with HHC. Allele frequencies of HFE C282Y in ethnically diverse western European white populations are 5-14% and in North American non-Hispanic whites are 6-7%. C282Y exists as a polymorphism only in Western European white and derivative populations, although C282Y may have arisen independently in non-whites outside Europe. There are two other regularly identified mutations of the HFE gene, one in which aspartate is substituted for histidine at amino acid position 63 (H63D), and the other in which cysteine is substituted for serine at amino acid position 65 (S65C). These mutations are generally not associated with iron loading unless seen with C282Y as a compound heterozygote, C282Y/H63D or C282Y/S65C.

Over the last 10 years, mutations of other genes coding for iron regulatory proteins have been implicated in inherited iron overload syndromes (e.g., hepcidin, hemojuvelin, transferrin receptor 2, and ferroportin). These mutations of other genes coding for iron regulatory proteins are thought to account for most of the non-HFE forms of HHC.

The largest predicted primary translation product of the HFE gene is 348 amino acids, which gives rise to a mature protein of approximately 321 amino acids after cleavage of the signal sequence. The HFE protein is similar to HLA Class I molecules at the level of the primary structure and tertiary structure. The mature protein is expressed on the cell surface as a heterodimer with beta-2-microglobulin, and this interaction is necessary for normal presentation on the cell surface. The C282Y pathogenic variant destroys a key cysteine residue that is required for disulfide bonding with beta-2-microglobulin. As a result, the HFE protein does not mature properly and becomes trapped in the endoplasmic reticulum and Golgi apparatus, leading to decreased cell-surface expression.

The diagnosis of HHC in individuals is typically based on finding elevated transferrin-iron saturation 45% or higher and serum ferritin concentration above the upper limit of normal (i.e., >300 ng/mL in men and >200 ng/mL in women) and two pathogenic variants on confirmatory HFE molecular genetic testing. Although serum ferritin concentration may increase progressively over time in untreated individuals with HHC, it is not specific for HHC, and therefore cannot be used alone for identification of individuals with HHC.

For patients diagnosed with HHC, treatment by phlebotomy (removal of blood) is an available option to help maintain serum ferritin concentration at 50 ng/mL.

An alternative treatment for patients diagnosed with HHC includes genome engineering. Genome engineering refers to the strategies and techniques for the targeted, specific modification of the genetic information (genome) of living organisms. Genome engineering is a very active field of research because of the wide range of possible applications, particularly in the areas of human health; the correction of a gene carrying a harmful mutation, for example, or to explore the function of a gene. Early technologies developed to insert a transgene into a living cell were often limited by the random nature of the insertion of the new sequence into the genome. Random insertions into the genome may result in disrupting normal regulation of neighboring genes leading to severe unwanted effects. Furthermore, random integration technologies offer little reproducibility, as there is no guarantee that the sequence would be inserted at the same place in two different cells. Recent genome engineering strategies, such as ZFNs, TALENs, HEs and MegaTALs, enable a specific area of the DNA to be modified, thereby increasing the precision of the correction or insertion compared to early technologies. These newer platforms offer a much larger degree of reproducibility, but still have their limitations.

Despite efforts from researchers and medical professionals worldwide who have been trying to address HHC, there still remains a critical need for developing safe and effective treatments for HHC.

Currently, phlebotomy treatment is the only available treatment for addressing HHC, and it only aims to manage symptoms, not treat the cause.

SUMMARY

The present disclosure presents an approach to address the genetic basis of HHC. By using genome engineering tools to create permanent changes to the genome that can address the HFE gene and restore HFE protein activity with as few as a single treatment, the resulting therapy may ameliorate the effects of or completely eliminate HHC Provided herein are cellular, ex vivo and in vivo methods for creating permanent changes to the genome by deleting, inserting, correcting, or modulating the expression or function of one or more mutations within or near an HFE gene or other DNA sequences that encode regulatory elements of the HFE gene, which can be used to treat HHC. Also provided herein are components, kits, and compositions for performing such methods. Also provided are cells produced by such methods.

Provided herein is a method for editing an HFE gene in a human cell by genome editing, the method comprising: introducing into the human cell one or more deoxyribonucleic acid (DNA) endonucleases to effect one or more single-strand breaks (SSBs) or double-strand breaks (DSBs) within or near the HFE gene or other DNA sequences that encode regulatory elements of the HFE gene that results in a permanent deletion, insertion, correction, or modulation of expression or function of one or more mutations within or near or affecting the expression or function of the HFE gene and results in restoration of HFE protein activity. The human cell can be a liver cell, skin cell, pancreatic cell, heart cell, joint cell, or cell from the testes.

Also provided herein is a method for inserting a haemochromatosis (HFE) gene in a human cell by genome editing, the method comprising: introducing into the human cell one or more deoxyribonucleic acid (DNA) endonucleases to effect one or more single-strand breaks (SSBs) or double-strand breaks (DSBs) within or near a safe harbor locus that results in a permanent insertion of the HFE gene, and results in restoration of HFE protein activity.

Also provided herein is an ex vivo method for treating a patient (e.g., a human) with HHC, the method comprising: creating a patient specific induced pluripotent stem cell (iPSC); editing within or near an HFE gene or other DNA sequences that encode regulatory elements of the HFE gene of the iPSC, or editing within or near a safe harbor locus of the iPSC; differentiating the genome-edited iPSC into a hepatocyte; and implanting the hepatocyte into the patient.

The step of creating a patient specific induced pluripotent stem cell (iPSC) can comprise: isolating a somatic cell from the patient; and introducing a set of pluripotency-associated genes into the somatic cell to induce the somatic cell to become a pluripotent stem cell. The somatic cell can be a fibroblast. The set of pluripotency-associated genes can be one or more of the genes selected from the group consisting of OCT4, SOX2, KLF4, Lin28, NANOG and cMYC.

The step of editing within or near an HFE gene or other DNA sequences that encode regulatory elements of the HFE gene of the iPSC or editing within or near a safe harbor locus of the iPSC can comprise: introducing into the iPSC one or more deoxyribonucleic acid (DNA) endonucleases to effect one or more single-strand breaks (SSBs) or double-strand breaks (DSBs) within or near the HFE gene or other DNA sequences that encode regulatory elements of the HFE gene that results in a permanent deletion, insertion, correction, or modulation of expression or function of one or more mutations within or near or affecting the expression or function of the HFE gene, or within or near a safe harbor locus, that results in restoration of HFE protein activity.

The safe harbor locus can be selected from the group consisting of AAVS1 (PPP1R12C), ALB, AngptI3, ApoC3, ASGR2, CCR5, FIX (F9), G6PC, Gys2, HGD, Lp(a), Pcsk9, Serpina1, TF, and TTR.

The step of differentiating the genome-edited iPSC into a hepatocyte can comprise: contacting the genome-edited iPSC with one or more of activin, B27 supplement, FGF4, HGF, BMP2, BMP4, Oncostatin M, or Dexametason.

The step of implanting the hepatocyte into the patient can comprise: implanting the hepatocyte into the patient by transplantation, local injection, systemic infusion, or combinations thereof.

Also provided herein is an ex vivo method for treating a patient (e.g., a human) with HHC, the method comprising: performing a biopsy of the patient's liver; isolating a liver specific progenitor cell or primary hepatocyte from the patient's liver; editing within or near an HFE gene or other DNA sequences that encode regulatory elements of the HFE gene of the liver specific progenitor cell or primary hepatocyte or editing within or near a safe harbor locus of the liver specific progenitor cell or primary hepatocyte; and implanting the genome-edited liver specific progenitor cell or primary hepatocyte into the patient.

The step of isolating a liver specific progenitor cell or primary hepatocyte from the patient's liver can comprise perfusion of fresh liver tissues with digestion enzymes, cell differencial centrifugation, cell culturing, or combinations thereof.

The step of editing within or near an HFE gene or other DNA sequences that encode regulatory elements of the HFE gene of the liver specific progenitor cell or primary hepatocyte or editing within or near a safe harbor locus of the liver specific progenitor cell or primary hepatocyte can comprise: introducing into the liver specific progenitor cell or primary hepatocyte one or more deoxyribonucleic acid (DNA) endonucleases to effect one or more single-strand breaks (SSBs) or double-strand breaks (DSBs) within or near the HFE gene or other DNA sequences that encode regulatory elements of the HFE gene or within or near a safe harbor locus that results in a permanent deletion, insertion, correction, or modulation of expression or function of one or more mutations within or near or affecting the expression or function of the HFE gene, or within or near a safe harbor locus, that results in restoration of HFE protein activity.

The safe harbor locus can be selected from the group consisting of AAVS1 (PPP1R12C), ALB, AngptI3, ApoC3, ASGR2, CCR5, FIX (F9), G6PC, Gys2, HGD, Lp(a), Pcsk9, Serpina1, TF, and TTR.

The step of implanting the genome-edited liver specific progenitor cell or primary hepatocyte into the patient can comprise: implanting the genome-edited liver specific progenitor cell or primary hepatocyte into the patient by transplantation, local injection, systemic infusion, or combinations thereof.

Also provided herein is an ex vivo method for treating a patient (e.g., a human) with HHC, the method comprising: isolating a mesenchymal stem cell from the patient; editing within or near an HFE gene or other DNA sequences that encode regulatory elements of the HFE gene of the mesenchymal stem cell, or editing within or near a safe harbor locus of the mesenchymal stem cell; differentiating the genome-edited mesenchymal stem cell into a hepatocyte; and implanting the hepatocyte into the patient.

The mesenchymal stem cell can be isolated from the patient's bone marrow by performing a biopsy of the patient's bone marrow or the mesenchymal stem cell can be isolated from peripheral blood. The step of isolating a mesenchymal stem cell from the patient can comprise aspiration of bone marrow and isolation of mesenchymal cells using density gradient centrifugation media.

The step of editing within or near the HFE gene or other DNA sequences that encode regulatory elements of the HFE gene of the mesenchymal stem cell can comprise introducing into the mesenchymal stem cell one or more deoxyribonucleic acid (DNA) endonucleases to effect one or more single-strand breaks (SSBs) or double-strand breaks (DSBs) within or near the HFE gene or other DNA sequences that encode regulatory elements of the HFE gene that results in a permanent deletion, insertion, correction, or modulation of expression or function of one or more mutations within or near or affecting the expression or function of the HFE gene or within or near a safe harbor locus, that results in restoration of HFE protein activity.

The safe harbor locus can be selected from the group consisting of AAVS1 (PPP1R12C), ALB, Angptl3, ApoC3, ASGR2, CCR5, FIX (F9), G6PC, Gys2, HGD, Lp(a), Pcsk9, Serpina1, TF, and TTR.

The step of differentiating the genome-edited mesenchymal stem cell into a hepatocyte can comprise contacting the genome-edited mesenchymal stem cell with one or more of insulin, transferrin, FGF4, HGF, or bile acids.

The step of implanting the hepatocyte into the patient can comprise implanting the hepatocyte into the patient by transplantation, local injection, systemic infusion, or combinations thereof.

Also provided herein is an in vivo method for treating a patient (e.g., a human) with HHC, the method comprising the step of editing an HFE gene in a cell of the patient or other DNA sequences that encode regulatory elements of the HFE gene, or editing within or near a safe harbor locus in a cell of the patient. The cell can be a liver cell, skin cell, pancreatic cell, heart cell, joint cell, or cell from the testes.

The step of editing an HFE gene in a cell of the patient can comprise introducing into the cell one or more deoxyribonucleic acid (DNA) endonucleases to effect one or more single-strand breaks (SSBs) or double-strand breaks (DSBs) within or near the HFE gene or other DNA sequences that encode regulatory elements of the HFE gene that results in a permanent deletion, insertion, correction, or modulation of expression or function of one or more mutations within or near or affecting the expression or function of the HFE gene or within or near a safe harbor locus that results in restoration of HFE protein activity.

The one or more DNA endonucleases can be a Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease; a homolog thereof, a recombination of the naturally occurring molecule thereof, codon-optimized thereof, or modified versions thereof, and combinations thereof.

The method can comprise introducing into the cell one or more polynucleotides encoding the one or more DNA endonucleases. The method can comprise introducing into the cell one or more ribonucleic acids (RNAs) encoding the one or more DNA endonucleases. The one or more polynucleotides or one or more RNAs can be one or more modified polynucleotides or one or more modified RNAs. The DNA endonuclease can be one or more proteins or polypeptides.

The method can further comprise introducing into the cell one or more guide ribonucleic acids (gRNAs). The one or more gRNAs can be single-molecule guide RNA (sgRNAs). The one or more gRNAs or one or more sgRNAs can be one or more modified gRNAs, one or more modified sgRNAs, or combinations thereof. The one or more DNA endonucleases can be pre-complexed with one or more gRNAs, one or more sgRNAs, or combinations thereof.

The method can further comprise introducing into the cell a polynucleotide donor template comprising at least a portion of the wild-type HFE gene, DNA sequences that encode wild-type regulatory elements of the HFE gene, and/or cDNA. The at least a portion of the wild-type HFE gene or cDNA can be exon 1, exon 2, exon 3, exon 4, exon 5, exon 6, exon 7, intronic regions, fragments of combinations thereof, or the entire HFE gene or cDNA. The donor template can be either single or double stranded. The donor template can have homologous arms to the 6p21.3 region.

The method can further comprise introducing into the cell one guide ribonucleic acid (gRNA) and a polynucleotide donor template comprising at least a portion of the wild-type HFE gene. The method can further comprise introducing into the cell one guide ribonucleic acid (gRNA) and a polynucleotide donor template comprising at least a portion of a codon optimized or modified HFE gene. The one or more DNA endonucleases can be one or more Cas9 or Cpf1 endonucleases that effect one single-strand break (SSB) or double-strand break (DSB) at a locus within or near the HFE gene (or codon optimized or modified HFE gene) or other DNA sequences that encode regulatory elements of the HFE gene, or within or near a safe harbor locus that facilitates insertion of a new sequence from the polynucleotide donor template into the chromosomal DNA at the locus or safe harbor locus that results in a permanent insertion or correction of a part of the chromosomal DNA of the HFE gene or other DNA sequences that encode regulatory elements of the HFE gene proximal to the locus, or safe harbor locus. The gRNA can comprise a spacer sequence that is complementary to a segment of the locus. Proximal can mean nucleotides both upstream and downstream of the locus or safe harbor locus.

The method can further comprise introducing into the cell one or more guide ribonucleic acid (gRNAs) and a polynucleotide donor template comprising at least a portion of the wild-type HFE gene. The one or more DNA endonucleases can be one or more Cas9 or Cpf1 endonucleases that effect or create at least two (e.g., a pair) single-strand breaks (SSBs) and/or double-strand breaks (DSBs), the first at a 5' locus and the second at a 3' locus, within or near the HFE gene or other DNA sequences that encode regulatory elements of the HFE gene or within or near a safe harbor locus that facilitates insertion of a new sequence from the polynucleotide donor template into the chromosomal DNA between the 5' locus and the 3' locus that results in a permanent insertion or correction of the chromosomal DNA between the 5' locus and the 3' locus within or near the HFE gene or other DNA sequences that encode regulatory elements of the HFE gene or within or near a safe harbor locus. The first guide RNA can comprise a spacer sequence that is complementary to a segment of the 5' locus and the second guide RNA can comprise a spacer sequence that is complementary to a segment of the 3' locus.

The one or more gRNAs can be one or more single-molecule guide RNA (sgRNAs). The one or more gRNAs or one or more sgRNAs can be one or more modified gRNAs or one or more modified sgRNAs. The one or more DNA endonucleases can be pre-complexed with one or more gRNAs or one or more sgRNAs.

The at least a portion of the wild-type HFE gene or cDNA can be exon 1, exon 2, exon 3, exon 4, exon 5, exon 6, exon 7, intronic regions, fragments, or combinations thereof, or the entire HFE gene or cDNA.

The donor template can be either a single or double stranded polynucleotide. The donor template can have homologous arms to the 6p21.3 region.

The gRNA or sgRNA can be directed to one or more of the pathological variants: C282Y, H63D, or S65C or combinations thereof.

The SSB or DSB can be in the first, second, third, fourth, fifth, sixth, seventh exon, or combinations thereof or introns of the HFE gene.

The insertion or correction can be by homology directed repair (HDR).

The method can further comprise introducing into the cell two guide ribonucleic acids (gRNAs). The one or more DNA endonucleases can be one or more Cas9 or Cpf1 endonucleases that effect or create two or more (e.g., a pair) double-strand breaks (DSBs), the first at a 5' DSB locus and the second at a 3' DSB locus, within or near the HFE gene or other DNA sequences that encode regulatory elements of the HFE gene, or within or near a safe harbor locus that causes a deletion of the chromosomal DNA between the 5' DSB locus and the 3' DSB locus that results in a permanent deletion of the chromosomal DNA between the 5' DSB locus and the 3' DSB locus within or near the HFE gene or other DNA sequences that encode regulatory elements of the HFE gene or safe harbor locus. The first guide RNA can comprise a spacer sequence that is complementary to a segment of the 5' DSB locus and the second guide RNA comprises a spacer sequence that is complementary to a segment of the 3' DSB locus.

The two gRNAs can be two single-molecule guide RNA (sgRNAs). The two gRNAs or two sgRNAs can be two modified gRNAs or two modified sgRNAs. The one or more DNA endonucleases can be pre-complexed with one or two gRNAs or one or two sgRNAs.

The 5' DSB and/or 3' DSB can be in or near the first exon, first intron, second exon, second intron, third exon, third intron, fourth exon, fourth intron, fifth exon, fifth intron, sixth exon, sixth intron, seventh exon, seventh intron, or combinations thereof, of the HFE gene.

The deletion can be a deletion of 1 kb or less.

The Cas9 or Cpf1 mRNA, gRNA, and donor template can be formulated into separate lipid nanoparticles or co-formulated into a lipid nanoparticle.

The Cas9 or Cpf1 mRNA can be formulated into a lipid nanoparticle, and the gRNA and donor template can be delivered to the cell by an adeno-associated virus (AAV) vector.

The Cas9 or Cpf1 mRNA can be formulated into a lipid nanoparticle, and the gRNA can be delivered to the cell by electroporation and donor template can be delivered to the cell by an adeno-associated virus (AAV) vector.

The HFE gene can be located on Chromosome 6: 26087458-26095569 (Genome Reference Consortium—GRCh38/hg38).

The restoration of HFE protein activity can be compared to a control (e.g., wild-type or normal HFE protein activity).

Also provided herein is one or more guide ribonucleic acids (gRNAs) for editing an HFE gene in a cell from a patient with HHC. The one or more gRNAs and/or sgRNAs can comprise a spacer sequence selected from the group consisting of nucleic acid sequences in SEQ ID NOs: 1-64,980 of the Sequence Listing. The one or more gRNAs can be one or more single-molecule guide RNAs (sgRNAs). The one or more gRNAs or one or more sgRNAs can be one or more modified gRNAs or one or more modified sgRNAs. The cell can be a liver cell, skin cell, pancreatic cell, heart cell, joint cell, or cell from the testes.

It is understood that the inventions described in this specification are not limited to the examples summarized in this Summary. Various other aspects are described and exemplified herein.

BRIEF DESCRIPTION OF THE DRAWINGS

Various aspects of materials and methods for treatment of HHC disclosed and described in this specification can be better understood by reference to the accompanying figures, in which:

FIG. 2A describes the cutting efficiencies of gRNAs selected via an in-vitro transcribed (IVT) gRNA screen;
FIG. 2B describes the cutting efficiencies of gRNAs selected via an in-vitro transcribed (IVT) gRNA screen;
FIG. 2C describes the cutting efficiencies of gRNAs selected via an in-vitro transcribed (IVT) gRNA screen;
FIG. 2D describes the cutting efficiencies of gRNAs selected via an in-vitro transcribed (IVT) gRNA screen;
FIG. 3B describes the cutting efficiency of S. pyogenes gRNAs in HEK293T cells targeting the HFE gene;
and
FIG. 3C describes the cutting efficiency of S. pyogenes gRNAs in HEK293T cells targeting the HFE gene.

BRIEF DESCRIPTION OF THE SEQUENCE LISTING

Figure 1A:
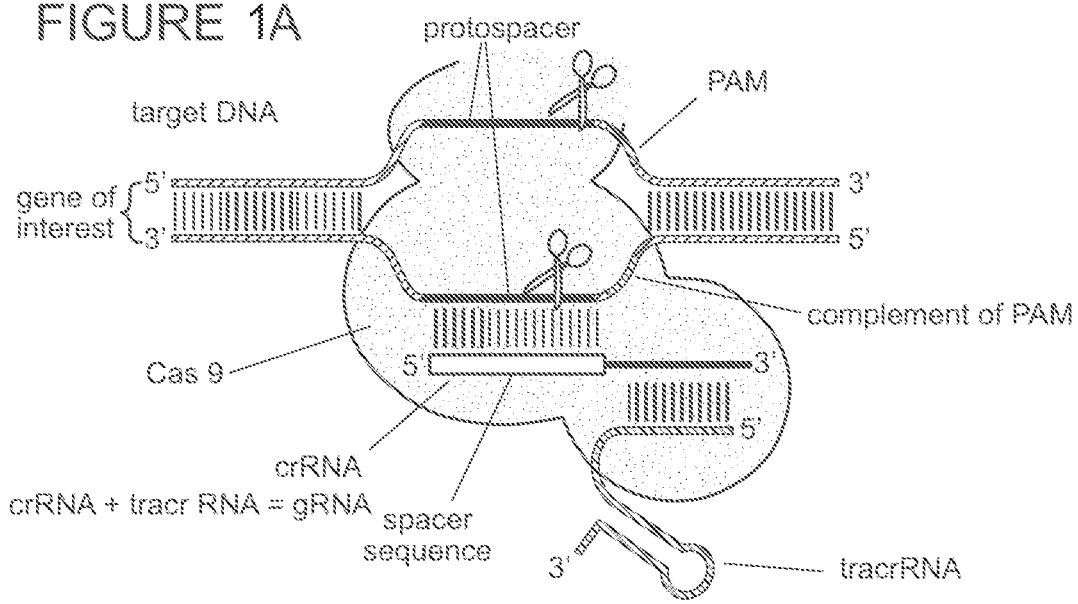
FIG. 1A is a depiction of the type II CRISPR/Cas system.

SEQ ID NOs: 1-4,455 are 20 bp spacer sequences for targeting an HFE gene with an S. pyogenes Cas9 endonuclease.

SEQ ID NOs: 4,456-4,979 are 20 bp spacer sequences for targeting an HFE gene with an S. aureus Cas9 endonuclease.

SEQ ID NOs: 4,980-5,139 are 20 bp spacer sequences for targeting an HFE gene with an S. thermophilus Cas9 endonuclease.

SEQ ID NOs: 5,140-5,192 are 20 bp spacer sequences for targeting an HFE gene with a T. denticola Cas9 endonuclease.

SEQ ID NOs: 5,193-5,617 are 20 bp spacer sequences for targeting an HFE gene with an N. meningitides Cas9 endonuclease.

SEQ ID NOs: 5,618-10,121 are 20-24 bp spacer sequences for targeting an HFE gene with an Acidominococcus, a Lachnospiraceae, and a Franciscella Novicida Cpf1 endonuclease.

SEQ ID NOs: 10,122-12,153 are 20 bp spacer sequences for targeting exons 1-2 of an AAVS1 (PPP1R12C) gene with an S. pyogenes Cas9 endonuclease.

SEQ ID NOs: 12,154-12,324 are 20 bp spacer sequences for targeting exons 1-2 of an AAVS1 (PPP1R12C) gene with an S. aureus Cas9 endonuclease.

SEQ ID NOs: 12,325-12,342 are 20 bp spacer sequences for targeting exons 1-2 of an AAVS1 (PPP1R12C) gene with an S. thermophilus Cas9 endonuclease.

SEQ ID NOs: 12,343-12,351 are 20 bp spacer sequences for targeting exons 1-2 of an AAVS1 (PPP1R12C) gene with a T. denticola Cas9 endonuclease.

SEQ ID NOs: 12,352-12,426 are 20 bp spacer sequences for targeting exons 1-2 of an AAVS1 (PPP1R12C) gene with an N. meningitides Cas9 endonuclease.

SEQ ID NOs: 12,427-13,602 are 22 bp spacer sequences for targeting exons 1-2 of an AAVS1 (PPP1R12C) gene with an Acidominococcus, Lachnospiraceae, and Francisella novicida Cpf1 endonuclease.

SEQ ID NOs: 13,603-13,770 are 20 bp spacer sequences for targeting exons 1-2 of an Alb gene with an *S. pyogenes* Cas9 endonuclease.

SEQ ID NOs: 13,771-13,798 are 20 bp spacer sequences for targeting exons 1-2 of an Alb gene with an *S. aureus* Cas9 endonuclease.

SEQ ID NOs: 13,799-13,816 are 20 bp spacer sequences for targeting exons 1-2 of an Alb gene with an *S. thermophilus* Cas9 endonuclease.

SEQ ID NOs: 13,817-13,821 are 20 bp spacer sequences for targeting exons 1-2 of an Alb gene with a *T. denticola* Cas9 endonuclease.

SEQ ID NOs: 13,822-13,845 are 20 bp spacer sequences for targeting exons 1-2 of an Alb gene with an *N. meningitides* Cas9 endonuclease.

SEQ ID NOs: 13,846-14,224 are 22 bp spacer sequences for targeting exons 1-2 of an Alb gene with an *Acidominococcus, Lachnospiraceae,* and *Francisella novicida* Cpf1 endonuclease.

SEQ ID NOs: 14,225-14,569 are 20 bp spacer sequences for targeting exons 1-2 of an Angptl3 gene with an *S. pyogenes* Cas9 endonuclease.

SEQ ID NOs: 14,570-14,605 are 20 bp spacer sequences for targeting exons 1-2 of an Angptl3 gene with an *S. aureus* Cas9 endonuclease.

SEQ ID NOs: 14,606-14,628 are 20 bp spacer sequences for targeting exons 1-2 of an Angptl3 gene with an *S. thermophilus* Cas9 endonuclease.

SEQ ID NOs: 14,629-14,641 are 20 bp spacer sequences for targeting exons 1-2 of an Angptl3 gene with a *T. denticola* Cas9 endonuclease.

SEQ ID NOs: 14,642-14,704 are 20 bp spacer sequences for targeting exons 1-2 of an Angptl3 gene with an *N. meningitides* Cas9 endonuclease.

SEQ ID NOs: 14,705-15,552 are 22 bp spacer sequences for targeting exons 1-2 of an Angptl3 gene with an *Acidominococcus, Lachnospiraceae,* and *Francisella novicida* Cpf1 endonuclease.

SEQ ID NOs: 15,553-15,955 are 20 bp spacer sequences for targeting exons 1-2 of an ApoC3 gene with an *S. pyogenes* Cas9 endonuclease.

SEQ ID NOs: 15,956-15,980 are 20 bp spacer sequences for targeting exons 1-2 of an ApoC3 gene with an *S. aureus* Cas9 endonuclease.

SEQ ID NOs: 15,981-15,983 are 20 bp spacer sequences for targeting exons 1-2 of an ApoC3 gene with an *S. thermophilus* Cas9 endonuclease.

SEQ ID NOs: 15,984-15,985 are 20 bp spacer sequences for targeting exons 1-2 of an ApoC3 gene with a *T. denticola* Cas9 endonuclease.

SEQ ID NOs: 15,986-15,997 are 20 bp spacer sequences for targeting exons 1-2 of an ApoC3 gene with an *N. meningitides* Cas9 endonuclease.

SEQ ID NOs: 15,998-16,229 are 22 bp spacer sequences for targeting exons 1-2 of an ApoC3 gene with an *Acidominococcus, Lachnospiraceae,* and *Francisella novicida* Cpf1 endonuclease.

SEQ ID NOs: 16,230-17,997 are 20 bp spacer sequences for targeting exons 1-2 of an ASGR2 gene with an *S. pyogenes* Cas9 endonuclease.

SEQ ID NOs: 17,998-18,203 are 20 bp spacer sequences for targeting exons 1-2 of an ASGR2 gene with an *S. aureus* Cas9 endonuclease.

SEQ ID NOs: 18,204-18,227 are 20 bp spacer sequences for targeting exons 1-2 of an ASGR2 gene with an *S. thermophilus* Cas9 endonuclease.

SEQ ID NOs: 18,228-18,239 are 20 bp spacer sequences for targeting exons 1-2 of an ASGR2 gene with a *T. denticola* Cas9 endonuclease.

SEQ ID NOs: 18,240-18,322 are 20 bp spacer sequences for targeting exons 1-2 of an ASGR2 gene with an *N. meningitides* Cas9 endonuclease.

SEQ ID NOs: 18,323-19,762 are 22 bp spacer sequences for targeting exons 1-2 of an ASGR2 gene with an *Acidominococcus, Lachnospiraceae,* and *Francisella novicida* Cpf1 endonuclease.

SEQ ID NOs: 19,763-19,965 are 20 bp spacer sequences for targeting exons 1-2 of a CCR5 gene with an *S. pyogenes* Cas9 endonuclease.

SEQ ID NOs: 19,966-19,997 are 20 bp spacer sequences for targeting exons 1-2 of a CCR5 gene with an *S. aureus* Cas9 endonuclease.

SEQ ID NOs: 19,998-20,011 are 20 bp spacer sequences for targeting exons 1-2 of a CCR5 gene with an *S. thermophilus* Cas9 endonuclease.

SEQ ID NOs: 20,012-20,013 are 20 bp spacer sequences for targeting exons 1-2 of a CCR5 gene with a *T. denticola* Cas9 endonuclease.

SEQ ID NOs: 20,014-20,041 are 20 bp spacer sequences for targeting exons 1-2 of a CCR5 gene with an *N. meningitides* Cas9 endonuclease.

SEQ ID NOs: 20,042-20,341 are 22 bp spacer sequences for targeting exons 1-2 of a CCR5 gene with an *Acidominococcus, Lachnospiraceae,* and *Francisella novicida* Cpf1 endonuclease.

SEQ ID NOs: 20,342-21,807 are 20 bp spacer sequences for targeting exons 1-2 of an F9 gene with an *S. pyogenes* Cas9 endonuclease.

SEQ ID NOs: 21,808-21,970 are 20 bp spacer sequences for targeting exons 1-2 of an F9 gene with an *S. aureus* Cas9 endonuclease.

SEQ ID NOs: 21,971-22,031 are 20 bp spacer sequences for targeting exons 1-2 of an F9 gene with an *S. thermophilus* Cas9 endonuclease.

SEQ ID NOs: 22,032-22,056 are 20 bp spacer sequences for targeting exons 1-2 of an F9 gene with a *T. denticola* Cas9 endonuclease.

SEQ ID NOs: 22,057-22,209 are 20 bp spacer sequences for targeting exons 1-2 of an F9 gene with an *N. meningitides* Cas9 endonuclease.

SEQ ID NOs: 22,210-24,350 are 22 bp spacer sequences for targeting exons 1-2 of an F9 gene with an *Acidominococcus, Lachnospiraceae,* and *Francisella novicida* Cpf1 endonuclease.

SEQ ID NOs: 24,351-25,366 are gRNA 20 bp spacer sequences for targeting exons 1-2 of the G6PC gene with an *S. pyogenes* Cas9 endonuclease.

SEQ ID NOs: 25,367-25,483 are gRNA 20 bp spacer sequences for targeting exons 1-2 of the G6PC gene with an *S. aureus* Cas9 endonuclease.

SEQ ID NOs: 25,484-25,507 are gRNA 20 bp spacer sequences for targeting exons 1-2 of the G6PC gene with an *S. thermophilus* Cas9 endonuclease.

SEQ ID NOs: 25,508-25,516 are gRNA 20 bp spacer sequences for targeting exons 1-2 of the G6PC gene with a *T. denticola* Cas9 endonuclease.

SEQ ID NOs: 25,517-25,606 are gRNA 20 bp spacer sequences for targeting exons 1-2 of the G6PC gene with an *N. meningitides* Cas9 endonuclease.

SEQ ID NOs: 25,607-26,701 are gRNA 22 bp spacer sequences for targeting exons 1-2 of the G6PC gene with an *Acidominococcus, Lachnospiraceae,* and *Francisella novicida* Cpf1 endonuclease.

SEQ ID NOs: 26,702-32,194 are 20 bp spacer sequences for targeting exons 1-2 of an Gys2 gene with an *S. pyogenes* Cas9 endonuclease.

SEQ ID NOs: 32,195-32,870 are gRNA 20 bp spacer sequences for targeting exons 1-2 of an Gys2 gene with an *S. aureus* Cas9 endonuclease.

SEQ ID NOs: 32,871-33,148 are gRNA 20 bp spacer sequences for targeting exons 1-2 of an Gys2 gene with an *S. thermophilus* Cas9 endonuclease.

SEQ ID NOs: 33,149-33,262 are gRNA 20 bp spacer sequences for targeting exons 1-2 of an Gys2 gene with a *T. denticola* Cas9 endonuclease.

SEQ ID NOs: 33,263-33,942 are gRNA 20 bp spacer sequences for targeting exons 1-2 of an Gys2 gene with an *N. meningitides* Cas9 endonuclease.

SEQ ID NOs: 33,943-42,374 are gRNA 22 bp spacer sequences for targeting exons 1-2 of an Gys2 gene with an *Acidominococcus, Lachnospiraceae*, and *Francisella novicida* Cpf1 endonuclease.

SEQ ID NOs: 42,375-44,067 are gRNA 20 bp spacer sequences for targeting exons 1-2 of an HGD gene with an *S. pyogenes* Cas9 endonuclease.

SEQ ID NOs: 44,068-44,281 are gRNA 20 bp spacer sequences for targeting exons 1-2 of an HGD gene with an *S. aureus* Cas9 endonuclease.

SEQ ID NOs: 44,282-44,364 are gRNA 20 bp spacer sequences for targeting exons 1-2 of an HGD gene with an *S. thermophilus* Cas9 endonuclease.

SEQ ID NOs: 44,365-44,383 are gRNA 20 bp spacer sequences for targeting exons 1-2 of an HGD gene with a *T. denticola* Cas9 endonuclease.

SEQ ID NOs: 44,384-44,584 are gRNA 20 bp spacer sequences for targeting exons 1-2 of an HGD gene with an *N. meningitides* Cas9 endonuclease.

SEQ ID NOs: 44,585-46,909 are gRNA 22 bp spacer sequences for targeting exons 1-2 of an HGD gene with an *Acidominococcus, Lachnospiraceae*, and *Francisella novicida* Cpf1 endonuclease.

SEQ ID NOs: 46,910-50,704 are gRNA 20 bp spacer sequences for targeting exons 1-2 of an Lp(a) gene with an *S. pyogenes* Cas9 endonuclease.

SEQ ID NOs: 50,705-51,114 are gRNA 20 bp spacer sequences for exons 1-2 of targeting the Lp(a) gene with an *S. aureus* Cas9 endonuclease.

SEQ ID NOs: 51,115-51,250 are gRNA 20 bp spacer sequences for targeting the exons 1-2 of Lp(a) gene with an *S. thermophilus* Cas9 endonuclease.

SEQ ID NOs: 51,251-51,285 are gRNA 20 bp spacer sequences for targeting exons 1-2 of an Lp(a) gene with a *T. denticola* Cas9 endonuclease.

SEQ ID NOs: 51,286-51,653 are gRNA 20 bp spacer sequences for targeting exons 1-2 of an Lp(a) gene with an *N. meningitides* Cas9 endonuclease.

SEQ ID NOs: 51,654-56,274 are gRNA 22 bp spacer sequences for targeting exons 1-2 of an Lp(a) gene with an *Acidominococcus, Lachnospiraceae*, and *Francisella novicida* Cpf1 endonuclease.

SEQ ID NOs: 56,275-58,294 are gRNA 20 bp spacer sequences for targeting exons 1-2 of a PCSK9 gene with an *S. pyogenes* Cas9 endonuclease.

SEQ ID NOs: 58,295-58,481 are gRNA 20 bp spacer sequences for targeting exons 1-2 of a PCSK9 gene with an *S. aureus* Cas9 endonuclease.

SEQ ID NOs: 58,482-58,517 are gRNA 20 bp spacer sequences, for targeting exons 1-2 of a PCSK9 gene with an *S. thermophilus* Cas9 endonuclease.

SEQ ID NOs: 58,518-58,531 are gRNA 20 bp spacer sequences for targeting exons 1-2 of a PCSK9 gene with a *T. denticola* Cas9 endonuclease.

SEQ ID NOs: 58,532-58,671 are gRNA 20 bp spacer sequences for targeting exons 1-2 of a PCSK9 gene with an *N. meningitides* Cas9 endonuclease.

SEQ ID NOs: 58,672-60,465 are gRNA 22 bp spacer sequences for targeting exons 1-2 of a PCSK9 gene with an *Acidominococcus, Lachnospiraceae*, and *Francisella novicida* Cpf1 endonuclease.

SEQ ID NOs: 60,466-61,603 are gRNA 20 bp spacer sequences for targeting exons 1-2 of a Serpina1 gene with an *S. pyogenes* Cas9 endonuclease.

SEQ ID NOs: 61,604-61,696 are gRNA 20 bp spacer sequences for targeting exons 1-2 of a Serpina1 gene with an *S. aureus* Cas9 endonuclease.

SEQ ID NOs: 61,697-61,708 are gRNA 20 bp spacer sequences for targeting exons 1-2 of a Serpina1 gene with an *S. thermophilus* Cas9 endonuclease.

SEQ ID NOs: 61,709-61,711 are gRNA 20 bp spacer sequences for targeting exons 1-2 of a Serpina1 gene with a *T. denticola* Cas9 endonuclease.

SEQ ID NOs: 61,712-61,762 are gRNA 20 bp spacer sequences for targeting exons 1-2 of a Serpina1 gene with an *N. meningitides* Cas9 endonuclease.

SEQ ID NOs: 61,763-62,566 are gRNA 22 bp spacer sequences for targeting exons 1-2 of a Serpina1 gene with an *Acidominococcus, Lachnospiraceae*, and *Francisella novicida* Cpf1 endonuclease.

SEQ ID NOs: 62,567-63,398 are gRNA 20 bp spacer sequences for targeting exons 1-2 of a TF gene with an *S. pyogenes* Cas9 endonuclease.

SEQ ID NOs: 63,399-63,484 are gRNA 20 bp spacer sequences for targeting exons 1-2 of a TF gene with an *S. aureus* Cas9 endonuclease.

SEQ ID NOs: 63,485-63,496 are gRNA 20 bp spacer sequences for targeting exons 1-2 of a TF gene with an *S. thermophilus* Cas9 endonuclease.

SEQ ID NOs: 63,497-63,503 are gRNA 20 bp spacer sequences for targeting exons 1-2 of a TF gene with a *T. denticola* Cas9 endonuclease.

SEQ ID NOs: 63,504-63,547 are gRNA 20 bp spacer sequences for targeting exons 1-2 of a TF gene with an *N. meningitides* Cas9 endonuclease.

SEQ ID NOs: 63,548-64,183 are gRNA 22 bp spacer sequences targeting exons 1-2 of a TF gene with an *Acidominococcus, Lachnospiraceae*, and *Francisella novicida* Cpf1 endonuclease.

SEQ ID NOs: 64,184-64,483 are gRNA 20 bp spacer sequences for targeting exons 1-2 of an TTR gene with an *S. pyogenes* Cas9 endonuclease.

SEQ ID NOs: 64,484-64,524 are gRNA 20 bp spacer sequences for targeting exons 1-2 of a TTR gene with an *S. aureus* Cas9 endonuclease.

SEQ ID NOs: 64,525-64,541 are gRNA 20 bp spacer sequences for targeting exons 1-2 of a TTR gene with an *S. thermophilus* Cas9 endonuclease.

SEQ ID NOs: 64,542-64,543 are gRNA 20 bp spacer sequences for targeting exons 1-2 of a TTR gene with a *T. denticola* Cas9 endonuclease.

SEQ ID NOs: 64,544-64,578 are gRNA 20 bp spacer sequences for targeting exons 1-2 of a TTR gene with an *N. meningitides* Cas9 endonuclease.

SEQ ID NOs: 64,579-64,980 are gRNA 22 bp spacer sequences for targeting exons 1-2 of a TTR gene with an *Acidominococcus, Lachnospiraceae*, and *Francisella novicida* Cpf1 endonuclease.

DETAILED DESCRIPTION

Hereditary Haemochromatosis (HHC)

HFE, a gene involved in HHC, is located on Chromosome 6 (6p21.3 region) and contains 7 exons spanning 12 kb.

It was discovered that the HFE gene has multiple allelic variants. One known mutation is a G-to-A missense mutation leading to the substitution of tyrosine for cysteine at amino acid position 282 of the protein product (C282Y). C282Y homozygotes account for 80%-85% of typical patients with HHC. Allele frequencies of HFE C282Y in ethnically diverse western European white populations are 5-14% and in North American non-Hispanic whites are 6-7%. C282Y exists as a polymorphism only in Western European white and derivative populations, although C282Y may have arisen independently in non-whites outside Europe. There are two other regularly identified mutations of the HFE gene, one in which aspartate is substituted for histidine at amino acid position 63 (H63D), and the other in which cysteine is substituted for serine at amino acid position 65 (S65C). These mutations are generally not associated with iron loading unless seen with C282Y as a compound heterozygote, C282Y/H63D or C282Y/S65C.

Mutations of other genes coding for iron regulatory proteins have been implicated in inherited iron overload syndromes (e.g., hepcidin, hemojuvelin, transferrin receptor 2, and ferroportin). These other mutated genes are thought to account for most of the non-HFE forms of HHC.

Therapeutic Approach

As the known forms of HHC are monogenic disorders with recessive inheritance, it is likely that correcting one of the mutant alleles per cell will be sufficient for correction and restoration or partial restoration of HFE function. The correction of one allele can coincide with one copy that remains with the original mutation, or a copy that was cleaved and repaired by non-homologous end joining (NHEJ) and therefore was not properly corrected. Bi-allelic correction can also occur. Various editing strategies that can be employed for specific mutations are discussed below.

Correction of one or possibly both of the mutant alleles provides an important improvement over existing or potential therapies, such as introduction of HFE expression cassettes through lentivirus delivery and integration. Gene editing has the advantage of precise genome modification and lower adverse effects or example, the mutation can be corrected by the insertions or deletions that arise due to the NHEJ repair pathway. If the patient's HFE gene has an inserted or deleted base, a targeted cleavage can result in a NHEJ-mediated insertion or deletion that restores the frame. Missense mutations can also be corrected through NHEJ-mediated correction using one or more guide RNA. The ability or likelihood of the cut(s) to correct the mutation can be designed or evaluated based on the local sequence and micro-homologies. NHEJ can also be used to delete segments of the gene, either directly or by altering splice donor or acceptor sites through cleavage by one gRNA targeting several locations, or several gRNAs. This may be useful if an amino acid, domain or exon contains the mutations and can be removed or inverted, or if the deletion otherwise restored function to the protein. Pairs of guide strands have been used for deletions and corrections of inversions.

Alternatively, the donor for correction by HDR contains the corrected sequence with small or large flanking homology arms to allow for annealing. HDR is essentially an error-free mechanism that uses a supplied homologous DNA sequence as a template during DSB repair. The rate of HDR is a function of the distance between the mutation and the cut site so choosing overlapping or nearby target sites is important. Templates can include extra sequences flanked by the homologous regions or can contain a sequence that differs from the genomic sequence, thus allowing sequence editing.

In addition to correcting mutations by NHEJ or HDR, a range of other options are possible. If there are small or large deletions or multiple mutations, a cDNA can be knocked in that contains the exons affected. A full length cDNA can be knocked into any "safe harbor"—i.e., non-deleterious insertion point that is not the HFE gene itself—, with or without suitable regulatory sequences. If this construct is knocked-in near the HFE regulatory elements, it should have physiological control, similar to the normal gene. Two or more (e.g., a pair) nucleases can be used to delete mutated gene regions, though a donor would usually have to be provided to restore function. In this case two gRNA and one donor sequence would be supplied.

Provided herein are cellular, ex vivo and in vivo methods for using genome engineering tools to create permanent changes to the genome by: 1) correcting, by insertions or deletions that arise due to the NHEJ pathway, one or more mutations within or near the HFE gene or other DNA sequences that encode regulatory elements of the HFE gene, 2) correcting, by HDR, one or more mutations within or near the HFE gene or other DNA sequences that encode regulatory elements of the HFE gene, or 3) deletion of the mutant region and/or knocking-in HFE cDNA or minigene into the gene locus or a safe harbour locus, such as, e.g., targeting exons 1-2 (exon 1, intron 1, and exon 2) of an AAVS1 (PPP1R12C) gene, an ALB gene, an Angptl3 gene, an ApoC3 gene, an ASGR2 gene, a CCR5 gene, a FIX (F9) gene, a G6PC gene, a Gys2 gene, an HGD gene, an Lp(a) gene, a Pcsk9 gene, a Serpina1 gene, a TF gene, and/or a TTR gene, or 4) deletion of the mutant region and knocking-in HFE cDNA or a minigene (comprised of one or more exons and introns or natural or synthetic introns) into the first exon of HGD, leading to disruption of HGD expression. HGD−/− hepatocytes have proliferation advantage when FAH activity is absent or reduced. Inhibition of FAH can be achieved by treatment with shRNA (AAV) targeting FAH, or siRNA (LNP formulated, or conjugate with GalNAc, or with cholesterol) or treatment with CEHPOBA (see e.g., Paulk et al. "In vivo selection of transplanted hepatocytes by pharmacological inhibition of fumarylacetoacetate hydrolase in wild-type mice." Mol Ther 2012, 20(10):1981-1987). Assessment of efficiency of HDR mediated knock-in of cDNA into the first exon can utilize cDNA knock-in into "safe harbor" sites such as: single-stranded or double-stranded DNA having homologous arms to one of the following regions, for example: ApoC3 (chr11:116829908-116833071), Angptl3 (chr1:62,597,487-62,606,305), Serpina1 (chr14:94376747-94390692), Lp(a) (chr6:160531483-160664259), Pcsk9 (chr1:55,039,475-55,064,852), FIX (chrX:139,530,736-139,563,458), ALB (chr4:73,404,254-73,421,411), TTR (chr18:31,591,766-31,599,023), TF (chr3:133,661,997-133,779,005), Gys2 (chr12:21,536,188-21,604,857), AAVS1(PPP1R12C) (chr19:55,090,912-55,117,599), HGD (chr3:120,628,167-120,682,570), CCR5 (chr3:46,370,854-46,376,206), ASGR2 (chr17:7,101,322-7,114,310), G6PC (chr17: 42,900,796-42,914,432), 5'UTR correspondent to ASS1 or alternative 5' UTR, complete CDS of HFE and 3' UTR of HFE or modified 3' UTR and at least 80 nt of the first intron, alternatively same DNA template sequence will be delivered by AAV. Both the HDR and knock-in strategies utilize a donor DNA template in Homology-Directed Repair (HDR). HDR in either strategy may be accomplished by making one or more single-stranded breaks (SSBs) or one or more double-stranded breaks (DSBs) at specific sites in the genome by using one or more endonucleases.

Such methods use endonucleases, such as CRISPR-associated (Cas9, Cpf1 and the like) nucleases, to permanently delete, insert, edit or correct one or more mutations within or near the genomic locus of the HFE gene or other DNA sequences that encode regulatory elements of the HFE gene. In this way, examples set forth in the present disclosure can help to restore the reading frame or the wild-type sequence of, or otherwise correct, the gene with as few as a single treatment (rather than deliver potential therapies for the lifetime of the patient).

Provided herein are methods for treating a patient with HHC. An aspect of such method is an ex vivo cell-based therapy. For example, a patient specific induced pluripotent stem cell (iPSC) can be created. Then, the chromosomal DNA of these iPS cells can be edited using the materials and methods described herein. Next, the genome-edited iPSCs can be differentiated into hepatocytes. Finally, the hepatocytes can be implanted into the patient.

Another aspect of such method is an ex vivo cell-based therapy. For example, a biopsy of the patient's liver is performed. Then, a liver specific progenitor cell or primary hepatocyte is isolated from the biopsied material. Next, the chromosomal DNA of these liver specific progenitor cells or primary hepatocytes can be edited using the materials and methods described herein. Finally, the genome-edited liver specific progenitor cell or primary hepatocyte can be implanted into the patient.

Yet another aspect of such method is an ex vivo cell-based therapy. For example, a mesenchymal stem cell can be isolated from the patient, which can be isolated from the patient's bone marrow by performing a biopsy of the patient's bone marrow or isolated from peripheral blood. Next, the chromosomal DNA of these mesenchymal stem cells can be edited using the materials and methods described herein. Next, the genome-edited mesenchymal stem cells can be differentiated into hepatocytes. Finally, these hepatocytes can be implanted into the patient.

One advantage of an ex vivo cell therapy approach is the ability to conduct a comprehensive analysis of the therapeutic prior to administration. Nuclease-based therapeutics can have some level of off-target effects. Performing gene correction ex vivo allows one to characterize the corrected cell population prior to implantation. The present disclosure includes sequencing the entire genome of the corrected cells to ensure that the off-target effects, if any, can be in genomic locations associated with minimal risk to the patient. Furthermore, populations of specific cells, including clonal populations, can be isolated prior to implantation.

Another advantage of ex vivo cell therapy relates to genetic correction in iPSCs compared to other primary cell sources. iPSCs are prolific, making it easy to obtain the large number of cells that will be required for a cell-based therapy. Furthermore, iPSCs are an ideal cell type for performing clonal isolations. This allows screening for the correct genomic correction, without risking a decrease in viability. In contrast, other potential cell types, such as primary hepatocytes, are viable for only a few passages and difficult to clonally expand. Thus, manipulation of iPSCs for the treatment of HHC can be much easier, and can shorten the amount of time needed to make the desired genetic correction.

Methods can also include an in vivo based therapy. Chromosomal DNA of the cells in the patient is edited using the materials and methods described herein.

An advantage of in vivo gene therapy can be the ease of therapeutic production and administration. The same therapeutic approach and therapy will have the potential to be used to treat more than one patient, for example a number of patients who share the same or similar genotype or allele. In contrast, ex vivo cell therapy typically requires using a patient's own cells, which are isolated, manipulated and returned to the same patient.

Also provided herein is a cellular method for editing the HFE gene in a cell by genome editing. For example, a cell can be isolated from a patient or animal. Then, the chromosomal DNA of the cell can be edited using the materials and methods described herein.

The methods provided herein, regardless of whether a cellular or ex vivo or in vivo method, can involve one or a combination of the following: 1) correcting, by insertions or deletions that arise due to the imprecise NHEJ pathway, one or more mutations within or near the HFE gene or other DNA sequences that encode regulatory elements of the HFE gene, 2) correcting, by HDR, one or more mutations within or near the HFE gene or other DNA sequences that encode regulatory elements of the HFE gene, or 3) deletion of the mutant region and/or knocking-in HFE cDNA into the gene locus or at a heterologous location in the genome (such as a safe harbor locus, such as, e.g., targeting exons 1-2 (exon 1, intron 1, and exon 2) of an AAVS1 (PPP1R12C) gene, an ALB gene, an Angptl3 gene, an ApoC3 gene, an ASGR2 gene, a CCR5 gene, a FIX (F9) gene, a G6PC gene, a Gys2 gene, an HGD gene, an Lp(a) gene, a Pcsk9 gene, a Serpina1 gene, a TF gene, and/or a TTR gene). Both the HDR and knock-in strategies utilize a donor DNA template in HDR. HDR in either strategy may be accomplished by making one or more single-stranded breaks (SSBs) or double-stranded breaks (DSBs) at specific sites in the genome by using one or more endonucleases.

For example, the NHEJ correction strategy can involve correcting a specific mutation in the HFE gene by inducing one single stranded break or double stranded break in the gene of interest with one or more CRISPR endonucleases and a gRNA (e.g., crRNA+tracrRNA, or sgRNA), or two or more single stranded breaks or double stranded breaks in the gene of interest with two or more CRISPR endonucleases and two or more sgRNAs. This approach can require development and optimization of sgRNAs and donor DNA molecules for the major varient of the HFE gene.

For example, the HDR correction strategy can involve correcting a specific mutation in the HFE gene by inducing one single stranded break or double stranded break in the gene of interest with one or more CRISPR endonucleases and a gRNA (e.g., crRNA+tracrRNA, or sgRNA), or two or more single stranded breaks or double stranded breaks in the gene of interest with one or more CRISPR endonucleases and two or more gRNAs, in the presence of a donor DNA template introduced exogenously to direct the cellular DSB response to Homology-Directed Repair (the donor DNA template can be a short single stranded oligonucleotide, a short double stranded oligonucleotide, a long single or double stranded DNA molecule). This approach can require development and optimization of gRNAs and donor DNA molecules for the major varient of the HFE gene.

For example, the knock-in strategy involves knocking-in HFE cDNA into the locus of the gene using a gRNA (e.g., crRNA+tracrRNA, or sgRNA) or a pair of gRNAs targeting upstream of or in the first or other exon and/or intron of the HFE gene, or in a safe harbor site (such as, e.g., exon 1-2 of, AAVS1 (PPP1R12C), ALB, Angptl3, ApoC3, ASGR2, CCR5, FIX (F9), G6PC, Gys2, HGD, Lp(a), Pcsk9, Serpina1, TF, and/or TTR). The donor DNA can be single or double stranded DNA having homologous arms to the human 6p21.3 region.

The advantages for the above strategies (correction and knock-in) are similar, including in principle both short and long term beneficial clinical and laboratory effects. The knock-in approach does provide one advantage over the correction approach—the ability to treat all patients versus only a subset of patients.

In addition to the above genome editing strategies, another strategy involves modulating expression, function, or activity of HFE by editing in the regulatory sequence.

In addition to the editing options listed above, Cas9 or similar proteins can be used to target effector domains to the same target sites that can be identified for editing, or additional target sites within range of the effector domain. A range of chromatin modifying enzymes, methylases or demethlyases can be used to alter expression of the target gene. One possibility is increasing the expression of the HFE protein if the mutation leads to lower activity. These types of epigenetic regulation have some advantages, particularly as they are limited in possible off-target effects.

A number of types of genomic target sites can be present in addition to mutations in the coding and splicing sequences.

The regulation of transcription and translation implicates a number of different classes of sites that interact with cellular proteins or nucleotides. Often the DNA binding sites of transcription factors or other proteins can be targeted for mutation or deletion to study the role of the site, though they can also be targeted to change gene expression. Sites can be added through non-homologous end joining NHEJ or direct genome editing by HDR. Increased use of genome sequencing, RNA expression and genome-wide studies of transcription factor binding have increased our ability to identify how the sites lead to developmental or temporal gene regulation. These control systems can be direct or can involve extensive cooperative regulation that can require the integration of activities from multiple enhancers. Transcription factors typically bind 6-12 bp-long degenerate DNA sequences. The low level of specificity provided by individual sites suggests that complex interactions and rules are involved in binding and the functional outcome. Binding sites with less degeneracy can provide simpler means of regulation. Artificial transcription factors can be designed to specify longer sequences that have less similar sequences in the genome and have lower potential for off-target cleavage. Any of these types of binding sites can be mutated, deleted or even created to enable changes in gene regulation or expression (Canver, M. C. et al., Nature (2015)).

Another class of gene regulatory regions having these features is microRNA (miRNA) binding sites. miRNAs are non-coding RNAs that play key roles in posttranscriptional gene regulation. miRNA can regulate the expression of 30% of all mammalian protein-encoding genes. Specific and potent gene silencing by double stranded RNA (RNAi) was discovered, plus additional small noncoding RNA (Canver, M. C. et al., Nature (2015)). The largest class of noncoding RNAs important for gene silencing are miRNAs. In mammals, miRNAs are first transcribed as a long RNA transcripts, which can be separate transcriptional units, part of protein introns, or other transcripts. The long transcripts are called primary miRNA (pri-miRNA) that include imperfectly base-paired hairpin structures. These pri-miRNA can be cleaved into one or more shorter precursor miRNAs (pre-miRNAs) by Microprocessor, a protein complex in the nucleus, involving Drosha.

Pre-miRNAs are short stem loops ~70 nucleotides in length with a 2-nucleotide 3'-overhang that are exported, into the mature 19-25 nucleotide miRNA:miRNA* duplexes. The miRNA strand with lower base pairing stability (the guide strand) can be loaded onto the RNA-induced silencing complex (RISC). The passenger guide strand (marked with *), can be functional, but is usually degraded. The mature miRNA tethers RISC to partly complementary sequence motifs in target mRNAs predominantly found within the 3' untranslated regions (UTRs) and induces posttranscriptional gene silencing (Bartel, D. P. *Cell* 136, 215-233 (2009); Saj, A. & Lai, E. C. *Curr Opin Genet Dev* 21, 504-510 (2011)).

miRNAs can be important in development, differentiation, cell cycle and growth control, and in virtually all biological pathways in mammals and other multicellular organisms. miRNAs can also be involved in cell cycle control, apoptosis and stem cell differentiation, hematopoiesis, hypoxia, muscle development, neurogenesis, insulin secretion, cholesterol metabolism, aging, viral replication and immune responses.

A single miRNA can target hundreds of different mRNA transcripts, while an individual transcript can be targeted by many different miRNAs. More than 28645 microRNAs have been annotated in the latest release of miRBase (v.21). Some miRNAs can be encoded by multiple loci, some of which can be expressed from tandemly co-transcribed clusters. The features allow for complex regulatory networks with multiple pathways and feedback controls. miRNAs can be integral parts of these feedback and regulatory circuits and can help regulate gene expression by keeping protein production within limits (Herranz, H. & Cohen, S. M. *Genes Dev* 24, 1339-1344 (2010); Posadas, D. M. & Carthew, R. W. *Curr Opin Genet Dev* 27, 1-6 (2014)).

miRNA can also be important in a large number of human diseases that are associated with abnormal miRNA expression. This association underscores the importance of the miRNA regulatory pathway. Recent miRNA deletion studies have linked miRNA with regulation of the immune responses (Stern-Ginossar, N. et al., *Science* 317, 376-381 (2007)).

miRNA also have a strong link to cancer and can play a role in different types of cancer. miRNAs have been found to be downregulated in a number of tumors. miRNA can be important in the regulation of key cancer-related pathways, such as cell cycle control and the DNA damage response, and can therefore be used in diagnosis and can be targeted clinically. MicroRNAs can delicately regulate the balance of angiogenesis, such that experiments depleting all microRNAs suppresses tumor angiogenesis (Chen, S. et al., *Genes Dev* 28, 1054-1067 (2014)).

As has been shown for protein coding genes, miRNA genes can also be subject to epigenetic changes occurring with cancer. Many miRNA loci can be associated with CpG islands increasing their opportunity for regulation by DNA methylation (Weber, B., Stresemann, C., Brueckner, B. & Lyko, F. *Cell Cycle* 6, 1001-1005 (2007)). The majority of studies have used treatment with chromatin remodeling drugs to reveal epigenetically silenced miRNAs.

In addition to their role in RNA silencing, miRNA can also activate translation (Posadas, D. M. & Carthew, R. W. *Curr Opin Genet Dev* 27, 1-6 (2014)). Knocking out these sites may lead to decreased expression of the targeted gene, while introducing these sites may increase expression.

Individual miRNA can be knocked out most effectively by mutating the seed sequence (bases 2-8 of the microRNA), which can be important for binding specificity. Cleavage in this region, followed by mis-repair by NHEJ can effectively abolish miRNA function by blocking binding to target sites. miRNA could also be inhibited by specific targeting of the special loop region adjacent to the palindromic sequence. Catalytically inactive Cas9 can also be used to inhibit shRNA expression (Zhao, Y. et al., *Sci Rep* 4, 3943 (2014)). In addition to targeting the miRNA, the binding sites can also be targeted and mutated to prevent the silencing by miRNA.

Human Cells

For ameliorating HHC, as described and illustrated herein, the principal targets for gene editing are human cells. For example, in the ex vivo methods, the human cells can be somatic cells, which after being modified using the techniques as described, can give rise to hepatocytes or progenitor cells. For example, in the in vivo methods, the human cells can be hepatocytes, or cells from other affected organs.

By performing gene editing in autologous cells that are derived from and therefore already completely matched with the patient in need, it is possible to generate cells that can be safely re-introduced into the patient, and effectively give rise to a population of cells that can be effective in ameliorating one or more clinical conditions associated with the patient's disease.

Progenitor cells (also referred to as stem cells herein) are capable of both proliferation and giving rise to more progenitor cells, these in turn having the ability to generate a large number of mother cells that can in turn give rise to differentiated or differentiable daughter cells. The daughter cells themselves can be induced to proliferate and produce progeny that subsequently differentiate into one or more mature cell types, while also retaining one or more cells with parental developmental potential. The term "stem cell" refers then, to a cell with the capacity or potential, under particular circumstances, to differentiate to a more specialized or differentiated phenotype, and which retains the capacity, under certain circumstances, to proliferate without substantially differentiating. In one aspect, the term progenitor or stem cell refers to a generalized mother cell whose descendants (progeny) specialize, often in different directions, by differentiation, e.g., by acquiring completely individual characters, as occurs in progressive diversification of embryonic cells and tissues. Cellular differentiation is a complex process typically occurring through many cell divisions. A differentiated cell may derive from a multipotent cell that, itself, is derived from a multipotent cell, and so on. While each of these multipotent cells may be considered stem cells, the range of cell types that each can give rise to may vary considerably. Some differentiated cells also have the capacity to give rise to cells of greater developmental potential. Such capacity may be natural or may be induced artificially upon treatment with various factors. In many biological instances, stem cells can also be "multipotent" because they can produce progeny of more than one distinct cell type, but this is not required for "stem-ness."

Self-renewal can be another important aspect of the stem cell. In theory, self-renewal can occur by either of two major mechanisms. Stem cells can divide asymmetrically, with one daughter retaining the stem state and the other daughter expressing some distinct other specific function and phenotype. Alternatively, some of the stem cells in a population can divide symmetrically into two stems, thus maintaining some stem cells in the population as a whole, while other cells in the population give rise to differentiated progeny only. Generally, "progenitor cells" have a cellular phenotype that is more primitive (i.e., is at an earlier step along a developmental pathway or progression than is a fully differentiated cell). Often, progenitor cells also have significant or very high proliferative potential. Progenitor cells can give rise to multiple distinct differentiated cell types or to a single differentiated cell type, depending on the developmental pathway and on the environment in which the cells develop and differentiate.

In the context of cell ontogeny, the adjective "differentiated," or "differentiating" is a relative term. A "differentiated cell" is a cell that has progressed further down the developmental pathway than the cell to which it is being compared. Thus, stem cells can differentiate into lineage-restricted precursor cells (such as a myocyte progenitor cell), which in turn can differentiate into other types of precursor cells further down the pathway (such as a myocyte precursor), and then to an end-stage differentiated cell, such as a myocyte, which plays a characteristic role in a certain tissue type, and may or may not retain the capacity to proliferate further.

Induced Pluripotent Stem Cells

The genetically engineered human cells described herein can be induced pluripotent stem cells (iPSCs). An advantage of using iPSCs is that the cells can be derived from the same subject to which the progenitor cells are to be administered. That is, a somatic cell can be obtained from a subject, reprogrammed to an induced pluripotent stem cell, and then re-differentiated into a progenitor cell to be administered to the subject (e.g., autologous cells). Because the progenitors are essentially derived from an autologous source, the risk of engraftment rejection or allergic response can be reduced compared to the use of cells from another subject or group of subjects. In addition, the use of iPSCs negates the need for cells obtained from an embryonic source. Thus, in one aspect, the stem cells used in the disclosed methods are not embryonic stem cells.

Although differentiation is generally irreversible under physiological contexts, several methods have been recently developed to reprogram somatic cells to iPSCs. Exemplary methods are known to those of skill in the art and are described briefly herein below.

The term "reprogramming" refers to a process that alters or reverses the differentiation state of a differentiated cell (e.g., a somatic cell). Stated another way, reprogramming refers to a process of driving the differentiation of a cell backwards to a more undifferentiated or more primitive type of cell. It should be noted that placing many primary cells in culture can lead to some loss of fully differentiated characteristics. Thus, simply culturing such cells included in the term differentiated cells does not render these cells non-differentiated cells (e.g., undifferentiated cells) or pluripotent cells. The transition of a differentiated cell to pluripotency requires a reprogramming stimulus beyond the stimuli that lead to partial loss of differentiated character in culture. Reprogrammed cells also have the characteristic of the capacity of extended passaging without loss of growth potential, relative to primary cell parents, which generally have capacity for only a limited number of divisions in culture.

The cell to be reprogrammed can be either partially or terminally differentiated prior to reprogramming. Reprogramming can encompasse complete reversion of the differentiation state of a differentiated cell (e.g., a somatic cell) to a pluripotent state or a multipotent state. Reprogramming can encompasse complete or partial reversion of the differentiation state of a differentiated cell (e.g., a somatic cell) to an undifferentiated cell (e.g., an embryonic-like cell). Reprogramming can result in expression of particular genes by the cells, the expression of which further contributes to reprogramming. In certain examples described herein, reprogramming of a differentiated cell (e.g., a somatic cell) can cause the differentiated cell to assume an undifferentiated state (e.g., is an undifferentiated cell). The resulting cells are referred to as "reprogrammed cells," or "induced pluripotent stem cells (iPSCs or iPS cells)."

Reprogramming can involve alteration, e.g., reversal, of at least some of the heritable patterns of nucleic acid modification (e.g., methylation), chromatin condensation, epigenetic changes, genomic imprinting, etc., that occur during cellular differentiation. Reprogramming is distinct from simply maintaining the existing undifferentiated state of a cell that is already pluripotent or maintaining the existing less than fully differentiated state of a cell that is already a multipotent cell (e.g., a hematopoietic stem cell). Reprogramming is also distinct from promoting the self-renewal or proliferation of cells that are already pluripotent or multipotent, although the compositions and methods described herein can also be of use for such purposes, in some examples.

Many methods are known in the art that can be used to generate pluripotent stem cells from somatic cells. Any such method that reprograms a somatic cell to the pluripotent phenotype would be appropriate for use in the methods described herein.

Reprogramming methodologies for generating pluripotent cells using defined combinations of transcription factors have been described. Mouse somatic cells can be converted to ES cell-like cells with expanded developmental potential by the direct transduction of Oct4, Sox2, Klf4, and c-Myc; see, e.g., Takahashi and Yamanaka, Cell 126(4): 663-76 (2006). iPSCs resemble ES cells, as they restore the pluripotency-associated transcriptional circuitry and much of the epigenetic landscape. In addition, mouse iPSCs satisfy all the standard assays for pluripotency: specifically, in vitro differentiation into cell types of the three germ layers, teratoma formation, contribution to chimeras, germline transmission [see, e.g., Maherali and Hochedlinger, Cell Stem Cell. 3(6):595-605 (2008)] and tetraploid complementation.

Human iPSCs can be obtained using similar transduction methods, and the transcription factor trio, OCT4, SOX2, and NANOG, has been established as the core set of transcription factors that govern pluripotency; see, e.g., Budniatzky and Gepstein, Stem Cells Transl Med. 3(4):448-57 (2014); Barrett et al., Stem Cells Trans Med 3:1-6 sctm.2014-0121 (2014); Focosi et al., Blood Cancer Journal 4: e211 (2014); and references cited therein. The production of iPSCs can be achieved by the introduction of nucleic acid sequences encoding stem cell-associated genes into an adult, somatic cell, historically using viral vectors.

iPSCs can be generated or derived from terminally differentiated somatic cells, as well as from adult stem cells, or somatic stem cells. That is, a non-pluripotent progenitor cell can be rendered pluripotent or multipotent by reprogramming. In such instances, it may not be necessary to include as many reprogramming factors as required to reprogram a terminally differentiated cell. Further, reprogramming can be induced by the non-viral introduction of reprogramming factors, e.g., by introducing the proteins themselves, or by introducing nucleic acids that encode the reprogramming factors, or by introducing messenger RNAs that upon translation produce the reprogramming factors (see e.g., Warren et al., Cell Stem Cell, 7(5):618-30 (2010). Reprogramming can be achieved by introducing a combination of nucleic acids encoding stem cell-associated genes, including, for example, Oct-4 (also known as Oct-3/4 or Pouf51), Sox1, Sox2, Sox3, Sox 15, Sox 18, NANOG, Klf1, Klf2, Klf4, Klf5, NR5A2, c-Myc, 1-Myc, n-Myc, Rem2, Tert, and LIN28. Reprogramming using the methods and compositions described herein can further comprise introducing one or more of Oct-3/4, a member of the Sox family, a member of the Klf family, and a member of the Myc family to a somatic cell. The methods and compositions described herein can further comprise introducing one or more of each of Oct-4, Sox2, Nanog, c-MYC and Klf4 for reprogramming. As noted above, the exact method used for reprogramming is not necessarily critical to the methods and compositions described herein. However, where cells differentiated from the reprogrammed cells are to be used in, e.g., human therapy, in one aspect the reprogramming is not effected by a method that alters the genome. Thus, in such examples, reprogramming can be achieved, e.g., without the use of viral or plasmid vectors.

The efficiency of reprogramming (i.e., the number of reprogrammed cells) derived from a population of starting cells can be enhanced by the addition of various agents, e.g., small molecules, as shown by Shi et al., Cell-Stem Cell 2:525-528 (2008); Huangfu et al., Nature Biotechnology 26(7):795-797 (2008) and Marson et al., Cell-Stem Cell 3: 132-135 (2008). Thus, an agent or combination of agents that enhance the efficiency or rate of induced pluripotent stem cell production can be used in the production of patient-specific or disease-specific iPSCs. Some non-limiting examples of agents that enhance reprogramming efficiency include soluble Wnt, Wnt conditioned media, BIX-01294 (a G9a histone methyltransferase), PD0325901 (a MEK inhibitor), DNA methyltransferase inhibitors, histone deacetylase (HDAC) inhibitors, valproic acid, 5'-azacytidine, dexamethasone, suberoylanilide, hydroxamic acid (SAHA), vitamin C, and trichostatin (TSA), among others.

Other non-limiting examples of reprogramming enhancing agents include: Suberoylanilide Hydroxamic Acid (SAHA (e.g., MK0683, vorinostat) and other hydroxamic acids), BML-210, Depudecin (e.g., (−)-Depudecin), HC Toxin, Nullscript (4-(I,3-Dioxo-IH,3H-benzo[de]isoquinolin-2-yl)-N-hydroxybutanamide), Phenylbutyrate (e.g., sodium phenylbutyrate) and Valproic Acid ((VPA) and other short chain fatty acids), Scriptaid, Suramin Sodium, Trichostatin A (TSA), APHA Compound 8, Apicidin, Sodium Butyrate, pivaloyloxymethyl butyrate (Pivanex, AN-9), Trapoxin B, Chlamydocin, Depsipeptide (also known as FR901228 or FK228), benzamides (e.g., Cl-994 (e.g., N-acetyl dinaline) and MS-27-275), MGCD0103, NVP-LAQ-824, CBHA (m-carboxycinnaminic acid bishydroxamic acid), JNJ16241199, Tubacin, A-161906, proxamide, oxamflatin, 3-Cl-UCHA (e.g., 6-(3-chlorophenylureido) caproic hydroxamic acid), AOE (2-amino-8-oxo-9, 10-epoxydecanoic acid), CHAP31 and CHAP 50. Other reprogramming enhancing agents include, for example, dominant negative forms of the HDACs (e.g., catalytically inactive forms), siRNA inhibitors of the HDACs, and antibodies that specifically bind to the HDACs. Such inhibitors are available, e.g., from BIOMOL International, Fukasawa, Merck Biosciences, Novartis, Gloucester Pharmaceuticals, Titan Pharmaceuticals, MethylGene, and Sigma Aldrich.

To confirm the induction of pluripotent stem cells for use with the methods described herein, isolated clones can be tested for the expression of a stem cell marker. Such expression in a cell derived from a somatic cell identifies the cells as induced pluripotent stem cells. Stem cell markers can be selected from the non-limiting group including SSEA3, SSEA4, CD9, Nanog, Fbxl5, Ecatl, Esgl, Eras, Gdf3, Fgf4, Cripto, Daxl, Zpf296, Slc2a3, Rexl, Utfl, and Natl. In one case, for example, a cell that expresses Oct4 or Nanog is identified as pluripotent. Methods for detecting the expression of such markers can include, for example, RT-PCR and immunological methods that detect the presence of the encoded polypeptides, such as Western blots or flow cytometric analyses. Detection can involve not only RT-PCR, but can also include detection of protein markers. Intracellular markers may be best identified via RT-PCR, or protein detection methods such as immunocytochemistry, while cell surface markers are readily identified, e.g., by immunocytochemistry.

The pluripotent stem cell character of isolated cells can be confirmed by tests evaluating the ability of the iPSCs to differentiate into cells of each of the three germ layers. As one example, teratoma formation in nude mice can be used to evaluate the pluripotent character of the isolated clones. The cells can be introduced into nude mice and histology and/or immunohistochemistry can be performed on a tumor arising from the cells. The growth of a tumor comprising cells from all three germ layers, for example, further indicates that the cells are pluripotent stem cells.

Hepatocytes

The genetically engineered human cells described herein can be hepatocytes. A hepatocyte is a cell of the main parenchymal tissue of the liver. Hepatocytes make up 70-85% of the liver's mass. These cells are involved in: protein synthesis; protein storage; transformation of carbohydrates; synthesis of cholesterol, bile salts and phospholipids; detoxification, modification, and excretion of exogenous and endogenous substances; and initiation of formation and secretion of bile.

Although the HFE gene is expressed in various tissues, iron is primarily deposed in hepatocytes and thus correction of the HFE gene should be primarily targeted to hepatocytes and the liver.

Creating Patient Specific iPSCs

One step of the ex vivo methods of the present disclosure can involve creating a patient specific iPS cell, patient specific iPS cells, or a patient specific iPS cell line. There are many established methods in the art for creating patient specific iPS cells, as described in Takahashi and Yamanaka 2006; Takahashi, Tanabe et al. 2007. For example, the creating step can comprise: isolating a somatic cell, such as a skin cell or fibroblast, from the patient; and introducing a set of pluripotency-associated genes into the somatic cell in order to induce the cell to become a pluripotent stem cell. The set of pluripotency-associated genes can be one or more of the genes selected from the group consisting of OCT4, SOX2, KLF4, Lin28, NANOG, and cMYC.

Performing a Biopsy or Aspirate of the Patient's Bone Marrow

A biopsy or aspirate is a sample of tissue or fluid taken from the body. There are many different kinds of biopsies or aspirates. Nearly all of them involve using a sharp tool to remove a small amount of tissue. If the biopsy will be on the skin or other sensitive area, numbing medicine can be applied first. A biopsy or aspirate can be performed according to any of the known methods in the art. For example, in a liver biopsy, a needle is injected into the liver through the skin or the belly, capturing the liver tissue. For example, in a bone marrow aspirate, a large needle is used to enter the pelvis bone to collect bone marrow.

Isolating a Liver Specific Progenitor Cell or Primary Hepatocyte

Liver specific progenitor cells and primary hepatocytes may be isolated according to any method known in the art. For example, human hepatocytes are isolated from fresh surgical specimens (e.g., an autologous sample). Healthy liver tissue is used to isolate hepatocytes by collagenase digestion. The obtained cell suspension is filtered through a 100-mm nylon mesh and sedimented by centrifugation at 50 g for 5 minutes, resuspended, and washed two to three times in cold wash medium. Human liver stem cells are obtained by culturing under stringent conditions of hepatocytes obtained from fresh liver preparations. Hepatocytes seeded on collagen-coated plates are cultured for 2 weeks. After 2 weeks, surviving cells are removed, and characterized for expression of stem cells markers (Herrera et al, STEM CELLS 2006; 24: 2840-2850).

Isolating a Mesenchymal Stem Cell

Mesenchymal stem cells can be isolated according to any method known in the art, such as from a patient's bone marrow or peripheral blood. For example, marrow aspirate can be collected into a syringe with heparin. Cells can be washed and centrifuged on a Percoll™ density gradient. Cells, such as blood cells, liver cells, interstitial cells, macrophages, mast cells, and thymocytes, can be separated using density gradient centrifugation media, Percoll™. The cells can then be cultured in Dulbecco's modified Eagle's medium (DMEM) (low glucose) containing 10% fetal bovine serum (FBS) (Pittinger M F, Mackay A M, Beck S C et al., Science 1999; 284:143-147).

Genome Editing

Genome editing generally refers to the process of modifying the nucleotide sequence of a genome, preferably in a precise or pre-determined manner. Examples of methods of genome editing described herein include methods of using site-directed nucleases to cut deoxyribonucleic acid (DNA) at precise target locations in the genome, thereby creating single-strand or double-strand DNA breaks at particular locations within the genome. Such breaks can be and regularly are repaired by natural, endogenous cellular processes, such as HDR and NHEJ. These two main DNA repair processes consist of a family of alternative pathways. NHEJ directly joins the DNA ends resulting from a double-strand break, sometimes with the loss or addition of nucleotide sequence, which may disrupt or enhance gene expression. HDR utilizes a homologous sequence, or donor sequence, as a template for inserting a defined DNA sequence at the break point. The homologous sequence can be in the endogenous genome, such as a sister chromatid. Alternatively, the donor can be an exogenous nucleic acid, such as a plasmid, a single-strand oligonucleotide, a double-stranded oligonucleotide, a duplex oligonucleotide or a virus, that has regions of high homology with the nuclease-cleaved locus, but which can also contain additional sequence or sequence changes including deletions that can be incorporated into the cleaved target locus. A third repair mechanism can be microhomology-mediated end joining (MMEJ), also referred to as "Alternative NHEJ", in which the genetic outcome is similar to NHEJ in that small deletions and insertions can occur at the cleavage site. MMEJ can make use of homologous sequences of a few basepairs flanking the DNA break site to drive a more favored DNA end joining repair outcome, and recent reports have further elucidated the molecular mechanism of this process. In some instances it may be possible to predict likely repair outcomes based on analysis of potential microhomologies at the site of the DNA break.

Each of these genome editing mechanisms can be used to create desired genomic alterations. A step in the genome editing process can be to create one or two DNA breaks, the latter as double-strand breaks or as two single-stranded breaks, in the target locus as near the site of intended mutation. This can be achieved via the use of site-directed polypeptides, as described and illustrated herein.

Site-directed polypeptides, such as a DNA endonuclease, can introduce double-strand breaks or single-strand breaks in nucleic acids, e.g., genomic DNA. The double-strand break can stimulate a cell's endogenous DNA-repair pathways (e.g., homology-dependent repair or non-homologous end joining or alternative non-homologous end joining (A-NHEJ) or microhomology-mediated end joining). NHEJ can repair cleaved target nucleic acid without the need for a homologous template. This can sometimes result in small deletions or insertions (indels) in the target nucleic acid at the site of cleavage, and can lead to disruption or alteration of gene expression. HDR can occur when a homologous repair template, or donor, is available. The homologous donor template can comprise sequences that can be homologous to sequences flanking the target nucleic acid cleavage site. The sister chromatid can be used by the cell as the repair template. However, for the purposes of genome editing, the repair template can be supplied as an exogenous nucleic acid, such as a plasmid, duplex oligonucleotide, single-strand oligonucleotide, double-stranded oligonucleotide, or viral nucleic acid. With exogenous donor templates, an additional nucleic acid sequence (such as a transgene) or modification (such as a single or multiple base change or a deletion) can be introduced between the flanking regions of homology so that the additional or altered nucleic acid sequence also becomes incorporated into the target locus. MMEJ can result in a genetic outcome that is similar to NHEJ in that small deletions and insertions can occur at the cleavage site. MMEJ can make use of homologous sequences of a few basepairs flanking the cleavage site to drive a favored end-joining DNA repair outcome. In some instances it may be possible to predict likely repair outcomes based on analysis of potential microhomologies in the nuclease target regions.

Thus, in some cases, homologous recombination can be used to insert an exogenous polynucleotide sequence into the target nucleic acid cleavage site. An exogenous polynucleotide sequence is termed a donor polynucleotide (or donor or donor sequence or polynucleotide donor template) herein. The donor polynucleotide, a portion of the donor polynucleotide, a copy of the donor polynucleotide, or a portion of a copy of the donor polynucleotide can be inserted into the target nucleic acid cleavage site. The donor polynucleotide can be an exogenous polynucleotide sequence, i.e., a sequence that does not naturally occur at the target nucleic acid cleavage site.

The modifications of the target DNA due to NHEJ and/or HDR can lead to, for example, mutations, deletions, alterations, integrations, gene correction, gene replacement, gene tagging, transgene insertion, nucleotide deletion, gene disruption, translocations and/or gene mutation. The processes of deleting genomic DNA and integrating non-native nucleic acid into genomic DNA are examples of genome editing.

CRISPR Endonuclease System

A CRISPR (Clustered Regularly Interspaced Short Palindromic Repeats) genomic locus can be found in the genomes of many prokaryotes (e.g., bacteria and archaea). In prokaryotes, the CRISPR locus encodes products that function as a type of immune system to help defend the prokaryotes against foreign invaders, such as virus and phage. There are three stages of CRISPR locus function: integration of new sequences into the CRISPR locus, expression of CRISPR RNA (crRNA), and silencing of foreign invader nucleic acid. Five types of CRISPR systems (e.g., Type I, Type II, Type III, Type U, and Type V) have been identified.

A CRISPR locus includes a number of short repeating sequences referred to as "repeats." When expressed, the repeats can form secondary structures (e.g., hairpins) and/or comprise unstructured single-stranded sequences. The repeats usually occur in clusters and frequently diverge between species. The repeats are regularly interspaced with unique intervening sequences referred to as "spacers," resulting in a repeat-spacer-repeat locus architecture. The spacers are identical to or have high homology with known foreign invader sequences. A spacer-repeat unit encodes a crisprRNA (crRNA), which is processed into a mature form of the spacer-repeat unit. A crRNA comprises a "seed" or spacer sequence that is involved in targeting a target nucleic acid (in the naturally occurring form in prokaryotes, the spacer sequence targets the foreign invader nucleic acid). A spacer sequence is located at the 5' or 3' end of the crRNA.

A CRISPR locus also comprises polynucleotide sequences encoding CRISPR Associated (Cas) genes. Cas genes encode endonucleases involved in the biogenesis and the interference stages of crRNA function in prokaryotes. Some Cas genes comprise homologous secondary and/or tertiary structures.

Type II CRISPR Systems crRNA biogenesis in a Type II CRISPR system in nature requires a trans-activating CRISPR RNA (tracrRNA). The tracrRNA can be modified by endogenous RNaseIII, and then hybridizes to a crRNA repeat in the pre-crRNA array. Endogenous RNaseIII can be recruited to cleave the pre-crRNA. Cleaved crRNAs can be subjected to exoribonuclease trimming to produce the mature crRNA form (e.g., 5' trimming). The tracrRNA can remain hybridized to the crRNA, and the tracrRNA and the crRNA associate with a site-directed polypeptide (e.g., Cas9). The crRNA of the crRNA-tracrRNA-Cas9 complex can guide the complex to a target nucleic acid to which the crRNA can hybridize. Hybridization of the crRNA to the target nucleic acid can activate Cas9 for targeted nucleic acid cleavage. The target nucleic acid in a Type II CRISPR system is referred to as a protospacer adjacent motif (PAM). In nature, the PAM is essential to facilitate binding of a site-directed polypeptide (e.g., Cas9) to the target nucleic acid. Type II systems (also referred to as Nmeni or CASS4) are further subdivided into Type II-A (CASS4) and II-B (CASS4a). Jinek et al., *Science*, 337(6096):816-821 (2012) showed that the CRISPR/Cas9 system is useful for RNA-programmable genome editing, and international patent application publication number WO2013/176772 provides numerous examples and applications of the CRISPR/Cas endonuclease system for site-specific gene editing.

Type V CRISPR Systems

Type V CRISPR systems have several important differences from Type II systems. For example, Cpf1 is a single RNA-guided endonuclease that, in contrast to Type II systems, lacks tracrRNA. In fact, Cpf1-associated CRISPR arrays can be processed into mature crRNAs without the requirement of an additional trans-activating tracrRNA. The Type V CRISPR array can be processed into short mature crRNAs of 42-44 nucleotides in length, with each mature crRNA beginning with 19 nucleotides of direct repeat followed by 23-25 nucleotides of spacer sequence. In contrast, mature crRNAs in Type II systems can start with 20-24 nucleotides of spacer sequence followed by about 22 nucleotides of direct repeat. Also, Cpf1 can utilize a T-rich protospacer-adjacent motif such that Cpf1-crRNA complexes efficiently cleave target DNA preceeded by a short T-rich PAM, which is in contrast to the G-rich PAM following the target DNA for Type II systems. Thus, Type V systems cleave at a point that is distant from the PAM, while Type II systems cleave at a point that is adjacent to the PAM. In addition, in contrast to Type II systems, Cpf1 cleaves DNA via a staggered DNA double-stranded break with a 4 or 5 nucleotide 5' overhang. Type II systems cleave via a blunt double-stranded break. Similar to Type II systems, Cpf1 contains a predicted RuvC-like endonuclease domain, but lacks a second HNH endonuclease domain, which is in contrast to Type II systems.

Cas Genes/Polypeptides and Protospacer Adjacent Motifs

Figure 1B:
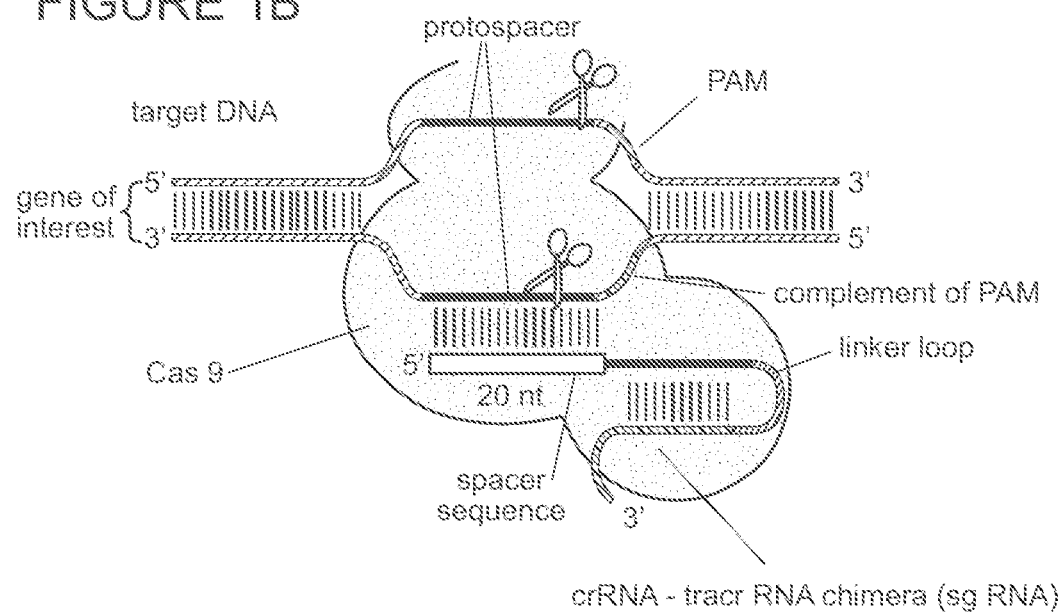
FIG. 1B is a depiction of the type II CRISPR/Cas system.

Exemplary CRISPR/Cas polypeptides include the Cas9 polypeptides in FIG. 1 of Fonfara et al., *Nucleic Acids Research*, 42: 2577-2590 (2014). The CRISPR/Cas gene naming system has undergone extensive rewriting since the Cas genes were discovered. FIG. 5 of Fonfara, supra, provides PAM sequences for the Cas9 polypeptides from various species.

Site-Directed Polypeptides

A site-directed polypeptide is a nuclease used in genome editing to cleave DNA. The site-directed can be administered to a cell or a patient as either: one or more polypeptides, or one or more mRNAs encoding the polypeptide.

In the context of a CRISPR/Cas or CRISIDR/Cpf1 system, the site-directed polypeptide can bind to a guide RNA that, in turn, specifies the site in the target DNA to which the polypeptide is directed. In the CRISPR/Cas or CRISPR/Cpf1 systems disclosed herein, the site-directed polypeptide can be an endonuclease, such as a DNA endonuclease.

A site-directed polypeptide can comprises a plurality of nucleic acid-cleaving (i.e., nuclease) domains. Two or more nucleic acid-cleaving domains can be linked together via a linker. For example, the linker can comprise a flexible linker. Linkers can comprise 1, 2, 3, 4, 5, 6, 7, 8, 9, 10, 11, 12, 13, 14, 15, 16, 17, 18, 19, 20, 21, 22, 23, 24, 25, 30, 35, 40 or more amino acids in length.

Naturally-occurring wild-type Cas9 enzymes comprise two nuclease domains, a HNH nuclease domain and a RuvC domain. Herein, the "Cas9" refers to both naturally-occurring and recombinant Cas9s. Cas9 enzymes contemplated herein can comprise a HNH or HNH-like nuclease domain, and/or a RuvC or RuvC-like nuclease domain.

HNH or HNH-like domains comprise a McrA-like fold. HNH or HNH-like domains comprises two antiparallel β-strands and an α-helix. HNH or HNH-like domains comprises a metal binding site (e.g., a divalent cation binding site). HNH or HNH-like domains can cleave one strand of a target nucleic acid (e.g., the complementary strand of the crRNA targeted strand).

RuvC or RuvC-like domains comprise an RNaseH or RNaseH-like fold. RuvC/RNaseH domains are involved in a diverse set of nucleic acid-based functions including acting on both RNA and DNA. The RNaseH domain comprises 5 β-strands surrounded by a plurality of α-helices. RuvC/RNaseH or RuvC/RNaseH-like domains comprise a metal binding site (e.g., a divalent cation binding site). RuvC/RNaseH or RuvC/RNaseH-like domains can cleave one strand of a target nucleic acid (e.g., the non-complementary strand of a double-stranded target DNA).

Site-directed polypeptides can introduce double-strand breaks or single-strand breaks in nucleic acids, e.g., genomic DNA. The double-strand break can stimulate a cell's endogenous DNA-repair pathways (e.g., HDR or NHEJ or alternative non-homologous end joining (A-NHEJ) or microhomology-mediated end joining (MMEJ)). NHEJ can repair cleaved target nucleic acid without the need for a homologous template. This can sometimes result in small deletions or insertions (indels) in the target nucleic acid at the site of cleavage, and can lead to disruption or alteration of gene expression. HDR can occur when a homologous repair template, or donor, is available. The homologous donor template can comprise sequences that are homologous to sequences flanking the target nucleic acid cleavage site. The sister chromatid can be used by the cell as the repair template. However, for the purposes of genome editing, the repair template can be supplied as an exogenous nucleic acid, such as a plasmid, duplex oligonucleotide, single-strand oligonucleotide or viral nucleic acid. With exogenous donor templates, an additional nucleic acid sequence (such as a transgene) or modification (such as a single or multiple base change or a deletion) can be introduced between the flanking regions of homology so that the additional or altered nucleic acid sequence also becomes incorporated into the target locus. MMEJ can result in a genetic outcome that is similar to NHEJ in that small deletions and insertions can occur at the cleavage site. MMEJ can make use of homologous sequences of a few basepairs flanking the cleavage site to drive a favored end-joining DNA repair outcome. In some instances it may be possible to predict likely repair outcomes based on analysis of potential microhomologies in the nuclease target regions.

Thus, in some cases, homologous recombination can be used to insert an exogenous polynucleotide sequence into the target nucleic acid cleavage site. An exogenous polynucleotide sequence is termed a donor polynucleotide (or donor or donor sequence) herein. The donor polynucleotide, a portion of the donor polynucleotide, a copy of the donor polynucleotide, or a portion of a copy of the donor polynucleotide can be inserted into the target nucleic acid cleavage site. The donor polynucleotide can be an exogenous polynucleotide sequence, i.e., a sequence that does not naturally occur at the target nucleic acid cleavage site.

The modifications of the target DNA due to NHEJ and/or HDR can lead to, for example, mutations, deletions, alterations, integrations, gene correction, gene replacement, gene tagging, transgene insertion, nucleotide deletion, gene disruption, translocations and/or gene mutation. The processes of deleting genomic DNA and integrating non-native nucleic acid into genomic DNA are examples of genome editing.

The site-directed polypeptide can comprise an amino acid sequence having at least 10%, at least 15%, at least 20%, at least 30%, at least 40%, at least 50%, at least 60%, at least 70%, at least 75%, at least 80%, at least 85%, at least 90%, at least 95%, at least 99%, or 100% amino acid sequence identity to a wild-type exemplary site-directed polypeptide [e.g., Cas9 from *S. pyogenes*, US2014/0068797 Sequence ID No. 8 or Sapranauskas et al., *Nucleic Acids Res*, 39(21): 9275-9282 (2011)], and various other site-directed polypeptides. The site-directed polypeptide can comprise at least 70, 75, 80, 85, 90, 95, 97, 99, or 100% identity to a wild-type site-directed polypeptide (e.g., Cas9 from *S. pyogenes*, supra) over 10 contiguous amino acids. The site-directed polypeptide can comprises at most: 70, 75, 80, 85, 90, 95, 97, 99, or 100% identity to a wild-type site-directed polypeptide (e.g., Cas9 from *S. pyogenes*, supra) over 10 contiguous amino acids. The site-directed polypeptide can comprise at least: 70, 75, 80, 85, 90, 95, 97, 99, or 100% identity to a wild-type site-directed polypeptide (e.g., Cas9 from *S. pyogenes*, supra) over 10 contiguous amino acids in a HNH nuclease domain of the site-directed polypeptide. The site-directed polypeptide can comprise at most: 70, 75, 80, 85, 90, 95, 97, 99, or 100% identity to a wild-type site-directed polypeptide (e.g., Cas9 from *S. pyogenes*, supra) over 10 contiguous amino acids in a HNH nuclease domain of the site-directed polypeptide. The site-directed polypeptide can comprise at least: 70, 75, 80, 85, 90, 95, 97, 99, or 100% identity to a wild-type site-directed polypeptide (e.g., Cas9 from *S. pyogenes*, supra) over 10 contiguous amino acids in a RuvC nuclease domain of the site-directed polypeptide. The site-directed polypeptide can comprise at most: 70, 75, 80, 85, 90, 95, 97, 99, or 100% identity to a wild-type site-directed polypeptide (e.g., Cas9 from *S. pyogenes*, supra) over 10 contiguous amino acids in a RuvC nuclease domain of the site-directed polypeptide.

The site-directed polypeptide can comprise a modified form of a wild-type exemplary site-directed polypeptide. The modified form of the wild-type exemplary site-directed polypeptide can comprise a mutation that reduces the nucleic acid-cleaving activity of the site-directed polypeptide. The modified form of the wild-type exemplary site-directed polypeptide can have less than 90%, less than 80%, less than 70%, less than 60%, less than 50%, less than 40%, less than 30%, less than 20%, less than 10%, less than 5%, or less than 1% of the nucleic acid-cleaving activity of the wild-type exemplary site-directed polypeptide (e.g., Cas9 from *S. pyogenes*, supra). The modified form of the site-directed polypeptide can have no substantial nucleic acid-cleaving activity. When a site-directed polypeptide is a modified form that has no substantial nucleic acid-cleaving activity, it is referred to herein as "enzymatically inactive."

The modified form of the site-directed polypeptide can comprise a mutation such that it can induce a single-strand break (SSB) on a target nucleic acid (e.g., by cutting only one of the sugar-phosphate backbones of a double-strand target nucleic acid). The mutation can result in less than 90%, less than 80%, less than 70%, less than 60%, less than 50%, less than 40%, less than 30%, less than 20%, less than 10%, less than 5%, or less than 1% of the nucleic acid-cleaving activity in one or more of the plurality of nucleic acid-cleaving domains of the wild-type site directed polypeptide (e.g., Cas9 from *S. pyogenes*, supra). The mutation can result in one or more of the plurality of nucleic acid-cleaving domains retaining the ability to cleave the complementary strand of the target nucleic acid, but reducing its ability to cleave the non-complementary strand of the target nucleic acid. The mutation can result in one or more of the plurality of nucleic acid-cleaving domains retaining the ability to cleave the non-complementary strand of the target nucleic acid, but reducing its ability to cleave the complementary strand of the target nucleic acid. For example, residues in the wild-type exemplary *S. pyogenes* Cas9 polypeptide, such as Asp10, His840, Asn854 and Asn856, are mutated to inactivate one or more of the plurality of nucleic acid-cleaving domains (e.g., nuclease domains). The residues to be mutated can correspond to residues Asp10, His840, Asn854 and Asn856 in the wild-type exemplary *S. pyogenes* Cas9 polypeptide (e.g., as determined by sequence and/or structural alignment). Non-limiting examples of mutations include D10A, H840A, N854A or N856A. One skilled in the art will recognize that mutations other than alanine substitutions can be suitable.

A D10A mutation can be combined with one or more of H840A, N854A, or N856A mutations to produce a site-directed polypeptide substantially lacking DNA cleavage activity. A H840A mutation can be combined with one or more of D10A, N854A, or N856A mutations to produce a site-directed polypeptide substantially lacking DNA cleavage activity. A N854A mutation can be combined with one or more of H840A, D10A, or N856A mutations to produce a site-directed polypeptide substantially lacking DNA cleavage activity. A N856A mutation can be combined with one or more of H840A, N854A, or D10A mutations to produce a site-directed polypeptide substantially lacking DNA cleavage activity. Site-directed polypeptides that comprise one substantially inactive nuclease domain are referred to as "nickases".

Nickase variants of RNA-guided endonucleases, for example Cas9, can be used to increase the specificity of CRISPR-mediated genome editing. Wild type Cas9 is typically guided by a single guide RNA designed to hybridize with a specified ~20 nucleotide sequence in the target sequence (such as an endogenous genomic locus). However, several mismatches can be tolerated between the guide RNA and the target locus, effectively reducing the length of required homology in the target site to, for example, as little as 13 nt of homology, and thereby resulting in elevated potential for binding and double-strand nucleic acid cleavage by the CRISPR/Cas9 complex elsewhere in the target genome—also known as off-target cleavage. Because nickase variants of Cas9 each only cut one strand, in order to create a double-strand break it is necessary for a pair of nickases to bind in close proximity and on opposite strands of the target nucleic acid, thereby creating a pair of nicks, which is the equivalent of a double-strand break. This requires that two separate guide RNAs—one for each nickase—must bind in close proximity and on opposite strands of the target nucleic acid. This requirement essentially doubles the minimum length of homology needed for the double-strand break to occur, thereby reducing the likelihood that a double-strand cleavage event will occur elsewhere in the genome, where the two guide RNA sites—if they exist—are unlikely to be sufficiently close to each other to enable the double-strand break to form. As described in the art, nickases can also be used to promote HDR versus NHEJ. HDR can be used to introduce selected changes into target sites in the genome through the use of specific donor sequences that effectively mediate the desired changes.

Mutations contemplated can include substitutions, additions, and deletions, or any combination thereof. The mutation converts the mutated amino acid to alanine. The mutation converts the mutated amino acid to another amino acid (e.g., glycine, serine, threonine, cysteine, valine, leucine, isoleucine, methionine, proline, phenylalanine, tyrosine, tryptophan, aspartic acid, glutamic acid, asparagines, glutamine, histidine, lysine, or arginine). The mutation converts the mutated amino acid to a non-natural amino acid (e.g., selenomethionine). The mutation converts the mutated amino acid to amino acid mimics (e.g., phosphomimics). The mutation can be a conservative mutation. For example, the mutation converts the mutated amino acid to amino acids that resemble the size, shape, charge, polarity, conformation, and/or rotamers of the mutated amino acids (e.g., cysteine/serine mutation, lysine/asparagine mutation, histidine/phenylalanine mutation). The mutation can cause a shift in reading frame and/or the creation of a premature stop codon. Mutations can cause changes to regulatory regions of genes or loci that affect expression of one or more genes.

The site-directed polypeptide (e.g., variant, mutated, enzymatically inactive and/or conditionally enzymatically inactive site-directed polypeptide) can target nucleic acid. The site-directed polypeptide (e.g., variant, mutated, enzymatically inactive and/or conditionally enzymatically inactive endoribonuclease) can target DNA. The site-directed polypeptide (e.g., variant, mutated, enzymatically inactive and/or conditionally enzymatically inactive endoribonuclease) can target RNA.

The site-directed polypeptide can comprise one or more non-native sequences (e.g., the site-directed polypeptide is a fusion protein).

The site-directed polypeptide can comprise an amino acid sequence comprising at least 15% amino acid identity to a Cas9 from a bacterium (e.g., S. pyogenes), a nucleic acid binding domain, and two nucleic acid cleaving domains (i.e., a HNH domain and a RuvC domain).

The site-directed polypeptide can comprise an amino acid sequence comprising at least 15% amino acid identity to a Cas9 from a bacterium (e.g., S. pyogenes), and two nucleic acid cleaving domains (i.e., a HNH domain and a RuvC domain).

The site-directed polypeptide can comprise an amino acid sequence comprising at least 15% amino acid identity to a Cas9 from a bacterium (e.g., S. pyogenes), and two nucleic acid cleaving domains, wherein one or both of the nucleic acid cleaving domains comprise at least 50% amino acid identity to a nuclease domain from Cas9 from a bacterium (e.g., S. pyogenes).

The site-directed polypeptide can comprise an amino acid sequence comprising at least 15% amino acid identity to a Cas9 from a bacterium (e.g., S. pyogenes), two nucleic acid cleaving domains (i.e., a HNH domain and a RuvC domain), and non-native sequence (for example, a nuclear localization signal) or a linker linking the site-directed polypeptide to a non-native sequence.

The site-directed polypeptide can comprise an amino acid sequence comprising at least 15% amino acid identity to a Cas9 from a bacterium (e.g., S. pyogenes), two nucleic acid cleaving domains (i.e., a HNH domain and a RuvC domain), wherein the site-directed polypeptide comprises a mutation in one or both of the nucleic acid cleaving domains that reduces the cleaving activity of the nuclease domains by at least 50%.

The site-directed polypeptide can comprise an amino acid sequence comprising at least 15% amino acid identity to a Cas9 from a bacterium (e.g., S. pyogenes), and two nucleic acid cleaving domains (i.e., a HNH domain and a RuvC domain), wherein one of the nuclease domains comprises mutation of aspartic acid 10, and/or wherein one of the nuclease domains can comprise a mutation of histidine 840, and wherein the mutation reduces the cleaving activity of the nuclease domain(s) by at least 50%.

The one or more site-directed polypeptides, e.g. DNA endonucleases, can comprise two nickases that together effect one double-strand break at a specific locus in the genome, or four nickases that together effect or cause two double-strand breaks at specific loci in the genome. Alternatively, one site-directed polypeptide, e.g. DNA endonuclease, can effect or cause one double-strand break at a specific locus in the genome.

Genome-Targeting Nucleic Acid

The present disclosure provides a genome-targeting nucleic acid that can direct the activities of an associated polypeptide (e.g., a site-directed polypeptide) to a specific target sequence within a target nucleic acid. The genome-targeting nucleic acid can be an RNA. A genome-targeting RNA is referred to as a "guide RNA" or "gRNA" herein. A guide RNA can comprise at least a spacer sequence that hybridizes to a target nucleic acid sequence of interest, and a CRISPR repeat sequence. In Type II systems, the gRNA also comprises a second RNA called the tracrRNA sequence. In the Type II guide RNA (gRNA), the CRISPR repeat sequence and tracrRNA sequence hybridize to each other to form a duplex. In the Type V guide RNA (gRNA), the crRNA forms a duplex. In both systems, the duplex can bind a site-directed polypeptide, such that the guide RNA and site-direct polypeptide form a complex. The genome-targeting nucleic acid can provide target specificity to the complex by virtue of its association with the site-directed polypeptide. The genome-targeting nucleic acid thus can direct the activity of the site-directed polypeptide.

Exemplary guide RNAs include the spacer sequences in SEQ ID NOs: 1-64,980 of the Sequence Listing, shown with the genome location of their target sequence and the associated Cas9 cut site, wherein the genome location is based on the GRCh38/hg38 human genome assembly.

Each guide RNA can be designed to include a spacer sequence complementary to its genomic target sequence. For example, each of the spacer sequences in SEQ ID NOs: 1-64,980 of the Sequence Listing can be put into a single RNA chimera or a crRNA (along with a corresponding tracrRNA). See Jinek et al., Science, 337, 816-821 (2012) and Deltcheva et al., Nature, 471, 602-607 (2011).

The genome-targeting nucleic acid can be a double-molecule guide RNA. The genome-targeting nucleic acid can be a single-molecule guide RNA.

A double-molecule guide RNA can comprise two strands of RNA. The first strand comprises in the 5' to 3' direction, an optional spacer extension sequence, a spacer sequence and a minimum CRISPR repeat sequence. The second strand can comprise a minimum tracrRNA sequence (complementary to the minimum CRISPR repeat sequence), a 3' tracrRNA sequence and an optional tracrRNA extension sequence.

A single-molecule guide RNA (sgRNA) in a Type II system can comprise, in the 5' to 3' direction, an optional spacer extension sequence, a spacer sequence, a minimum CRISPR repeat sequence, a single-molecule guide linker, a minimum tracrRNA sequence, a 3' tracrRNA sequence and an optional tracrRNA extension sequence. The optional tracrRNA extension can comprise elements that contribute additional functionality (e.g., stability) to the guide RNA. The single-molecule guide linker can link the minimum CRISPR repeat and the minimum tracrRNA sequence to form a hairpin structure. The optional tracrRNA extension can comprise one or more hairpins.

A single-molecule guide RNA (sgRNA) in a Type V system can comprise, in the 5' to 3' direction, a minimum CRISPR repeat sequence and a spacer sequence.

The sgRNA can comprise a 20 nucleotide spacer sequence at the 5' end of the sgRNA sequence. The sgRNA can comprise a less than a 20 nucleotide spacer sequence at the 5' end of the sgRNA sequence. The sgRNA can comprise a more than 20 nucleotide spacer sequence at the 5' end of the sgRNA sequence. The sgRNA can comprise a variable length spacer sequence with 17-30 nucleotides at the 5' end of the sgRNA sequence (see Table 1).

The sgRNA can comprise no uracil at the 3'end of the sgRNA sequence, such as in SEQ ID NO. 64,985 of Table 1. The sgRNA can comprise one or more uracil at the 3'end of the sgRNA sequence, such as in SEQ ID NOs. 64,986-64,987 in Table 1. For example, the sgRNA can comprise 1 uracil (U) at the 3'end of the sgRNA sequence. The sgRNA can comprise 2 uracil (UU) at the 3'end of the sgRNA sequence. The sgRNA can comprise 3 uracil (UUU) at the 3'end of the sgRNA sequence. The sgRNA can comprise 4 uracil (UUUU) at the 3'end of the sgRNA sequence. The sgRNA can comprise 5 uracil (UUUUU) at the 3'end of the sgRNA sequence. The sgRNA can comprise 6 uracil (UUUUUU) at the 3'end of the sgRNA sequence. The sgRNA can comprise 7 uracil (UUUUUUU) at the 3'end of the sgRNA sequence. The sgRNA can comprise 8 uracil (UUUUUUUU) at the 3'end of the sgRNA sequence.

The sgRNA can be unmodified or modified. For example, modified sgRNAs can comprise one or more 2'-O-methyl phosphorothioate nucleotides. For example, modified sgRNAs can comprise 2'-O-methyl phosphorothioate nucleotides as the first 3 nucleotides and 2'-O-methyl phosphorothioate nucleotides as the last 3 nucleotides, such as in SEQ ID NO. 64,984 in Table 1 where "*" indicates 2'-O-methyl phosphorothioate nucleotides. The first 3 nucleotides in the $n_{(17-30)}$ region of SEQ ID NO. 64,987 can be 2'-O-methyl phosphorothioate nucleotides (i.e.: n*). The last 3 nucleotides within the $u_{(1-8)}$ region of SEQ ID NO. 64,987 can be 2'-O-methyl phosphorothioate urasils (i.e.: u*). In certain examples where the $u_{(1-8)}$ region of SEQ ID NO. 64,987 contains less than 3 urasil, one or two nucleotides prior to the $u_{(1-8)}$ region can be 2'-O-methyl phosphorothioate nucleotides such that the last three nucleotides of the sequence are 2'-O-methyl phosphorothioate nucleotides.

TABLE 1

| SEQ ID NO. | sgRNA sequence |
|---|---|
| 64,983 | nnnnnnnnnnnnnnnnnnnnguuuuagagcuagaaa uagcaaguuaaaauaaggcuaguccguuaucaacuu gaaaaaguggcaccgagucggugucuuuu |
| 64,984 | n*n*n*nnnnnnnnnnnnnnnnnnguuuuagagcuag aaauagcaaguuaaaauaaggcuaguccguuaucaa cuugaaaaaguggcaccgagucggugcun*n*n* |
| 64,985 | nnnnnnnnnnnnnnnnnnnnguuuuagagcuagaaa uagcaaguuaaaauaaggcuaguccguuaucaacuu gaaaaaguggcaccgagucggugc |
| 64,986 | $n_{(17-30)}$guuuuagagcuagaaauagcaaguuaaaau aaggcuaguccguuaucaacuugaaaaaguggcacc gagucggugcu$_{(1-8)}$ |
| 64,987 | $n_{(17-30)}$guuuuagagcuagaaauagcaaguuaaaau aaggcuaguccguuaucaacuugaaaaaguggcacc gagucggugcu$_{(1-8)}$ |

By way of illustration, guide RNAs used in the CRISPR/Cas/Cpf1 system, or other smaller RNAs, can be readily synthesized by chemical means, as illustrated below and described in the art. While chemical synthetic procedures are continually expanding, purifications of such RNAs by procedures such as high performance liquid chromatography (HPLC, which avoids the use of gels such as PAGE) tends to become more challenging as polynucleotide lengths increase significantly beyond a hundred or so nucleotides. One approach used for generating RNAs of greater length is to produce two or more molecules that are ligated together. Much longer RNAs, such as those encoding a Cas9 or Cpf1 endonuclease, are more readily generated enzymatically.

Various types of RNA modifications can be introduced during or after chemical synthesis and/or enzymatic generation of RNAs, e.g., modifications that enhance stability, reduce the likelihood or degree of innate immune response, and/or enhance other attributes, as described in the art.

Spacer Extension Sequence

In some examples of genome-targeting nucleic acids, a spacer extension sequence can modify activity, provide stability and/or provide a location for modifications of a genome-targeting nucleic acid. A spacer extension sequence can modify on- or off-target activity or specificity. In some examples, a spacer extension sequence can be provided. The spacer extension sequence can have a length of more than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, or 7000 or more nucleotides. The spacer extension sequence can have a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, 7000 or more nucleotides. The spacer extension sequence can be less than 10 nucleotides in length. The spacer extension sequence can be between 10-30 nucleotides in length. The spacer extension sequence can be between 30-70 nucleotides in length.

The spacer extension sequence can comprise another moiety (e.g., a stability control sequence, an endoribonuclease binding sequence, a ribozyme). The moiety can decrease or increase the stability of a nucleic acid targeting nucleic acid. The moiety can be a transcriptional terminator segment (i.e., a transcription termination sequence). The moiety can function in a eukaryotic cell. The moiety can function in a prokaryotic cell. The moiety can function in both eukaryotic and prokaryotic cells. Non-limiting examples of suitable moieties include: a 5' cap (e.g., a 7-methylguanylate cap (m7 G)), a riboswitch sequence (e.g., to allow for regulated stability and/or regulated accessibility by proteins and protein complexes), a sequence that forms a dsRNA duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like).

Spacer Sequence

The spacer sequence hybridizes to a sequence in a target nucleic acid of interest. The spacer of a genome-targeting nucleic acid can interact with a target nucleic acid in a sequence-specific manner via hybridization (i.e., base pairing). The nucleotide sequence of the spacer can vary depending on the sequence of the target nucleic acid of interest.

In a CRISPR/Cas system herein, the spacer sequence can be designed to hybridize to a target nucleic acid that is located 5' of a PAM of the Cas9 enzyme used in the system. The spacer may perfectly match the target sequence or may have mismatches. Each Cas9 enzyme has a particular PAM sequence that it recognizes in a target DNA. For example, S. pyogenes recognizes in a target nucleic acid a PAM that comprises the sequence 5'-NRG-3', where R comprises either A or G, where N is any nucleotide and N is immediately 3' of the target nucleic acid sequence targeted by the spacer sequence.

The target nucleic acid sequence can comprise 20 nucleotides. The target nucleic acid can comprise less than 20 nucleotides. The target nucleic acid can comprise more than 20 nucleotides. The target nucleic acid can comprise at least: 5, 10, 15, 16, 17, 18, 19, 20, 21, 22, 23, 24, 25, 30 or more nucleotides. The target nucleic acid can comprise at most: 5, 10, 15, 16, 17, 18, 19, 20, 21, 22, 23, 24, 25, 30 or more nucleotides. The target nucleic acid sequence can comprise 20 bases immediately 5' of the first nucleotide of the PAM. For example, in a sequence comprising 5'-NNNNNNNNNNNNNNNNNNNNRG-3' (SEQ ID NO. 64,981), the target nucleic acid can comprise the sequence that corresponds to the Ns, wherein N is any nucleotide, and the underlined NRG sequence is the *S. pyogenes* PAM.

The spacer sequence that hybridizes to the target nucleic acid can have a length of at least about 6 nucleotides (nt). The spacer sequence can be at least about 6 nt, at least about 10 nt, at least about 15 nt, at least about 18 nt, at least about 19 nt, at least about 20 nt, at least about 25 nt, at least about 30 nt, at least about 35 nt or at least about 40 nt, from about 6 nt to about 80 nt, from about 6 nt to about 50 nt, from about 6 nt to about 45 nt, from about 6 nt to about 40 nt, from about 6 nt to about 35 nt, from about 6 nt to about 30 nt, from about 6 nt to about 25 nt, from about 6 nt to about 20 nt, from about 6 nt to about 19 nt, from about 10 nt to about 50 nt, from about 10 nt to about 45 nt, from about 10 nt to about 40 nt, from about 10 nt to about 35 nt, from about 10 nt to about 30 nt, from about 10 nt to about 25 nt, from about 10 nt to about 20 nt, from about 10 nt to about 19 nt, from about 19 nt to about 25 nt, from about 19 nt to about 30 nt, from about 19 nt to about 35 nt, from about 19 nt to about 40 nt, from about 19 nt to about 45 nt, from about 19 nt to about 50 nt, from about 19 nt to about 60 nt, from about 20 nt to about 25 nt, from about 20 nt to about 30 nt, from about 20 nt to about 35 nt, from about 20 nt to about 40 nt, from about 20 nt to about 45 nt, from about 20 nt to about 50 nt, or from about 20 nt to about 60 nt. In some examples, the spacer sequence can comprise 20 nucleotides. In some examples, the spacer can comprise 19 nucleotides.

In some examples, the percent complementarity between the spacer sequence and the target nucleic acid is at least about 30%, at least about 40%, at least about 50%, at least about 60%, at least about 65%, at least about 70%, at least about 75%, at least about 80%, at least about 85%, at least about 90%, at least about 95%, at least about 97%, at least about 98%, at least about 99%, or 100%. In some examples, the percent complementarity between the spacer sequence and the target nucleic acid is at most about 30%, at most about 40%, at most about 50%, at most about 60%, at most about 65%, at most about 70%, at most about 75%, at most about 80%, at most about 85%, at most about 90%, at most about 95%, at most about 97%, at most about 98%, at most about 99%, or 100%. In some examples, the percent complementarity between the spacer sequence and the target nucleic acid is 100% over the six contiguous 5'-most nucleotides of the target sequence of the complementary strand of the target nucleic acid. The percent complementarity between the spacer sequence and the target nucleic acid can be at least 60% over about 20 contiguous nucleotides. The length of the spacer sequence and the target nucleic acid can differ by 1 to 6 nucleotides, which may be thought of as a bulge or bulges.

The spacer sequence can be designed or chosen using a computer program. The computer program can use variables, such as predicted melting temperature, secondary structure formation, predicted annealing temperature, sequence identity, genomic context, chromatin accessibility, % GC, frequency of genomic occurrence (e.g., of sequences that are identical or are similar but vary in one or more spots as a result of mismatch, insertion or deletion), methylation status, presence of SNPs, and the like.

Minimum CRISPR Repeat Sequence

A minimum CRISPR repeat sequence can be a sequence with at least about 30%, about 40%, about 50%, about 60%, about 65%, about 70%, about 75%, about 80%, about 85%, about 90%, about 95%, or 100% sequence identity to a reference CRISPR repeat sequence (e.g., crRNA from *S. pyogenes*).

A minimum CRISPR repeat sequence can comprise nucleotides that can hybridize to a minimum tracrRNA sequence in a cell. The minimum CRISPR repeat sequence and a minimum tracrRNA sequence can form a duplex, i.e. a base-paired double-stranded structure. Together, the minimum CRISPR repeat sequence and the minimum tracrRNA sequence can bind to the site-directed polypeptide. At least a part of the minimum CRISPR repeat sequence can hybridize to the minimum tracrRNA sequence. At least a part of the minimum CRISPR repeat sequence can comprise at least about 30%, about 40%, about 50%, about 60%, about 65%, about 70%, about 75%, about 80%, about 85%, about 90%, about 95%, or 100% complementary to the minimum tracrRNA sequence. At least a part of the minimum CRISPR repeat sequence can comprise at most about 30%, about 40%, about 50%, about 60%, about 65%, about 70%, about 75%, about 80%, about 85%, about 90%, about 95%, or 100% complementary to the minimum tracrRNA sequence.

The minimum CRISPR repeat sequence can have a length from about 7 nucleotides to about 100 nucleotides. For example, the length of the minimum CRISPR repeat sequence is from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt, or from about 15 nt to about 25 nt. In some examples, the minimum CRISPR repeat sequence can be approximately 9 nucleotides in length. The minimum CRISPR repeat sequence can be approximately 12 nucleotides in length.

The minimum CRISPR repeat sequence can be at least about 60% identical to a reference minimum CRISPR repeat sequence (e.g., wild-type crRNA from *S. pyogenes*) over a stretch of at least 6, 7, or 8 contiguous nucleotides. For example, the minimum CRISPR repeat sequence can be at least about 65% identical, at least about 70% identical, at least about 75% identical, at least about 80% identical, at least about 85% identical, at least about 90% identical, at least about 95% identical, at least about 98% identical, at least about 99% identical or 100% identical to a reference minimum CRISPR repeat sequence over a stretch of at least 6, 7, or 8 contiguous nucleotides.

Minimum tracrRNA Sequence

A minimum tracrRNA sequence can be a sequence with at least about 30%, about 40%, about 50%, about 60%, about 65%, about 70%, about 75%, about 80%, about 85%, about 90%, about 95%, or 100% sequence identity to a reference tracrRNA sequence (e.g., wild type tracrRNA from *S. pyogenes*).

A minimum tracrRNA sequence can comprise nucleotides that hybridize to a minimum CRISPR repeat sequence in a cell. A minimum tracrRNA sequence and a minimum CRISPR repeat sequence form a duplex, i.e. a base-paired double-stranded structure. Together, the minimum tracrRNA sequence and the minimum CRISPR repeat can bind to a site-directed polypeptide. At least a part of the minimum tracrRNA sequence can hybridize to the minimum CRISPR repeat sequence. The minimum tracrRNA sequence can be at least about 30%, about 40%, about 50%, about 60%, about 65%, about 70%, about 75%, about 80%, about 85%, about 90%, about 95%, or 100% complementary to the minimum CRISPR repeat sequence.

The minimum tracrRNA sequence can have a length from about 7 nucleotides to about 100 nucleotides. For example, the minimum tracrRNA sequence can be from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt or from about 15 nt to about 25 nt long. The minimum tracrRNA sequence can be approximately 9 nucleotides in length. The minimum tracrRNA sequence can be approximately 12 nucleotides. The minimum tracrRNA can consist of tracrRNA nt 23-48 described in Jinek et al., supra.

The minimum tracrRNA sequence can be at least about 60% identical to a reference minimum tracrRNA (e.g., wild type, tracrRNA from *S. pyogenes*) sequence over a stretch of at least 6, 7, or 8 contiguous nucleotides. For example, the minimum tracrRNA sequence can be at least about 65% identical, about 70% identical, about 75% identical, about 80% identical, about 85% identical, about 90% identical, about 95% identical, about 98% identical, about 99% identical or 100% identical to a reference minimum tracrRNA sequence over a stretch of at least 6, 7, or 8 contiguous nucleotides.

The duplex between the minimum CRISPR RNA and the minimum tracrRNA can comprise a double helix. The duplex between the minimum CRISPR RNA and the minimum tracrRNA can comprise at least about 1, 2, 3, 4, 5, 6, 7, 8, 9, or 10 or more nucleotides. The duplex between the minimum CRISPR RNA and the minimum tracrRNA can comprise at most about 1, 2, 3, 4, 5, 6, 7, 8, 9, or 10 or more nucleotides.

The duplex can comprise a mismatch (i.e., the two strands of the duplex are not 100% complementary). The duplex can comprise at least about 1, 2, 3, 4, or 5 or mismatches. The duplex can comprise at most about 1, 2, 3, 4, or 5 or mismatches. The duplex can comprise no more than 2 mismatches.

Bulges

In some cases, there can be a "bulge" in the duplex between the minimum CRISPR RNA and the minimum tracrRNA. A bulge is an unpaired region of nucleotides within the duplex. A bulge can contribute to the binding of the duplex to the site-directed polypeptide. The bulge can comprise, on one side of the duplex, an unpaired 5'-XXXY-3' where X is any purine and Y comprises a nucleotide that can form a wobble pair with a nucleotide on the opposite strand, and an unpaired nucleotide region on the other side of the duplex. The number of unpaired nucleotides on the two sides of the duplex can be different.

In one example, the bulge can comprise an unpaired purine (e.g., adenine) on the minimum CRISPR repeat strand of the bulge. In some examples, the bulge can comprise an unpaired 5'-AAGY-3' of the minimum tracrRNA sequence strand of the bulge, where Y comprises a nucleotide that can form a wobble pairing with a nucleotide on the minimum CRISPR repeat strand.

A bulge on the minimum CRISPR repeat side of the duplex can comprise at least 1, 2, 3, 4, or 5 or more unpaired nucleotides. A bulge on the minimum CRISPR repeat side of the duplex can comprise at most 1, 2, 3, 4, or 5 or more unpaired nucleotides. A bulge on the minimum CRISPR repeat side of the duplex can comprise 1 unpaired nucleotide.

A bulge on the minimum tracrRNA sequence side of the duplex can comprise at least 1, 2, 3, 4, 5, 6, 7, 8, 9, or 10 or more unpaired nucleotides. A bulge on the minimum tracrRNA sequence side of the duplex can comprise at most 1, 2, 3, 4, 5, 6, 7, 8, 9, or 10 or more unpaired nucleotides. A bulge on a second side of the duplex (e.g., the minimum tracrRNA sequence side of the duplex) can comprise 4 unpaired nucleotides.

A bulge can comprise at least one wobble pairing. In some examples, a bulge can comprise at most one wobble pairing. A bulge can comprise at least one purine nucleotide. A bulge can comprise at least 3 purine nucleotides. A bulge sequence can comprises at least 5 purine nucleotides. A bulge sequence can comprise at least one guanine nucleotide. In some examples, a bulge sequence can comprise at least one adenine nucleotide.

Hairpins

In various examples, one or more hairpins can be located 3' to the minimum tracrRNA in the 3' tracrRNA sequence.

The hairpin can start at least about 1, 2, 3, 4, 5, 6, 7, 8, 9, 10, 15, or 20 or more nucleotides 3' from the last paired nucleotide in the minimum CRISPR repeat and minimum tracrRNA sequence duplex. The hairpin can start at most about 1, 2, 3, 4, 5, 6, 7, 8, 9 or 10 or more nucleotides 3' of the last paired nucleotide in the minimum CRISPR repeat and minimum tracrRNA sequence duplex.

The hairpin can comprise at least about 1, 2, 3, 4, 5, 6, 7, 8, 9, 10, 15, or 20 or more consecutive nucleotides. The hairpin can comprise at most about 1, 2, 3, 4, 5, 6, 7, 8, 9, 10, 15, or more consecutive nucleotides.

The hairpin can comprise a CC dinucleotide (i.e., two consecutive cytosine nucleotides).

The hairpin can comprise duplexed nucleotides (e.g., nucleotides in a hairpin, hybridized together). For example, a hairpin can comprise a CC dinucleotide that is hybridized to a GG dinucleotide in a hairpin duplex of the 3' tracrRNA sequence.

One or more of the hairpins can interact with guide RNA-interacting regions of a site-directed polypeptide.

In some examples, there are two or more hairpins, and in other examples there are three or more hairpins.

3' tracrRNA Sequence

A 3' tracrRNA sequence can comprise a sequence with at least about 30%, about 40%, about 50%, about 60%, about 65%, about 70%, about 75%, about 80%, about 85%, about 90%, about 95%, or 100% sequence identity to a reference tracrRNA sequence (e.g., a tracrRNA from *S. pyogenes*).

The 3' tracrRNA sequence can have a length from about 6 nucleotides to about 100 nucleotides. For example, the 3' tracrRNA sequence can have a length from about 6 nucleotides (nt) to about 50 nt, from about 6 nt to about 40 nt, from about 6 nt to about 30 nt, from about 6 nt to about 25 nt, from about 6 nt to about 20 nt, from about 6 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt, or from about 15 nt to about 25 nt. The 3' tracrRNA sequence can have a length of approximately 14 nucleotides.

The 3' tracrRNA sequence can be at least about 60% identical to a reference 3' tracrRNA sequence (e.g., wild type 3' tracrRNA sequence from *S. pyogenes*) over a stretch of at least 6, 7, or 8 contiguous nucleotides. For example, the 3' tracrRNA sequence can be at least about 60% identical, about 65% identical, about 70% identical, about 75% identical, about 80% identical, about 85% identical, about 90% identical, about 95% identical, about 98% identical, about 99% identical, or 100% identical, to a reference 3' tracrRNA sequence (e.g., wild type 3' tracrRNA sequence from S. pyogenes) over a stretch of at least 6, 7, or 8 contiguous nucleotides.

The 3' tracrRNA sequence can comprise more than one duplexed region (e.g., hairpin, hybridized region). The 3' tracrRNA sequence can comprise two duplexed regions.

The 3' tracrRNA sequence can comprise a stem loop structure. The stem loop structure in the 3' tracrRNA can comprise at least 1, 2, 3, 4, 5, 6, 7, 8, 9, 10, 15 or 20 or more nucleotides. The stem loop structure in the 3' tracrRNA can comprise at most 1, 2, 3, 4, 5, 6, 7, 8, 9 or 10 or more nucleotides. The stem loop structure can comprise a functional moiety. For example, the stem loop structure can comprise an aptamer, a ribozyme, a protein-interacting hairpin, a CRISPR array, an intron, or an exon. The stem loop structure can comprise at least about 1, 2, 3, 4, or 5 or more functional moieties. The stem loop structure can comprise at most about 1, 2, 3, 4, or 5 or more functional moieties.

The hairpin in the 3' tracrRNA sequence can comprise a P-domain. In some examples, the P-domain can comprise a double-stranded region in the hairpin.

tracrRNA Extension Sequence

A tracrRNA extension sequence may be provided whether the tracrRNA is in the context of single-molecule guides or double-molecule guides. The tracrRNA extension sequence can have a length from about 1 nucleotide to about 400 nucleotides. The tracrRNA extension sequence can have a length of more than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, or 400 nucleotides. The tracrRNA extension sequence can have a length from about 20 to about 5000 or more nucleotides. The tracrRNA extension sequence can have a length of more than 1000 nucleotides. The tracrRNA extension sequence can have a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400 or more nucleotides. The tracrRNA extension sequence can have a length of less than 1000 nucleotides. The tracrRNA extension sequence can comprise less than 10 nucleotides in length. The tracrRNA extension sequence can be 10-30 nucleotides in length. The tracrRNA extension sequence can be 30-70 nucleotides in length.

The tracrRNA extension sequence can comprise a functional moiety (e.g., a stability control sequence, ribozyme, endoribonuclease binding sequence). The functional moiety can comprise a transcriptional terminator segment (i.e., a transcription termination sequence). The functional moiety can have a total length from about 10 nucleotides (nt) to about 100 nucleotides, from about 10 nt to about 20 nt, from about 20 nt to about 30 nt, from about 30 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt, from about 15 nt to about 80 nt, from about 15 nt to about 50 nt, from about 15 nt to about 40 nt, from about 15 nt to about 30 nt, or from about 15 nt to about 25 nt. The functional moiety can function in a eukaryotic cell. The functional moiety can function in a prokaryotic cell. The functional moiety can function in both eukaryotic and prokaryotic cells.

Non-limiting examples of suitable tracrRNA extension functional moieties include a 3' poly-adenylated tail, a riboswitch sequence (e.g., to allow for regulated stability and/or regulated accessibility by proteins and protein complexes), a sequence that forms a dsRNA duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like). The tracrRNA extension sequence can comprise a primer binding site or a molecular index (e.g., barcode sequence). The tracrRNA extension sequence can comprise one or more affinity tags.

Single-Molecule Guide Linker Sequence

The linker sequence of a single-molecule guide nucleic acid can have a length from about 3 nucleotides to about 100 nucleotides. In Jinek et al., supra, for example, a simple 4 nucleotide "tetraloop" (-GAAA-) was used, Science, 337 (6096):816-821 (2012). An illustrative linker has a length from about 3 nucleotides (nt) to about 90 nt, from about 3 nt to about 80 nt, from about 3 nt to about 70 nt, from about 3 nt to about 60 nt, from about 3 nt to about 50 nt, from about 3 nt to about 40 nt, from about 3 nt to about 30 nt, from about 3 nt to about 20 nt, from about 3 nt to about 10 nt. For example, the linker can have a length from about 3 nt to about 5 nt, from about 5 nt to about 10 nt, from about 10 nt to about 15 nt, from about 15 nt to about 20 nt, from about 20 nt to about 25 nt, from about 25 nt to about 30 nt, from about 30 nt to about 35 nt, from about 35 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt. The linker of a single-molecule guide nucleic acid can be between 4 and 40 nucleotides. The linker can be at least about 100, 500, 1000, 1500, 2000, 2500, 3000, 3500, 4000, 4500, 5000, 5500, 6000, 6500, or 7000 or more nucleotides. The linker can be at most about 100, 500, 1000, 1500, 2000, 2500, 3000, 3500, 4000, 4500, 5000, 5500, 6000, 6500, or 7000 or more nucleotides.

Linkers can comprise any of a variety of sequences, although in some examples the linker will not comprise sequences that have extensive regions of homology with other portions of the guide RNA, which might cause intramolecular binding that could interfere with other functional regions of the guide. In Jinek et al., supra, a simple 4 nucleotide sequence -GAAA- was used, Science, 337 (6096):816-821 (2012), but numerous other sequences, including longer sequences can likewise be used.

The linker sequence can comprise a functional moiety. For example, the linker sequence can comprise one or more features, including an aptamer, a ribozyme, a protein-interacting hairpin, a protein binding site, a CRISPR array, an intron, or an exon. The linker sequence can comprise at least about 1, 2, 3, 4, or 5 or more functional moieties. In some examples, the linker sequence can comprise at most about 1, 2, 3, 4, or 5 or more functional moieties.

Genome Engineering Strategies to Correct Cells by Deletion, Insertion, or Correction of One or More Mutations within or Near the HFE Gene, or by Knocking-in HFE cDNA into the Locus of the Corresponding HFE Gene or Safe Harbor Site The methods of the present disclosure can involve correction of one or both of the mutant alleles. Gene editing to correct the mutation has the advantage of restoration of correct expression levels and temporal control. Sequencing the patient's HFE alleles allows for design of the gene editing strategy to best correct the identified mutation(s).

A step of the ex vivo methods of the present disclosure can comprise editing/correcting the patient specific iPSC cells using genome engineering. Alternatively, a step of the ex vivo methods of the present disclosure can comprise editing/correcting the liver specific progenitor cell, primary hepatocyte, or mesenchymal stem cell. Likewise, a step of the in vivo methods of the present disclosure can comprise editing/correcting the cells in a HHC patient using genome engineering. Similarly, a step in the cellular methods of the present disclosure can comprise editing/correcting the HFE gene in a human cell by genome engineering.

HHC patients exhibit one or more mutations in the HFE gene. Therefore, different patients will generally require different correction strategies. Any CRISPR endonuclease may be used in the methods of the present disclosure, each CRISPR endonuclease having its own associated PAM, which may or may not be disease specific. For example, gRNA spacer sequences for targeting the HFE gene with a CRISPR/Cas9 endonuclease from *S. pyogenes* have been identified in SEQ ID NOs. 1-4,455 of the Sequence Listing. gRNA spacer sequences for targeting the HFE gene with a CRISPR/Cas9 endonuclease from *S. aureus* have been identified in SEQ ID NOs. 4,456-4,979 of the Sequence Listing. gRNA spacer sequences for targeting the HFE gene with a CRISPR/Cas9 endonuclease from *S. thermophilus* have been identified in SEQ ID NOs. 4,980-5,139 of the Sequence Listing. gRNA spacer sequences for targeting the HFE gene with a CRISPR/Cas9 endonuclease from *T. denticola* have been identified in SEQ ID NOs. 5,140-5,192 of the Sequence Listing. gRNA spacer sequences for targeting the HFE gene with a CRISPR/Cas9 endonuclease from *N. meningitides* have been identified in SEQ ID NOs. 5,193-5,617 of the Sequence Listing. gRNA spacer sequences for targeting the HFE gene with a CRISPR/Cpf1 endonuclease from *Acidominococcus, Lachnospiraceae*, and *Franciscella Novicida* have been identified in SEQ ID NOs. 5,618-10,121 of the Sequence Listing.

For example, the mutation can be corrected by the insertions or deletions that arise due to the imprecise NHEJ repair pathway. If the patient's HFE gene has an inserted or deleted base, a targeted cleavage can result in a NHEJ-mediated insertion or deletion that restores the frame. Missense mutations can also be corrected through NHEJ-mediated correction using one or more guide RNA. The ability or likelihood of the cut(s) to correct the mutation can be designed or evaluated based on the local sequence and micro-homologies. NHEJ can also be used to delete segments of the gene, either directly or by altering splice donor or acceptor sites through cleavage by one gRNA targeting several locations, or several gRNAs. This may be useful if an amino acid, domain or exon contains the mutations and can be removed or inverted, or if the deletion otherwise restored function to the protein. Pairs of guide strands have been used for deletions and corrections of inversions.

Alternatively, the donor for correction by HDR contains the corrected sequence with small or large flanking homology arms to allow for annealing. HDR is essentially an error-free mechanism that uses a supplied homologous DNA sequence as a template during DSB repair. The rate of HDR is a function of the distance between the mutation and the cut site so choosing overlapping or nearest target sites is important. Templates can include extra sequences flanked by the homologous regions or can contain a sequence that differs from the genomic sequence, thus allowing sequence editing.

In addition to correcting mutations by NHEJ or HDR, a range of other options are possible. If there are small or large deletions or multiple mutations, a cDNA can be knocked in that contains the exons affected. A full length cDNA can be knocked into any "safe harbor", but must use a supplied or other promoter. If this construct is knocked into the correct location, it will have physiological control, similar to the normal gene. Pairs of nucleases can be used to delete mutated gene regions, though a donor would usually have to be provided to restore function. In this case two gRNA would be supplied and one donor sequence.

Some genome engineering strategies involve correction of one or more mutations in or near the HFE gene, or deleting the mutant HFE DNA and/or knocking-in HFE cDNA into the locus of the corresponding gene or a safe harbor locus by HDR, which is also known as homologous recombination (HR). Homology directed repair can be one strategy for treating patients that have one or more mutations in or near the HFE gene. These strategies can restore the HFE gene and reverse, treat, and/or mitigate the diseased state. These strategies can require a more custom approach based on the location of the patient's mutation(s). Donor nucleotides for correcting mutations often are small (<300 bp). This is advantageous, as HDR efficiencies may be inversely related to the size of the donor molecule. Also, it is expected that the donor templates can fit into size constrained adeno-associated virus (AAV) molecules, which have been shown to be an effective means of donor template delivery.

Homology direct repair is a cellular mechanism for repairing double-stranded breaks (DSBs). The most common form is homologous recombination. There are additional pathways for HDR, including single-strand annealing and alternative-HDR. Genome engineering tools allow researchers to manipulate the cellular homologous recombination pathways to create site-specific modifications to the genome. It has been found that cells can repair a double-stranded break using a synthetic donor molecule provided in trans. Therefore, by introducing a double-stranded break near a specific mutation and providing a suitable donor, targeted changes can be made in the genome. Specific cleavage increases the rate of HDR more than 1,000 fold above the rate of 1 in $10^6$ cells receiving a homologous donor alone. The rate of HDR at a particular nucleotide is a function of the distance to the cut site, so choosing overlapping or nearest target sites is important. Gene editing offers the advantage over gene addition, as correcting in situ leaves the rest of the genome unperturbed.

Supplied donors for editing by HDR vary markedly but can contain the intended sequence with small or large flanking homology arms to allow annealing to the genomic DNA. The homology regions flanking the introduced genetic changes can be 30 bp or smaller, or as large as a multi-kilobase cassette that can contain promoters, cDNAs, etc. Both single-stranded and double-stranded oligonucleotide donors have been used. These oligonucleotides range in size from less than 100 nt to over many kb, though longer ssDNA can also be generated and used. Double-stranded donors can be used, including PCR amplicons, plasmids, and mini-circles. In general, it has been found that an AAV vector can be a very effective means of delivery of a donor template, though the packaging limits for individual donors is <5 kb. Active transcription of the donor increased HDR three-fold, indicating the inclusion of promoter may increase conversion. Conversely, CpG methylation of the donor decreased gene expression and HDR.

In addition to wildtype endonucleases, such as Cas9, nickase variants exist that have one or the other nuclease domain inactivated resulting in cutting of only one DNA strand. HDR can be directed from individual Cas nickases or using pairs of nickases that flank the target area. Donors can be single-stranded, nicked, or dsDNA.

The donor DNA can be supplied with the nuclease or independently by a variety of different methods, for example by transfection, nano-particle, micro-injection, or viral transduction. A range of tethering options has been proposed to increase the availability of the donors for HDR. Examples include attaching the donor to the nuclease, attaching to DNA binding proteins that bind nearby, or attaching to proteins that are involved in DNA end binding or repair.

The repair pathway choice can be guided by a number of culture conditions, such as those that influence cell cycling, or by targeting of DNA repair and associated proteins. For example, to increase HDR, key NHEJ molecules can be suppressed, such as KU70, KU80 or DNA ligase IV.

Without a donor present, the ends from a DNA break or ends from different breaks can be joined using the several nonhomologous repair pathways in which the DNA ends are joined with little or no base-pairing at the junction. In addition to canonical NHEJ, there are similar repair mechanisms, such as alt-NHEJ. If there are two breaks, the intervening segment can be deleted or inverted. NHEJ repair pathways can lead to insertions, deletions or mutations at the joints.

NHEJ was used to insert a 15-kb inducible gene expression cassette into a defined locus in human cell lines after nuclease cleavage. Maresca, M., Lin, V. G., Guo, N. & Yang, Y., *Genome Res* 23, 539-546 (2013).

In addition to genome editing by NHEJ or HDR, site-specific gene insertions have been conducted that use both the NHEJ pathway and HR. A combination approach may be applicable in certain settings, possibly including intron/exon borders. NHEJ may prove effective for ligation in the intron, while the error-free HDR may be better suited in the coding region.

The HFE gene contains 7 exons. Any one or more of the 7 exons or nearby introns can be repaired in order to correct a mutation and restore HFE protein activity. Alternatively, there are various mutations associated with HHC, which are a combination of insertions, deletions, missense, nonsense, frameshift and other mutations, with the common effect of inactivating the HFE gene. Any one or more of the mutations can be repaired in order to restore the inactive HFE gene expression. For example, one or more of the following pathological variants may be corrected: C282Y, H63D, S65C, or combinations thereof (See Table 2). As a further alternative, HFE cDNA can be knocked-in to the locus of the corresponding gene or knocked-in to a safe harbor site, such as AAVS1. In some examples, the methods can provide one gRNA or a pair of gRNAs that can be used to facilitate incorporation of a new sequence from a polynucleotide donor template to correct one or more mutations or to knock-in a part of or the entire HFE gene or cDNA.

TABLE 2

| Variant | Location | Variant type |
| --- | --- | --- |
| C282Y | 6:26092913, rs1800562 | missense |
| H63D | 6:26090951, rs1799945 | missense |
| S65C | 6:26090957, rs1800730 | missense |

The methods can provide gRNA pairs that make a deletion by cutting the gene twice, one gRNA cutting at the 5' end of one or more mutations and the other gRNA cutting at the 3' end of one or more mutations that facilitates insertion of a new sequence from a polynucleotide donor template to replace the one or more mutations. The cutting can be accomplished by a pair of DNA endonucleases that each makes a DSB in the genome, or by multiple nickases that together make a DSB in the genome.

Alternatively, the methods can provide one gRNA to make one double-strand cut around one or more mutations that facilitates insertion of a new sequence from a polynucleotide donor template to replace the one or more mutations. The double-strand cut can be made by a single DNA endonuclease or multiple nickases that together make a DSB in the genome.

Illustrative modifications within the HFE gene include replacements within or near (proximal) to the mutations referred to above, such as within the region of less than 3 kb, less than 2 kb, less than 1 kb, less than 0.5 kb upstream or downstream of the specific mutation. Given the relatively wide variations of mutations in the HFE gene, it will be appreciated that numerous variations of the replacements referenced above (including without limitation larger as well as smaller deletions), would be expected to result in restoration of the HFE protein activity.

Such variants can include replacements that are larger in the 5' and/or 3' direction than the specific mutation in question, or smaller in either direction. Accordingly, by "near" or "proximal" with respect to specific replacements, it is intended that the SSB or DSB locus associated with a desired replacement boundary (also referred to herein as an endpoint) can be within a region that is less than about 3 kb from the reference locus noted. The SSB or DSB locus can be more proximal and within 2 kb, within 1 kb, within 0.5 kb, or within 0.1 kb. In the case of small replacement, the desired endpoint can be at or "adjacent to" the reference locus, by which it is intended that the endpoint can be within 100 bp, within 50 bp, within 25 bp, or less than about 10 bp to 5 bp from the reference locus.

Examples comprising larger or smaller replacements can be expected to provide the same benefit, as long as the HFE protein activity is restored. It is thus expected that many variations of the replacements described and illustrated herein can be effective for ameliorating HHC.

Another genome engineering strategy involves exon deletion. Targeted deletion of specific exons can be an attractive strategy for treating a large subset of patients with a single therapeutic cocktail. Deletions can either be single exon deletions or multi-exon deletions. While multi-exon deletions can reach a larger number of patients, for larger deletions the efficiency of deletion greatly decreases with increased size. Therefore, deletions range can be from 40 to 10,000 base pairs (bp) in size. For example, deletions can range from 40-100; 100-300; 300-500; 500-1,000; 1,000-2,000; 2,000-3,000; 3,000-5,000; or 5,000-10,000 base pairs in size.

As stated previously, the HFE gene contains 7 exons. Any one or more of the 7 exons, or aberrant intronic splice acceptor or donor sites, may be deleted in order to restore the HFE reading frame. In some embodiments, the methods provide gRNA pairs that can be used to delete exons 1, 2, 3, 4, 5, 6, 7 or any combinations thereof.

In order to ensure that the pre-mRNA is properly processed following deletion, the surrounding splicing signals can be deleted. Splicing donor and acceptors are generally within 100 base pairs of the neighboring intron. Therefore, in some examples, methods can provide all gRNAs that cut approximately +/−100-3100 bp with respect to each exon/intron junction of interest.

For any of the genome editing strategies, gene editing can be confirmed by sequencing or PCR analysis.

Target Sequence Selection

Shifts in the location of the 5' boundary and/or the 3' boundary relative to particular reference loci can be used to facilitate or enhance particular applications of gene editing, which depend in part on the endonuclease system selected for the editing, as further described and illustrated herein.

In a first nonlimiting example of such target sequence selection, many endonuclease systems have rules or criteria that can guide the initial selection of potential target sites for cleavage, such as the requirement of a PAM sequence motif in a particular position adjacent to the DNA cleavage sites in the case of CRISPR Type II or Type V endonucleases.

In another nonlimiting example of target sequence selection or optimization, the frequency of off-target activity for a particular combination of target sequence and gene editing endonuclease (i.e. the frequency of DSBs occurring at sites other than the selected target sequence) can be assessed relative to the frequency of on-target activity. In some cases, cells that have been correctly edited at the desired locus can have a selective advantage relative to other cells. Illustrative, but nonlimiting, examples of a selective advantage include the acquisition of attributes such as enhanced rates of replication, persistence, resistance to certain conditions, enhanced rates of successful engraftment or persistence in vivo following introduction into a patient, and other attributes associated with the maintenance or increased numbers or viability of such cells. In other cases, cells that have been correctly edited at the desired locus can be positively selected for by one or more screening methods used to identify, sort or otherwise select for cells that have been correctly edited. Both selective advantage and directed selection methods can take advantage of the phenotype associated with the correction. In some cases, cells can be edited two or more times in order to create a second modification that creates a new phenotype that is used to select or purify the intended population of cells. Such a second modification could be created by adding a second gRNA for a selectable or screenable marker. In some cases, cells can be correctly edited at the desired locus using a DNA fragment that contains the cDNA and also a selectable marker.

Whether any selective advantage is applicable or any directed selection is to be applied in a particular case, target sequence selection can also be guided by consideration of off-target frequencies in order to enhance the effectiveness of the application and/or reduce the potential for undesired alterations at sites other than the desired target. As described further and illustrated herein and in the art, the occurrence of off-target activity can be influenced by a number of factors including similarities and dissimilarities between the target site and various off-target sites, as well as the particular endonuclease used. Bioinformatics tools are available that assist in the prediction of off-target activity, and frequently such tools can also be used to identify the most likely sites of off-target activity, which can then be assessed in experimental settings to evaluate relative frequencies of off-target to on-target activity, thereby allowing the selection of sequences that have higher relative on-target activities. Illustrative examples of such techniques are provided herein, and others are known in the art.

Another aspect of target sequence selection relates to homologous recombination events. Sequences sharing regions of homology can serve as focal points for homologous recombination events that result in deletion of intervening sequences. Such recombination events occur during the normal course of replication of chromosomes and other DNA sequences, and also at other times when DNA sequences are being synthesized, such as in the case of repairs of double-strand breaks (DSBs), which occur on a regular basis during the normal cell replication cycle but can also be enhanced by the occurrence of various events (such as UV light and other inducers of DNA breakage) or the presence of certain agents (such as various chemical inducers). Many such inducers cause DSBs to occur indiscriminately in the genome, and DSBs can be regularly induced and repaired in normal cells. During repair, the original sequence can be reconstructed with complete fidelity, however, in some cases, small insertions or deletions (referred to as "indels") are introduced at the DSB site.

DSBs can also be specifically induced at particular locations, as in the case of the endonucleases systems described herein, which can be used to cause directed or preferential gene modification events at selected chromosomal locations. The tendency for homologous sequences to be subject to recombination in the context of DNA repair (as well as replication) can be taken advantage of in a number of circumstances, and is the basis for one application of gene editing systems, such as CRISPR, in which homology directed repair is used to insert a sequence of interest, provided through use of a "donor" polynucleotide, into a desired chromosomal location.

Regions of homology between particular sequences, which can be small regions of "microhomology" that can comprise as few as ten basepairs or less, can also be used to bring about desired deletions. For example, a single DSB can be introduced at a site that exhibits microhomology with a nearby sequence. During the normal course of repair of such DSB, a result that occurs with high frequency is the deletion of the intervening sequence as a result of recombination being facilitated by the DSB and concomitant cellular repair process.

In some circumstances, however, selecting target sequences within regions of homology can also give rise to much larger deletions, including gene fusions (when the deletions are in coding regions), which may or may not be desired given the particular circumstances.

The examples provided herein further illustrate the selection of various target regions for the creation of DSBs designed to induce replacements that result in restoration of HFE protein activity, as well as the selection of specific target sequences within such regions that are designed to minimize off-target events relative to on-target events.

Nucleic Acid Modifications

In some cases, polynucleotides introduced into cells can comprise one or more modifications that can be used individually or in combination, for example, to enhance activity, stability or specificity, alter delivery, reduce innate immune responses in host cells, or for other enhancements, as further described herein and known in the art.

In certain examples, modified polynucleotides can be used in the CRISPR/Cas9/Cpf1 system, in which case the guide RNAs (either single-molecule guides or double-molecule guides) and/or a DNA or an RNA encoding a Cas or Cpf1 endonuclease introduced into a cell can be modified, as described and illustrated below. Such modified polynucleotides can be used in the CRISPR/Cas9/Cpf1 system to edit any one or more genomic loci.

Using the CRISPR/Cas9/Cpf1 system for purposes of nonlimiting illustrations of such uses, modifications of guide RNAs can be used to enhance the formation or stability of the CRISPR/Cas9/Cpf1 genome editing complex comprising guide RNAs, which can be single-molecule guides or double-molecule, and a Cas or Cpf1 endonuclease. Modifications of guide RNAs can also or alternatively be used to enhance the initiation, stability or kinetics of interactions between the genome editing complex with the target sequence in the genome, which can be used, for example, to enhance on-target activity. Modifications of guide RNAs can also or alternatively be used to enhance specificity, e.g., the relative rates of genome editing at the on-target site as compared to effects at other (off-target) sites.

Modifications can also or alternatively be used to increase the stability of a guide RNA, e.g., by increasing its resistance to degradation by ribonucleases (RNases) present in a cell, thereby causing its half-life in the cell to be increased. Modifications enhancing guide RNA half-life can be particularly useful in aspects in which a Cas or Cpf1 endonuclease is introduced into the cell to be edited via an RNA that needs to be translated in order to generate endonuclease, because increasing the half-life of guide RNAs introduced at the same time as the RNA encoding the endonuclease can be used to increase the time that the guide RNAs and the encoded Cas or Cpf1 endonuclease co-exist in the cell.

Modifications can also or alternatively be used to decrease the likelihood or degree to which RNAs introduced into cells elicit innate immune responses. Such responses, which have been well characterized in the context of RNA interference (RNAi), including small-interfering RNAs (siRNAs), as described below and in the art, tend to be associated with reduced half-life of the RNA and/or the elicitation of cytokines or other factors associated with immune responses.

One or more types of modifications can also be made to RNAs encoding an endonuclease that are introduced into a cell, including, without limitation, modifications that enhance the stability of the RNA (such as by increasing its degradation by RNAses present in the cell), modifications that enhance translation of the resulting product (i.e. the endonuclease), and/or modifications that decrease the likelihood or degree to which the RNAs introduced into cells elicit innate immune responses.

Combinations of modifications, such as the foregoing and others, can likewise be used. In the case of CRISPR/Cas9/Cpf1, for example, one or more types of modifications can be made to guide RNAs (including those exemplified above), and/or one or more types of modifications can be made to RNAs encoding Cas endonuclease (including those exemplified above).

By way of illustration, guide RNAs used in the CRISPR/Cas9/Cpf1 system, or other smaller RNAs can be readily synthesized by chemical means, enabling a number of modifications to be readily incorporated, as illustrated below and described in the art. While chemical synthetic procedures are continually expanding, purifications of such RNAs by procedures such as high performance liquid chromatography (HPLC, which avoids the use of gels such as PAGE) tends to become more challenging as polynucleotide lengths increase significantly beyond a hundred or so nucleotides. One approach that can be used for generating chemically-modified RNAs of greater length is to produce two or more molecules that are ligated together. Much longer RNAs, such as those encoding a Cas9 endonuclease, are more readily generated enzymatically. While fewer types of modifications are available for use in enzymatically produced RNAs, there are still modifications that can be used to, e.g., enhance stability, reduce the likelihood or degree of innate immune response, and/or enhance other attributes, as described further below and in the art; and new types of modifications are regularly being developed.

By way of illustration of various types of modifications, especially those used frequently with smaller chemically synthesized RNAs, modifications can comprise one or more nucleotides modified at the 2' position of the sugar, in some aspects a 2'-O-alkyl, 2'-O-alkyl-O-alkyl, or 2'-fluoro-modified nucleotide. In some examples, RNA modifications can comprise 2'-fluoro, 2'-amino or 2' O-methyl modifications on the ribose of pyrimidines, abasic residues, or an inverted base at the 3' end of the RNA. Such modifications can be routinely incorporated into oligonucleotides and these oligonucleotides have been shown to have a higher Tm (i.e., higher target binding affinity) than 2'-deoxyoligonucleotides against a given target.

A number of nucleotide and nucleoside modifications have been shown to make the oligonucleotide into which they are incorporated more resistant to nuclease digestion than the native oligonucleotide; these modified oligos survive intact for a longer time than unmodified oligonucleotides. Specific examples of modified oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. Some oligonucleotides are oligonucleotides with phosphorothioate backbones and those with heteroatom backbones, particularly $CH_2$—NH—O—$CH_2$, $CH$,~$N(CH_3)$~O~$CH_2$ (known as a methylene(methylimino) or MMI backbone), $CH_2$—O—$N(CH_3)$—$CH_2$, $CH_2$—$N(CH_3)$—$N(CH_3)$—$CH_2$ and O—$N(CH_3)$—$CH_2$—$CH_2$ backbones, wherein the native phosphodiester backbone is represented as O—P—O—$CH_2$); amide backbones [see De Mesmaeker et al., Ace. Chem. Res., 28:366-374 (1995)]; morpholino backbone structures (see Summerton and Weller, U.S. Pat. No. 5,034,506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone, see Nielsen et al., Science 1991, 254, 1497). Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050.

Morpholino-based oligomeric compounds are described in Braasch and David Corey, Biochemistry, 41(14): 4503-4510 (2002); Genesis, Volume 30, Issue 3, (2001); Heasman, Dev. Biol., 243: 209-214 (2002); Nasevicius et al., Nat. Genet., 26:216-220 (2000); Lacerra et al., Proc. Natl. Acad. Sci 97: 9591-9596 (2000); and U.S. Pat. No. 5,034,506, issued Jul. 23, 1991.

Cyclohexenyl nucleic acid oligonucleotide mimetics are described in Wang et al., J. Am. Chem. Soc., 122: 8595-8602 (2000).

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and $CH_2$ component parts; see U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439.

One or more substituted sugar moieties can also be included, e.g., one of the following at the 2' position: OH, SH, $SCH_3$, F, OCN, $OCH_3OCH_3$, $OCH_3O(CH_2)n$ $CH_3$, $O(CH_2)n$ $NH_2$, or $O(CH_2)n$ $CH_3$, where n is from 1 to about 10; C1 to C10 lower alkyl, alkoxyalkoxy, substituted lower alkyl, alkaryl or aralkyl; Cl; Br; ON; $CF_3$, $OCF_3$; O-, S-, or N-alkyl; O-, S-, or N-alkenyl; $SOCH_3$; $SO_2CH_3$; $ONO_2$; $NO_2$; $N_3$; $NH_2$; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. In some aspects, a modification includes 2'-methoxyethoxy (2'-O—$CH_2CH_2OCH_3$, also known as 2'-O-(2-methoxyethyl)) (Martin et al, Helv. Chim. Acta, 1995, 78, 486). Other modifications include 2'-methoxy (2'-O—$CH_3$), 2'-propoxy (2'-$OCH_2CH_2CH_3$) and 2'-fluoro (2'-F). Similar modifications can also be made at other positions on the oligonucleotide, particularly the 3' position of the sugar on the 3' terminal nucleotide and the 5' position of 5' terminal nucleotide. Oligonucleotides can also have sugar mimetics, such as cyclobutyls in place of the pentofuranosyl group.

In some examples, both a sugar and an internucleoside linkage, i.e., the backbone, of the nucleotide units can be replaced with novel groups. The base units can be maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide can be replaced with an amide containing backbone, for example, an aminoethylglycine backbone. The nucleobases can be retained and bound directly or indirectly to aza nitrogen atoms of the amide portion of the backbone. Representative United States patents that teach the preparation of PNA compounds comprise, but are not limited to, U.S. Pat. Nos. 5,539,082; 5,714,331; and 5,719,262. Further teaching of PNA compounds can be found in Nielsen et al, Science, 254: 1497-1500 (1991).

Guide RNAs can also include, additionally or alternatively, nucleobase (often referred to in the art simply as "base") modifications or substitutions. As used herein, "unmodified" or "natural" nucleobases include adenine (A), guanine (G), thymine (T), cytosine (C), and uracil (U). Modified nucleobases include nucleobases found only infrequently or transiently in natural nucleic acids, e.g., hypoxanthine, 6-methyladenine, 5-Me pyrimidines, particularly 5-methylcytosine (also referred to as 5-methyl-2' deoxycytosine and often referred to in the art as 5-Me-C), 5-hydroxymethylcytosine (HMC), glycosyl HMC and gentobiosyl HMC, as well as synthetic nucleobases, e.g., 2-aminoadenine, 2-(methylamino)adenine, 2-(imidazolylalkyl) adenine, 2-(aminoalklyamino)adenine or other heterosubstituted alkyladenines, 2-thiouracil, 2-thiothymine, 5-bromouracil, 5-hydroxymethyluracil, 8-azaguanine, 7-deazaguanine, N6 (6-am inohexyl)adenine, and 2,6-diaminopurine. Kornberg, A., DNA Replication, W. H. Freeman & Co., San Francisco, pp 75-77 (1980); Gebeyehu et al., Nucl. Acids Res. 15:4513 (1997). A "universal" base known in the art, e.g., inosine, can also be included. 5-Me-C substitutions have been shown to increase nucleic acid duplex stability by 0.6-1.2° C. (Sanghvi, Y. S., in Crooke, S. T. and Lebleu, B., eds., Antisense Research and Applications, CRC Press, Boca Raton, 1993, pp. 276-278) and are aspects of base substitutions.

Modified nucleobases can comprise other synthetic and natural nucleobases, such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazaguanine and 7-deazaadenine, and 3-deazaguanine and 3-deazaadenine.

Further, nucleobases can comprise those disclosed in U.S. Pat. No. 3,687,808, those disclosed in 'The Concise Encyclopedia of Polymer Science And Engineering', pages 858-859, Kroschwitz, J. I., ed. John Wiley & Sons, 1990, those disclosed by Englisch et al., Angewandle Chemie, International Edition', 1991, 30, page 613, and those disclosed by Sanghvi, Y. S., Chapter 15, Antisense Research and Applications', pages 289-302, Crooke, S. T. and Lebleu, B. ea., CRC Press, 1993. Certain of these nucleobases are particularly useful for increasing the binding affinity of the oligomeric compounds of the invention. These include 5-substituted pyrimidines, 6-azapyrimidines and N-2, N-6 and O-6 substituted purines, comprising 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., eds, 'Antisense Research and Applications', CRC Press, Boca Raton, 1993, pp. 276-278) and are aspects of base substitutions, even more particularly when combined with 2'-O-methoxyethyl sugar modifications. Modified nucleobases are described in U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,596,091; 5,614,617; 5,681,941; 5,750,692; 5,763,588; 5,830,653; 6,005,096; and US Patent Application Publication 2003/0158403.

Thus, the term "modified" refers to a non-natural sugar, phosphate, or base that is incorporated into a guide RNA, an endonuclease, or both a guide RNA and an endonuclease. It is not necessary for all positions in a given oligonucleotide to be uniformly modified, and in fact more than one of the aforementioned modifications can be incorporated in a single oligonucleotide, or even in a single nucleoside within an oligonucleotide.

The guide RNAs and/or mRNA (or DNA) encoding an endonuclease can be chemically linked to one or more moieties or conjugates that enhance the activity, cellular distribution, or cellular uptake of the oligonucleotide. Such moieties comprise, but are not limited to, lipid moieties such as a cholesterol moiety [Letsinger et al., Proc. Natl. Acad. Sci. USA, 86: 6553-6556 (1989)]; cholic acid [Manoharan et al., Bioorg. Med. Chem. Let., 4: 1053-1060 (1994)]; a thioether, e.g., hexyl-S-tritylthiol [Manoharan et al, Ann. N. Y. Acad. Sci., 660: 306-309 (1992) and Manoharan et al., Bioorg. Med. Chem. Let., 3: 2765-2770 (1993)]; a thiocholesterol [Oberhauser et al., Nucl. Acids Res., 20: 533-538 (1992)]; an aliphatic chain, e.g., dodecandiol or undecyl residues [Kabanov et al., FEBS Lett., 259: 327-330 (1990) and Svinarchuk et al., Biochimie, 75: 49-54 (1993)]; a phospholipid, e.g., di-hexadecyl-rac-glycerol or triethylammonium 1,2-di-O-hexadecyl-rac-glycero-3-H-phosphonate [Manoharan et al., Tetrahedron Lett., 36: 3651-3654 (1995) and Shea et al., Nucl. Acids Res., 18: 3777-3783 (1990)]; a polyamine or a polyethylene glycol chain [Mancharan et al., Nucleosides & Nucleotides, 14: 969-973 (1995)]; adamantane acetic acid [Manoharan et al., Tetrahedron Lett., 36: 3651-3654 (1995)]; a palmityl moiety [(Mishra et al., Biochim. Biophys. Acta, 1264: 229-237 (1995)]; or an octadecylamine or hexylamino-carbonyl-t oxycholesterol moiety [Crooke et al., J. Pharmacol. Exp. Ther., 277: 923-937 (1996)]. See also U.S. Pat. Nos. 4,828,979; 4,948,882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599, 928 and 5,688,941.

Sugars and other moieties can be used to target proteins and complexes comprising nucleotides, such as cationic polysomes and liposomes, to particular sites. For example, hepatic cell directed transfer can be mediated via asialoglycoprotein receptors (ASGPRs); see, e.g., Hu, et al., Protein Pept Lett. 21(10):1025-30 (2014). Other systems known in the art and regularly developed can be used to target biomolecules of use in the present case and/or complexes thereof to particular target cells of interest.

These targeting moieties or conjugates can include conjugate groups covalently bound to functional groups, such as primary or secondary hydroxyl groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this disclosure, include groups that improve uptake, enhance resistance to degradation, and/or strengthen sequence-specific hybridization with the target nucleic acid. Groups that enhance the pharmacokinetic properties, in the context of this invention, include groups that improve uptake, distribution, metabolism or excretion of the compounds of the present invention. Representative conjugate groups are disclosed in International Patent Application No. PCT/US92/09196, filed Oct. 23, 1992, and U.S. Pat. No. 6,287,860. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy cholesterol moiety. See, e.g., U.S. Pat. Nos. 4,828,979; 4,948,882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

Longer polynucleotides that are less amenable to chemical synthesis and are typically produced by enzymatic synthesis can also be modified by various means. Such modifications can include, for example, the introduction of certain nucleotide analogs, the incorporation of particular sequences or other moieties at the 5' or 3' ends of molecules, and other modifications. By way of illustration, the mRNA encoding Cas9 is approximately 4 kb in length and can be synthesized by in vitro transcription. Modifications to the mRNA can be applied to, e.g., increase its translation or stability (such as by increasing its resistance to degradation with a cell), or to reduce the tendency of the RNA to elicit an innate immune response that is often observed in cells following introduction of exogenous RNAs, particularly longer RNAs such as that encoding Cas9.

Numerous such modifications have been described in the art, such as polyA tails, 5' cap analogs (e.g., Anti Reverse Cap Analog (ARCA) or m7G(5')ppp(5')G (mCAP)), modified 5' or 3' untranslated regions (UTRs), use of modified bases (such as Pseudo-UTP, 2-Thio-UTP, 5-Methylcytidine-5'-Triphosphate (5-Methyl-CTP) or N6-Methyl-ATP), or treatment with phosphatase to remove 5' terminal phosphates. These and other modifications are known in the art, and new modifications of RNAs are regularly being developed.

There are numerous commercial suppliers of modified RNAs, including for example, TriLink Biotech, AxoLabs, Bio-Synthesis Inc., Dharmacon and many others. As described by TriLink, for example, 5-Methyl-CTP can be used to impart desirable characteristics, such as increased nuclease stability, increased translation or reduced interaction of innate immune receptors with in vitro transcribed RNA. 5-Methylcytidine-5'-Triphosphate (5-Methyl-CTP), N6-Methyl-ATP, as well as Pseudo-UTP and 2-Thio-UTP, have also been shown to reduce innate immune stimulation in culture and in vivo while enhancing translation, as illustrated in publications by Kormann et al. and Warren et al. referred to below.

It has been shown that chemically modified mRNA delivered in vivo can be used to achieve improved therapeutic effects; see, e.g., Kormann et al., Nature Biotechnology 29, 154-157 (2011). Such modifications can be used, for example, to increase the stability of the RNA molecule and/or reduce its immunogenicity. Using chemical modifications such as Pseudo-U, N6-Methyl-A, 2-Thio-U and 5-Methyl-C, it was found that substituting just one quarter of the uridine and cytidine residues with 2-Thio-U and 5-Methyl-C respectively resulted in a significant decrease in toll-like receptor (TLR) mediated recognition of the mRNA in mice. By reducing the activation of the innate immune system, these modifications can be used to effectively increase the stability and longevity of the mRNA in vivo; see, e.g., Kormann et al., supra.

It has also been shown that repeated administration of synthetic messenger RNAs incorporating modifications designed to bypass innate anti-viral responses can reprogram differentiated human cells to pluripotency. See, e.g., Warren, et al., Cell Stem Cell, 7(5):618-30 (2010). Such modified mRNAs that act as primary reprogramming proteins can be an efficient means of reprogramming multiple human cell types. Such cells are referred to as induced pluripotency stem cells (iPSCs), and it was found that enzymatically synthesized RNA incorporating 5-Methyl-CTP, Pseudo-UTP and an Anti Reverse Cap Analog (ARCA) could be used to effectively evade the cell's antiviral response; see, e.g., Warren et al., supra.

Other modifications of polynucleotides described in the art include, for example, the use of polyA tails, the addition of 5' cap analogs (such as m7G(5')ppp(5')G (mCAP)), modifications of 5' or 3' untranslated regions (UTRs), or treatment with phosphatase to remove 5' terminal phosphates—and new approaches are regularly being developed.

A number of compositions and techniques applicable to the generation of modified RNAs for use herein have been developed in connection with the modification of RNA interference (RNAi), including small-interfering RNAs (siRNAs). siRNAs present particular challenges in vivo because their effects on gene silencing via mRNA interference are generally transient, which can require repeat administration. In addition, siRNAs are double-stranded RNAs (dsRNA) and mammalian cells have immune responses that have evolved to detect and neutralize dsRNA, which is often a by-product of viral infection. Thus, there are mammalian enzymes such as PKR (dsRNA-responsive kinase), and potentially retinoic acid-inducible gene I (RIG-I), that can mediate cellular responses to dsRNA, as well as Toll-like receptors (such as TLR3, TLR7 and TLR8) that can trigger the induction of cytokines in response to such molecules; see, e.g., the reviews by Angart et al., Pharmaceuticals (Basel) 6(4): 440-468 (2013); Kanasty et al., Molecular Therapy 20(3): 513-524 (2012); Burnett et al., Biotechnol J. 6(9):1130-46 (2011); Judge and MacLachlan, Hum Gene Ther 19(2):111-24 (2008); and references cited therein.

A large variety of modifications have been developed and applied to enhance RNA stability, reduce innate immune responses, and/or achieve other benefits that can be useful in connection with the introduction of polynucleotides into human cells, as described herein; see, e.g., the reviews by Whitehead K A et al., Annual Review of Chemical and Biomolecular Engineering, 2: 77-96 (2011); Gaglione and Messere, Mini Rev Med Chem, 10(7):578-95 (2010); Chernolovskaya et al, Curr Opin Mol Ther., 12(2):158-67 (2010); Deleavey et al., Curr Protoc Nucleic Acid Chem Chapter 16:Unit 16.3 (2009); Behlke, Oligonucleotides 18(4):305-19 (2008); Fucini et al., Nucleic Acid Ther 22(3): 205-210 (2012); Bremsen et al., Front Genet 3:154 (2012).

As noted above, there are a number of commercial suppliers of modified RNAs, many of which have specialized in modifications designed to improve the effectiveness of siRNAs. A variety of approaches are offered based on various findings reported in the literature. For example, Dharmacon notes that replacement of a non-bridging oxygen with sulfur (phosphorothioate, PS) has been extensively used to improve nuclease resistance of siRNAs, as reported by Kole, Nature Reviews Drug Discovery 11:125-140 (2012). Modifications of the 2'-position of the ribose have been reported to improve nuclease resistance of the internucleotide phosphate bond while increasing duplex stability (Tm), which has also been shown to provide protection from immune activation. A combination of moderate PS backbone modifications with small, well-tolerated 2'-substitutions (2'-O-Methyl, 2'-Fluoro, 2'-Hydro) have been associated with highly stable siRNAs for applications in vivo, as reported by Soutschek et al. Nature 432:173-178 (2004); and 2'-O-Methyl modifications have been reported to be effective in improving stability as reported by Volkov, Oligonucleotides 19:191-202 (2009). With respect to decreasing the induction of innate immune responses, modifying specific sequences with 2'-O-Methyl, 2'-Fluoro, 2'-Hydro have been reported to reduce TLR7/TLR8 interaction while generally preserving silencing activity; see, e.g., Judge et al., Mol. Ther. 13:494-505 (2006); and Cekaite et al., J. Mol. Biol. 365:90-108 (2007). Additional modifications, such as 2-thiouracil, pseudouracil, 5-methylcytosine, 5-methyluracil, and N6-methyladenosine have also been shown to minimize the immune effects mediated by TLR3, TLR7, and TLR8; see, e.g., Kariko, K. et al., Immunity 23:165-175 (2005).

As is also known in the art, and commercially available, a number of conjugates can be applied to polynucleotides, such as RNAs, for use herein that can enhance their delivery and/or uptake by cells, including for example, cholesterol, tocopherol and folic acid, lipids, peptides, polymers, linkers and aptamers; see, e.g., the review by Winkler, Ther. Deliv. 4:791-809 (2013), and references cited therein.

Codon-Optimization

A polynucleotide encoding a site-directed polypeptide can be codon-optimized according to methods standard in the art for expression in the cell containing the target DNA of interest. For example, if the intended target nucleic acid is in a human cell, a human codon-optimized polynucleotide encoding Cas9 is contemplated for use for producing the Cas9 polypeptide.

Complexes of a Genome-Targeting Nucleic Acid and a Site-Directed Polypeptide

A genome-targeting nucleic acid interacts with a site-directed polypeptide (e.g., a nucleic acid-guided nuclease such as Cas9), thereby forming a complex. The genome-targeting nucleic acid guides the site-directed polypeptide to a target nucleic acid.

RNPs

The site-directed polypeptide and genome-targeting nucleic acid can each be administered separately to a cell or a patient. On the other hand, the site-directed polypeptide can be pre-complexed with one or more guide RNAs, or one or more crRNA together with a tracrRNA. The pre-complexed material can then be administered to a cell or a patient. Such pre-complexed material is known as a ribonucleoprotein particle (RNP).

Nucleic Acids Encoding System Components

The present disclosure provides a nucleic acid comprising a nucleotide sequence encoding a genome-targeting nucleic acid of the disclosure, a site-directed polypeptide of the disclosure, and/or any nucleic acid or proteinaceous molecule necessary to carry out the aspects of the methods of the disclosure.

The nucleic acid encoding a genome-targeting nucleic acid of the disclosure, a site-directed polypeptide of the disclosure, and/or any nucleic acid or proteinaceous molecule necessary to carry out the aspects of the methods of the disclosure can comprise a vector (e.g., a recombinant expression vector).

The term "vector" refers to a nucleic acid molecule capable of transporting another nucleic acid to which it has been linked. One type of vector is a "plasmid", which refers to a circular double-stranded DNA loop into which additional nucleic acid segments can be ligated. Another type of vector is a viral vector, wherein additional nucleic acid segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome.

In some examples, vectors can be capable of directing the expression of nucleic acids to which they are operatively linked. Such vectors are referred to herein as "recombinant expression vectors", or more simply "expression vectors", which serve equivalent functions.

The term "operably linked" means that the nucleotide sequence of interest is linked to regulatory sequence(s) in a manner that allows for expression of the nucleotide sequence. The term "regulatory sequence" is intended to include, for example, promoters, enhancers and other expression control elements (e.g., polyadenylation signals). Such regulatory sequences are well known in the art and are described, for example, in Goeddel; Gene Expression Technology: Methods in Enzymology 185, Academic Press, San Diego, Calif. (1990). Regulatory sequences include those that direct constitutive expression of a nucleotide sequence in many types of host cells, and those that direct expression of the nucleotide sequence only in certain host cells (e.g., tissue-specific regulatory sequences). It will be appreciated by those skilled in the art that the design of the expression vector can depend on such factors as the choice of the target cell, the level of expression desired, and the like.

Expression vectors contemplated include, but are not limited to, viral vectors based on vaccinia virus, poliovirus, adenovirus, adeno-associated virus, SV40, herpes simplex virus, human immunodeficiency virus, retrovirus (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus) and other recombinant vectors. Other vectors contemplated for eukaryotic target cells include, but are not limited to, the vectors pXT1, pSG5, pSVK3, pBPV, pMSG, and pSVLSV40 (Pharmacia). Additional vectors contemplated for eukaryotic target cells include, but are not limited to, the vectors pCTx-1, pCTx-2, and pCTx-3. Other vectors can be used so long as they are compatible with the host cell.

In some examples, a vector can comprise one or more transcription and/or translation control elements. Depending on the host/vector system utilized, any of a number of suitable transcription and translation control elements, including constitutive and inducible promoters, transcription enhancer elements, transcription terminators, etc. can be used in the expression vector. The vector can be a self-inactivating vector that either inactivates the viral sequences or the components of the CRISPR machinery or other elements.

Non-limiting examples of suitable eukaryotic promoters (i.e., promoters functional in a eukaryotic cell) include those from cytomegalovirus (CMV) immediate early, herpes simplex virus (HSV) thymidine kinase, early and late SV40, long terminal repeats (LTRs) from retrovirus, human elongation factor-1 promoter (EF1), a hybrid construct comprising the cytomegalovirus (CMV) enhancer fused to the chicken beta-actin promoter (CAG), murine stem cell virus promoter (MSCV), phosphoglycerate kinase-1 locus promoter (PGK), and mouse metallothionein-I.

For expressing small RNAs, including guide RNAs used in connection with Cas endonuclease, various promoters such as RNA polymerase III promoters, including for example U6 and H1, can be advantageous. Descriptions of and parameters for enhancing the use of such promoters are known in art, and additional information and approaches are regularly being described; see, e.g., Ma, H. et al., *Molecular Therapy-Nucleic Acids* 3, e161 (2014) doi:10.1038/mtna.2014.12.

The expression vector can also contain a ribosome binding site for translation initiation and a transcription terminator. The expression vector can also comprise appropriate sequences for amplifying expression. The expression vector can also include nucleotide sequences encoding non-native tags (e.g., histidine tag, hemagglutinin tag, green fluorescent protein, etc.) that are fused to the site-directed polypeptide, thus resulting in a fusion protein.

A promoter can be an inducible promoter (e.g., a heat shock promoter, tetracycline-regulated promoter, steroid-regulated promoter, metal-regulated promoter, estrogen receptor-regulated promoter, etc.). The promoter can be a constitutive promoter (e.g., CMV promoter, UBC promoter). In some cases, the promoter can be a spatially restricted and/or temporally restricted promoter (e.g., a tissue specific promoter, a cell type specific promoter, etc.).

The nucleic acid encoding a genome-targeting nucleic acid of the disclosure and/or a site-directed polypeptide can be packaged into or on the surface of delivery vehicles for delivery to cells. Delivery vehicles contemplated include, but are not limited to, nanospheres, liposomes, quantum dots, nanoparticles, polyethylene glycol particles, hydrogels, and micelles. As described in the art, a variety of targeting moieties can be used to enhance the preferential interaction of such vehicles with desired cell types or locations.

Introduction of the complexes, polypeptides, and nucleic acids of the disclosure into cells can occur by viral or bacteriophage infection, transfection, conjugation, protoplast fusion, lipofection, electroporation, nucleofection, calcium phosphate precipitation, polyethyleneimine (PEI)-mediated transfection, DEAE-dextran mediated transfection, liposome-mediated transfection, particle gun technology, calcium phosphate precipitation, direct micro-injection, nanoparticle-mediated nucleic acid delivery, and the like.

Delivery

Guide RNA polynucleotides (RNA or DNA) and/or endonuclease polynucleotide(s) (RNA or DNA) can be delivered by viral or non-viral delivery vehicles known in the art. Alternatively, endonuclease polypeptide(s) can be delivered by viral or non-viral delivery vehicles known in the art, such as electroporation or lipid nanoparticles. In further alternative aspects, the DNA endonuclease can be delivered as one or more polypeptides, either alone or pre-complexed with one or more guide RNAs, or one or more crRNA together with a tracrRNA.

Polynucleotides can be delivered by non-viral delivery vehicles including, but not limited to, nanoparticles, liposomes, ribonucleoproteins, positively charged peptides, small molecule RNA-conjugates, aptamer-RNA chimeras, and RNA-fusion protein complexes. Some exemplary non-viral delivery vehicles are described in Peer and Lieberman, Gene Therapy, 18: 1127-1133 (2011) (which focuses on non-viral delivery vehicles for siRNA that are also useful for delivery of other polynucleotides).

Polynucleotides, such as guide RNA, sgRNA, and mRNA encoding an endonuclease, can be delivered to a cell or a patient by a lipid nanoparticle (LNP).

A LNP refers to any particle having a diameter of less than 1000 nm, 500 nm, 250 nm, 200 nm, 150 nm, 100 nm, 75 nm, 50 nm, or 25 nm. Alternatively, a nanoparticle can range in size from 1-1000 nm, 1-500 nm, 1-250 nm, 25-200 nm, 25-100 nm, 35-75 nm, or 25-60 nm.

LNPs can be made from cationic, anionic, or neutral lipids. Neutral lipids, such as the fusogenic phospholipid DOPE or the membrane component cholesterol, can be included in LNPs as 'helper lipids' to enhance transfection activity and nanoparticle stability. Limitations of cationic lipids include low efficacy owing to poor stability and rapid clearance, as well as the generation of inflammatory or anti-inflammatory responses.

LNPs can also be comprised of hydrophobic lipids, hydrophilic lipids, or both hydrophobic and hydrophilic lipids.

Any lipid or combination of lipids that are known in the art can be used to produce a LNP. Examples of lipids used to produce LNPs are: DOTMA, DOSPA, DOTAP, DMRIE, DC-cholesterol, DOTAP-cholesterol, GAP-DMORIE-DPyPE, and GL67A-DOPE-DMPE-polyethylene glycol (PEG). Examples of cationic lipids are: 98N12-5, C12-200, DLin-KC2-DMA (KC2), DLin-MC3-DMA (MC3), XTC, MD1, and 7C1. Examples of neutral lipids are: DPSC, DPPC, POPC, DOPE, and SM. Examples of PEG-modified lipids are: PEG-DMG, PEG-CerC14, and PEG-CerC20.

The lipids can be combined in any number of molar ratios to produce a LNP. In addition, the polynucleotide(s) can be combined with lipid(s) in a wide range of molar ratios to produce a LNP.

As stated previously, the site-directed polypeptide and genome-targeting nucleic acid can each be administered separately to a cell or a patient. On the other hand, the site-directed polypeptide can be pre-complexed with one or more guide RNAs, or one or more crRNA together with a tracrRNA. The pre-complexed material can then be administered to a cell or a patient. Such pre-complexed material is known as a ribonucleoprotein particle (RNP).

RNA is capable of forming specific interactions with RNA or DNA. While this property is exploited in many biological processes, it also comes with the risk of promiscuous interactions in a nucleic acid-rich cellular environment. One solution to this problem is the formation of ribonucleoprotein particles (RNPs), in which the RNA is pre-complexed with an endonuclease. Another benefit of the RNP is protection of the RNA from degradation.

The endonuclease in the RNP can be modified or unmodified. Likewise, the gRNA, crRNA, tracrRNA, or sgRNA can be modified or unmodified. Numerous modifications are known in the art and can be used.

The endonuclease and sgRNA can be generally combined in a 1:1 molar ratio. Alternatively, the endonuclease, crRNA and tracrRNA can be generally combined in a 1:1:1 molar ratio. However, a wide range of molar ratios can be used to produce a RNP.

A recombinant adeno-associated virus (AAV) vector can be used for delivery. Techniques to produce rAAV particles, in which an AAV genome to be packaged that includes the polynucleotide to be delivered, rep and cap genes, and helper virus functions are provided to a cell are standard in the art. Production of rAAV typically requires that the following components are present within a single cell (denoted herein as a packaging cell): a rAAV genome, AAV rep and cap genes separate from (i.e., not in) the rAAV genome, and helper virus functions. The AAV rep and cap genes may be from any AAV serotype for which recombinant virus can be derived, and may be from a different AAV serotype than the rAAV genome ITRs, including, but not limited to, AAV serotypes AAV-1, AAV-2, AAV-3, AAV-4, AAV-5, AAV-6, AAV-7, AAV-8, AAV-9, AAV-10, AAV-11, AAV-12, AAV-13 and AAV rh.74. Production of pseudotyped rAAV is disclosed in, for example, international patent application publication number WO 01/83692. See Table 3.

TABLE 3

| AAV Serotype | Genbank Accession No. |
|---|---|
| AAV-1 | NC_002077.1 |
| AAV-2 | NC_001401.2 |
| AAV-3 | NC_001729.1 |
| AAV-3B | AF028705.1 |
| AAV-4 | NC_001829.1 |
| AAV-5 | NC_006152.1 |
| AAV-6 | AF028704.1 |
| AAV-7 | NC_006260.1 |
| AAV-8 | NC_006261.1 |
| AAV-9 | AX753250.1 |
| AAV-10 | AY631965.1 |
| AAV-11 | AY631966.1 |
| AAV-12 | DQ813647.1 |
| AAV-13 | EU285562.1 |

A method of generating a packaging cell involves creating a cell line that stably expresses all of the necessary components for AAV particle production. For example, a plasmid (or multiple plasmids) comprising a rAAV genome lacking AAV rep and cap genes, AAV rep and cap genes separate from the rAAV genome, and a selectable marker, such as a neomycin resistance gene, are integrated into the genome of a cell. AAV genomes have been introduced into bacterial plasmids by procedures such as GC tailing (Samulski et al., 1982, Proc. Natl. Acad. S6. USA, 79:2077-2081), addition of synthetic linkers containing restriction endonuclease cleavage sites (Laughlin et al., 1983, Gene, 23:65-73) or by direct, blunt-end ligation (Senapathy & Carter, 1984, J. Biol. Chem., 259:4661-4666). The packaging cell line can then be infected with a helper virus, such as adenovirus. The advantages of this method are that the cells are selectable and are suitable for large-scale production of rAAV. Other examples of suitable methods employ adenovirus or baculovirus, rather than plasmids, to introduce rAAV genomes and/or rep and cap genes into packaging cells.

General principles of rAAV production are reviewed in, for example, Carter, 1992, Current Opinions in Biotechnology, 1533-539; and Muzyczka, 1992, Curr. Topics in Microbial. and Immunol., 158:97-129). Various approaches are described in Ratschin et al., Mol. Cell. Biol. 4:2072 (1984); Hermonat et al., Proc. Natl. Acad. Sci. USA, 81:6466 (1984); Tratschin et al., Mol. Cell. Biol. 5:3251 (1985); McLaughlin et al., J. Virol., 62:1963 (1988); and Lebkowski et al., 1988 Mol. Cell. Biol., 7:349 (1988). Samulski et al.

(1989, J. Virol., 63:3822-3828); U.S. Pat. No. 5,173,414; WO 95/13365 and corresponding U.S. Pat. No. 5,658,776; WO 95/13392; WO 96/17947; PCT/US98/18600; WO 97/09441 (PCT/US96/14423); WO 97/08298 (PCT/US96/13872); WO 97/21825 (PCT/US96/20777); WO 97/06243 (PCT/FR96/01064); WO 99/11764; Perrin et al. (1995) Vaccine 13:1244-1250; Paul et al. (1993) Human Gene Therapy 4:609-615; Clark et al. (1996) Gene Therapy 3:1124-1132; U.S. Pat. Nos. 5,786,211; 5,871,982; and 6,258,595.

AAV vector serotypes can be matched to target cell types. For example, the following exemplary cell types can be transduced by the indicated AAV serotypes among others. See Table 4.

TABLE 4

| Tissue/Cell Type | Serotype |
| --- | --- |
| Liver | AAV8, AA3, AA5, AAV9 |
| Skeletal muscle | AAV1, AAV7, AAV6, AAV8, AAV9 |
| Central nervous system | AAV5, AAV1, AAV4 |
| RPE | AAV5, AAV4 |
| Photoreceptor cells | AAV5 |
| Lung | AAV9 |
| Heart | AAV8 |
| Pancreas | AAV8 |
| Kidney | AAV2, AAV8 |

In addition to adeno-associated viral vectors, other viral vectors can be used. Such viral vectors include, but are not limited to, lentivirus, alphavirus, enterovirus, pestivirus, baculovirus, herpesvirus, Epstein Barr virus, papovavirusr, poxvirus, vaccinia virus, and herpes simplex virus.

In some cases, Cas9 mRNA, sgRNA targeting one or two loci in the HFE gene, and donor DNA can each be separately formulated into lipid nanoparticles, or are all co-formulated into one lipid nanoparticle.

In some cases, Cas9 mRNA can be formulated in a lipid nanoparticle, while sgRNA and donor DNA can be delivered in an AAV vector.

Options are available to deliver the Cas9 nuclease as a DNA plasmid, as mRNA or as a protein. The guide RNA can be expressed from the same DNA, or can also be delivered as an RNA. The RNA can be chemically modified to alter or improve its half-life, or decrease the likelihood or degree of immune response. The endonuclease protein can be complexed with the gRNA prior to delivery. Viral vectors allow efficient delivery; split versions of Cas9 and smaller orthologs of Cas9 can be packaged in AAV, as can donors for HDR. A range of non-viral delivery methods also exist that can deliver each of these components, or non-viral and viral methods can be employed in tandem. For example, nanoparticles can be used to deliver the protein and guide RNA, while AAV can be used to deliver a donor DNA.

Genetically Modified Cells

The term "genetically modified cell" refers to a cell that comprises at least one genetic modification introduced by genome editing (e.g., using the CRISPR/Cas9/Cpf1 system). In some ex vivo examples herein, the genetically modified cell can be genetically modified progenitor cell. In some in vivo examples herein, the genetically modified cell can be a genetically modified liver cell. A genetically modified cell comprising an exogenous genome-targeting nucleic acid and/or an exogenous nucleic acid encoding a genome-targeting nucleic acid is contemplated herein.

The term "control treated population" describes a population of cells that has been treated with identical media, viral induction, nucleic acid sequences, temperature, confluency, flask size, pH, etc., with the exception of the addition of the genome editing components. Any method known in the art can be used to measure restoration of the HFE gene or protein expression or activity, for example Western Blot analysis of the HFE protein or quantifying HFE mRNA.

The term "isolated cell" refers to a cell that has been removed from an organism in which it was originally found, or a descendant of such a cell. Optionally, the cell can be cultured in vitro, e.g., under defined conditions or in the presence of other cells. Optionally, the cell can be later introduced into a second organism or re-introduced into the organism from which it (or the cell from which it is descended) was isolated.

The term "isolated population" with respect to an isolated population of cells refers to a population of cells that has been removed and separated from a mixed or heterogeneous population of cells. In some cases, the isolated population can be a substantially pure population of cells, as compared to the heterogeneous population from which the cells were isolated or enriched. In some cases, the isolated population can be an isolated population of human progenitor cells, e.g., a substantially pure population of human progenitor cells, as compared to a heterogeneous population of cells comprising human progenitor cells and cells from which the human progenitor cells were derived.

The term "substantially enhanced," with respect to a particular cell population, refers to a population of cells in which the occurrence of a particular type of cell is increased relative to pre-existing or reference levels, by at least 2-fold, at least 3-, at least 4-, at least 5-, at least 6-, at least 7-, at least 8-, at least 9, at least 10-, at least 20-, at least 50-, at least 100-, at least 400-, at least 1000-, at least 5000-, at least 20000-, at least 100000- or more fold depending, e.g., on the desired levels of such cells for ameliorating hereditary haemochromatosis.

The term "substantially pure" with respect to a particular cell population, refers to a population of cells that is at least about 75%, at least about 85%, at least about 90%, or at least about 95% pure, with respect to the cells making up a total cell population. That is, the terms "substantially pure" or "essentially purified," with regard to a population of progenitor cells, refers to a population of cells that contain fewer than about 20%, about 15%, about 10%, about 9%, about 8%, about 7%, about 6%, about 5%, about 4%, about 3%, about 2%, about 1%, or less than 1%, of cells that are not progenitor cells as defined by the terms herein.

Differentiation of Genome-Edited iPSCs into Hepatocytes

Another step of the ex vivo methods of the present disclosure can comprise differentiating the genome-edited iPSCs into hepatocytes. The differentiating step can be performed according to any method known in the art. For example, hiPSC are differentiated into definitive endoderm using various treatments, including activin and B27 supplement (Life Technology). The definitive endoderm is further differentiated into hepatocyte, the treatment includes: FGF4, HGF, BMP2, BMP4, Oncostatin M, Dexametason, etc (Duan et al, STEM CELLS; 2010; 28:674-686, Ma et al, STEM CELLS TRANSLATIONAL MEDICINE 2013; 2:409-419).

Differentiation of Genome-Edited Mesenchymal Stem Cells into Hepatocytes

Another step of the ex vivo methods of the present disclosure can comprise differentiating the genome-edited mesenchymal stem cells into hepatocytes. The differentiating step can be performed according to any method known in the art. For example, hMSC are treated with various factors and hormones, including insulin, transferrin, FGF4, HGF, bile acids (Sawitza I et al, Sci Rep. 2015; 5: 13320).

Implanting Cells into Patients

Another step of the ex vivo methods of the present disclosure can comprise implanting liver specific progenitor cells or primary hepatocytes into patients. This implanting step can be accomplished using any method of implantation known in the art. For example, the genetically modified cells can be injected directly in the patient's liver or otherwise administered to the patient. The genetically modified cells may be purified ex vivo using a selected marker.

Pharmaceutically Acceptable Carriers

The ex vivo methods of administering progenitor cells to a subject contemplated herein can involve the use of therapeutic compositions comprising progenitor cells.

Therapeutic compositions can contain a physiologically tolerable carrier together with the cell composition, and optionally at least one additional bioactive agent as described herein, dissolved or dispersed therein as an active ingredient. In some cases, the therapeutic composition is not substantially immunogenic when administered to a mammal or human patient for therapeutic purposes, unless so desired.

In general, the progenitor cells described herein can be administered as a suspension with a pharmaceutically acceptable carrier. One of skill in the art will recognize that a pharmaceutically acceptable carrier to be used in a cell composition will not include buffers, compounds, cryopreservation agents, preservatives, or other agents in amounts that substantially interfere with the viability of the cells to be delivered to the subject. A formulation comprising cells can include e.g., osmotic buffers that permit cell membrane integrity to be maintained, and optionally, nutrients to maintain cell viability or enhance engraftment upon administration. Such formulations and suspensions are known to those of skill in the art and/or can be adapted for use with the progenitor cells, as described herein, using routine experimentation.

A cell composition can also be emulsified or presented as a liposome composition, provided that the emulsification procedure does not adversely affect cell viability. The cells and any other active ingredient can be mixed with excipients that are pharmaceutically acceptable and compatible with the active ingredient, and in amounts suitable for use in the therapeutic methods described herein.

Additional agents included in a cell composition can include pharmaceutically acceptable salts of the components therein. Pharmaceutically acceptable salts include the acid addition salts (formed with the free amino groups of the polypeptide) that are formed with inorganic acids, such as, for example, hydrochloric or phosphoric acids, or such organic acids as acetic, tartaric, mandelic and the like. Salts formed with the free carboxyl groups can also be derived from inorganic bases, such as, for example, sodium, potassium, ammonium, calcium or ferric hydroxides, and such organic bases as isopropylamine, trimethylamine, 2-ethylamino ethanol, histidine, procaine and the like.

Physiologically tolerable carriers are well known in the art. Exemplary liquid carriers are sterile aqueous solutions that contain no materials in addition to the active ingredients and water, or contain a buffer such as sodium phosphate at physiological pH value, physiological saline or both, such as phosphate-buffered saline. Still further, aqueous carriers can contain more than one buffer salt, as well as salts such as sodium and potassium chlorides, dextrose, polyethylene glycol and other solutes. Liquid compositions can also contain liquid phases in addition to and to the exclusion of water. Exemplary of such additional liquid phases are glycerin, vegetable oils such as cottonseed oil, and water-oil emulsions. The amount of an active compound used in the cell compositions that is effective in the treatment of a particular disorder or condition can depend on the nature of the disorder or condition, and can be determined by standard clinical techniques.

Administration & Efficacy

The terms "administering," "introducing" and "transplanting" are used interchangeably in the context of the placement of cells, e.g., progenitor cells, into a subject, by a method or route that results in at least partial localization of the introduced cells at a desired site, such as a site of injury or repair, such that a desired effect(s) is produced. The cells e.g., progenitor cells, or their differentiated progeny, can be administered by any appropriate route that results in delivery to a desired location in the subject where at least a portion of the implanted cells or components of the cells remain viable. The period of viability of the cells after administration to a subject can be as short as a few hours, e.g., twenty-four hours, to a few days, to as long as several years, or even the life time of the patient, i.e., long-term engraftment. For example, in some aspects described herein, an effective amount of myogenic progenitor cells is administered via a systemic route of administration, such as an intraperitoneal or intravenous route.

The terms "individual", "subject," "host" and "patient" are used interchangeably herein and refer to any subject for whom diagnosis, treatment or therapy is desired. In some aspects, the subject is a mammal. In some aspects, the subject is a human being.

When provided prophylactically, progenitor cells described herein can be administered to a subject in advance of any symptom of HHC, e.g., prior to the development of abdominal pain, weakness, lethargy, and weight loss, cirrhosis, progressive increase in skin pigmentation, diabetes mellitus, congestive heart failure, and/or arrhythmias, arthritis, and hypogonadism. Accordingly, the prophylactic administration of a liver progenitor cell population serves to prevent hereditary haemochromatosis.

When provided therapeutically, liver progenitor cells are provided at (or after) the onset of a symptom or indication of hereditary haemochromatosis, e.g., upon the onset of disease.

The liver progenitor cell population being administered according to the methods described herein can comprise allogeneic liver progenitor cells obtained from one or more donors. "Allogeneic" refers to a liver progenitor cell or biological samples comprising liver progenitor cells obtained from one or more different donors of the same species, where the genes at one or more loci are not identical. For example, a liver progenitor cell population being administered to a subject can be derived from one more unrelated donor subjects, or from one or more non-identical siblings. In some cases, syngeneic liver progenitor cell populations can be used, such as those obtained from genetically identical animals, or from identical twins. The liver progenitor cells can be autologous cells; that is, the liver progenitor cells are obtained or isolated from a subject and administered to the same subject, i.e., the donor and recipient are the same.

The term "effective amount" refers to the amount of a population of progenitor cells or their progeny needed to prevent or alleviate at least one or more signs or symptoms of HHC, and relates to a sufficient amount of a composition to provide the desired effect, e.g., to treat a subject having HHC. The term "therapeutically effective amount" therefore refers to an amount of progenitor cells or a composition comprising progenitor cells that is sufficient to promote a particular effect when administered to a typical subject, such as one who has or is at risk for HHC. An effective amount would also include an amount sufficient to prevent or delay the development of a symptom of the disease, alter the course of a symptom of the disease (for example but not limited to, slow the progression of a symptom of the disease), or reverse a symptom of the disease. It is understood that for any given case, an appropriate "effective amount" can be determined by one of ordinary skill in the art using routine experimentation.

For use in the various aspects described herein, an effective amount of progenitor cells comprises at least $10^2$ progenitor cells, at least $5\times10^2$ progenitor cells, at least $10^3$ progenitor cells, at least $5\times10^3$ progenitor cells, at least $10^4$ progenitor cells, at least $5\times10^4$ progenitor cells, at least $10^5$ progenitor cells, at least $2\times10^5$ progenitor cells, at least $3\times10^5$ progenitor cells, at least $4\times10^5$ progenitor cells, at least $5\times10^5$ progenitor cells, at least $6\times10^5$ progenitor cells, at least $7\times10^5$ progenitor cells, at least $8\times10^5$ progenitor cells, at least $9\times10^5$ progenitor cells, at least $1\times10^6$ progenitor cells, at least $2\times10^6$ progenitor cells, at least $3\times10^6$ progenitor cells, at least $4\times10^6$ progenitor cells, at least $5\times10^6$ progenitor cells, at least $6\times10^6$ progenitor cells, at least $7\times10^6$ progenitor cells, at least $8\times10^6$ progenitor cells, at least $9\times10^6$ progenitor cells, or multiples thereof. The progenitor cells can be derived from one or more donors, or can be obtained from an autologous source. In some examples described herein, the progenitor cells can be expanded in culture prior to administration to a subject in need thereof.

Modest and incremental increases in the levels of functional HFE expressed in cells of patients having HHC can be beneficial for ameliorating one or more symptoms of the disease, for increasing long-term survival, and/or for reducing side effects associated with other treatments. Upon administration of such cells to human patients, the presence of liver progenitors that are producing increased levels of functional HFE is beneficial. In some cases, effective treatment of a subject gives rise to at least about 3%, 5% or 7% functional HFE relative to total HFE in the treated subject. In some examples, functional HFE will be at least about 10% of total HFE. In some examples, functional HFE will be at least about 20% to 30% of total HFE. Similarly, the introduction of even relatively limited subpopulations of cells having significantly elevated levels of functional HFE can be beneficial in various patients because in some situations normalized cells will have a selective advantage relative to diseased cells. However, even modest levels of liver progenitors with elevated levels of functional HFE can be beneficial for ameliorating one or more aspects of HHC in patients. In some examples, about 10%, about 20%, about 30%, about 40%, about 50%, about 60%, about 70%, about 80%, about 90% or more of the liver progenitors in patients to whom such cells are administered are producing increased levels of functional HFE.

"Administered" refers to the delivery of a progenitor cell composition into a subject by a method or route that results in at least partial localization of the cell composition at a desired site. A cell composition can be administered by any appropriate route that results in effective treatment in the subject, i.e. administration results in delivery to a desired location in the subject where at least a portion of the composition delivered, i.e. at least $1\times10^4$ cells are delivered to the desired site for a period of time. Modes of administration include injection, infusion, instillation, or ingestion. "Injection" includes, without limitation, intravenous, intra-muscular, intra-arterial, intrathecal, intraventricular, intracapsular, intraorbital, intracardiac, intradermal, intraperitoneal, transtracheal, subcutaneous, subcuticular, intraarticular, sub capsular, subarachnoid, intraspinal, intracerebro spinal, and intrasternal injection and infusion. In some examples, the route is intravenous. For the delivery of cells, administration by injection or infusion can be made.

The cells can be administered systemically. The phrases "systemic administration," "administered systemically", "peripheral administration" and "administered peripherally" refer to the administration of a population of progenitor cells other than directly into a target site, tissue, or organ, such that it enters, instead, the subject's circulatory system and, thus, is subject to metabolism and other like processes.

The efficacy of a treatment comprising a composition for the treatment of HHC can be determined by the skilled clinician. However, a treatment is considered "effective treatment," if any one or all of the signs or symptoms of, as but one example, levels of functional HFE are altered in a beneficial manner (e.g., increased by at least 10%), or other clinically accepted symptoms or markers of disease are improved or ameliorated. Efficacy can also be measured by failure of an individual to worsen as assessed by hospitalization or need for medical interventions (e.g., progression of the disease is halted or at least slowed). Methods of measuring these indicators are known to those of skill in the art and/or described herein. Treatment includes any treatment of a disease in an individual or an animal (some non-limiting examples include a human, or a mammal) and includes: (1) inhibiting the disease, e.g., arresting, or slowing the progression of symptoms; or (2) relieving the disease, e.g., causing regression of symptoms; and (3) preventing or reducing the likelihood of the development of symptoms.

The treatment according to the present disclosure can ameliorate one or more symptoms associated with HHC by increasing the amount of functional HFE in the individual. Early signs typically associated with HHC include for example, abdominal pain, weakness, lethargy, and weight loss, cirrhosis, progressive increase in skin pigmentation, diabetes mellitus, congestive heart failure, and/or arrhythmias, arthritis, and hypogonadism.

Kits

The present disclosure provides kits for carrying out the methods described herein. A kit can include one or more of a genome-targeting nucleic acid, a polynucleotide encoding a genome-targeting nucleic acid, a site-directed polypeptide, a polynucleotide encoding a site-directed polypeptide, and/or any nucleic acid or proteinaceous molecule necessary to carry out the aspects of the methods described herein, or any combination thereof.

A kit can comprise: (1) a vector comprising a nucleotide sequence encoding a genome-targeting nucleic acid, (2) the site-directed polypeptide or a vector comprising a nucleotide sequence encoding the site-directed polypeptide, and (3) a reagent for reconstitution and/or dilution of the vector(s) and or polypeptide.

A kit can comprise: (1) a vector comprising (i) a nucleotide sequence encoding a genome-targeting nucleic acid, and (ii) a nucleotide sequence encoding the site-directed polypeptide; and (2) a reagent for reconstitution and/or dilution of the vector.

In any of the above kits, the kit can comprise a single-molecule guide genome-targeting nucleic acid. In any of the above kits, the kit can comprise a double-molecule genome-targeting nucleic acid. In any of the above kits, the kit can comprise two or more double-molecule guides or single-molecule guides. The kits can comprise a vector that encodes the nucleic acid targeting nucleic acid.

In any of the above kits, the kit can further comprise a polynucleotide to be inserted to effect the desired genetic modification.

Components of a kit can be in separate containers, or combined in a single container.

Any kit described above can further comprise one or more additional reagents, where such additional reagents are selected from a buffer, a buffer for introducing a polypeptide or polynucleotide into a cell, a wash buffer, a control reagent, a control vector, a control RNA polynucleotide, a reagent for in vitro production of the polypeptide from DNA, adaptors for sequencing and the like. A buffer can be a stabilization buffer, a reconstituting buffer, a diluting buffer, or the like. A kit can also comprise one or more components that can be used to facilitate or enhance the on-target binding or the cleavage of DNA by the endonuclease, or improve the specificity of targeting.

In addition to the above-mentioned components, a kit can further comprise instructions for using the components of the kit to practice the methods. The instructions for practicing the methods can be recorded on a suitable recording medium. For example, the instructions can be printed on a substrate, such as paper or plastic, etc. The instructions can be present in the kits as a package insert, in the labeling of the container of the kit or components thereof (i.e., associated with the packaging or subpackaging), etc. The instructions can be present as an electronic storage data file present on a suitable computer readable storage medium, e.g. CD-ROM, diskette, flash drive, etc. In some instances, the actual instructions are not present in the kit, but means for obtaining the instructions from a remote source (e.g. via the Internet), can be provided. An example of this case is a kit that comprises a web address where the instructions can be viewed and/or from which the instructions can be downloaded. As with the instructions, this means for obtaining the instructions can be recorded on a suitable substrate.

Guide RNA Formulation

Guide RNAs of the present disclosure can be formulated with pharmaceutically acceptable excipients such as carriers, solvents, stabilizers, adjuvants, diluents, etc., depending upon the particular mode of administration and dosage form. Guide RNA compositions can be formulated to achieve a physiologically compatible pH, and range from a pH of about 3 to a pH of about 11, about pH 3 to about pH 7, depending on the formulation and route of administration. In some cases, the pH can be adjusted to a range from about pH 5.0 to about pH 8. In some cases, the compositions can comprise a therapeutically effective amount of at least one compound as described herein, together with one or more pharmaceutically acceptable excipients. Optionally, the compositions can comprise a combination of the compounds described herein, or can include a second active ingredient useful in the treatment or prevention of bacterial growth (for example and without limitation, anti-bacterial or anti-microbial agents), or can include a combination of reagents of the present disclosure.

Suitable excipients include, for example, carrier molecules that include large, slowly metabolized macromolecules such as proteins, polysaccharides, polylactic acids, polyglycolic acids, polymeric amino acids, amino acid copolymers, and inactive virus particles. Other exemplary excipients can include antioxidants (for example and without limitation, ascorbic acid), chelating agents (for example and without limitation, EDTA), carbohydrates (for example and without limitation, dextrin, hydroxyalkylcellulose, and hydroxyalkylmethylcellulose), stearic acid, liquids (for example and without limitation, oils, water, saline, glycerol and ethanol), wetting or emulsifying agents, pH buffering substances, and the like.

Other Possible Therapeutic Approaches

Gene editing can be conducted using nucleases engineered to target specific sequences. To date there are four major types of nucleases: meganucleases and their derivatives, zinc finger nucleases (ZFNs), transcription activator like effector nucleases (TALENs), and CRISPR-Cas9 nuclease systems. The nuclease platforms vary in difficulty of design, targeting density and mode of action, particularly as the specificity of ZFNs and TALENs is through protein-DNA interactions, while RNA-DNA interactions primarily guide Cas9. Cas9 cleavage also requires an adjacent motif, the PAM, which differs between different CRISPR systems. Cas9 from *Streptococcus pyogenes* cleaves using a NGG PAM, CRISPR from *Neisseria meningitidis* can cleave at sites with PAMs including NNNNGATT, NNNNNGTTT and NNNNGCTT. A number of other Cas9 orthologs target protospacer adjacent to alternative PAMs.

CRISPR endonucleases, such as Cas9, can be used in the methods of the present disclosure. However, the teachings described herein, such as therapeutic target sites, could be applied to other forms of endonucleases, such as ZFNs, TALENs, HEs, or MegaTALs, or using combinations of nulceases. However, in order to apply the teachings of the present disclosure to such endonucleases, one would need to, among other things, engineer proteins directed to the specific target sites.

Additional binding domains can be fused to the Cas9 protein to increase specificity. The target sites of these constructs would map to the identified gRNA specified site, but would require additional binding motifs, such as for a zinc finger domain. In the case of Mega-TAL, a meganuclease can be fused to a TALE DNA-binding domain. The meganuclease domain can increase specificity and provide the cleavage. Similarly, inactivated or dead Cas9 (dCas9) can be fused to a cleavage domain and require the sgRNA/Cas9 target site and adjacent binding site for the fused DNA-binding domain. This likely would require some protein engineering of the dCas9, in addition to the catalytic inactivation, to decrease binding without the additional binding site.

Zinc Finger Nucleases

Zinc finger nucleases (ZFNs) are modular proteins comprised of an engineered zinc finger DNA binding domain linked to the catalytic domain of the type II endonuclease FokI. Because FokI functions only as a dimer, a pair of ZFNs must be engineered to bind to cognate target "half-site" sequences on opposite DNA strands and with precise spacing between them to enable the catalytically active FokI dimer to form. Upon dimerization of the FokI domain, which itself has no sequence specificity per se, a DNA double-strand break is generated between the ZFN half-sites as the initiating step in genome editing.

The DNA binding domain of each ZFN is typically comprised of 3-6 zinc fingers of the abundant Cys2-His2 architecture, with each finger primarily recognizing a triplet of nucleotides on one strand of the target DNA sequence, although cross-strand interaction with a fourth nucleotide also can be important. Alteration of the amino acids of a finger in positions that make key contacts with the DNA alters the sequence specificity of a given finger. Thus, a four-finger zinc finger protein will selectively recognize a 12 bp target sequence, where the target sequence is a composite of the triplet preferences contributed by each finger, although triplet preference can be influenced to varying degrees by neighboring fingers. An important aspect of ZFNs is that they can be readily re-targeted to almost any genomic address simply by modifying individual fingers, although considerable expertise is required to do this well. In most applications of ZFNs, proteins of 4-6 fingers are used, recognizing 12-18 bp respectively. Hence, a pair of ZFNs will typically recognize a combined target sequence of 24-36 bp, not including the typical 5-7 bp spacer between half-sites. The binding sites can be separated further with larger spacers, including 15-17 bp. A target sequence of this length is likely to be unique in the human genome, assuming repetitive sequences or gene homologs are excluded during the design process. Nevertheless, the ZFN protein-DNA interactions are not absolute in their specificity so off-target binding and cleavage events do occur, either as a heterodimer between the two ZFNs, or as a homodimer of one or the other of the ZFNs. The latter possibility has been effectively eliminated by engineering the dimerization interface of the FokI domain to create "plus" and "minus" variants, also known as obligate heterodimer variants, which can only dimerize with each other, and not with themselves. Forcing the obligate heterodimer prevents formation of the homodimer. This has greatly enhanced specificity of ZFNs, as well as any other nuclease that adopts these FokI variants.

A variety of ZFN-based systems have been described in the art, modifications thereof are regularly reported, and numerous references describe rules and parameters that are used to guide the design of ZFNs; see, e.g., Segal et al., *Proc Natl Acad Sci USA* 96(6):2758-63 (1999); Dreier B et al., *J Mol Biol.* 303(4):489-502 (2000); Liu Q et al., *J Biol Chem.* 277(6):3850-6 (2002); Dreier et al., *J Biol Chem* 280(42): 35588-97 (2005); and Dreier et al., *J Biol Chem.* 276(31): 29466-78 (2001).

Transcription Activator-Like Effector Nucleases (TALENs)

TALENs represent another format of modular nucleases whereby, as with ZFNs, an engineered DNA binding domain is linked to the FokI nuclease domain, and a pair of TALENs operate in tandem to achieve targeted DNA cleavage. The major difference from ZFNs is the nature of the DNA binding domain and the associated target DNA sequence recognition properties. The TALEN DNA binding domain derives from TALE proteins, which were originally described in the plant bacterial pathogen *Xanthomonas* sp. TALEs are comprised of tandem arrays of 33-35 amino acid repeats, with each repeat recognizing a single basepair in the target DNA sequence that is typically up to 20 bp in length, giving a total target sequence length of up to 40 bp. Nucleotide specificity of each repeat is determined by the repeat variable diresidue (RVD), which includes just two amino acids at positions 12 and 13. The bases guanine, adenine, cytosine and thymine are predominantly recognized by the four RVDs: Asn-Asn, Asn-Ile, His-Asp and Asn-Gly, respectively. This constitutes a much simpler recognition code than for zinc fingers, and thus represents an advantage over the latter for nuclease design. Nevertheless, as with ZFNs, the protein-DNA interactions of TALENs are not absolute in their specificity, and TALENs have also benefitted from the use of obligate heterodimer variants of the FokI domain to reduce off-target activity.

Additional variants of the FokI domain have been created that are deactivated in their catalytic function. If one half of either a TALEN or a ZFN pair contains an inactive FokI domain, then only single-strand DNA cleavage (nicking) will occur at the target site, rather than a DSB. The outcome is comparable to the use of CRISPR/Cas9/Cpf1 "nickase" mutants in which one of the Cas9 cleavage domains has been deactivated. DNA nicks can be used to drive genome editing by HDR, but at lower efficiency than with a DSB. The main benefit is that off-target nicks are quickly and accurately repaired, unlike the DSB, which is prone to NHEJ-mediated mis-repair.

A variety of TALEN-based systems have been described in the art, and modifications thereof are regularly reported; see, e.g., Boch, *Science* 326(5959):1509-12 (2009); Mak et al., *Science* 335(6069):716-9 (2012); and Moscou et al., *Science* 326(5959):1501 (2009). The use of TALENs based on the "Golden Gate" platform, or cloning scheme, has been described by multiple groups; see, e.g., Cermak et al., *Nucleic Acids Res.* 39(12):e82 (2011); Li et al., *Nucleic Acids Res.* 39(14):6315-25(2011); Weber et al., *PLoS One.* 6(2):e16765 (2011); Wang et al., *J Genet Genomics* 41(6): 339-47, Epub 2014 May 17 (2014); and Cermak T et al., *Methods Mol Biol.* 1239:133-59 (2015).

Homing Endonucleases

Homing endonucleases (HEs) are sequence-specific endonucleases that have long recognition sequences (14-44 base pairs) and cleave DNA with high specificity—often at sites unique in the genome. There are at least six known families of HEs as classified by their structure, including LAGLIDADG (SEQ ID NO. 64,982), GIY-YIG, His-Cis box, H—N—H, PD-(D/E)xK, and Vsr-like that are derived from a broad range of hosts, including eukarya, protists, bacteria, archaea, cyanobacteria and phage.

As with ZFNs and TALENs, HEs can be used to create a DSB at a target locus as the initial step in genome editing. In addition, some natural and engineered HEs cut only a single strand of DNA, thereby functioning as site-specific nickases. The large target sequence of HEs and the specificity that they offer have made them attractive candidates to create site-specific DSBs.

A variety of HE-based systems have been described in the art, and modifications thereof are regularly reported; see, e.g., the reviews by Steentoft et al., *Glycobiology* 24(8):663-80 (2014); Belfort and Bonocora, *Methods Mol Biol.* 1123: 1-26 (2014); Hafez and Hausner, *Genome* 55(8):553-69 (2012); and references cited therein.

MegaTAL/Tev-mTALEN/MegaTev

As further examples of hybrid nucleases, the MegaTAL platform and Tev-mTALEN platform use a fusion of TALE DNA binding domains and catalytically active HEs, taking advantage of both the tunable DNA binding and specificity of the TALE, as well as the cleavage sequence specificity of the HE; see, e.g., Boissel et al., *NAR* 42: 2591-2601 (2014); Kleinstiver et al., *G3* 4:1155-65 (2014); and Boissel and Scharenberg, *Methods Mol. Biol.* 1239: 171-96 (2015).

In a further variation, the MegaTev architecture is the fusion of a meganuclease (Mega) with the nuclease domain derived from the GIY-YIG homing endonuclease I-TevI (Tev). The two active sites are positioned ~30 bp apart on a DNA substrate and generate two DSBs with non-compatible cohesive ends; see, e.g., Wolfs et al., *NAR* 42, 8816-29 (2014). It is anticipated that other combinations of existing nuclease-based approaches will evolve and be useful in achieving the targeted genome modifications described herein.

dCas9-FokI or dCpf1-Fok1 and Other Nucleases

Combining the structural and functional properties of the nuclease platforms described above offers a further approach to genome editing that can potentially overcome some of the inherent deficiencies. As an example, the CRISPR genome editing system typically uses a single Cas9 endonuclease to create a DSB. The specificity of targeting is driven by a 20 or 24 nucleotide sequence in the guide RNA that undergoes Watson-Crick base-pairing with the target DNA (plus an additional 2 bases in the adjacent NAG or NGG PAM sequence in the case of Cas9 from *S. pyogenes*). Such a sequence is long enough to be unique in the human genome, however, the specificity of the RNA/DNA interaction is not absolute, with significant promiscuity sometimes tolerated, particularly in the 5' half of the target sequence, effectively reducing the number of bases that drive specificity. One solution to this has been to completely deactivate the Cas9 or Cpf1 catalytic function—retaining only the RNA-guided DNA binding function—and instead fusing a FokI domain to the deactivated Cas9; see, e.g., Tsai et al., *Nature Biotech* 32: 569-76 (2014); and Guilinger et al., *Nature Biotech.* 32: 577-82 (2014). Because FokI must dimerize to become catalytically active, two guide RNAs are required to tether two FokI fusions in close proximity to form the dimer and cleave DNA. This essentially doubles the number of bases in the combined target sites, thereby increasing the stringency of targeting by CRISPR-based systems.

As further example, fusion of the TALE DNA binding domain to a catalytically active HE, such as I-TevI, takes advantage of both the tunable DNA binding and specificity of the TALE, as well as the cleavage sequence specificity of I-TevI, with the expectation that off-target cleavage can be further reduced.

Methods and Compositions of the Invention

Accordingly, the present disclosure relates in particular to the following non-limiting inventions: In a first method, Method 1, the present disclosure provides a method for editing an HFE gene in a human cell by genome editing, the method comprising: introducing into the human cell one or more deoxyribonucleic acid (DNA) endonucleases to effect one or more single-strand breaks (SSBs) or double-strand breaks (DSBs) within or near the HFE gene or other DNA sequences that encode regulatory elements of the HFE gene that results in a permanent deletion, insertion, correction, or modulation of expression or function of one or more mutations within or near or affecting the expression or function of the HFE gene and results in restoration of HFE protein activity.

In another method, Method 2, the present disclosure provides an ex vivo method for inserting a haemochromatosis (HFE) gene in a human cell by genome editing, the method comprising: introducing into the human cell one or more deoxyribonucleic acid (DNA) endonucleases to effect one or more single-strand breaks (SSBs) or double-strand breaks (DSBs) within or near a safe harbor locus that results in a permanent insertion of the HFE gene, and results in restoration of HFE protein activity.

In another method, Method 3, the present disclosure provides an ex vivo method for treating a patient with HHC, the method comprising: creating a patient specific induced pluripotent stem cell (iPSC); editing within or near an HFE gene or other DNA sequences that encode regulatory elements of the HFE gene of the iPSC, or editing within or near a safe harbor locus of the iPSC; differentiating the genome-edited iPSC into a hepatocyte; and implanting the hepatocyte into the patient.

In another method, Method 4, the present disclosure provides an ex vivo method for treating a patient with HHC as provided in Method 3 wherein the creating step comprises: isolating a somatic cell from the patient; and introducing a set of pluripotency-associated genes into the somatic cell to induce the somatic cell to become a pluripotent stem cell.

In another method, Method 5, the present disclosure provides an ex vivo method for treating a patient with HHC as provided in Method 4, wherein the somatic cell is a fibroblast.

In another method, Method 6, the present disclosure provides an ex vivo method for treating a patient with HHC as provided in Methods 4 or 5, wherein the set of pluripotency-associated genes is one or more of the genes selected from the group consisting of OCT4, SOX2, KLF4, Lin28, NANOG and cMYC.

In another method, Method 7, the present disclosure provides an ex vivo method for treating a patient with HHC as provided in any one of Methods 3-6, wherein the editing step comprises introducing into the iPSC one or more deoxyribonucleic acid (DNA) endonucleases to effect one or more single-strand breaks (SSBs) or double-strand breaks (DSBs) within or near the HFE gene or other DNA sequences that encode regulatory elements of the HFE gene that results in a permanent deletion, insertion, correction, or modulation of expression or function of one or more mutations within or near or affecting the expression or function of the HFE gene, or within or near a safe harbor locus, that results in restoration of HFE protein activity.

In another method, Method 8, the present disclosure provides an ex vivo method for treating a patient with HHC as provided in Method 7, wherein the safe harbor locus is selected from the group consisting of AAVS1 (PPP1R12C), ALB, AngptI3, ApoC3, ASGR2, CCR5, FIX (F9), G6PC, Gys2, HGD, Lp(a), Pcsk9, Serpina1, TF, and TTR.

In another method, Method 9, the present disclosure provides an ex vivo method for treating a patient with HHC as provided in any one of Methods 3-8, wherein the differentiating step comprises contacting the genome-edited iPSC with one or more of activin, B27 supplement, FGF4, HGF, BMP2, BMP4, Oncostatin M, or Dexametason.

In another method, Method 10, the present disclosure provides an ex vivo method for treating a patient with HHC as provided in any one of Methods 3-9, wherein the implanting step comprises implanting the hepatocyte into the patient by transplantation, local injection, systemic infusion, or combinations thereof.

In another method, Method 11, the present disclosure provides an ex vivo method for treating a patient with HHC, the method comprising: performing a biopsy of the patient's liver; isolating a liver specific progenitor cell or primary hepatocyte from the patient's liver; editing within or near an HFE gene or other DNA sequences that encode regulatory elements of the HFE gene of the liver specific progenitor cell or primary hepatocyte or editing within or near a safe harbor locus of the liver specific progenitor cell or primary hepatocyte; and implanting the genome-edited liver specific progenitor cell or primary hepatocyte into the patient.

In another method, Method 12, the present disclosure provides an ex vivo method for treating a patient with HHC as provided in Method 11, wherein the isolating step comprises: perfusion of fresh liver tissues with digestion enzymes, cell differencial centrifugation, cell culturing, or combinations thereof.

In another method, Method 13, the present disclosure provides an ex vivo method for treating a patient with HHC as provided in Methods 11 or 12, wherein the editing step comprises introducing into the liver specific progenitor cell or primary hepatocyte one or more deoxyribonucleic acid (DNA) endonucleases to effect one or more single-strand breaks (SSBs) or double-strand breaks (DSBs) within or near the HFE gene or other DNA sequences that encode regulatory elements of the HFE gene or within or near a safe harbor locus that results in a permanent deletion, insertion, correction, or modulation of expression or function of one or more mutations within or near or affecting the expression or function of the HFE gene, or within or near a safe harbor locus, and restoration of HFE protein activity.

In another method, Method 14, the present disclosure provides an ex vivo method for treating a patient with HHC as provided in Method 13, wherein the safe harbor locus is selected from the group consisting of AAVS1 (PPP1R12C), ALB, Angptl3, ApoC3, ASGR2, CCR5, FIX (F9), G6PC, Gys2, HGD, Lp(a), Pcsk9, Serpina1, TF, and TTR.

In another method, Method 15, the present disclosure provides an ex vivo method for treating a patient with HHC as provided in any one of Methods 11-14, wherein the implanting step comprises implanting the genome-edited liver specific progenitor cell or primary hepatocyte into the patient by transplantation, local injection, systemic infusion, or combinations thereof.

In another method, Method 16, the present disclosure provides an ex vivo method for treating a patient with HHC, the method comprising: isolating a mesenchymal stem cell from the patient; editing within or near an HFE gene or other DNA sequences that encode regulatory elements of the HFE gene of the mesenchymal stem cell, or editing within or near a safe harbor locus of the mesenchymal stem cell; differentiating the genome-edited mesenchymal stem cell into a hepatocyte; and implanting the hepatocyte into the patient.

In another method, Method 17, the present disclosure provides an ex vivo method for treating a patient with HHC as provided in Method 16, wherein the mesenchymal stem cell is isolated from the patient's bone marrow by performing a biopsy of the patient's bone marrow or the mesenchymal stem cell is isolated from peripheral blood.

In another method, Method 18, the present disclosure provides an ex vivo method for treating a patient with HHC as provided in Methods 16 or 17, wherein the isolating step comprises: aspiration of bone marrow and isolation of mesenchymal cells using density gradient centrifugation media.

In another method, Method 19, the present disclosure provides an ex vivo method for treating a patient with HHC as provided in any one of Methods 16-18, wherein the editing step comprises introducing into the mesenchymal stem cell one or more deoxyribonucleic acid (DNA) endonucleases to effect one or more single-strand breaks (SSBs) or double-strand breaks (DSBs) within or near the HFE gene or other DNA sequences that encode regulatory elements of the HFE gene that results in a permanent deletion, insertion, correction, or modulation of expression or function of one or more mutations within or near or affecting the expression or function of the HFE gene or within or near a safe harbor locus, that results in restoration of HFE protein activity.

In another method, Method 20, the present disclosure provides an ex vivo method for treating a patient with HHC as provided in Method 19, wherein the safe harbor locus is selected from the group consisting of AAVS1 (PPP1R12C), ALB, Angptl3, ApoC3, ASGR2, CCR5, FIX (F9), G6PC, Gys2, HGD, Lp(a), Pcsk9, Serpina1, TF, and TTR.

In another method, Method 21, the present disclosure provides an ex vivo method for treating a patient with HHC as provided in any one of Methods 16-20, wherein the differentiating step comprises contacting the genome-edited mesenchymal stem cell with one or more of insulin, transferrin, FGF4, HGF, or bile acids.

In another method, Method 22, the present disclosure provides an ex vivo method for treating a patient with HHC as provided in any one of Methods 16-21, wherein the implanting step comprises implanting the hepatocyte into the patient by transplantation, local injection, systemic infusion, or combinations thereof.

In another method, Method 23, the present disclosure provides an in vivo method for treating a patient with HHC, the method comprising the step of editing an HFE gene in a cell of the patient or other DNA sequences that encode regulatory elements of the HFE gene, or editing within or near a safe harbor locus in a cell of the patient.

In another method, Method 24, the present disclosure provides an in vivo method for treating a patient with HHC as provided in Method 23, wherein the editing step comprises introducing into the cell one or more deoxyribonucleic acid (DNA) endonucleases to effect one or more single-strand breaks (SSBs) or double-strand breaks (DSBs) within or near the HFE gene or other DNA sequences that encode regulatory elements of the HFE gene that results in a permanent deletion, insertion, correction, or modulation of expression or function of one or more mutations within or near or affecting the expression or function of the HFE gene or within or near a safe harbor locus that results in restoration of HFE protein activity.

In another method, Method 25, the present disclosure provides a method according to any one of Methods 1, 2, 7, 13, 19, and 24, wherein the one or more DNA endonucleases is a Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease; a homolog thereof, a recombination of the naturally occurring molecule thereof, codon-optimized thereof, or modified versions thereof, and combinations thereof.

In another method, Method 26, the present disclosure provides a method as provided in Method 25, wherein the method comprises introducing into the cell one or more polynucleotides encoding the one or more DNA endonucleases.

In another method, Method 27, the present disclosure provides a method as provided in Method 25, wherein the method comprises introducing into the cell one or more ribonucleic acids (RNAs) encoding the one or more DNA endonucleases.

In another method, Method 28, the present disclosure provides a method as provided in Methods 26 or 27, wherein the one or more polynucleotides or one or more RNAs is one or more modified polynucleotides or one or more modified RNAs.

In another method, Method 29, the present disclosure provides a method as provided in Method 25, wherein the DNA endonuclease is one or more proteins or polypeptides.

In another method, Method 30, the present disclosure provides a method as provided in any one of Methods 1-29, wherein the method further comprises introducing into the cell one or more guide ribonucleic acids (gRNAs).

In another method, Method 31, the present disclosure provides a method as provided in Method 30, wherein the one or more gRNAs are single-molecule guide RNA (sgRNAs).

In another method, Method 32, the present disclosure provides a method as provided in Methods 30 or 31, wherein the one or more gRNAs or one or more sgRNAs is one or more modified gRNAs or one or more modified sgRNAs.

In another method, Method 33, the present disclosure provides a method as provided in any one of Methods 29-31, wherein the one or more DNA endonucleases is pre-complexed with one or more gRNAs or one or more sgRNAs.

In another method, Method 34, the present disclosure provides a method as provided in any one of Methods 1-33, wherein the method further comprises introducing into the cell a polynucleotide donor template comprising at least a portion of the wild-type HFE gene, DNA sequences that encode wild-type regulatory elements of the HFE gene, or cDNA.

In another method, Method 35, the present disclosure provides a method as provided in Method 34, wherein the at least a portion of the wild-type HFE gene or cDNA is exon 1, exon 2, exon 3, exon 4, exon 5, exon 6, exon 7, intronic regions, fragments or combinations thereof, or the entire HFE gene or cDNA.

In another method, Method 36, the present disclosure provides a method as provided in any one of Methods 34 or 35, wherein the donor template is either single or double stranded.

In another method, Method 37, the present disclosure provides a method as provided in any one of Methods 34-36, wherein the donor template has homologous arms to the 6p21.3 region.

In another method, Method 38, the present disclosure provides a method as provided in any one of Methods 1, 2, 7, 13, 19, and 24, wherein the method further comprises introducing into the cell one guide ribonucleic acid (gRNA) and a polynucleotide donor template comprising at least a portion of the wild-type HFE gene, and wherein the one or more DNA endonucleases is one or more Cas9 or Cpf1 endonucleases that effect one single-strand break (SSB) or double-strand break (DSB) at a locus within or near the HFE gene or other DNA sequences that encode regulatory elements of the HFE gene, or within or near a safe harbor locus, that facilitates insertion of a new sequence from the polynucleotide donor template into the chromosomal DNA at the locus or safe harbor locus that results in a permanent insertion or correction of a part of the chromosomal DNA of the HFE gene or other DNA sequences that encode regulatory elements of the HFE gene proximal to the locus, or safe harbor locus, and wherein the gRNA comprises a spacer sequence that is complementary to a segment of the locus, or safe harbor locus.

In another method, Method 39, the present disclosure provides a method as provided in Method 38, wherein proximal means nucleotides both upstream and downstream of the locus or safe harbor locus.

In another method, Method 40, the present disclosure provides a method as provided in any one of Methods 1, 2, 7, 13, 19, and 24, wherein the method further comprises introducing into the cell one or more guide ribonucleic acid (gRNAs) and a polynucleotide donor template comprising at least a portion of the wild-type HFE gene, and wherein the one or more DNA endonucleases is one or more Cas9 or Cpf1 endonucleases that effect a pair of single-strand breaks (SSBs) or double-strand breaks (DSBs), the first at a 5' locus and the second at a 3' locus, within or near the HFE gene or other DNA sequences that encode regulatory elements of the HFE gene or within or near a safe harbor locus that facilitates insertion of a new sequence from the polynucleotide donor template into the chromosomal DNA between the 5' locus and the 3' locus that results in a permanent insertion or correction of the chromosomal DNA between the 5' locus and the 3' locus within or near the HFE gene or other DNA sequences that encode regulatory elements of the HFE gene or within or near a safe harbor locus, and wherein the first guide RNA comprises a spacer sequence that is complementary to a segment of the 5' locus and the second guide RNA comprises a spacer sequence that is complementary to a segment of the 3' locus.

In another method, Method 41, the present disclosure provides a method as provided in any one of Methods 38-40, wherein the one or more gRNAs are one or more single-molecule guide RNA (sgRNAs).

In another method, Method 42, the present disclosure provides a method as provided in any one of Methods 38-41, wherein the one or more gRNAs or one or more sgRNAs is one or more modified gRNAs or one or more modified sgRNAs.

In another method, Method 43, the present disclosure provides a method as provided in any one of Methods 38-42, wherein the one or more DNA endonucleases is pre-complexed with one or more gRNAs or one or more sgRNAs.

In another method, Method 44, the present disclosure provides a method as provided in any one of Methods 38-43, wherein the at least a portion of the wild-type HFE gene or cDNA is exon 1, exon 2, exon 3, exon 4, exon 5, exon 6, exon 7, intronic regions, fragments or combinations thereof, or the entire HFE gene or cDNA.

In another method, Method 45, the present disclosure provides a method as provided in any one of Methods 38-44, wherein the donor template is either a single or double stranded polynucleotide.

In another method, Method 46, the present disclosure provides a method as provided in any one of Methods 38-45, wherein the donor template has homologous arms to the 6p21.3 region.

In another method, Method 47, the present disclosure provides a method as provided in any one of Method 44, wherein the SSB or DSB are in the first, second, third, fourth, fifth, sixth, seventh exon, or combinations thereof, of the HFE gene.

In another method, Method 48, the present disclosure provides a method as provided in any one of Methods 1, 2, 7, 13, 19, 24, 30-33, or 41-43, wherein the gRNA or sgRNA is directed to one or more of the following pathological variants: C282Y, H63D, S65C, or combinations thereof.

In another method, Method 49, the present disclosure provides a method as provided in any one of Methods 1, 2, 7, 13, 19, and 24-48, wherein the insertion or correction is by HDR.

In another method, Method 50, the present disclosure provides a method as provided in any one of Methods 1, 2, 7, 13, 19, and 24, wherein the method further comprises introducing into the cell two guide ribonucleic acid (gRNAs), and wherein the one or more DNA endonucleases is one or more Cas9 or Cpf1 endonucleases that effect a pair of double-strand breaks (DSBs), the first at a 5' DSB locus and the second at a 3' DSB locus, within or near the HFE gene or other DNA sequences that encode regulatory elements of the HFE gene, or within or near a safe harbor locus that causes a deletion of the chromosomal DNA between the 5' DSB locus and the 3' DSB locus that results in a permanent deletion of the chromosomal DNA between the 5' DSB locus and the 3' DSB locus within or near the HFE gene or other DNA sequences that encode regulatory elements of the HFE gene or safe harbor locus, and wherein the first guide RNA comprises a spacer sequence that is complementary to a segment of the 5' DSB locus and the second guide RNA comprises a spacer sequence that is complementary to a segment of the 3' DSB locus.

In another method, Method 51, the present disclosure provides a method as provided in Method 50, wherein the two gRNAs are two single-molecule guide RNA (sgRNAs).

In another method, Method 52, the present disclosure provides a method as provided in Methods 50 or 51 wherein the two gRNAs or two sgRNAs are two modified gRNAs or two modified sgRNAs.

In another method, Method 53, the present disclosure provides a method as provided in any one of Methods 50-52, wherein the one or more DNA endonucleases is pre-complexed with one or two gRNAs or one or two sgRNAs.

In another method, Method 54, the present disclosure provides a method as provided in any one of Methods 50-53, wherein both the 5' DSB and 3' DSB are in or near either the first exon, first intron, second exon, second intron, third exon, third intron, fourth exon, fourth intron, fifth exon, fifth intron, sixth exon, sixth intron, seventh exon, seventh intron, or combinations thereof, of the HFE gene.

In another method, Method 55, the present disclosure provides a method as provided in any one of Methods 50-54, wherein the deletion is a deletion of 1 kb or less.

In another method, Method 56, the present disclosure provides a method as provided in any one of Methods 1, 2, 7, 13, 19, and 24-55 wherein the Cas9 or Cpf1 mRNA, gRNA, and donor template are either each formulated into separate lipid nanoparticles or all co-formulated into a lipid nanoparticle.

In another method, Method 57, the present disclosure provides a method as provided in any one of Methods 1, 2, 7, 13, 19, and 24-55, wherein the Cas9 or Cpf1 mRNA is formulated into a lipid nanoparticle, and both the gRNA and donor template are delivered to the cell by an adeno-associated virus (AAV) vector.

In another method, Method 58, the present disclosure provides a method as provided in any one of Methods 1, 2, 7, 13, 19, and 24-55, wherein the Cas9 or Cpf1 mRNA is formulated into a lipid nanoparticle, and the gRNA is delivered to the cell by electroporation and donor template is delivered to the cell by an adeno-associated virus (AAV) vector.

In another method, Method 59, the present disclosure provides a method as provided in any one of Methods 1-58, wherein the HFE gene is located on Chromosome 6: 26087458-26095569 (Genome Reference Consortium—GRCh38/hg38).

In another method, Method 60, the present disclosure provides a method as provided in any one of Methods 1, 2, 7, 13, 19, and 24, wherein the restoration of HFE protein activity is compared to wild-type or normal HFE protein activity.

In a first composition, Composition 1, the present disclosure provides one or more guide ribonucleic acids (gRNAs) for editing an HFE gene in a cell from a patient with HHC, the one or more gRNAs comprising a spacer sequence selected from the group consisting of nucleic acid sequences in SEQ ID NOs: 1-64,980 of the Sequence Listing.

In another composition, Composition 2, the present disclosure provides the one or more gRNAs of Composition 1, wherein the one or more gRNAs are one or more single-molecule guide RNAs (sgRNAs).

In another composition, Composition 3, the present disclosure provides the one or more gRNAs or sgRNAs of Compositions 1 or 2, wherein the one or more gRNAs or one or more sgRNAs is one or more modified gRNAs or one or more modified sgRNAs.

In another composition, Composition 4, the present disclosure provides the one or more gRNAs or sgRNAs of Compositions 1-3, wherein the cell is selected from a group consisting of a liver cell, skin cell, pancreatic cell, heart cell, joint cell, or cell from the testes.

In another method, Method 65, the present disclosure provides a method as provided in any one of Method 1, wherein the human cell is selected from a group consisting of a liver cell, skin cell, pancreatic cell, heart cell, joint cell, or cell from the testes.

In another method, Method 66, the present disclosure provides a method as provided in any one of Method 23, wherein the human cell is selected from a group consisting of a liver cell, skin cell, pancreatic cell, heart cell, joint cell, or cell from the testes.

Definitions

The term "comprising" or "comprises" is used in reference to compositions, methods, and respective component(s) thereof, that are essential to the invention, yet open to the inclusion of unspecified elements, whether essential or not.

The term "consisting essentially of" refers to those elements required for a given aspect. The term permits the presence of additional elements that do not materially affect the basic and novel or functional characteristic(s) of that aspect of the invention.

The term "consisting of" refers to compositions, methods, and respective components thereof as described herein, which are exclusive of any element not recited in that description of the aspect.

The singular forms "a," "an," and "the" include plural references, unless the context clearly dictates otherwise.

Any numerical range recited in this specification describes all sub-ranges of the same numerical precision (i.e., having the same number of specified digits) subsumed within the recited range. For example, a recited range of "1.0 to 10.0" describes all sub-ranges between (and including) the recited minimum value of 1.0 and the recited maximum value of 10.0, such as, for example, "2.4 to 7.6," even if the range of "2.4 to 7.6" is not expressly recited in the text of the specification. Accordingly, the Applicant reserves the right to amend this specification, including the claims, to expressly recite any sub-range of the same numerical precision subsumed within the ranges expressly recited in this specification. All such ranges are inherently described in this specification such that amending to expressly recite any such sub-ranges will comply with written description, sufficiency of description, and added matter requirements, including the requirements under 35 U.S.C. § 112(a) and Article 123(2) EPC. Also, unless expressly specified or otherwise required by context, all numerical parameters described in this specification (such as those expressing values, ranges, amounts, percentages, and the like) may be read as if prefaced by the word "about," even if the word "about" does not expressly appear before a number. Additionally, numerical parameters described in this specification should be construed in light of the number of reported significant digits, numerical precision, and by applying ordinary rounding techniques. It is also understood that numerical parameters described in this specification will necessarily possess the inherent variability characteristic of the underlying measurement techniques used to determine the numerical value of the parameter.

EXAMPLES

The invention will be more fully understood by reference to the following examples, which provide illustrative non-limiting aspects of the invention.

The examples describe the use of the CRISPR system as an illustrative genome editing technique to create defined therapeutic genomic deletions, insertions, or replacements, termed "genomic modifications" herein, in the HFE gene that lead to permanent correction of mutations in the genomic locus, or expression at a heterologous locus, that restore HFE protein activity.

Single gRNAs spanning different regions of the HFE gene were selected and tested for cutting efficiencies (Table 5).

TABLE 5

| SEQ ID NO. | gRNA Name | gRNA Sequence without PAM | PAM Sequence |
|---|---|---|---|
| 409 | Hfe_T5 | CGCTTGCTGCGTGAGTCCGA | GGG |
| 4117 | Hfe_T338 | AGATGCCCAGTAAAACTTCC | TGG |
| 377 | Hfe_T252 | TGAGCCTAGGCAATAGCTGT | AGG |
| 378 | Hfe_T101 | GAGCCTAGGCAATAGCTGTA | GGG |
| 4114 | Hfe_T394 | TACAGCTATTGCCTAGGCTC | AGG |
| 4112 | Hfe_T240 | TCACCCTACAGCTATTGCCT | AGG |
| 379 | Hfe_T158 | AATAGCTGTAGGGTGACTTC | TGG |
| 4106 | Hfe_T377 | TTTTGGGGGCGGGGAAACG | GGG |
| 4102 | Hfe_T278 | CTCCGCTTCTTTTGGGGGC | GGG |
| 4100 | Hfe_T402 | AAATCTCCGCTTCTTTTGGG | GGG |
| 4099 | Hfe_T285 | TAAATCTCCGCTTCTTTTGG | GGG |
| 4098 | Hfe_T398 | TTAAATCTCCGCTTCTTTTG | GGG |
| 386 | Hfe_T238 | AAAAGAAGCGGAGATTTAAC | GGG |
| 4097 | Hfe_T304 | GTTAAATCTCCGCTTCTTTT | GGG |
| 387 | Hfe_T88 | AAAGAAGCGGAGATTTAACG | GGG |
| 4096 | Hfe_T108 | CGTTAAATCTCCGCTTCTTT | TGG |
| 388 | Hfe_T18 | GGAGATTTAACGGGGACGTG | CGG |
| 391 | Hfe_T229 | CGGGGACGTGCGGCCAGAGC | TGG |
| 398 | Hfe_T60 | GGGAAATGGGCCCGCGAGCC | AGG |
| 399 | Hfe_T117 | AATGGGCCCGCGAGCCAGGC | CGG |
| 4093 | Hfe_T99 | GAAGCGCCGGCCTGGCTCGC | GGG |
| 4092 | Hfe_T100 | AGAAGCGCCGGCCTGGCTCG | CGG |
| 4091 | Hfe_T239 | CAGGAGGAGAAGCGCCGGCC | TGG |
| 401 | Hfe_T118 | CCTGATGCTTTTGCAGACCG | CGG |
| 4087 | Hfe_T246 | CGGTCTGCAAAAGCATCAGG | AGG |
| 4085 | Hfe_T24 | CCGCGGTCTGCAAAAGCATC | AGG |
| 403 | Hfe_T27 | TTTGCAGACCGCGGTCCTGC | AGG |
| 404 | Hfe_T34 | TTGCAGACCGCGGTCCTGCA | GGG |
| 405 | Hfe_T146 | TGCAGACCGCGGTCCTGCAG | GGG |
| 4082 | Hfe_T152 | CAAGCGCCCTGCAGGACCG | CGG |
| 4081 | Hfe_T78 | CACGCAGCAAGCGCCCTGC | AGG |
| 408 | Hfe_T11 | GCGCTTGCTGCGTGAGTCCG | AGG |
| 410 | Hfe_T269 | CTGCGTGAGTCCGAGGGCTG | CGG |
| 411 | Hfe_T157 | TGCGTGAGTCCGAGGGCTGC | GGG |

TABLE 5-continued

| SEQ ID NO. | gRNA Name | gRNA Sequence without PAM | PAM Sequence |
|---|---|---|---|
| 413 | Hfe_T19 | CCGAGGGCTGCGGGCGAACT | AGG |
| 414 | Hfe_T1 | CGAGGGCTGCGGGCGAACTA | GGG |
| 415 | Hfe_T3 | GAGGGCTGCGGGCGAACTAG | GGG |
| 4077 | Hfe_T61 | CCTAGTTCGCCCGCAGCCCT | CGG |
| 416 | Hfe_T28 | CTGCGGGCGAACTAGGGGCG | CGG |
| 417 | Hfe_T68 | CGGGCGAACTAGGGGCGCGG | CGG |
| 418 | Hfe_T122 | GGGCGAACTAGGGGCGCGGC | GGG |
| 419 | Hfe_T113 | GGCGAACTAGGGGCGCGGCG | GGG |
| 420 | Hfe_T138 | GCGAACTAGGGGCGCGGCGG | GGG |
| 423 | Hfe_T274 | ACTAGCTTTTCTTTGCGCT | TGG |
| 426 | Hfe_T208 | GCTTGGGAGTTTGCTAACTT | TGG |
| 428 | Hfe_T264 | TGGGAGTTTGCTAACTTTGG | AGG |
| 3678 | Hfe_T131 | CTCATACCATCAGCTGTGTC | TGG |
| 964 | Hfe_T132 | CTGATGGTATGAGTTGATGC | AGG |
| 969 | Hfe_T207 | CCTCCTACTACACATGGTTA | AGG |
| 3671 | Hfe_T352 | TTAACCATGTGTAGTAGGAG | GGG |
| 3670 | Hfe_T233 | CTTAACCATGTGTAGTAGGA | GGG |
| 3669 | Hfe_T171 | CCTTAACCATGTGTAGTAGG | AGG |
| 3667 | Hfe_T59 | AGGCCTTAACCATGTGTAGT | AGG |
| 3659 | Hfe_T385 | TAGTGCAGAGAGTGTGAACC | TGG |
| 972 | Hfe_T547 | CTCTCTGCACTACCTCTTCA | TGG |
| 973 | Hfe_T303 | TCTCTGCACTACCTCTTCAT | GGG |
| 3654 | Hfe_T448 | GCTCTGAGGCACCCATGAAG | AGG |
| 977 | Hfe_T458 | CTTCATGGGTGCCTCAGAGC | AGG |
| 978 | Hfe_T622 | GGTGCCTCAGAGCAGGACCT | TGG |
| 3651 | Hfe_T667 | AAGACCAAGGTCCTGCTCTG | AGG |
| 980 | Hfe_T732 | TCTTTCCTTGTTTGAAGCTT | TGG |
| 981 | Hfe_T740 | CTTTCCTTGTTTGAAGCTTT | GGG |
| 3646 | Hfe_T281 | GTAGCCCAAAGCTTCAAACA | AGG |
| 982 | Hfe_T44 | GTTTGAAGCTTTGGGCTACG | TGG |
| 3642 | Hfe_T102 | GATCATAGAACACGAACAGC | TGG |
| 986 | Hfe_T4 | TGATCATGAGAGTCGCCGTG | TGG |
| 988 | Hfe_T106 | GTGTGGAGCCCCGAACTCCA | TGG |
| 989 | Hfe_T33 | TGTGGAGCCCCGAACTCCAT | GGG |
| 3639 | Hfe_T151 | ATGGAGTTCGGGGCTCCACA | CGG |
| 3638 | Hfe_T91 | CTGGAAACCCATGGAGTTCG | GGG |
| 3637 | Hfe_T388 | ACTGGAAACCCATGGAGTTC | GGG |
| 3636 | Hfe_T234 | TACTGGAAACCCATGGAGTT | CGG |
| 3634 | Hfe_T552 | GAAATTCTACTGGAAACCCA | TGG |

TABLE 5-continued

| SEQ ID NO. | gRNA Name | gRNA Sequence without PAM | PAM Sequence |
|---|---|---|---|
| 3633 | Hfe_T372 | CATCTGGCTTGAAATTCTAC | TGG |
| 3632 | Hfe_T494 | GACTCAGCTGCAGCCACATC | TGG |
| 1000 | Hfe_T694 | CAGCTGAGTCAGAGTCTGAA | AGG |
| 1002 | Hfe_T762 | TGAGTCAGAGTCTGAAAGGG | TGG |
| 1003 | Hfe_T579 | GAGTCAGAGTCTGAAAGGGT | GGG |
| 1004 | Hfe_T558 | ACATGTTCACTGTTGACTTC | TGG |
| 1005 | Hfe_T397 | TGTTGACTTCTGGACTATTA | TGG |
| 1010 | Hfe_T608 | ACAACCACAGCAAGGGTATG | TGG |
| 1013 | Hfe_T566 | CACAGCAAGGGTATGTGGAG | AGG |
| 1014 | Hfe_T721 | ACAGCAAGGGTATGTGGAGA | GGG |
| 3624 | Hfe_T374 | CTCTCCACATACCCTTGCTG | TGG |
| 1015 | Hfe_T687 | CAGCAAGGGTATGTGGAGAG | GGG |
| 3621 | Hfe_T411 | AAGCTCTGACAACCTCAGGA | AGG |
| 3619 | Hfe_T530 | TGAAAAGCTCTGACAACCTC | AGG |
| 1028 | Hfe_T429 | GCTGGAAGTCTGAGGTCTTG | TGG |
| 1029 | Hfe_T386 | CTGGAAGTCTGAGGTCTTGT | GGG |
| 1032 | Hfe_T441 | GTCTGAGGTCTTGTGGGAGC | AGG |
| 1033 | Hfe_T636 | TCTGAGGTCTTGTGGGAGCA | GGG |
| 1041 | Hfe_T658 | ATTTGCTTCCTGAGATCATT | TGG |
| 1042 | Hfe_T359 | TCCTGAGATCATTTGGTCCT | TGG |
| 1043 | Hfe_T290 | CCTGAGATCATTTGGTCCTT | GGG |
| 1044 | Hfe_T346 | CTGAGATCATTTGGTCCTTG | GGG |
| 3610 | Hfe_T168 | CCCAAGGACCAAATGATCTC | AGG |
| 1045 | Hfe_T446 | GATCATTTGGTCCTTGGGGA | TGG |
| 1049 | Hfe_T553 | CCTTGGGGATGGTGGAAATA | GGG |
| 1050 | Hfe_T216 | GAAATAGGGACCTATTCCTT | TGG |
| 1053 | Hfe_T376 | TCCTTTGGTTGCAGTTAACA | AGG |
| 1054 | Hfe_T188 | TTGGTTGCAGTTAACAAGGC | TGG |
| 3604 | Hfe_T232 | GCCTTGTTAACTGCAACCAA | AGG |
| 1055 | Hfe_T230 | TGGTTGCAGTTAACAAGGCT | GGG |
| 1056 | Hfe_T329 | GGTTGCAGTTAACAAGGCTG | GGG |
| 3601 | Hfe_T537 | ACCTGCAGGGTGTGGGACTC | TGG |
| 1062 | Hfe_T396 | CACACCCTGCAGGTCATCCT | GGG |
| 3598 | Hfe_T450 | ACAGCCCAGGATGACCTGCA | GGG |
| 1067 | Hfe_T48 | GCAAGAAGACAACAGTACCG | AGG |
| 1068 | Hfe_T175 | CAAGAAGACAACAGTACCGA | GGG |
| 1069 | Hfe_T84 | ACAACAGTACCGAGGGCTAC | TGG |
| 1071 | Hfe_T89 | ACCGAGGGCTACTGGAAGTA | CGG |
| 1072 | Hfe_T50 | CCGAGGGCTACTGGAAGTAC | GGG |
| 3592 | Hfe_T144 | CCCGTACTTCCAGTAGCCCT | CGG |
| 1073 | Hfe_T57 | TACTGGAAGTACGGGTATGA | TGG |
| 1074 | Hfe_T23 | ACTGGAAGTACGGGTATGAT | GGG |
| 1076 | Hfe_T66 | GAAGTACGGGTATGATGGGC | AGG |
| 3588 | Hfe_T504 | GTGTGTCAGGGCAGAATTCA | AGG |
| 1077 | Hfe_T521 | TGAATTCTGCCCTGACACAC | TGG |
| 1078 | Hfe_T206 | TCTGCCCTGACACACTGGAT | TGG |
| 3585 | Hfe_T404 | CTCTCCAATCCAGTGTGTCA | GGG |
| 3584 | Hfe_T211 | GCTCTCCAATCCAGTGTGTC | AGG |
| 1084 | Hfe_T531 | ATTGGAGAGCAGCAGAACCC | AGG |
| 1088 | Hfe_T542 | CAGGGCCTGGCCCACCAAGC | TGG |
| 1090 | Hfe_T472 | CCTGGCCCACCAAGCTGGAG | TGG |
| 1091 | Hfe_T375 | CTGGCCCACCAAGCTGGAGT | GGG |
| 3577 | Hfe_T508 | CTTTCCCACTCCAGCTTGGT | GGG |
| 1096 | Hfe_T528 | GTGGGAAAGGCACAAGATTC | GGG |
| 1098 | Hfe_T179 | AAAGGCACAAGATTCGGGCC | AGG |
| 1101 | Hfe_T277 | AGATTCGGGCCAGGCAGAAC | AGG |
| 1102 | Hfe_T318 | GATTCGGGCCAGGCAGAACA | GGG |
| 1103 | Hfe_T313 | CAGGCAGAACAGGGCCTACC | TGG |
| 3573 | Hfe_T405 | CAGGTAGGCCCTGTTCTGCC | TGG |
| 3572 | Hfe_T493 | AGGGCAGTCCCTCTCCAGGT | AGG |
| 1121 | Hfe_T342 | AGAGGTGTTTGGACCAACA | AGG |
| 1122 | Hfe_T104 | TGTTTTGGACCAACAAGGTA | TGG |
| 1123 | Hfe_T299 | TTTGGACCAACAAGGTATGG | TGG |
| 3561 | Hfe_T82 | GTGTTTCCACCATACCTTGT | TGG |
| 1125 | Hfe_T98 | CTTCTGCCCCTATACTCTAG | TGG |
| 1128 | Hfe_T355 | CCTATACTCTAGTGGCAGAG | TGG |
| 3558 | Hfe_T120 | ACTCTGCCACTAGAGTATAG | GGG |
| 3557 | Hfe_T111 | CACTCTGCCACTAGAGTATA | GGG |
| 3556 | Hfe_T205 | CCACTCTGCCACTAGAGTAT | AGG |
| 1137 | Hfe_T210 | GTTGCAGGGCACGGAATCCC | TGG |
| 1138 | Hfe_T112 | CAGGGCACGGAATCCCTGGT | TGG |
| 1142 | Hfe_T418 | ATCCCTGGTTGGAGTTTCAG | AGG |
| 3552 | Hfe_T327 | CACCTCTGAAACTCCAACCA | GGG |
| 1158 | Hfe_T294 | ATGAGACAGCCACAAGTCAT | GGG |
| 1161 | Hfe_T204 | TCTCCATGCATATGGCTCAA | AGG |
| 1162 | Hfe_T231 | CTCCATGCATATGGCTCAAA | GGG |
| 3531 | Hfe_T322 | TTCCCTTTGAGCCATATGCA | TGG |

TABLE 5-continued

| SEQ ID NO. | gRNA Name | gRNA Sequence without PAM | PAM Sequence |
|---|---|---|---|
| 1164 | Hfe_T361 | GGCTCAAAGGGAAGTGTCTA | TGG |
| 1223 | Hfe_T129 | TCAGCTATCATATGAATACC | AGG |
| 3479 | Hfe_T250 | CCTCACTTGATATTTTGTCC | TGG |
| 3478 | Hfe_T369 | GATTCTTCTACTCTGATAAG | TGG |
| 1232 | Hfe_T8 | TCAGAGTAGAAGAATCCTTT | AGG |
| 3471 | Hfe_T217 | AAGAAGCGGACTTGTAAGAT | AGG |
| 1241 | Hfe_T62 | AATGCCTCCTAGGTTGACCC | AGG |
| 3465 | Hfe_T147 | TTCACCTGGGTCAACCTAGG | AGG |
| 3463 | Hfe_T289 | AGTTTCACCTGGGTCAACCT | AGG |
| 3461 | Hfe_T421 | ACAGATGGTCAGTTTCACCT | GGG |
| 3460 | Hfe_T209 | TACAGATGGTCAGTTTCACC | TGG |
| 3450 | Hfe_T311 | GACTCTAACACAGTGTCACT | TGG |
| 1258 | Hfe_T92 | CTGTGTTAGAGTCCAATCTT | AGG |
| 3448 | Hfe_T224 | ACCATTTTGTGTCCTAAGAT | TGG |
| 1266 | Hfe_T193 | TCCTTCCTCCAACCTATAGA | AGG |
| 3438 | Hfe_T235 | CACTTCCTTCTATAGGTTGG | AGG |
| 3433 | Hfe_T243 | TTTACCCTTGCCAGGAAGAC | TGG |
| 3431 | Hfe_T83 | GGGATCTGTTTACCCTTGCC | AGG |
| 3417 | Hfe_T93 | CACCAAAGGAGGCACTTGAC | AGG |
| 1278 | Hfe_T371 | TCAAGTGCCTCCTTTGGTGA | AGG |
| 3395 | Hfe_T198 | TCGAACTCCTTGGCATCCAT | TGG |
| 3394 | Hfe_T186 | GTCTTTAGGTTCGAACTCCT | TGG |
| 1295 | Hfe_T41 | CCTAAAGACGTATTGCCCAA | TGG |
| 1296 | Hfe_T36 | CTAAAGACGTATTGCCCAAT | GGG |
| 1297 | Hfe_T133 | TAAAGACGTATTGCCCAATG | GGG |
| 3393 | Hfe_T39 | CCATTGGGCAATACGTCTTT | AGG |
| 1298 | Hfe_T87 | GACGTATTGCCCAATGGGGA | TGG |
| 1299 | Hfe_T45 | ACGTATTGCCCAATGGGGAT | GGG |
| 1301 | Hfe_T801 | CAATGGGGATGGGACCTACC | AGG |
| 1302 | Hfe_T125 | AATGGGGATGGGACCTACCA | GGG |
| 3391 | Hfe_T366 | TGGTAGGTCCCATCCCCATT | GGG |
| 3390 | Hfe_T167 | CTGGTAGGTCCCATCCCCAT | TGG |
| 1303 | Hfe_T324 | GGGATGGGACCTACCAGGGC | TGG |
| 1304 | Hfe_T134 | CTACCAGGGCTGGATAACCT | TGG |
| 3389 | Hfe_T174 | CAAGGTTATCCAGCCCTGGT | AGG |
| 3387 | Hfe_T140 | CAGCCAAGGTTATCCAGCCC | TGG |
| 1305 | Hfe_T85 | ATAACCTTGGCTGTACCCCC | TGG |
| 1306 | Hfe_T155 | TAACCTTGGCTGTACCCCCT | GGG |

TABLE 5-continued

| SEQ ID NO. | gRNA Name | gRNA Sequence without PAM | PAM Sequence |
|---|---|---|---|
| 1307 | Hfe_T242 | AACCTTGGCTGTACCCCCTG | GGG |
| 3385 | Hfe_T331 | TTCCCCAGGGGGTACAGCCA | AGG |
| 3382 | Hfe_T829 | TATCTCTGCTCTTCCCCAGG | GGG |
| 3381 | Hfe_T731 | ATATCTCTGCTCTTCCCCAG | GGG |

All tested gRNAs can be used for an HDR/correction based editing approach. Single gRNAs targeting the splice acceptors can be used to induce exon skipping to restore the reading frame of the HFE gene. Selected pairs of gRNAs can be used to make deletions in the HFE gene that restore the reading frame. Selected pairs of gRNAs can be used to make deletions that simulate patient mutations and can be used to generate model HFE mutant lines.

Various Cas orthologs were evaluated for cutting. SP, NM, ST, SA, and TD gRNAs were delivered as RNA, expressed from the U6 promoter in plasmids, or expressed from the U6 promoter in lentivirus. The corresponding Cas protein was either knocked into the cell line of interest and constitutively expressed, delivered as mRNA, or delivered as protein. The activity of the gRNAs in all the above mentioned formats were evaluated using TIDE analysis or next generation sequencing in HEK293T cells, K562 cells, or induced pluripotent stem cells (iPSCs).

Overall, it was determined that most gRNAs tested induced cutting. However, the amount of cutting was highly dependent on the Cas protein tested. It was found that, generally, SP Cas9 gRNAs induce the highest levels of cutting. Generally, it is beneficial to select gRNAs for therapeutic application that have the highest cutting efficiency possible. However, for an iPSC based therapy, the cutting efficiency is not as important. iPSCs are highly proliferative and make it simple to isolate a clonal population of cells with the desired edit, even when the editing efficiency is less than 10%.

Introduction of the defined therapeutic modifications described above represents a novel therapeutic strategy for the potential amelioration of HHC, as described and illustrated herein.

Example 1—CRISPR/SpCas9 Target Sites for the HFE Gene

Regions of the HFE gene were scanned for target sites. Each area was scanned for a protospacer adjacent motif (PAM) having the sequence NRG. gRNA 20 bp spacer sequences corresponding to the PAM were identified, as shown in SEQ ID NOs: 1-4,455 of the Sequence Listing.

Example 2—CRISPR/SaCas9 Target Sites for the HFE Gene

Regions of the HFE gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 4,456-4,979 of the Sequence Listing.

Example 3—CRISPR/StCas9 Target Sites for the HFE Gene

Regions of the HFE gene were scanned for target sites. Each area was scanned for a protospacer adjacent motif (PAM) having the sequence NNAGAAW. gRNA 24 bp spacer sequences corresponding to the PAM were identified, as shown in SEQ ID NOs: 4,980-5,139 of the Sequence Listing.

Example 4—CRISPR/TdCas9 Target Sites for the HFE Gene

Regions of the HFE gene were scanned for target sites. Each area was scanned for a protospacer adjacent motif (PAM) having the sequence NAAAAC. gRNA 24 bp spacer sequences corresponding to the PAM were identified, as shown in SEQ ID NOs: 5,140-5,192 of the Sequence Listing.

Example 5—CRISPR/NmCas9 Target Sites for the HFE Gene

Regions of the HFE gene were scanned for target sites. Each area was gRNA 24 bp spacer sequences corresponding to the PAM were identified, as shown in SEQ ID NOs: 5,193-5,617 of the Sequence Listing.

Example 6—CRISPR/Cpf1 Target Sites for the HFE Gene

Regions of the HFE gene were scanned for target sites. Each area was scanned for a protospacer adjacent motif (PAM) having the sequence YTN. gRNA 20-24 bp spacer sequences corresponding to the PAM were identified, as shown in SEQ ID NOs: 5,618-10,121 of the Sequence Listing.

Example 7—CRISPR/SpCas9 Target Sites for the AAVS1 (PPP1R12C) Gene

Exons 1-2 of the AAVS1 (PPP1R12C) gene were scanned for target sites. Each area was scanned for a protospacer adjacent motif (PAM) having the sequence NRG. gRNA 20 bp spacer sequences corresponding to the PAM were identified, as shown in SEQ ID NOs: 10,122-12,153 of the Sequence Listing.

Example 8—CRISPR/SaCas9 Target Sites for the AAVS1 (PPP1R12C) Gene

Exons 1-2 of the AAVS1 (PPP1R12C) gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 12,154-12,324 of the Sequence Listing.

Example 9—CRISPR/StCas9 Target Sites for the AAVS1 (PPP1R12C) Gene

Exons 1-2 of the AAVS1 (PPP1R12C) gene were scanned for target sites. Each area was scanned for a protospacer adjacent motif (PAM) having the sequence NNAGAAW. gRNA 20 bp spacer sequences corresponding to the PAM were identified, as shown in SEQ ID NOs: 12,325-12,342 of the Sequence Listing.

Example 10—CRISPR/TdCas9 Target Sites for the AAVS1 (PPP1R12C) Gene

Exons 1-2 of the AAVS1 (PPP1R12C) gene were scanned for target sites. Each area was scanned for a protospacer adjacent motif (PAM) having the sequence NAAAAC. gRNA 20 bp spacer sequences corresponding to the PAM were identified, as shown in SEQ ID NOs: 12,343-12,351 of the Sequence Listing.

Example 11—CRISPR/NmCas9 Target Sites for the AAVS1 (PPP1R12C) Gene

Exons 1-2 of the AAVS1 (PPP1R12C) gene were scanned for target sites. Each area was scanned for a protospacer adjacent motif (PAM) having the sequence NNNNGHTT. gRNA 20 bp spacer sequences corresponding to the PAM were identified, as shown in SEQ ID NOs: 12,352-12,426 of the Sequence Listing.

Example 12—CRISPR/Cpf1 Target Sites for the AAVS1 (PPP1R12C) Gene

Exons 1-2 of the AAVS1 (PPP1R12C) gene were scanned for target sites. Each area was scanned for a protospacer adjacent motif (PAM) having the sequence YTN. gRNA 22 bp spacer sequences corresponding to the PAM were identified, as shown in SEQ ID NOs: 12,427-13,602 of the Sequence Listing.

Example 13—CRISPR/SpCas9 Target Sites for the ALB Gene

Exons 1-2 of the ALB gene were scanned for target sites. Each area was scanned for a protospacer adjacent motif (PAM) having the sequence NRG. gRNA 20 bp spacer sequences corresponding to the PAM were identified, as shown in SEQ ID NOs: 13,603-13,770 of the Sequence Listing.

Example 14—CRISPR/SaCas9 Target Sites for the ALB Gene

Exons 1-2 of the ALB gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 13,771-13,798 of the Sequence Listing.

Example 15—CRISPR/StCas9 Target Sites for the ALB Gene

Exons 1-2 of the ALB gene were scanned for target sites. Each area was scanned for a protospacer adjacent motif (PAM) having the sequence NNAGAAW.

gRNA 20 bp spacer sequences corresponding to the PAM were identified, as shown in SEQ ID NOs: 13,799-13,816 of the Sequence Listing.

Example 16—CRISPR/TdCas9 Target Sites for the ALB Gene

Exons 1-2 of the ALB gene were scanned for target sites. Each area was scanned for a protospacer adjacent motif (PAM) having the sequence NAAAAC. gRNA 20 bp spacer sequences corresponding to the PAM were identified, as shown in SEQ ID NOs: 13,817-13,821 of the Sequence Listing.

Example 17—CRISPR/NmCas9 Target Sites for the ALB Gene

Exons 1-2 of the ALB gene were scanned for target sites. Each area was SEQ ID NOs: 13,822-13,845 of the Sequence Listing.

Example 18—CRISPR/Cpf1 Target Sites for the ALB Gene

Exons 1-2 of the ALB gene were scanned for target sites. Each area was scanned for a protospacer adjacent motif (PAM) having the sequence YTN. gRNA 22 bp spacer sequences corresponding to the PAM were identified, as shown in SEQ ID NOs: 13,846-14,224 of the Sequence Listing.

Example 19—CRISPR/SpCas9 Target Sites for the Angptl3 Gene

Exons 1-2 of the Angptl3 gene were scanned for target sites. Each area was scanned for a protospacer adjacent motif (PAM) having the sequence NRG. gRNA 20 bp spacer sequences corresponding to the PAM were identified, as shown in SEQ ID NOs: 14,225-14,569 of the Sequence Listing.

Example 20—CRISPR/SaCas9 Target Sites for the Angptl3 Gene

Exons 1-2 of the Angptl3 gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 14,570-14,605 of the Sequence Listing.

Example 21—CRISPR/StCas9 Target Sites for the Angptl3 Gene

Exons 1-2 of the Angptl3 gene were scanned for target sites. Each area was scanned for a protospacer adjacent motif (PAM) having the sequence NNAGAAW. gRNA 20 bp spacer sequences corresponding to the PAM were identified, as shown in SEQ ID NOs: 14,606-14,628 of the Sequence Listing.

Example 22—CRISPR/TdCas9 Target Sites for the Angptl3 Gene

Exons 1-2 of the Angptl3 gene were scanned for target sites. Each area was scanned for a protospacer adjacent motif (PAM) having the sequence NAAAAC. gRNA 20 bp spacer sequences corresponding to the PAM were identified, as shown in SEQ ID NOs: 14,629-14,641 of the Sequence Listing.

Example 23—CRISPR/NmCas9 Target Sites for the Angptl3 Gene

Exons 1-2 of the Angptl3 gene were scanned for target sites. Each area was SEQ ID NOs: 14,642-14,704 of the Sequence Listing.

Example 24—CRISPR/Cpf1 Target Sites for the Angptl3 Gene

Exons 1-2 of the Angptl3 gene were scanned for target sites. Each area was scanned for a protospacer adjacent motif (PAM) having the sequence YTN. gRNA 22 bp spacer sequences corresponding to the PAM were identified, as shown in SEQ ID NOs: 14,705-15,552 of the Sequence Listing.

Example 25—CRISPR/SpCas9 Target Sites for the ApoC3 Gene

Exons 1-2 of the ApoC3 gene were scanned for target sites. Each area was scanned for a protospacer adjacent motif (PAM) having the sequence NRG. gRNA 20 bp spacer sequences corresponding to the PAM were identified, as shown in SEQ ID NOs: 15,553-15,955 of the Sequence Listing.

Example 26—CRISPR/SaCas9 Target Sites for the ApoC3 Gene

Exons 1-2 of the ApoC3 gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 15,956-15,980 of the Sequence Listing.

Example 27—CRISPR/StCas9 Target Sites for the ApoC3 Gene

Exons 1-2 of the ApoC3 gene were scanned for target sites. Each area was scanned for a protospacer adjacent motif (PAM) having the sequence NNAGAAW. gRNA 20 bp spacer sequences corresponding to the PAM were identified, as shown in SEQ ID NOs: 15,981-15,983 of the Sequence Listing.

Example 28—CRISPR/TdCas9 Target Sites for the ApoC3 Gene

Exons 1-2 of the ApoC3 gene were scanned for target sites. Each area was scanned for a protospacer adjacent motif (PAM) having the sequence NAAAAC. gRNA 20 bp spacer sequences corresponding to the PAM were identified, as shown in SEQ ID NOs: 15,984-15,985 of the Sequence Listing.

Example 29—CRISPR/NmCas9 Target Sites for the ApoC3 Gene

Exons 1-2 of the ApoC3 gene were scanned for target sites. Each area was SEQ ID NOs: 15,986-15,997 of the Sequence Listing.

Example 30—CRISPR/Cpf1 Target Sites for the ApoC3 Gene

Exons 1-2 of the ApoC3 gene were scanned for target sites. Each area was scanned for a protospacer adjacent motif (PAM) having the sequence YTN. gRNA 22 bp spacer sequences corresponding to the PAM were identified, as shown in SEQ ID NOs: 15,998-16,229 of the Sequence Listing.

Example 31—CRISPR/SpCas9 Target Sites for the ASGR2 Gene

Exons 1-2 of the ASGR2 gene were scanned for target sites. Each area was scanned for a protospacer adjacent motif (PAM) having the sequence NRG. gRNA 20 bp spacer sequences corresponding to the PAM were identified, as shown in SEQ ID NOs: 16,230-17,997 of the Sequence Listing.

Example 32—CRISPR/SaCas9 Target Sites for the ASGR2 Gene

Exons 1-2 of the ASGR2 gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 17,998-18,203 of the Sequence Listing.

Example 33—CRISPR/StCas9 Target Sites for the ASGR2 Gene

Exons 1-2 of the ASGR2 gene were scanned for target sites. Each area was scanned for a protospacer adjacent motif (PAM) having the sequence NNAGAAW. gRNA 20 bp spacer sequences corresponding to the PAM were identified, as shown in SEQ ID NOs: 18,204-18,227 of the Sequence Listing.

Example 34—CRISPR/TdCas9 Target Sites for the ASGR2 Gene

Exons 1-2 of the ASGR2 gene were scanned for target sites. Each area was scanned for a protospacer adjacent motif (PAM) having the sequence NAAAAC. gRNA 20 bp spacer sequences corresponding to the PAM were identified, as shown in SEQ ID NOs: 18,228-18,239 of the Sequence Listing.

Example 35—CRISPR/NmCas9 Target Sites for the ASGR2 Gene

Exons 1-2 of the ASGR2 gene were scanned for target sites. Each area was SEQ ID NOs: 18,240-18,322 of the Sequence Listing.

Example 36—CRISPR/Cpf1 Target Sites for the ASGR2 Gene

Exons 1-2 of the ASGR2 gene were scanned for target sites. Each area was scanned for a protospacer adjacent motif (PAM) having the sequence YTN. gRNA 22 bp spacer sequences corresponding to the PAM were identified, as shown in SEQ ID NOs: 18,323-19,762 of the Sequence Listing.

Example 37—CRISPR/SpCas9 Target Sites for the CCR5 Gene

Exons 1-2 of the CCR5 gene were scanned for target sites. Each area was scanned for a protospacer adjacent motif (PAM) having the sequence NRG. gRNA 20 bp spacer sequences corresponding to the PAM were identified, as shown in SEQ ID NOs: 19,763-19,965 of the Sequence Listing.

Example 38—CRISPR/SaCas9 Target Sites for the CCR5 Gene

Exons 1-2 of the CCR5 gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 19,966-19,997 of the Sequence Listing.

Example 39—CRISPR/StCas9 Target Sites for the CCR5 Gene

Exons 1-2 of the CCR5 gene were scanned for target sites. Each area was scanned for a protospacer adjacent motif (PAM) having the sequence NNAGAAW. gRNA 20 bp spacer sequences corresponding to the PAM were identified, as shown in SEQ ID NOs: 19,998-20,011 of the Sequence Listing.

Example 40—CRISPR/TdCas9 Target Sites for the CCR5 Gene

Exons 1-2 of the CCR5 gene were scanned for target sites. Each area was scanned for a protospacer adjacent motif (PAM) having the sequence NAAAAC. gRNA 20 bp spacer sequences corresponding to the PAM were identified, as shown in SEQ ID NOs: 20,012-20,013 of the Sequence Listing.

Example 41—CRISPR/NmCas9 Target Sites for the CCR5 Gene

Exons 1-2 of the CCR5 gene were scanned for target sites. Each area was SEQ ID NOs: 20,014-20,041 of the Sequence Listing.

Example 42—CRISPR/Cpf1 Target Sites for the CCR5 Gene

Exons 1-2 of the CCR5 gene were scanned for target sites. Each area was scanned for a protospacer adjacent motif (PAM) having the sequence YTN. gRNA 22 bp spacer sequences corresponding to the PAM were identified, as shown in SEQ ID NOs: 20,042-20,341 of the Sequence Listing.

Example 43—CRISPR/SpCas9 Target Sites for the FIX (F9) Gene

Exons 1-2 of the FIX (F9) gene were scanned for target sites. Each area was scanned for a protospacer adjacent motif (PAM) having the sequence NRG. gRNA 20 bp spacer sequences corresponding to the PAM were identified, as shown in SEQ ID NOs: 20,342-21,807 of the Sequence Listing.

Example 44—CRISPR/SaCas9 Target Sites for the FIX (F9) Gene

Exons 1-2 of the FIX (F9) gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 21,808-21,970 of the Sequence Listing.

Example 45—CRISPR/StCas9 Target Sites for the FIX (F9) Gene

Exons 1-2 of the FIX (F9) gene were scanned for target sites. Each area was scanned for a protospacer adjacent motif (PAM) having the sequence NNAGAAW. gRNA 20 bp spacer sequences corresponding to the PAM were identified, as shown in SEQ ID NOs: 21,971-22,031 of the Sequence Listing.

Example 46—CRISPR/TdCas9 Target Sites for the FIX (F9) Gene

Exons 1-2 of the FIX (F9) gene were scanned for target sites. Each area was scanned for a protospacer adjacent motif (PAM) having the sequence NAAAAC. gRNA 20 bp spacer sequences corresponding to the PAM were identified, as shown in SEQ ID NOs: 22,032-22,056 of the Sequence Listing.

Example 47—CRISPR/NmCas9 Target Sites for the FIX (F9) Gene

Exons 1-2 of the FIX (F9) gene were scanned for target sites. Each area was scanned for a protospacer adjacent motif (PAM) having the sequence NNNNGHTT. SEQ ID NOs: 22,057-22,209 of the Sequence Listing.

Example 48—CRISPR/Cpf1 Target Sites for the FIX (F9) Gene

Exons 1-2 of the FIX (F9) gene were scanned for target sites. Each area was scanned for a protospacer adjacent motif (PAM) having the sequence YTN. gRNA 22 bp spacer sequences corresponding to the PAM were identified, as shown in SEQ ID NOs: 22,210-24,350 of the Sequence Listing.

Example 49—CRISPR/SpCas9 Target Sites for the G6PC Gene

Regions of the G6PC gene were scanned for target sites. Each area was scanned for a protospacer adjacent motif (PAM) having the sequence NRG. gRNA 20 bp spacer sequences corresponding to the PAM were identified, as shown in SEQ ID NOs: 24,351-25,366 of the Sequence Listing.

Example 50—CRISPR/SaCas9 Target Sites for the G6PC Gene

Regions of the G6PC gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 25,367-25,483 of the Sequence Listing.

Example 51—CRISPR/StCas9 Target Sites for the G6PC Gene

Regions of the G6PC gene were scanned for target sites. Each area was scanned for a protospacer adjacent motif (PAM) having the sequence NNAGAAW. gRNA 20 bp spacer sequences corresponding to the PAM were identified, as shown in SEQ ID NOs: 25,484-25,507 of the Sequence Listing.

Example 52—CRISPR/TdCas9 Target Sites for the G6PC Gene

Regions of the G6PC gene were scanned for target sites. Each area was scanned for a protospacer adjacent motif (PAM) having the sequence NAAAAC. gRNA 20 bp spacer sequences corresponding to the PAM were identified, as shown in SEQ ID NOs: 25,508-25,516 of the Sequence Listing.

Example 53—CRISPR/NmCas9 Target Sites for the G6PC Gene

Regions of the G6PC gene were scanned for target sites. Each area was SEQ ID NOs: 25,517-25,606 of the Sequence Listing.

Example 54—CRISPR/Cpf1 Target Sites for the G6PC Gene

Regions of the G6PC gene were scanned for target sites. Each area was scanned for a protospacer adjacent motif (PAM) having the sequence YTN. gRNA 22 bp spacer sequences corresponding to the PAM were identified, as shown in SEQ ID NOs: 25,607-26,701 of the Sequence Listing.

Example 55—CRISPR/SpCas9 Target Sites for the Gys2 Gene

Exons 1-2 of the Gys2 gene were scanned for target sites. Each area was scanned for a protospacer adjacent motif (PAM) having the sequence NRG. gRNA 20 bp spacer sequences corresponding to the PAM were identified, as shown in SEQ ID NOs: 26,702-32,194 of the Sequence Listing.

Example 56—CRISPR/SaCas9 Target Sites for the Gys2 Gene

Exons 1-2 of the Gys2 gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 32,195-32,870 of the Sequence Listing.

Example 57—CRISPR/StCas9 Target Sites for the Gys2 Gene

Exons 1-2 of the Gys2 gene were scanned for target sites. Each area was scanned for a protospacer adjacent motif (PAM) having the sequence NNAGAAW. gRNA 20 bp spacer sequences corresponding to the PAM were identified, as shown in SEQ ID NOs: 32,871-33,148 of the Sequence Listing.

Example 58—CRISPR/TdCas9 Target Sites for the Gys2 Gene

Exons 1-2 of the Gys2 gene were scanned for target sites. Each area was scanned for a protospacer adjacent motif (PAM) having the sequence NAAAAC. gRNA 20 bp spacer sequences corresponding to the PAM were identified, as shown in SEQ ID NOs: 33,149-33,262 of the Sequence Listing.

Example 59—CRISPR/NmCas9 Target Sites for the Gys2 Gene

Exons 1-2 of the Gys2 gene were scanned for target sites. Each area was SEQ ID NOs: 33,263-33,942 of the Sequence Listing.

Example 60—CRISPR/Cpf1 Target Sites for the Gys2 Gene

Exons 1-2 of the Gys2 gene were scanned for target sites. Each area was scanned for a protospacer adjacent motif (PAM) having the sequence YTN. gRNA 22 bp spacer sequences corresponding to the PAM were identified, as shown in SEQ ID NOs: 33,943-42,374 of the Sequence Listing.

Example 61—CRISPR/SpCas9 Target Sites for the HGD Gene

Exons 1-2 of the HGD gene were scanned for target sites. Each area was scanned for a protospacer adjacent motif (PAM) having the sequence NRG. gRNA 20 bp spacer sequences corresponding to the PAM were identified, as shown in SEQ ID NOs: 42,375-44,067 of the Sequence Listing.

Example 62—CRISPR/SaCas9 Target Sites for the HGD Gene

Exons 1-2 of the HGD gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 44,068-44,281 of the Sequence Listing.

Example 63—CRISPR/StCas9 Target Sites for the HGD Gene

Exons 1-2 of the HGD gene were scanned for target sites. Each area was scanned for a protospacer adjacent motif (PAM) having the sequence NNAGAAW. gRNA 20 bp spacer sequences corresponding to the PAM were identified, as shown in SEQ ID NOs: 44,282-44,364 of the Sequence Listing.

Example 64—CRISPR/TdCas9 Target Sites for the HGD Gene

Exons 1-2 of the HGD gene were scanned for target sites. Each area was scanned for a protospacer adjacent motif (PAM) having the sequence NAAAAC. gRNA 20 bp spacer sequences corresponding to the PAM were identified, as shown in SEQ ID NOs: 44,365-44,383 of the Sequence Listing.

Example 65—CRISPR/NmCas9 Target Sites for the HGD Gene

Exons 1-2 of the HGD gene were scanned for target sites. Each area was SEQ ID NOs: 44,384-44,584 of the Sequence Listing.

Example 66—CRISPR/Cpf1 Target Sites for the HGD Gene

Exons 1-2 of the HGD gene were scanned for target sites. Each area was scanned for a protospacer adjacent motif (PAM) having the sequence YTN. gRNA 22 bp spacer sequences corresponding to the PAM were identified, as shown in SEQ ID NOs: 44,585-46,909 of the Sequence Listing.

Example 67—CRISPR/SpCas9 Target Sites for the Lp(a) Gene

Exons 1-2 of the Lp(a) gene were scanned for target sites. Each area was scanned for a protospacer adjacent motif (PAM) having the sequence NRG. gRNA 20 bp spacer sequences corresponding to the PAM were identified, as shown in SEQ ID NOs: 46,910-50,704 of the Sequence Listing.

Example 68—CRISPR/SaCas9 Target Sites for the Lp(a) Gene

Exons 1-2 of the Lp(a) gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 50,705-51,114 of the Sequence Listing.

Example 69—CRISPR/StCas9 Target Sites for the Lp(a) Gene

Exons 1-2 of the Lp(a) gene were scanned for target sites. Each area was scanned for a protospacer adjacent motif (PAM) having the sequence NNAGAAW. gRNA 20 bp spacer sequences corresponding to the PAM were identified, as shown in SEQ ID NOs: 51,115-51,250 of the Sequence Listing.

Example 70—CRISPR/TdCas9 Target Sites for the Lp(a) Gene

Exons 1-2 of the Lp(a) gene were scanned for target sites. Each area was scanned for a protospacer adjacent motif (PAM) having the sequence NAAAAC. gRNA 20 bp spacer sequences corresponding to the PAM were identified, as shown in SEQ ID NOs: 51,251-51,285 of the Sequence Listing.

Example 71—CRISPR/NmCas9 Target Sites for the Lp(a) Gene

Exons 1-2 of the Lp(a) gene were scanned for target sites. Each area was SEQ ID NOs: 51,286-51,653 of the Sequence Listing.

Example 72—CRISPR/Cpf1 Target Sites for the Lp(a) Gene

Exons 1-2 of the Lp(a) gene were scanned for target sites. Each area was scanned for a protospacer adjacent motif (PAM) having the sequence YTN. gRNA 22 bp spacer sequences corresponding to the PAM were identified, as shown in SEQ ID NOs: 51,654-56,274 of the Sequence Listing.

Example 73—CRISPR/SpCas9 Target Sites for the PCSK9 Gene

Exons 1-2 of the PCSK9 gene were scanned for target sites. Each area was scanned for a protospacer adjacent motif (PAM) having the sequence NRG. gRNA 20 bp spacer sequences corresponding to the PAM were identified, as shown in SEQ ID NOs: 56,275-58,294 of the Sequence Listing.

Example 74—CRISPR/SaCas9 Target Sites for the PCSK9 Gene

Exons 1-2 of the PCSK9 gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 58,295-58,481 of the Sequence Listing.

Example 75—CRISPR/StCas9 Target Sites for the PCSK9 Gene

Exons 1-2 of the PCSK9 gene were scanned for target sites. Each area was scanned for a protospacer adjacent motif (PAM) having the sequence NNAGAAW. gRNA 20 bp spacer sequences corresponding to the PAM were identified, as shown in SEQ ID NOs: 58,482-58,517 of the Sequence Listing.

Example 76—CRISPR/TdCas9 Target Sites for the PCSK9 Gene

Exons 1-2 of the PCSK9 gene were scanned for target sites. Each area was scanned for a protospacer adjacent motif (PAM) having the sequence NAAAAC. gRNA 20 bp spacer sequences corresponding to the PAM were identified, as shown in SEQ ID NOs: 58,518-58,531 of the Sequence Listing.

Example 77—CRISPR/NmCas9 Target Sites for the PCSK9 Gene

Exons 1-2 of the PCSK9 gene were scanned for target sites. Each area was SEQ ID NOs: 58,532-58,671 of the Sequence Listing.

Example 78—CRISPR/Cpf1 Target Sites for the PCSK9 Gene

Exons 1-2 of the PCSK9 gene were scanned for target sites. Each area was scanned for a protospacer adjacent motif (PAM) having the sequence YTN. gRNA 22 bp spacer sequences corresponding to the PAM were identified, as shown in SEQ ID NOs: 58,672-60,465 of the Sequence Listing.

Example 79—CRISPR/SpCas9 Target Sites for the Serpina1 Gene

Exons 1-2 of the Serpina1 gene were scanned for target sites. Each area was scanned for a protospacer adjacent motif (PAM) having the sequence NRG. gRNA 20 bp spacer sequences corresponding to the PAM were identified, as shown in SEQ ID NOs: 60,466-61,603 of the Sequence Listing.

Example 80—CRISPR/SaCas9 Target Sites for the Serpina1 Gene

Exons 1-2 of the Serpina1 gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 61,604-61,696 of the Sequence Listing.

Example 81—CRISPR/StCas9 Target Sites for the Serpina1 Gene

Exons 1-2 of the Serpina1 gene were scanned for target sites. Each area was scanned for a protospacer adjacent motif (PAM) having the sequence NNAGAAW. gRNA 20 bp spacer sequences corresponding to the PAM were identified, as shown in SEQ ID NOs: 61,697-61,708 of the Sequence Listing.

Example 82—CRISPR/TdCas9 Target Sites for the Serpina1 Gene

Exons 1-2 of the Serpina1 gene were scanned for target sites. Each area was scanned for a protospacer adjacent motif (PAM) having the sequence NAAAAC. gRNA 20 bp spacer sequences corresponding to the PAM were identified, as shown in SEQ ID NOs: 61,709-61,711 of the Sequence Listing.

Example 83—CRISPR/NmCas9 Target Sites for the Serpina1 Gene

Exons 1-2 of the Serpina1 gene were scanned for target sites. Each area was scanned for a protospacer adjacent motif (PAM) having the sequence NNNNGHTT. SEQ ID NOs: 61,712-61,762 of the Sequence Listing.

Example 84—CRISPR/Cpf1 Target Sites for the Serpina1 Gene

Exons 1-2 of the Serpina1 gene were scanned for target sites. Each area was scanned for a protospacer adjacent motif (PAM) having the sequence YTN. gRNA 22 bp spacer sequences corresponding to the PAM were identified, as shown in SEQ ID NOs: 61,763-62,566 of the Sequence Listing.

Example 85—CRISPR/SpCas9 Target Sites for the TF Gene

Exons 1-2 of the TF gene were scanned for target sites. Each area was scanned for a protospacer adjacent motif (PAM) having the sequence NRG. gRNA 20 bp spacer sequences corresponding to the PAM were identified, as shown in SEQ ID NOs: 62,567-63,398 of the Sequence Listing.

Example 86—CRISPR/SaCas9 Target Sites for the TF Gene

Exons 1-2 of the TF gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 63,399-63,484 of the Sequence Listing.

Example 87—CRISPR/StCas9 Target Sites for the TF Gene

Exons 1-2 of the TF gene were scanned for target sites. Each area was scanned for a protospacer adjacent motif (PAM) having the sequence NNAGAAW. gRNA 20 bp spacer sequences corresponding to the PAM were identified, as shown in SEQ ID NOs: 63,485-63,496 of the Sequence Listing.

Example 88—CRISPR/TdCas9 Target Sites for the TF Gene

Exons 1-2 of the TF gene were scanned for target sites. Each area was scanned for a protospacer adjacent motif (PAM) having the sequence NAAAAC. gRNA 20 bp spacer sequences corresponding to the PAM were identified, as shown in SEQ ID NOs: 63,497-63,503 of the Sequence Listing.

Example 89—CRISPR/NmCas9 Target Sites for the TF Gene

Exons 1-2 of the TF gene were scanned for target sites. Each area was SEQ ID NOs: 63,504-63,547 of the Sequence Listing.

Example 90—CRISPR/Cpf1 Target Sites for the TF Gene

Exons 1-2 of the TF gene were scanned for target sites. Each area was scanned for a protospacer adjacent motif (PAM) having the sequence YTN. gRNA 22 bp spacer sequences corresponding to the PAM were identified, as shown in SEQ ID NOs: 63,548-64,183 of the Sequence Listing.

Example 91—CRISPR/SpCas9 Target Sites for the TTR Gene

Exons 1-2 of the TTR gene were scanned for target sites. Each area was scanned for a protospacer adjacent motif (PAM) having the sequence NRG. gRNA 20 bp spacer sequences corresponding to the PAM were identified, as shown in SEQ ID NOs: 64,184-64,483 of the Sequence Listing.

Example 92—CRISPR/SaCas9 Target Sites for the TTR Gene

Exons 1-2 of the TTR gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 64,484-64,524 of the Sequence Listing.

Example 93—CRISPR/StCas9 Target Sites for the TTR Gene

Exons 1-2 of the TTR gene were scanned for target sites. Each area was scanned for a protospacer adjacent motif (PAM) having the sequence NNAGAAW. gRNA 20 bp spacer sequences corresponding to the PAM were identified, as shown in SEQ ID NOs: 64,525-64,541 of the Sequence Listing.

Example 94—CRISPR/TdCas9 Target Sites for the TTR Gene

Exons 1-2 of the TTR gene were scanned for target sites. Each area was scanned for a protospacer adjacent motif (PAM) having the sequence NAAAAC. gRNA 20 bp spacer sequences corresponding to the PAM were identified, as shown in SEQ ID NOs: 64,542-64,543 of the Sequence Listing.

Example 95—CRISPR/NmCas9 Target Sites for the TTR Gene

Exons 1-2 of the TTR gene were scanned for target sites. Each area was SEQ ID NOs: 64,544-64,578 of the Sequence Listing.

Example 96—CRISPR/Cpf1 Target Sites for the TTR Gene

Exons 1-2 of the TTR gene were scanned for target sites. Each area was scanned for a protospacer adjacent motif (PAM) having the sequence YTN. gRNA 22 bp spacer sequences corresponding to the PAM were identified, as shown in SEQ ID NOs: 64,579-64,980 of the Sequence Listing.

Example 97—Bioinformatics Analysis of the Guide Strands

Candidate guides will be screened and selected in a multi-step process that involves both theoretical binding and experimentally assessed activity. By way of illustration, candidate guides having sequences that match a particular on-target site, such as a site within the HFE gene, with adjacent PAM can be assessed for their potential to cleave at off-target sites having similar sequences, using one or more of a variety of bioinformatics tools available for assessing off-target binding, as described and illustrated in more detail below, in order to assess the likelihood of effects at chromosomal positions other than those intended. Candidates predicted to have relatively lower potential for off-target activity can then be assessed experimentally to measure their on-target activity, and then off-target activities at various sites. Preferred guides have sufficiently high on-target activity to achieve desired levels of gene editing at the selected locus, and relatively lower off-target activity to reduce the likelihood of alterations at other chromosomal loci. The ratio of on-target to off-target activity is often referred to as the "specificity" of a guide.

For initial screening of predicted off-target activities, there are a number of bioinformatics tools known and publicly available that can be used to predict the most likely off-target sites; and since binding to target sites in the CRISPR/Cas9/Cpf1 nuclease system is driven by Watson-Crick base pairing between complementary sequences, the degree of dissimilarity (and therefore reduced potential for off-target binding) is essentially related to primary sequence differences: mismatches and bulges, i.e. bases that are changed to a non-complementary base, and insertions or deletions of bases in the potential off-target site relative to the target site. An exemplary bioinformatics tool called COSMID (CRISPR Off-target Sites with Mismatches, Insertions and Deletions) (available on the web at crispr.bme.gatech.edu) compiles such similarities. Other bioinformatics tools include, but are not limited to, GUIDO, autoCOSMID, and CCtop.

Bioinformatics were used to minimize off-target cleavage in order to reduce the detrimental effects of mutations and chromosomal rearrangements. Studies on CRISPR/Cas9 systems suggested the possibility of high off-target activity due to nonspecific hybridization of the guide strand to DNA sequences with base pair mismatches and/or bulges, particularly at positions distal from the PAM region. Therefore, it is important to have a bioinformatics tool that can identify potential off-target sites that have insertions and/or deletions between the RNA guide strand and genomic sequences, in addition to base-pair mismatches. The bioinformatics-based tool, COSMID (CRISPR Off-target Sites with Mismatches, Insertions and Deletions) was therefore used to search genomes for potential CRISPR off-target sites (available on the web at crispr.bme.gatech.edu). COSMID output ranked lists of the potential off-target sites based on the number and location of mismatches, allowing more informed choice of target sites, and avoiding the use of sites with more likely off-target cleavage.

Additional bioinformatics pipelines were employed that weigh the estimated on- and/or off-target activity of gRNA targeting sites in a region. Other features that may be used to predict activity include information about the cell type in question, DNA accessibility, chromatin state, transcription factor binding sites, transcription factor binding data, and other CHIP-seq data. Additional factors are weighed that predict editing efficiency, such as relative positions and directions of pairs of gRNAs, local sequence features and micro-homologies.

Example 98—Testing of Preferred Guides in Cells for On-Target Activity

The gRNAs predicted to have the lowest off-target activity will then be tested for on-target activity in a model cell line, such as Huh-7 cells, and evaluated for indel frequency using TIDE or next generation sequencing. TIDE is a web tool to rapidly assess genome editing by CRISPR-Cas9 of a target locus determined by a guide RNA (gRNA or sgRNA). Based on quantitative sequence trace data from two standard capillary sequencing reactions, the TIDE software quantifies the editing efficacy and identifies the predominant types of insertions and deletions (indels) in the DNA of a targeted cell pool. See Brinkman et al, Nucl. Acids Res. (2014) for a detailed explanation and examples. Next-generation sequencing (NGS), also known as high-throughput sequencing, is the catch-all term used to describe a number of different modern sequencing technologies including: Illumina (Solexa) sequencing, Roche 454 sequencing, Ion torrent: Proton/PGM sequencing, and SOLiD sequencing. These recent technologies allow one to sequence DNA and RNA much more quickly and cheaply than the previously used Sanger sequencing, and as such have revolutionised the study of genomics and molecular biology.

Transfection of tissue culture cells, allows screening of different constructs and a robust means of testing activity and specificity. Tissue culture cell lines, such as Huh-7 cells, are easily transfected and result in high activity. These or other cell lines will be evaluated to determine the cell lines that match with hepatocytes and provide the best surrogate. These cells will then be used for many early stage tests. For example, individual gRNAs for S. pyogenes Cas9 will be transfected into the cells using plasmids, such as, for example, CTx-1, CTx-2, or CTx-3, which are suitable for expression in human cells. Several days later, the genomic DNA is harvested and the target site amplified by PCR. The cutting activity can be measured by the rate of insertions, deletions and mutations introduced by NHEJ repair of the free DNA ends. Although this method cannot differentiate correctly repaired sequences from uncleaved DNA, the level of cutting can be gauged by the amount of mis-repair. Off-target activity can be observed by amplifying identified putative off-target sites and using similar methods to detect cleavage. Translocation can also be assayed using primers flanking cut sites, to determine if specific cutting and translocations happen. Un-guided assays have been developed allowing complementary testing of off-target cleavage including guide-seq. The gRNA or pairs of gRNA with significant activity can then be followed up in cultured cells to measure correction of the HFE mutation. Off-target events can be followed again. Similarly hepatocytes can be transfected and the level of gene correction and possible off-target events measured. These experiments allow optimization of nuclease and donor design and delivery.

Example 99—Testing of Preferred Guides in Cells for Off-Target Activity

The gRNAs having the best on-target activity from the TIDE and next generation sequencing studies in the above example will then be tested for off-target activity using whole genome sequencing. Candidate gRNAs will be more completely evaluated in hepatocytes or iPSCs.

Example 100—Testing Different Approaches for HDR Gene Editing

After testing the gRNAs for both on-target activity and off-target activity, mutation correction and knock-in strategies will be tested for HDR gene editing.

For the mutation correction approach, donor DNA template will be provided as a short single-stranded oligonucleotide, a short double-stranded oligonucleotide (PAM sequence intact/PAM sequence mutated), a long single-stranded DNA molecule (PAM sequence intact/PAM sequence mutated) or a long double-stranded DNA molecule (PAM sequence intact/PAM sequence mutated). In addition, the donor DNA template will be delivered by AAV.

For the cDNA knock-in approach, a single-stranded or double-stranded DNA having homologous arms to the 6p21.3 region may include more than 40 nt of the first exon (the first coding exon) of the HFE gene, the complete CDS of the HFE gene and 3'UTR of the HFE gene, and at least 40 nt of the following intron. The single-stranded or double-stranded DNA having homologous arms to the 6p21.3 region may include more than 80 nt of the first exon of the HFE gene, the complete CDS of the HFE gene and 3'UTR of the HFE gene, and at least 80 nt of the following intron. The single-stranded or double-stranded DNA having homologous arms to the 6p21.3 region may include more than 100 nt of the first exon of the HFE gene, the complete CDS of the HFE gene and 3'UTR of the HFE gene, and at least 100 nt of the following intron. The single-stranded or double-stranded DNA having homologous arms to the 6p21.3 region may include more than 150 nt of the first exon of the HFE gene, the complete CDS of the HFE gene and 3'UTR of the HFE gene, and at least 150 nt of the following intron. The single-stranded or double-stranded DNA having homologous arms to the 6p21.3 region may include more than 300 nt of the first exon of the HFE gene, the complete CDS of the HFE gene and 3'UTR of the HFE gene, and at least 300 nt of the following intron. The single-stranded or double-stranded DNA having homologous arms to the 6p21.3 region may include more than 400 nt of the first exon of the HFE gene, the complete CDS of the HFE gene and 3'UTR of the HFE gene, and at least 400 nt of the following intron. Alternatively, the DNA template will be delivered by AAV.

Example 101—Re-Assessment of Lead CRISPR-Cas9/DNA Donor Combinations

After testing the different strategies for HDR gene editing, the lead CRISPR-Cas9/DNA donor combinations will be re-assessed in primary human hepatocytes for efficiency of deletion, recombination, and off-target specificity. Cas9 mRNA or RNP will be formulated into lipid nanoparticles for delivery, sgRNAs will be formulated into nanoparticles or delivered as AAV, and donor DNA will be formulated into nanoparticles or delivered as AAV.

Example 102—In Vivo Testing in Relevant Animal Model

After the CRISPR-Cas9/DNA donor combinations have been re-assessed, the lead formulations will be tested in vivo in a FRG mouse model with the livers repopulated with human hepatocytes (normal or HFE deficient human hepatocytes).

Culture in human cells allows direct testing on the human target and the background human genome, as described above.

Preclinical efficacy and safety evaluations can be observed through engraftment of modified mouse or human hepatocytes in FRG mice. The modified cells can be observed in the months after engraftment.

Example 103—In Vitro Transcribed (IVT) gRNA Screen

Figure 3A:
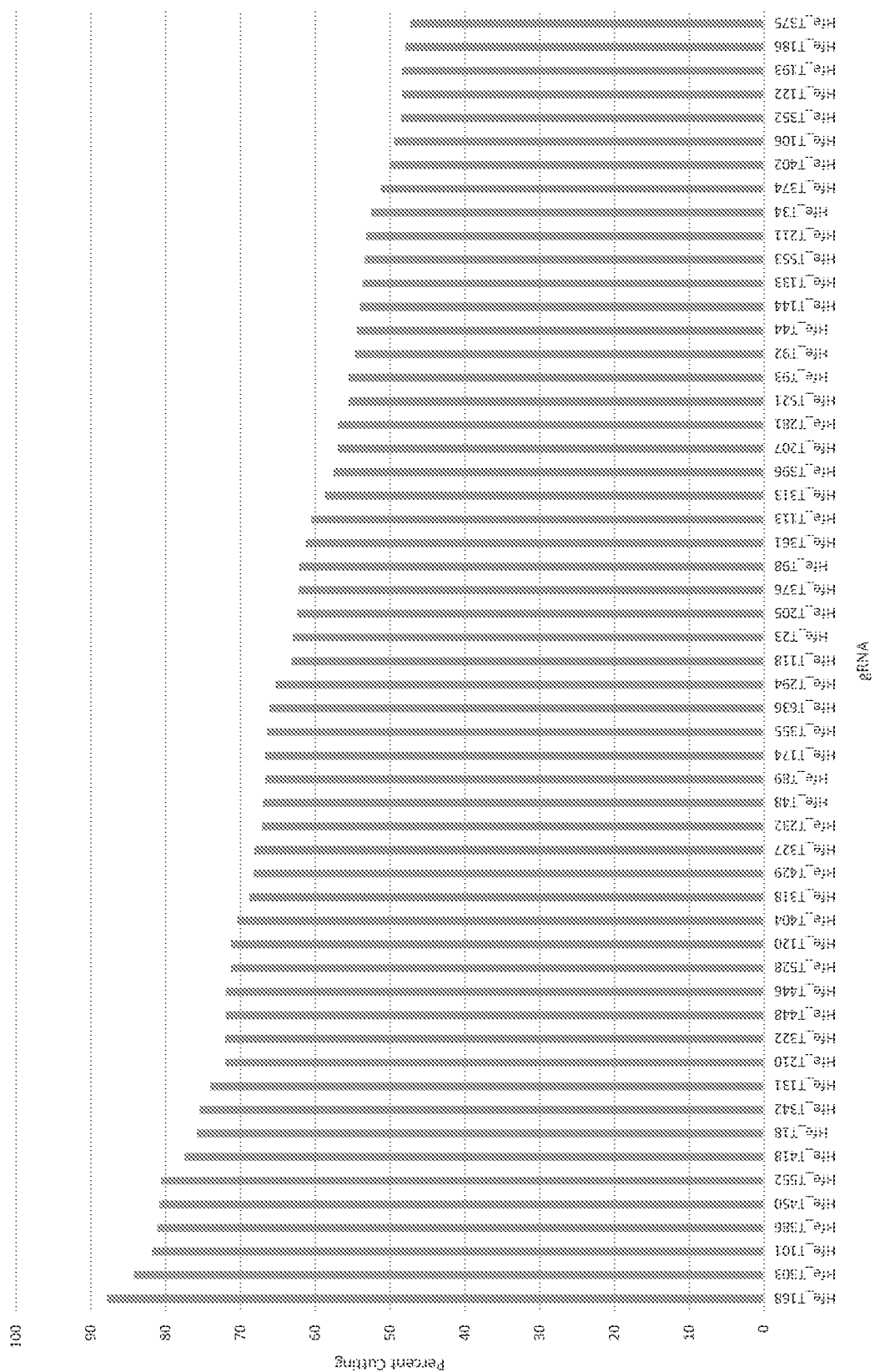
FIG. 3A describes the cutting efficiency of S. pyogenes gRNAs in HEK293T cells targeting the HFE gene.

To identify a large spectrum of pairs of gRNAs able to edit the cognate DNA target region, an in vitro transcribed (IVT) gRNA screen was conducted. The HFE genomic sequence, located on Chromsome 6 (6p21.3 region), was submitted for analysis using a gRNA design software. The resulting list of gRNAs were narrowed to a list of about 200 gRNAs based on uniqueness of sequence (only gRNAs without a perfect match somewhere else in the genome were screened) and minimal predicted off targets. This set of gRNAs were in vitro transcribed, and transfected using messenger Max into HEK293T cells that stably express Cas9. Cells were harvested 48 hours post transfection, the genomic DNA was isolated, and cutting efficiency was evaluated using TIDE analysis. (FIGS. 2A-2D; FIGS. 3A-C).

Note Regarding Illustrative Examples

While the present disclosure provides descriptions of various specific aspects for the purpose of illustrating various aspects of the present invention and/or its potential applications, it is understood that variations and modifications will occur to those skilled in the art. Accordingly, the invention or inventions described herein should be understood to be at least as broad as they are claimed, and not as more narrowly defined by particular illustrative aspects provided herein.

Any patent, publication, or other disclosure material identified herein is incorporated by reference into this specification in its entirety unless otherwise indicated, but only to the extent that the incorporated material does not conflict with existing descriptions, definitions, statements, or other disclosure material expressly set forth in this specification. As such, and to the extent necessary, the express disclosure as set forth in this specification supersedes any conflicting material incorporated by reference. Any material, or portion thereof, that is said to be incorporated by reference into this specification, but which conflicts with existing definitions, statements, or other disclosure material set forth herein, is only incorporated to the extent that no conflict arises between that incorporated material and the existing disclosure material. Applicants reserve the right to amend this specification to expressly recite any subject matter, or portion thereof, incorporated by reference herein.

SEQUENCE LISTING (64987 sequences)

SEQ ID NO: 1 - DNA, 20 bp, Artificial Sequence
  chemically synthesized
ccagaccagcctgaccaaca

SEQ ID NO: 2 - DNA, 20 bp, Artificial Sequence
  chemically synthesized
ctaaaaatacaaaaattaac

SEQ ID NO: 3 - DNA, 20 bp, Artificial Sequence
  chemically synthesized
taaaaatacaaaaattaacc

SEQ ID NO: 4 - DNA, 20 bp, Artificial Sequence
  chemically synthesized
atacaaaaattaaccaggca

SEQ ID NO: 5 - DNA, 20 bp, Artificial Sequence
  chemically synthesized
caaaaattaaccaggcatgg

SEQ ID NO: 6 - DNA, 20 bp, Artificial Sequence
  chemically synthesized
aaattaaccaggcatggtgg

SEQ ID NO: 7 - DNA, 20 bp, Artificial Sequence
  chemically synthesized
aattaaccaggcatggtggc

SEQ ID NO: 8 - DNA, 20 bp, Artificial Sequence
  chemically synthesized
gtggcaggtacctgtaatcc

SEQ ID NO: 9 - DNA, 20 bp, Artificial Sequence
  chemically synthesized
tacctgtaatcccagctgct

SEQ ID NO: 10 - DNA, 20 bp, Artificial Sequence
  chemically synthesized
acctgtaatcccagctgctt

SEQ ID NO: 11 - DNA, 20 bp, Artificial Sequence
  chemically synthesized
ctgtaatcccagctgcttgg

SEQ ID NO: 12 - DNA, 20 bp, Artificial Sequence
  chemically synthesized
tgtaatcccagctgcttggg

SEQ ID NO: 13 - DNA, 20 bp, Artificial Sequence
  chemically synthesized
tcccagctgcttgggaggct

SEQ ID NO: 14 - DNA, 20 bp, Artificial Sequence
  chemically synthesized
cccagctgcttgggaggctg

SEQ ID NO: 15 - DNA, 20 bp, Artificial Sequence
  chemically synthesized
agctgcttgggaggctgagg

SEQ ID NO: 16 - DNA, 20 bp, Artificial Sequence
  chemically synthesized
gctgcttgggaggctgaggc

SEQ ID NO: 17 - DNA, 20 bp, Artificial Sequence
  chemically synthesized
tgcttgggaggctgaggcag

SEQ ID NO: 18 - DNA, 20 bp, Artificial Sequence
  chemically synthesized
gcaggagaattgcttgaacc

SEQ ID NO: 19 - DNA, 20 bp, Artificial Sequence
  chemically synthesized
caggagaattgcttgaacct

SEQ ID NO: 20 - DNA, 20 bp, Artificial Sequence
  chemically synthesized
ggagaattgcttgaacctgg

SEQ ID NO: 21 - DNA, 20 bp, Artificial Sequence
  chemically synthesized
gagaattgcttgaacctggg

SEQ ID NO: 22 - DNA, 20 bp, Artificial Sequence
  chemically synthesized
gaattgcttgaacctgggag

SEQ ID NO: 23 - DNA, 20 bp, Artificial Sequence
  chemically synthesized
aattgcttgaacctgggagg

SEQ ID NO: 24 - DNA, 20 bp, Artificial Sequence
  chemically synthesized
ttgcttgaacctgggaggag

SEQ ID NO: 25 - DNA, 20 bp, Artificial Sequence
  chemically synthesized
ttgaacctgggaggaggagc

SEQ ID NO: 26 - DNA, 20 bp, Artificial Sequence
  chemically synthesized
aacctgggaggaggagccag

SEQ ID NO: 27 - DNA, 20 bp, Artificial Sequence
  chemically synthesized
tgggaggaggagccagtggc

SEQ ID NO: 28 - DNA, 20 bp, Artificial Sequence
  chemically synthesized
gggaggaggagccagtggcc

SEQ ID NO: 29 - DNA, 20 bp, Artificial Sequence
  chemically synthesized
gaggagccagtggccgggat

SEQ ID NO: 30 - DNA, 20 bp, Artificial Sequence
  chemically synthesized
aggagccagtggccgggatt

SEQ ID NO: 31 - DNA, 20 bp, Artificial Sequence
  chemically synthesized
tgggccactgcactccaacc

SEQ ID NO: 32 - DNA, 20 bp, Artificial Sequence
  chemically synthesized
gggccactgcactccaacct

SEQ ID NO: 33 - DNA, 20 bp, Artificial Sequence
  chemically synthesized
ctgcactccaacctgggcaa

SEQ ID NO: 34 - DNA, 20 bp, Artificial Sequence
  chemically synthesized
gcactccaacctgggcaata

SEQ ID NO: 35 - DNA, 20 bp, Artificial Sequence
  chemically synthesized
tccaacctgggcaatagagt

SEQ ID NO: 36 - DNA, 20 bp, Artificial Sequence
  chemically synthesized
ccaacctgggcaatagagtg

SEQ ID NO: 37 - DNA, 20 bp, Artificial Sequence
  chemically synthesized
ggctctgtcaaaaaaaaaaa

SEQ ID NO: 38 - DNA, 20 bp, Artificial Sequence
  chemically synthesized
ctgtcaaaaaaaaaaaaaga

SEQ ID NO: 39 - DNA, 20 bp, Artificial Sequence
  chemically synthesized
tgtcaaaaaaaaaaaaagat

SEQ ID NO: 40 - DNA, 20 bp, Artificial Sequence
  chemically synthesized
aaaaaaaaaagataggatta

SEQ ID NO: 41 - DNA, 20 bp, Artificial Sequence
  chemically synthesized
aaagataggattatagatta

SEQ ID NO: 42 - DNA, 20 bp, Artificial Sequence
  chemically synthesized
gattatagattatagcataa

SEQ ID NO: 43 - DNA, 20 bp, Artificial Sequence
  chemically synthesized
attatagattatagcataat

SEQ ID NO: 44 - DNA, 20 bp, Artificial Sequence
  chemically synthesized
tagcataatgggataaaatt

SEQ ID NO: 45 - DNA, 20 bp, Artificial Sequence
  chemically synthesized
atgggataaaattgagactc

SEQ ID NO: 46 - DNA, 20 bp, Artificial Sequence
  chemically synthesized
gaaataaactctcacattta

SEQ ID NO: 47 - DNA, 20 bp, Artificial Sequence
  chemically synthesized
ataaactctcacatttatgg

SEQ ID NO: 48 - DNA, 20 bp, Artificial Sequence
  chemically synthesized
atggtagattgatttttgat

SEQ ID NO: 49 - DNA, 20 bp, Artificial Sequence
  chemically synthesized
tggtagattgatttttgata

SEQ ID NO: 50 - DNA, 20 bp, Artificial Sequence
  chemically synthesized
ggtagattgatttttgataa

SEQ ID NO: 51 - DNA, 20 bp, Artificial Sequence
  chemically synthesized
ccaaaacacttcaatgaaaa

SEQ ID NO: 52 - DNA, 20 bp, Artificial Sequence
  chemically synthesized
aaaacacttcaatgaaaaaa

SEQ ID NO: 53 - DNA, 20 bp, Artificial Sequence
  chemically synthesized
gaaaaaagagtcttctcaac

SEQ ID NO: 54 - DNA, 20 bp, Artificial Sequence
  chemically synthesized
agagtcttctcaacaagtga

SEQ ID NO: 55 - DNA, 20 bp, Artificial Sequence
  chemically synthesized
gtcttctcaacaagtgatgg

SEQ ID NO: 56 - DNA, 20 bp, Artificial Sequence
  chemically synthesized
aaccacatttttgttctatc

SEQ ID NO: 57 - DNA, 20 bp, Artificial Sequence
  chemically synthesized
accacatttttgttctatct

SEQ ID NO: 58 - DNA, 20 bp, Artificial Sequence
  chemically synthesized
ccacatttttgttctatctg

SEQ ID NO: 59 - DNA, 20 bp, Artificial Sequence
  chemically synthesized
ggggccctgattcaaaaacc

SEQ ID NO: 60 - DNA, 20 bp, Artificial Sequence
  chemically synthesized
gggccctgattcaaaaaccc

SEQ ID NO: 61 - DNA, 20 bp, Artificial Sequence
  chemically synthesized
ctgattcaaaaacccaggca

SEQ ID NO: 62 - DNA, 20 bp, Artificial Sequence
  chemically synthesized
ttcaaaaacccaggcaaaga

SEQ ID NO: 63 - DNA, 20 bp, Artificial Sequence
  chemically synthesized
caaaaacccaggcaaagatg

SEQ ID NO: 64 - DNA, 20 bp, Artificial Sequence
  chemically synthesized
aaaacccaggcaaagatgga

SEQ ID NO: 65 - DNA, 20 bp, Artificial Sequence
  chemically synthesized
aggcaaagatggagagaaat

SEQ ID NO: 66 - DNA, 20 bp, Artificial Sequence
  chemically synthesized
gaactctcatacactgctga

SEQ ID NO: 67 - DNA, 20 bp, Artificial Sequence
  chemically synthesized
aactctcatacactgctgat

SEQ ID NO: 68 - DNA, 20 bp, Artificial Sequence
  chemically synthesized
ctctcatacactgctgatag

SEQ ID NO: 69 - DNA, 20 bp, Artificial Sequence
  chemically synthesized
tctcatacactgctgatagg

SEQ ID NO: 70 - DNA, 20 bp, Artificial Sequence
  chemically synthesized
ggaggataaaatgcttactt

SEQ ID NO: 71 - DNA, 20 bp, Artificial Sequence
  chemically synthesized
ataaaatgcttactttggaa

SEQ ID NO: 72 - DNA, 20 bp, Artificial Sequence
  chemically synthesized
gcttactttggaaaagaatg

SEQ ID NO: 73 - DNA, 20 bp, Artificial Sequence
  chemically synthesized
agaatgtggcaattcctcaa

SEQ ID NO: 74 - DNA, 20 bp, Artificial Sequence
  chemically synthesized
gaatgtggcaattcctcaaa

SEQ ID NO: 75 - DNA, 20 bp, Artificial Sequence
  chemically synthesized
caattcctcaaaaggttaaa

SEQ ID NO: 76 - DNA, 20 bp, Artificial Sequence
  chemically synthesized
aacagtgttaccatatgacc

SEQ ID NO: 77 - DNA, 20 bp, Artificial Sequence
  chemically synthesized
tgacccagcaaacccacttc

SEQ ID NO: 78 - DNA, 20 bp, Artificial Sequence
  chemically synthesized
acttctagatatataaccaa

SEQ ID NO: 79 - DNA, 20 bp, Artificial Sequence
  chemically synthesized
accaaaagaaatcaaaacat

SEQ ID NO: 80 - DNA, 20 bp, Artificial Sequence
  chemically synthesized
ttgtacataaatgtttataa

SEQ ID NO: 81 - DNA, 20 bp, Artificial Sequence
  chemically synthesized
tataacagcactattcccaa

SEQ ID NO: 82 - DNA, 20 bp, Artificial Sequence
  chemically synthesized
cactattcccaatagccata

SEQ ID NO: 83 - DNA, 20 bp, Artificial Sequence
  chemically synthesized
tattcccaatagccataaag

SEQ ID NO: 84 - DNA, 20 bp, Artificial Sequence
  chemically synthesized
agaaacaaaccaatgtccat

SEQ ID NO: 85 - DNA, 20 bp, Artificial Sequence
  chemically synthesized
tgaataaataaaatatgttg

SEQ ID NO: 86 - DNA, 20 bp, Artificial Sequence
  chemically synthesized
gttgtggtatgtccttataa

SEQ ID NO: 87 - DNA, 20 bp, Artificial Sequence
  chemically synthesized
gtccttataatagatattat

SEQ ID NO: 88 - DNA, 20 bp, Artificial Sequence
  chemically synthesized
aaaaacattatgctaaatga

SEQ ID NO: 89 - DNA, 20 bp, Artificial Sequence
  chemically synthesized
aacattatgctaaatgaaag

SEQ ID NO: 90 - DNA, 20 bp, Artificial Sequence
  chemically synthesized
ttatgctaaatgaaagaagc

SEQ ID NO: 91 - DNA, 20 bp, Artificial Sequence
  chemically synthesized
taaatgaaagaagccagtca

SEQ ID NO: 92 - DNA, 20 bp, Artificial Sequence
  chemically synthesized
gaaagaagccagtcacggca

SEQ ID NO: 93 - DNA, 20 bp, Artificial Sequence
  chemically synthesized
tgtatactaaatgttccaaa

SEQ ID NO: 94 - DNA, 20 bp, Artificial Sequence
  chemically synthesized
tactaaatgttccaaataga

SEQ ID NO: 95 - DNA, 20 bp, Artificial Sequence
  chemically synthesized
aaatgttccaaatagaaaga

SEQ ID NO: 96 - DNA, 20 bp, Artificial Sequence
  chemically synthesized
tgttccaaatagaaagaaag

SEQ ID NO: 97 - DNA, 20 bp, Artificial Sequence
  chemically synthesized
aatagaaagaaagtagatta

SEQ ID NO: 98 - DNA, 20 bp, Artificial Sequence
  chemically synthesized
aaagtagattaaagattgtc

SEQ ID NO: 99 - DNA, 20 bp, Artificial Sequence
  chemically synthesized
aagtagattaaagattgtct

SEQ ID NO: 100 - DNA, 20 bp, Artificial Sequence
  chemically synthesized
agtagattaaagattgtcta

SEQ ID NO: 101 - DNA, 20 bp, Artificial Sequence
  chemically synthesized
gattaaagattgtctagggc

SEQ ID NO: 102 - DNA, 20 bp, Artificial Sequence
  chemically synthesized
attaaagattgtctagggct

SEQ ID NO: 103 - DNA, 20 bp, Artificial Sequence
  chemically synthesized
taaagattgtctagggctgg

SEQ ID NO: 104 - DNA, 20 bp, Artificial Sequence
  chemically synthesized
aaagattgtctagggctggg

SEQ ID NO: 105 - DNA, 20 bp, Artificial Sequence
  chemically synthesized
aagattgtctagggctggga

SEQ ID NO: 106 - DNA, 20 bp, Artificial Sequence
  chemically synthesized
agattgtctagggctgggag

SEQ ID NO: 107 - DNA, 20 bp, Artificial Sequence
  chemically synthesized
attgtctagggctgggaggg

SEQ ID NO: 108 - DNA, 20 bp, Artificial Sequence
  chemically synthesized
ttgtctagggctgggagggg

SEQ ID NO: 109 - DNA, 20 bp, Artificial Sequence
  chemically synthesized
gtctagggctgggaggggag

SEQ ID NO: 110 - DNA, 20 bp, Artificial Sequence
  chemically synthesized
tctagggctgggaggggagg

SEQ ID NO: 111 - DNA, 20 bp, Artificial Sequence
  chemically synthesized
tagggctgggaggggaggag

SEQ ID NO: 112 - DNA, 20 bp, Artificial Sequence
  chemically synthesized
agggctgggaggggaggagg

SEQ ID NO: 113 - DNA, 20 bp, Artificial Sequence
  chemically synthesized
ggctgggaggggaggaggag

SEQ ID NO: 114 - DNA, 20 bp, Artificial Sequence
  chemically synthesized
ggaggggaggaggaggagaa

SEQ ID NO: 115 - DNA, 20 bp, Artificial Sequence
  chemically synthesized
aggggaggaggaggagaatg

SEQ ID NO: 116 - DNA, 20 bp, Artificial Sequence
  chemically synthesized
ggggaggaggaggagaatgg

SEQ ID NO: 117 - DNA, 20 bp, Artificial Sequence
  chemically synthesized
aggaggagaatggaggaatc

SEQ ID NO: 118 - DNA, 20 bp, Artificial Sequence
  chemically synthesized
ggaggagaatggaggaatct

SEQ ID NO: 119 - DNA, 20 bp, Artificial Sequence
  chemically synthesized
aggagaatggaggaatctgg

SEQ ID NO: 120 - DNA, 20 bp, Artificial Sequence
  chemically synthesized
ggagaatggaggaatctggg

SEQ ID NO: 121 - DNA, 20 bp, Artificial Sequence
  chemically synthesized
aatctgggaggcgatgaatt

SEQ ID NO: 122 - DNA, 20 bp, Artificial Sequence
  chemically synthesized
atctgggaggcgatgaatta

SEQ ID NO: 123 - DNA, 20 bp, Artificial Sequence
  chemically synthesized
tctgggaggcgatgaattaa

SEQ ID NO: 124 - DNA, 20 bp, Artificial Sequence
  chemically synthesized
atgaattaagggtactgaat

SEQ ID NO: 125 - DNA, 20 bp, Artificial Sequence
  chemically synthesized
tgaattaagggtactgaatt

SEQ ID NO: 126 - DNA, 20 bp, Artificial Sequence
  chemically synthesized
gaattaagggtactgaatta

SEQ ID NO: 127 - DNA, 20 bp, Artificial Sequence
  chemically synthesized
aattaagggtactgaattag

SEQ ID NO: 128 - DNA, 20 bp, Artificial Sequence
  chemically synthesized
ggtactgaattaggggaaca

SEQ ID NO: 129 - DNA, 20 bp, Artificial Sequence
  chemically synthesized
aggggaacatggtttctttt

SEQ ID NO: 130 - DNA, 20 bp, Artificial Sequence
  chemically synthesized
ggggaacatggtttcttttt

SEQ ID NO: 131 - DNA, 20 bp, Artificial Sequence
  chemically synthesized
gggaacatggtttctttttg

SEQ ID NO: 132 - DNA, 20 bp, Artificial Sequence
  chemically synthesized
gaacatggtttctttttggg

SEQ ID NO: 133 - DNA, 20 bp, Artificial Sequence
  chemically synthesized
atggtttctttttggggaga

SEQ ID NO: 134 - DNA, 20 bp, Artificial Sequence
  chemically synthesized
gagatagaaatgtaaaattt

SEQ ID NO: 135 - DNA, 20 bp, Artificial Sequence
  chemically synthesized
gaaatgtaaaattttggtaa

SEQ ID NO: 136 - DNA, 20 bp, Artificial Sequence
  chemically synthesized
attttatttattttattttt

SEQ ID NO: 137 - DNA, 20 bp, Artificial Sequence
  chemically synthesized
tatttattttatttttgaga

SEQ ID NO: 138 - DNA, 20 bp, Artificial Sequence
  chemically synthesized
tttattttatttttgagacg

SEQ ID NO: 139 - DNA, 20 bp, Artificial Sequence
  chemically synthesized
ggagtttcgctcttgttgcc

SEQ ID NO: 140 - DNA, 20 bp, Artificial Sequence
  chemically synthesized
gagtttcgctcttgttgccc

SEQ ID NO: 141 - DNA, 20 bp, Artificial Sequence
  chemically synthesized
ttcgctcttgttgcccaggc

SEQ ID NO: 142 - DNA, 20 bp, Artificial Sequence
  chemically synthesized
cgctcttgttgcccaggctg

SEQ ID NO: 143 - DNA, 20 bp, Artificial Sequence
  chemically synthesized
ttgcccaggctggagtgcaa

SEQ ID NO: 144 - DNA, 20 bp, Artificial Sequence
  chemically synthesized
ggagtgcaatggcatgatct

SEQ ID NO: 145 - DNA, 20 bp, Artificial Sequence
  chemically synthesized
tcaccacaacctccgcctcc

SEQ ID NO: 146 - DNA, 20 bp, Artificial Sequence
  chemically synthesized
caccacaacctccgcctccc

SEQ ID NO: 147 - DNA, 20 bp, Artificial Sequence
  chemically synthesized
aacctccgcctcccaggttc

SEQ ID NO: 148 - DNA, 20 bp, Artificial Sequence
  chemically synthesized
ttcaagcgattctcctgtct

SEQ ID NO: 149 - DNA, 20 bp, Artificial Sequence
  chemically synthesized
ttctcctgtctcagcttccc

SEQ ID NO: 150 - DNA, 20 bp, Artificial Sequence
  chemically synthesized
tcctgtctcagcttcccgag

SEQ ID NO: 151 - DNA, 20 bp, Artificial Sequence
  chemically synthesized
gtctcagcttcccgagtagc

SEQ ID NO: 152 - DNA, 20 bp, Artificial Sequence
  chemically synthesized
ttcccgagtagctggaatta

SEQ ID NO: 153 - DNA, 20 bp, Artificial Sequence
  chemically synthesized
tcccgagtagctggaattac

SEQ ID NO: 154 - DNA, 20 bp, Artificial Sequence
  chemically synthesized
caggtgcatgccaccacacc

SEQ ID NO: 155 - DNA, 20 bp, Artificial Sequence
  chemically synthesized
ccagctaatttttttttttt

SEQ ID NO: 156 - DNA, 20 bp, Artificial Sequence
  chemically synthesized
aattttttttttttgagatg

SEQ ID NO: 157 - DNA, 20 bp, Artificial Sequence
  chemically synthesized
cttgctcttgtctcccatgc

SEQ ID NO: 158 - DNA, 20 bp, Artificial Sequence
  chemically synthesized
tgctcttgtctcccatgctg

SEQ ID NO: 159 - DNA, 20 bp, Artificial Sequence
  chemically synthesized
tctcccatgctggagtgtga

SEQ ID NO: 160 - DNA, 20 bp, Artificial Sequence
  chemically synthesized
ggagtgtgatggcacgatct

SEQ ID NO: 161 - DNA, 20 bp, Artificial Sequence
  chemically synthesized
tcactgcaacctacgcctcc

SEQ ID NO: 162 - DNA, 20 bp, Artificial Sequence
  chemically synthesized
cactgcaacctacgcctccc

SEQ ID NO: 163 - DNA, 20 bp, Artificial Sequence
  chemically synthesized
aacctacgcctcccgggttc

SEQ ID NO: 164 - DNA, 20 bp, Artificial Sequence
  chemically synthesized
ttcaagcgattctcctgcct

SEQ ID NO: 165 - DNA, 20 bp, Artificial Sequence
  chemically synthesized
tcctgcctcagcctctaatg

SEQ ID NO: 166 - DNA, 20 bp, Artificial Sequence
  chemically synthesized
gcctcagcctctaatgtagc

SEQ ID NO: 167 - DNA, 20 bp, Artificial Sequence
  chemically synthesized
cctcagcctctaatgtagct

SEQ ID NO: 168 - DNA, 20 bp, Artificial Sequence
  chemically synthesized
ctctaatgtagctgggatta

SEQ ID NO: 169 - DNA, 20 bp, Artificial Sequence
  chemically synthesized
cagttgcctgctatcacgcc

SEQ ID NO: 170 - DNA, 20 bp, Artificial Sequence
  chemically synthesized
ccggctaatttttgtatttt

SEQ ID NO: 171 - DNA, 20 bp, Artificial Sequence
  chemically synthesized
taatttttgtatttttagta

SEQ ID NO: 172 - DNA, 20 bp, Artificial Sequence
  chemically synthesized
ttttgtatttttagtaaaga

SEQ ID NO: 173 - DNA, 20 bp, Artificial Sequence
  chemically synthesized
tttgtatttttagtaaagac

SEQ ID NO: 174 - DNA, 20 bp, Artificial Sequence
  chemically synthesized
ttgtatttttagtaaagacg

SEQ ID NO: 175 - DNA, 20 bp, Artificial Sequence
  chemically synthesized
aagacggggtttcaccatgt

SEQ ID NO: 176 - DNA, 20 bp, Artificial Sequence
  chemically synthesized
cggggtttcaccatgttggc

SEQ ID NO: 177 - DNA, 20 bp, Artificial Sequence
  chemically synthesized
ggggtttcaccatgttggcc

SEQ ID NO: 178 - DNA, 20 bp, Artificial Sequence
  chemically synthesized
tttcaccatgttggccaggc

SEQ ID NO: 179 - DNA, 20 bp, Artificial Sequence
  chemically synthesized
tggtctcgaacccctgatct

SEQ ID NO: 180 - DNA, 20 bp, Artificial Sequence
  chemically synthesized
ggtctcgaacccctgatctc

SEQ ID NO: 181 - DNA, 20 bp, Artificial Sequence
  chemically synthesized
ctcaggtgatctgccttcct

SEQ ID NO: 182 - DNA, 20 bp, Artificial Sequence
  chemically synthesized
ctgccttcctcggccgccca

SEQ ID NO: 183 - DNA, 20 bp, Artificial Sequence
  chemically synthesized
tcctcggccgcccaaagtgc

SEQ ID NO: 184 - DNA, 20 bp, Artificial Sequence
  chemically synthesized
cctcggccgcccaaagtgct

SEQ ID NO: 185 - DNA, 20 bp, Artificial Sequence
  chemically synthesized
gcccaaagtgctgggattac

SEQ ID NO: 186 - DNA, 20 bp, Artificial Sequence
  chemically synthesized
agtgctgggattacaagcgt

SEQ ID NO: 187 - DNA, 20 bp, Artificial Sequence
  chemically synthesized
gattacaagcgtgagccact

SEQ ID NO: 188 - DNA, 20 bp, Artificial Sequence
  chemically synthesized
acaagcgtgagccactgagc

SEQ ID NO: 189 - DNA, 20 bp, Artificial Sequence
  chemically synthesized
caagcgtgagccactgagcc

SEQ ID NO: 190 - DNA, 20 bp, Artificial Sequence
  chemically synthesized
gccaatttttgcattttaca

SEQ ID NO: 191 - DNA, 20 bp, Artificial Sequence
  chemically synthesized
ttttacatagatgaattata

SEQ ID NO: 192 - DNA, 20 bp, Artificial Sequence
  chemically synthesized
tcttaccaaaaattgaaaaa

SEQ ID NO: 193 - DNA, 20 bp, Artificial Sequence
  chemically synthesized
cttaccaaaaattgaaaaaa

SEQ ID NO: 194 - DNA, 20 bp, Artificial Sequence
  chemically synthesized
caaaaattgaaaaaaaggaa

SEQ ID NO: 195 - DNA, 20 bp, Artificial Sequence
  chemically synthesized
aaaaaaaggaatagtactat

SEQ ID NO: 196 - DNA, 20 bp, Artificial Sequence
  chemically synthesized
ttattgtatctgtttgccta

SEQ ID NO: 197 - DNA, 20 bp, Artificial Sequence
  chemically synthesized
gtatctgtttgcctacagtc

SEQ ID NO: 198 - DNA, 20 bp, Artificial Sequence
  chemically synthesized
tatctgtttgcctacagtcg

SEQ ID NO: 199 - DNA, 20 bp, Artificial Sequence
  chemically synthesized
ataatgcctgttgaatttgc

SEQ ID NO: 200 - DNA, 20 bp, Artificial Sequence
  chemically synthesized
ttgaatttgctagatatgta

SEQ ID NO: 201 - DNA, 20 bp, Artificial Sequence
  chemically synthesized
tgaatttgctagatatgtaa

SEQ ID NO: 202 - DNA, 20 bp, Artificial Sequence
  chemically synthesized
ttgctagatatgtaaaggtt

SEQ ID NO: 203 - DNA, 20 bp, Artificial Sequence
  chemically synthesized
gctagatatgtaaaggtttg

SEQ ID NO: 204 - DNA, 20 bp, Artificial Sequence
  chemically synthesized
tgtaaaggtttggagcaaat

SEQ ID NO: 205 - DNA, 20 bp, Artificial Sequence
  chemically synthesized
gtaaaggtttggagcaaatc

SEQ ID NO: 206 - DNA, 20 bp, Artificial Sequence
  chemically synthesized
taatattgtttgaaatgtct

SEQ ID NO: 207 - DNA, 20 bp, Artificial Sequence
  chemically synthesized
aatattgtttgaaatgtcta

SEQ ID NO: 208 - DNA, 20 bp, Artificial Sequence
  chemically synthesized
aataattcccaaacttcgtt

SEQ ID NO: 209 - DNA, 20 bp, Artificial Sequence
  chemically synthesized
ataattcccaaacttcgttg

SEQ ID NO: 210 - DNA, 20 bp, Artificial Sequence
  chemically synthesized
taattcccaaacttcgttga

SEQ ID NO: 211 - DNA, 20 bp, Artificial Sequence
  chemically synthesized
attcccaaacttcgttgagg

SEQ ID NO: 212 - DNA, 20 bp, Artificial Sequence
  chemically synthesized
cccaaacttcgttgagggag

SEQ ID NO: 213 - DNA, 20 bp, Artificial Sequence
  chemically synthesized
ccaaacttcgttgagggaga

SEQ ID NO: 214 - DNA, 20 bp, Artificial Sequence
  chemically synthesized
acttcgttgagggagaagga

SEQ ID NO: 215 - DNA, 20 bp, Artificial Sequence
  chemically synthesized
gcttttaaaatcccattgcc

SEQ ID NO: 216 - DNA, 20 bp, Artificial Sequence
  chemically synthesized
cttttaaaatcccattgccc

SEQ ID NO: 217 - DNA, 20 bp, Artificial Sequence
  chemically synthesized
ttaaaatcccattgcccagg

SEQ ID NO: 218 - DNA, 20 bp, Artificial Sequence
  chemically synthesized
gtggcatcccatactgttac

SEQ ID NO: 219 - DNA, 20 bp, Artificial Sequence
  chemically synthesized
tggcatcccatactgttact

SEQ ID NO: 220 - DNA, 20 bp, Artificial Sequence
  chemically synthesized
tgttactgggaattatgcat

SEQ ID NO: 221 - DNA, 20 bp, Artificial Sequence
  chemically synthesized
gttactgggaattatgcatt

SEQ ID NO: 222 - DNA, 20 bp, Artificial Sequence
  chemically synthesized
ctgggaattatgcattggga

SEQ ID NO: 223 - DNA, 20 bp, Artificial Sequence
  chemically synthesized
ttgggatggatcctttaacc

SEQ ID NO: 224 - DNA, 20 bp, Artificial Sequence
  chemically synthesized
tgggatggatcctttaaccg

SEQ ID NO: 225 - DNA, 20 bp, Artificial Sequence
  chemically synthesized
ggatggatcctttaaccgag

SEQ ID NO: 226 - DNA, 20 bp, Artificial Sequence
  chemically synthesized
tttaaccgaggagattatta

SEQ ID NO: 227 - DNA, 20 bp, Artificial Sequence
  chemically synthesized
accgaggagattattatagc

SEQ ID NO: 228 - DNA, 20 bp, Artificial Sequence
  chemically synthesized
cgaggagattattatagccg

SEQ ID NO: 229 - DNA, 20 bp, Artificial Sequence
  chemically synthesized
ttatagccggagctctgaac

SEQ ID NO: 230 - DNA, 20 bp, Artificial Sequence
  chemically synthesized
gagctctgaaccagcaatct

SEQ ID NO: 231 - DNA, 20 bp, Artificial Sequence
  chemically synthesized
agcaatctcagttcttgtga

SEQ ID NO: 232 - DNA, 20 bp, Artificial Sequence
  chemically synthesized
atctcagttcttgtgatagt

SEQ ID NO: 233 - DNA, 20 bp, Artificial Sequence
  chemically synthesized
agttcttgtgatagtgagca

SEQ ID NO: 234 - DNA, 20 bp, Artificial Sequence
  chemically synthesized
acaaactaacaccaaaatgc

SEQ ID NO: 235 - DNA, 20 bp, Artificial Sequence
  chemically synthesized
aacaccaaaatgcaagctta

SEQ ID NO: 236 - DNA, 20 bp, Artificial Sequence
  chemically synthesized
caaaatgcaagcttaaagca

SEQ ID NO: 237 - DNA, 20 bp, Artificial Sequence
  chemically synthesized
gcttaaagcaaagtttattg

SEQ ID NO: 238 - DNA, 20 bp, Artificial Sequence
  chemically synthesized
gaagcacaataatacactct

SEQ ID NO: 239 - DNA, 20 bp, Artificial Sequence
  chemically synthesized
aagcacaataatacactctg

SEQ ID NO: 240 - DNA, 20 bp, Artificial Sequence
  chemically synthesized
agcacaataatacactctga

SEQ ID NO: 241 - DNA, 20 bp, Artificial Sequence
  chemically synthesized
caataatacactctgaggga

SEQ ID NO: 242 - DNA, 20 bp, Artificial Sequence
  chemically synthesized
taatacactctgagggacag

SEQ ID NO: 243 - DNA, 20 bp, Artificial Sequence
  chemically synthesized
aatacactctgagggacagc

SEQ ID NO: 244 - DNA, 20 bp, Artificial Sequence
  chemically synthesized
acagcgggcttatttctgcg

SEQ ID NO: 245 - DNA, 20 bp, Artificial Sequence
  chemically synthesized
ttatttctgcgaagtgaact

SEQ ID NO: 246 - DNA, 20 bp, Artificial Sequence
  chemically synthesized
gtgaactcagcacttcttta

SEQ ID NO: 247 - DNA, 20 bp, Artificial Sequence
  chemically synthesized
gaactcagcacttctttaca

SEQ ID NO: 248 - DNA, 20 bp, Artificial Sequence
  chemically synthesized
agcacttctttacagagctc

SEQ ID NO: 249 - DNA, 20 bp, Artificial Sequence
  chemically synthesized
gcacttctttacagagctca

SEQ ID NO: 250 - DNA, 20 bp, Artificial Sequence
  chemically synthesized
cagagctcaaggtgctttta

SEQ ID NO: 251 - DNA, 20 bp, Artificial Sequence
  chemically synthesized
agagctcaaggtgcttttat

SEQ ID NO: 252 - DNA, 20 bp, Artificial Sequence
  chemically synthesized
gagctcaaggtgcttttatg

SEQ ID NO: 253 - DNA, 20 bp, Artificial Sequence
  chemically synthesized
aggtgcttttatggggtttg

SEQ ID NO: 254 - DNA, 20 bp, Artificial Sequence
  chemically synthesized
ggtgcttttatggggtttgt

SEQ ID NO: 255 - DNA, 20 bp, Artificial Sequence
  chemically synthesized
gtgcttttatggggtttgtg

SEQ ID NO: 256 - DNA, 20 bp, Artificial Sequence
  chemically synthesized
gcttttatggggtttgtggg

SEQ ID NO: 257 - DNA, 20 bp, Artificial Sequence
  chemically synthesized
cttttatggggtttgtgggg

SEQ ID NO: 258 - DNA, 20 bp, Artificial Sequence
  chemically synthesized
tttatggggtttgtggggag

SEQ ID NO: 259 - DNA, 20 bp, Artificial Sequence
  chemically synthesized
ggggtttgtggggaggagtt

SEQ ID NO: 260 - DNA, 20 bp, Artificial Sequence
  chemically synthesized
gggtttgtggggaggagttg

SEQ ID NO: 261 - DNA, 20 bp, Artificial Sequence
  chemically synthesized
tgtggggaggagttgaggtt

SEQ ID NO: 262 - DNA, 20 bp, Artificial Sequence
  chemically synthesized
gtggggaggagttgaggttt

SEQ ID NO: 263 - DNA, 20 bp, Artificial Sequence
  chemically synthesized
ttgaggtttgggctgtatct

SEQ ID NO: 264 - DNA, 20 bp, Artificial Sequence
  chemically synthesized
tttgggctgtatctgagtga

SEQ ID NO: 265 - DNA, 20 bp, Artificial Sequence
  chemically synthesized
ttgggctgtatctgagtgac

SEQ ID NO: 266 - DNA, 20 bp, Artificial Sequence
  chemically synthesized
aggatgatgttatttgattg

SEQ ID NO: 267 - DNA, 20 bp, Artificial Sequence
  chemically synthesized
tgttatttgattgaagtgta

SEQ ID NO: 268 - DNA, 20 bp, Artificial Sequence
  chemically synthesized
atctaaaattaaactgtgca

SEQ ID NO: 269 - DNA, 20 bp, Artificial Sequence
  chemically synthesized
ggtcttacctataatttgtt

SEQ ID NO: 270 - DNA, 20 bp, Artificial Sequence
  chemically synthesized
tacctataatttgttaagaa

SEQ ID NO: 271 - DNA, 20 bp, Artificial Sequence
  chemically synthesized
atttgttaagaaaagcctcc

SEQ ID NO: 272 - DNA, 20 bp, Artificial Sequence
  chemically synthesized
tttgttaagaaaagcctccc

SEQ ID NO: 273 - DNA, 20 bp, Artificial Sequence
  chemically synthesized
ttgttaagaaaagcctccca

SEQ ID NO: 274 - DNA, 20 bp, Artificial Sequence
  chemically synthesized
taagaaaagcctcccaggga

SEQ ID NO: 275 - DNA, 20 bp, Artificial Sequence
  chemically synthesized
aagaaaagcctcccagggat

SEQ ID NO: 276 - DNA, 20 bp, Artificial Sequence
  chemically synthesized
agaaaagcctcccagggatg

SEQ ID NO: 277 - DNA, 20 bp, Artificial Sequence
  chemically synthesized
gaaaagcctcccagggatgg

SEQ ID NO: 278 - DNA, 20 bp, Artificial Sequence
  chemically synthesized
aaaagcctcccagggatggg

SEQ ID NO: 279 - DNA, 20 bp, Artificial Sequence
  chemically synthesized
aaagcctcccagggatgggg

SEQ ID NO: 280 - DNA, 20 bp, Artificial Sequence
  chemically synthesized
tgtaaattctattataatga

SEQ ID NO: 281 - DNA, 20 bp, Artificial Sequence
  chemically synthesized
taatgatggcatgatgaact

SEQ ID NO: 282 - DNA, 20 bp, Artificial Sequence
  chemically synthesized
aatgatggcatgatgaactt

SEQ ID NO: 283 - DNA, 20 bp, Artificial Sequence
  chemically synthesized
atgatggcatgatgaacttg

SEQ ID NO: 284 - DNA, 20 bp, Artificial Sequence
  chemically synthesized
atgaacttggggtgaacttg

SEQ ID NO: 285 - DNA, 20 bp, Artificial Sequence
  chemically synthesized
acttggggtgaacttgaaga

SEQ ID NO: 286 - DNA, 20 bp, Artificial Sequence
  chemically synthesized
cttggggtgaacttgaagac

SEQ ID NO: 287 - DNA, 20 bp, Artificial Sequence
  chemically synthesized
aagacaggcttttgtgttgt

SEQ ID NO: 288 - DNA, 20 bp, Artificial Sequence
  chemically synthesized
agacaggcttttgtgttgtt

SEQ ID NO: 289 - DNA, 20 bp, Artificial Sequence
  chemically synthesized
ttgttgggcatgtgccacct

SEQ ID NO: 290 - DNA, 20 bp, Artificial Sequence
  chemically synthesized
tgttgggcatgtgccacctt

SEQ ID NO: 291 - DNA, 20 bp, Artificial Sequence
  chemically synthesized
gttgggcatgtgccacctta

SEQ ID NO: 292 - DNA, 20 bp, Artificial Sequence
  chemically synthesized
taccctcctttctctttctc

SEQ ID NO: 293 - DNA, 20 bp, Artificial Sequence
  chemically synthesized
accctcctttctctttctcc

SEQ ID NO: 294 - DNA, 20 bp, Artificial Sequence
  chemically synthesized
tctctttctccaggatattt

SEQ ID NO: 295 - DNA, 20 bp, Artificial Sequence
  chemically synthesized
tctccaggatattttggcca

SEQ ID NO: 296 - DNA, 20 bp, Artificial Sequence
  chemically synthesized
ttatcataaactccatccct

SEQ ID NO: 297 - DNA, 20 bp, Artificial Sequence
  chemically synthesized
tatcataaactccatccctt

SEQ ID NO: 298 - DNA, 20 bp, Artificial Sequence
  chemically synthesized
atcataaactccatccctta

SEQ ID NO: 299 - DNA, 20 bp, Artificial Sequence
  chemically synthesized
ataaactccatcccttaggg

SEQ ID NO: 300 - DNA, 20 bp, Artificial Sequence
  chemically synthesized
tccatcccttagggtggcat

SEQ ID NO: 301 - DNA, 20 bp, Artificial Sequence
  chemically synthesized
ccatcccttagggtggcatt

SEQ ID NO: 302 - DNA, 20 bp, Artificial Sequence
  chemically synthesized
catcccttagggtggcatta

SEQ ID NO: 303 - DNA, 20 bp, Artificial Sequence
  chemically synthesized
cccttagggtggcattaggg

SEQ ID NO: 304 - DNA, 20 bp, Artificial Sequence
  chemically synthesized
gggtggcattagggtagtct

SEQ ID NO: 305 - DNA, 20 bp, Artificial Sequence
  chemically synthesized
ggtggcattagggtagtctt

SEQ ID NO: 306 - DNA, 20 bp, Artificial Sequence
  chemically synthesized
ggtagtcttgggcctgaatt

SEQ ID NO: 307 - DNA, 20 bp, Artificial Sequence
  chemically synthesized
gtagtcttgggcctgaattt

SEQ ID NO: 308 - DNA, 20 bp, Artificial Sequence
  chemically synthesized
gtcttgggcctgaatttagg

SEQ ID NO: 309 - DNA, 20 bp, Artificial Sequence
  chemically synthesized
tcttgggcctgaatttaggt

SEQ ID NO: 310 - DNA, 20 bp, Artificial Sequence
  chemically synthesized
gggcctgaatttaggtgggc

SEQ ID NO: 311 - DNA, 20 bp, Artificial Sequence
  chemically synthesized
cctgaatttaggtgggccag

SEQ ID NO: 312 - DNA, 20 bp, Artificial Sequence
  chemically synthesized
aggtgggccagtggctgtct

SEQ ID NO: 313 - DNA, 20 bp, Artificial Sequence
  chemically synthesized
gccagtggctgtcttagtga

SEQ ID NO: 314 - DNA, 20 bp, Artificial Sequence
  chemically synthesized
ctaacaattacccattaaat

SEQ ID NO: 315 - DNA, 20 bp, Artificial Sequence
  chemically synthesized
acccattaaatcagtgtgtc

SEQ ID NO: 316 - DNA, 20 bp, Artificial Sequence
  chemically synthesized
cccattaaatcagtgtgtct

SEQ ID NO: 317 - DNA, 20 bp, Artificial Sequence
  chemically synthesized
ccattaaatcagtgtgtctg

SEQ ID NO: 318 - DNA, 20 bp, Artificial Sequence
  chemically synthesized
taaatcagtgtgtctggggt

SEQ ID NO: 319 - DNA, 20 bp, Artificial Sequence
  chemically synthesized
aaatcagtgtgtctggggtt

SEQ ID NO: 320 - DNA, 20 bp, Artificial Sequence
  chemically synthesized
atcagtgtgtctggggttag

SEQ ID NO: 321 - DNA, 20 bp, Artificial Sequence
  chemically synthesized
agtgtgtctggggttaggag

SEQ ID NO: 322 - DNA, 20 bp, Artificial Sequence
  chemically synthesized
gtgtgtctggggttaggagc

SEQ ID NO: 323 - DNA, 20 bp, Artificial Sequence
  chemically synthesized
caatatgtttaatcattctc

SEQ ID NO: 324 - DNA, 20 bp, Artificial Sequence
  chemically synthesized
cagataatcccaatactgta

SEQ ID NO: 325 - DNA, 20 bp, Artificial Sequence
  chemically synthesized
aaagtttgtgaaacacttgt

SEQ ID NO: 326 - DNA, 20 bp, Artificial Sequence
  chemically synthesized
tgtcagataattcaattatg

SEQ ID NO: 327 - DNA, 20 bp, Artificial Sequence
  chemically synthesized
gtcagataattcaattatga

SEQ ID NO: 328 - DNA, 20 bp, Artificial Sequence
  chemically synthesized
taattcaattatgaaggctg

SEQ ID NO: 329 - DNA, 20 bp, Artificial Sequence
  chemically synthesized
ttcaattatgaaggctgtgg

SEQ ID NO: 330 - DNA, 20 bp, Artificial Sequence
  chemically synthesized
tcaattatgaaggctgtgga

SEQ ID NO: 331 - DNA, 20 bp, Artificial Sequence
  chemically synthesized
gaaggctgtggaaggtgttt

SEQ ID NO: 332 - DNA, 20 bp, Artificial Sequence
  chemically synthesized
ggctgtggaaggtgtttcag

SEQ ID NO: 333 - DNA, 20 bp, Artificial Sequence
  chemically synthesized
gctgtggaaggtgtttcagt

SEQ ID NO: 334 - DNA, 20 bp, Artificial Sequence
  chemically synthesized
gtgtttcagtaggatctaat

SEQ ID NO: 335 - DNA, 20 bp, Artificial Sequence
  chemically synthesized
aatcaaaaaacaaaatgaaa

SEQ ID NO: 336 - DNA, 20 bp, Artificial Sequence
  chemically synthesized
tgaaaaagctttatatttct

SEQ ID NO: 337 - DNA, 20 bp, Artificial Sequence
  chemically synthesized
tttatatttctaagtcaaat

SEQ ID NO: 338 - DNA, 20 bp, Artificial Sequence
  chemically synthesized
ttctaagtcaaataagacat

SEQ ID NO: 339 - DNA, 20 bp, Artificial Sequence
  chemically synthesized
aagtcaaataagacataagt

SEQ ID NO: 340 - DNA, 20 bp, Artificial Sequence
  chemically synthesized
aataagacataagttggtct

SEQ ID NO: 341 - DNA, 20 bp, Artificial Sequence
  chemically synthesized
ataagacataagttggtcta

SEQ ID NO: 342 - DNA, 20 bp, Artificial Sequence
  chemically synthesized
acataagttggtctaaggtt

SEQ ID NO: 343 - DNA, 20 bp, Artificial Sequence
  chemically synthesized
cataaatatttaaatatcta

SEQ ID NO: 344 - DNA, 20 bp, Artificial Sequence
  chemically synthesized
atatttaaatatctaaagtt

SEQ ID NO: 345 - DNA, 20 bp, Artificial Sequence
  chemically synthesized
taaatatctaaagttcagat

SEQ ID NO: 346 - DNA, 20 bp, Artificial Sequence
  chemically synthesized
gttcagatcagaacattgcg

SEQ ID NO: 347 - DNA, 20 bp, Artificial Sequence
  chemically synthesized
cccaatcaacaacacccctt

SEQ ID NO: 348 - DNA, 20 bp, Artificial Sequence
  chemically synthesized
ccaatcaacaacaccccttc

SEQ ID NO: 349 - DNA, 20 bp, Artificial Sequence
  chemically synthesized
cccttcaggatttaaaaacc

SEQ ID NO: 350 - DNA, 20 bp, Artificial Sequence
  chemically synthesized
ccttcaggatttaaaaacca

SEQ ID NO: 351 - DNA, 20 bp, Artificial Sequence
  chemically synthesized
cttcaggatttaaaaaccaa

SEQ ID NO: 352 - DNA, 20 bp, Artificial Sequence
  chemically synthesized
ttcaggatttaaaaaccaag

SEQ ID NO: 353 - DNA, 20 bp, Artificial Sequence
  chemically synthesized
tcaggatttaaaaaccaagg

SEQ ID NO: 354 - DNA, 20 bp, Artificial Sequence
  chemically synthesized
ttaaaaaccaagggggacac

SEQ ID NO: 355 - DNA, 20 bp, Artificial Sequence
  chemically synthesized
aagggggacactggatcacc

SEQ ID NO: 356 - DNA, 20 bp, Artificial Sequence
  chemically synthesized
tggatcacctagtgtttcac

SEQ ID NO: 357 - DNA, 20 bp, Artificial Sequence
  chemically synthesized
atcacctagtgtttcacaag

SEQ ID NO: 358 - DNA, 20 bp, Artificial Sequence
  chemically synthesized
tcacctagtgtttcacaagc

SEQ ID NO: 359 - DNA, 20 bp, Artificial Sequence
  chemically synthesized
caagcaggtaccttctgctg

SEQ ID NO: 360 - DNA, 20 bp, Artificial Sequence
  chemically synthesized
aagcaggtaccttctgctgt

SEQ ID NO: 361 - DNA, 20 bp, Artificial Sequence
  chemically synthesized
gcaggtaccttctgctgtag

SEQ ID NO: 362 - DNA, 20 bp, Artificial Sequence
  chemically synthesized
aggtaccttctgctgtagga

SEQ ID NO: 363 - DNA, 20 bp, Artificial Sequence
  chemically synthesized
gtaccttctgctgtaggaga

SEQ ID NO: 364 - DNA, 20 bp, Artificial Sequence
  chemically synthesized
accttctgctgtaggagaga

SEQ ID NO: 365 - DNA, 20 bp, Artificial Sequence
  chemically synthesized
ctgtaggagagagagaacta

SEQ ID NO: 366 - DNA, 20 bp, Artificial Sequence
  chemically synthesized
agagagaactaaagttctga

SEQ ID NO: 367 - DNA, 20 bp, Artificial Sequence
  chemically synthesized
aaagacctgttgcttttcac

SEQ ID NO: 368 - DNA, 20 bp, Artificial Sequence
  chemically synthesized
aagacctgttgcttttcacc

SEQ ID NO: 369 - DNA, 20 bp, Artificial Sequence
  chemically synthesized
acctgttgcttttcaccagg

SEQ ID NO: 370 - DNA, 20 bp, Artificial Sequence
  chemically synthesized
ttttcaccaggaagttttac

SEQ ID NO: 371 - DNA, 20 bp, Artificial Sequence
  chemically synthesized
tttcaccaggaagttttact

SEQ ID NO: 372 - DNA, 20 bp, Artificial Sequence
  chemically synthesized
agttttactgggcatctcct

SEQ ID NO: 373 - DNA, 20 bp, Artificial Sequence
  chemically synthesized
tactgggcatctcctgagcc

SEQ ID NO: 374 - DNA, 20 bp, Artificial Sequence
  chemically synthesized
actgggcatctcctgagcct

SEQ ID NO: 375 - DNA, 20 bp, Artificial Sequence
  chemically synthesized
catctcctgagcctaggcaa

SEQ ID NO: 376 - DNA, 20 bp, Artificial Sequence
  chemically synthesized
ctgagcctaggcaatagctg

SEQ ID NO: 377 - DNA, 20 bp, Artificial Sequence
  chemically synthesized
tgagcctaggcaatagctgt

SEQ ID NO: 378 - DNA, 20 bp, Artificial Sequence
  chemically synthesized
gagcctaggcaatagctgta

SEQ ID NO: 379 - DNA, 20 bp, Artificial Sequence
  chemically synthesized
aatagctgtagggtgacttc

SEQ ID NO: 380 - DNA, 20 bp, Artificial Sequence
  chemically synthesized
tagctgtagggtgacttctg

SEQ ID NO: 381 - DNA, 20 bp, Artificial Sequence
  chemically synthesized
cccgtttccccgccccccaa

SEQ ID NO: 382 - DNA, 20 bp, Artificial Sequence
  chemically synthesized
gtttccccgccccccaaaag

SEQ ID NO: 383 - DNA, 20 bp, Artificial Sequence
  chemically synthesized
tccccgccccccaaaagaag

SEQ ID NO: 384 - DNA, 20 bp, Artificial Sequence
  chemically synthesized
cccgccccccaaaagaagcg

SEQ ID NO: 385 - DNA, 20 bp, Artificial Sequence
  chemically synthesized
caaaagaagcggagatttaa

SEQ ID NO: 386 - DNA, 20 bp, Artificial Sequence
  chemically synthesized
aaaagaagcggagatttaac

SEQ ID NO: 387 - DNA, 20 bp, Artificial Sequence
  chemically synthesized
aaagaagcggagatttaacg

SEQ ID NO: 388 - DNA, 20 bp, Artificial Sequence
  chemically synthesized
ggagatttaacggggacgtg

SEQ ID NO: 389 - DNA, 20 bp, Artificial Sequence
  chemically synthesized
atttaacggggacgtgcggc

SEQ ID NO: 390 - DNA, 20 bp, Artificial Sequence
  chemically synthesized
ttaacggggacgtgcggcca

SEQ ID NO: 391 - DNA, 20 bp, Artificial Sequence
  chemically synthesized
cggggacgtgcggccagagc

SEQ ID NO: 392 - DNA, 20 bp, Artificial Sequence
  chemically synthesized
ggggacgtgcggccagagct

SEQ ID NO: 393 - DNA, 20 bp, Artificial Sequence
  chemically synthesized
gggacgtgcggccagagctg

SEQ ID NO: 394 - DNA, 20 bp, Artificial Sequence
  chemically synthesized
tgcggccagagctggggaaa

SEQ ID NO: 395 - DNA, 20 bp, Artificial Sequence
  chemically synthesized
gcggccagagctggggaaat

SEQ ID NO: 396 - DNA, 20 bp, Artificial Sequence
  chemically synthesized
agctggggaaatgggcccgc

SEQ ID NO: 397 - DNA, 20 bp, Artificial Sequence
  chemically synthesized
ggggaaatgggcccgcgagc

SEQ ID NO: 398 - DNA, 20 bp, Artificial Sequence
  chemically synthesized
gggaaatgggcccgcgagcc

SEQ ID NO: 399 - DNA, 20 bp, Artificial Sequence
  chemically synthesized
aatgggcccgcgagccaggc

SEQ ID NO: 400 - DNA, 20 bp, Artificial Sequence
  chemically synthesized
ttctcctcctgatgcttttg

SEQ ID NO: 401 - DNA, 20 bp, Artificial Sequence
  chemically synthesized
cctgatgcttttgcagaccg

SEQ ID NO: 402 - DNA, 20 bp, Artificial Sequence
  chemically synthesized
ttttgcagaccgcggtcctg

SEQ ID NO: 403 - DNA, 20 bp, Artificial Sequence
  chemically synthesized
tttgcagaccgcggtcctgc

SEQ ID NO: 404 - DNA, 20 bp, Artificial Sequence
  chemically synthesized
ttgcagaccgcggtcctgca

SEQ ID NO: 405 - DNA, 20 bp, Artificial Sequence
  chemically synthesized
tgcagaccgcggtcctgcag

SEQ ID NO: 406 - DNA, 20 bp, Artificial Sequence
  chemically synthesized
tgcaggggcgcttgctgcgt

SEQ ID NO: 407 - DNA, 20 bp, Artificial Sequence
  chemically synthesized
ggcgcttgctgcgtgagtcc

SEQ ID NO: 408 - DNA, 20 bp, Artificial Sequence
  chemically synthesized
gcgcttgctgcgtgagtccg

SEQ ID NO: 409 - DNA, 20 bp, Artificial Sequence
  chemically synthesized
cgcttgctgcgtgagtccga

SEQ ID NO: 410 - DNA, 20 bp, Artificial Sequence
  chemically synthesized
ctgcgtgagtccgagggctg

SEQ ID NO: 411 - DNA, 20 bp, Artificial Sequence
  chemically synthesized
tgcgtgagtccgagggctgc

SEQ ID NO: 412 - DNA, 20 bp, Artificial Sequence
  chemically synthesized
tccgagggctgcgggcgaac

SEQ ID NO: 413 - DNA, 20 bp, Artificial Sequence
  chemically synthesized
ccgagggctgcgggcgaact

SEQ ID NO: 414 - DNA, 20 bp, Artificial Sequence
  chemically synthesized
cgagggctgcgggcgaacta

SEQ ID NO: 415 - DNA, 20 bp, Artificial Sequence
  chemically synthesized
gagggctgcgggcgaactag

SEQ ID NO: 416 - DNA, 20 bp, Artificial Sequence
  chemically synthesized
ctgcgggcgaactaggggcg

SEQ ID NO: 417 - DNA, 20 bp, Artificial Sequence
  chemically synthesized
cgggcgaactaggggcgcgg

SEQ ID NO: 418 - DNA, 20 bp, Artificial Sequence
  chemically synthesized
gggcgaactaggggcgcggc

SEQ ID NO: 419 - DNA, 20 bp, Artificial Sequence
  chemically synthesized
ggcgaactaggggcgcggcg

SEQ ID NO: 420 - DNA, 20 bp, Artificial Sequence
  chemically synthesized
gcgaactaggggcgcggcgg

SEQ ID NO: 421 - DNA, 20 bp, Artificial Sequence
  chemically synthesized
aactaggggcgcggcggggg

SEQ ID NO: 422 - DNA, 20 bp, Artificial Sequence
  chemically synthesized
gggggtggaaaaatcgaaac

SEQ ID NO: 423 - DNA, 20 bp, Artificial Sequence
  chemically synthesized
actagctttttctttgcgct

SEQ ID NO: 424 - DNA, 20 bp, Artificial Sequence
  chemically synthesized
ctagctttttctttgcgctt

SEQ ID NO: 425 - DNA, 20 bp, Artificial Sequence
  chemically synthesized
agctttttctttgcgcttgg

SEQ ID NO: 426 - DNA, 20 bp, Artificial Sequence
  chemically synthesized
gcttgggagtttgctaactt

SEQ ID NO: 427 - DNA, 20 bp, Artificial Sequence
  chemically synthesized
ttgggagtttgctaactttg

SEQ ID NO: 428 - DNA, 20 bp, Artificial Sequence
  chemically synthesized
tgggagtttgctaactttgg

SEQ ID NO: 429 - DNA, 20 bp, Artificial Sequence
  chemically synthesized
acctgctcaaccctatccgc

SEQ ID NO: 430 - DNA, 20 bp, Artificial Sequence
  chemically synthesized
ctctccctactttctgcgtc

SEQ ID NO: 431 - DNA, 20 bp, Artificial Sequence
  chemically synthesized
tttctgcgtccagaccccgt

SEQ ID NO: 432 - DNA, 20 bp, Artificial Sequence
  chemically synthesized
ttctgcgtccagaccccgtg

SEQ ID NO: 433 - DNA, 20 bp, Artificial Sequence
  chemically synthesized
tctgcgtccagaccccgtga

SEQ ID NO: 434 - DNA, 20 bp, Artificial Sequence
  chemically synthesized
tgcgtccagaccccgtgagg

SEQ ID NO: 435 - DNA, 20 bp, Artificial Sequence
  chemically synthesized
gagtgcctaccactgaactg

SEQ ID NO: 436 - DNA, 20 bp, Artificial Sequence
  chemically synthesized
gcctaccactgaactgcaga

SEQ ID NO: 437 - DNA, 20 bp, Artificial Sequence
  chemically synthesized
cctaccactgaactgcagat

SEQ ID NO: 438 - DNA, 20 bp, Artificial Sequence
  chemically synthesized
ctaccactgaactgcagata

SEQ ID NO: 439 - DNA, 20 bp, Artificial Sequence
  chemically synthesized
taccactgaactgcagatag

SEQ ID NO: 440 - DNA, 20 bp, Artificial Sequence
  chemically synthesized
cagataggggtccctcgccc

SEQ ID NO: 441 - DNA, 20 bp, Artificial Sequence
  chemically synthesized
agataggggtccctcgcccc

SEQ ID NO: 442 - DNA, 20 bp, Artificial Sequence
  chemically synthesized
ccaggacctgccccctcccc

SEQ ID NO: 443 - DNA, 20 bp, Artificial Sequence
  chemically synthesized
gccccctcccccggctgtcc

SEQ ID NO: 444 - DNA, 20 bp, Artificial Sequence
  chemically synthesized
ccccggctgtcccggctctg

SEQ ID NO: 445 - DNA, 20 bp, Artificial Sequence
  chemically synthesized
ccggctgtcccggctctgcg

SEQ ID NO: 446 - DNA, 20 bp, Artificial Sequence
  chemically synthesized
cggctctgcggagtgacttt

SEQ ID NO: 447 - DNA, 20 bp, Artificial Sequence
  chemically synthesized
gcccactcccttcccccaac

SEQ ID NO: 448 - DNA, 20 bp, Artificial Sequence
  chemically synthesized
atgcttttaaataaatctcg

SEQ ID NO: 449 - DNA, 20 bp, Artificial Sequence
  chemically synthesized
aatctcgtagttcctcactt

SEQ ID NO: 450 - DNA, 20 bp, Artificial Sequence
  chemically synthesized
cgtagttcctcacttgagct

SEQ ID NO: 451 - DNA, 20 bp, Artificial Sequence
  chemically synthesized
ttcctcacttgagctgagct

SEQ ID NO: 452 - DNA, 20 bp, Artificial Sequence
  chemically synthesized
cacttgagctgagctaagcc

SEQ ID NO: 453 - DNA, 20 bp, Artificial Sequence
  chemically synthesized
acttgagctgagctaagcct

SEQ ID NO: 454 - DNA, 20 bp, Artificial Sequence
  chemically synthesized
cttgagctgagctaagcctg

SEQ ID NO: 455 - DNA, 20 bp, Artificial Sequence
  chemically synthesized
agcctggggctccttgaacc

SEQ ID NO: 456 - DNA, 20 bp, Artificial Sequence
  chemically synthesized
ggctccttgaacctggaact

SEQ ID NO: 457 - DNA, 20 bp, Artificial Sequence
  chemically synthesized
gctccttgaacctggaactc

SEQ ID NO: 458 - DNA, 20 bp, Artificial Sequence
  chemically synthesized
ctcgggtttatttccaatgt

SEQ ID NO: 459 - DNA, 20 bp, Artificial Sequence
  chemically synthesized
tatttccaatgtcagctgtg

SEQ ID NO: 460 - DNA, 20 bp, Artificial Sequence
  chemically synthesized
cagctgtgcagttttttccc

SEQ ID NO: 461 - DNA, 20 bp, Artificial Sequence
  chemically synthesized
tttccccagtcatctccaaa

SEQ ID NO: 462 - DNA, 20 bp, Artificial Sequence
  chemically synthesized
ttccccagtcatctccaaac

SEQ ID NO: 463 - DNA, 20 bp, Artificial Sequence
  chemically synthesized
cccagtcatctccaaacagg

SEQ ID NO: 464 - DNA, 20 bp, Artificial Sequence
  chemically synthesized
caaacaggaagttcttccct

SEQ ID NO: 465 - DNA, 20 bp, Artificial Sequence
  chemically synthesized
ttcttccctgagtgcttgcc

SEQ ID NO: 466 - DNA, 20 bp, Artificial Sequence
  chemically synthesized
ttccctgagtgcttgccgag

SEQ ID NO: 467 - DNA, 20 bp, Artificial Sequence
  chemically synthesized
tccctgagtgcttgccgaga

SEQ ID NO: 468 - DNA, 20 bp, Artificial Sequence
  chemically synthesized
gagtgcttgccgagaaggct

SEQ ID NO: 469 - DNA, 20 bp, Artificial Sequence
  chemically synthesized
gagaaggctgagcaaaccca

SEQ ID NO: 470 - DNA, 20 bp, Artificial Sequence
  chemically synthesized
aaggctgagcaaacccacag

SEQ ID NO: 471 - DNA, 20 bp, Artificial Sequence
  chemically synthesized
aggctgagcaaacccacagc

SEQ ID NO: 472 - DNA, 20 bp, Artificial Sequence
  chemically synthesized
aacccacagcaggatccgca

SEQ ID NO: 473 - DNA, 20 bp, Artificial Sequence
  chemically synthesized
acccacagcaggatccgcac

SEQ ID NO: 474 - DNA, 20 bp, Artificial Sequence
  chemically synthesized
cccacagcaggatccgcacg

SEQ ID NO: 475 - DNA, 20 bp, Artificial Sequence
  chemically synthesized
tccgcacggggtttccacct

SEQ ID NO: 476 - DNA, 20 bp, Artificial Sequence
  chemically synthesized
ccacctcagaacgaatgcgt

SEQ ID NO: 477 - DNA, 20 bp, Artificial Sequence
  chemically synthesized
cacctcagaacgaatgcgtt

SEQ ID NO: 478 - DNA, 20 bp, Artificial Sequence
  chemically synthesized
ctcagaacgaatgcgttggg

SEQ ID NO: 479 - DNA, 20 bp, Artificial Sequence
  chemically synthesized
agaacgaatgcgttgggcgg

SEQ ID NO: 480 - DNA, 20 bp, Artificial Sequence
  chemically synthesized
gaacgaatgcgttgggcggt

SEQ ID NO: 481 - DNA, 20 bp, Artificial Sequence
  chemically synthesized
aacgaatgcgttgggcggtg

SEQ ID NO: 482 - DNA, 20 bp, Artificial Sequence
  chemically synthesized
acgaatgcgttgggcggtgg

SEQ ID NO: 483 - DNA, 20 bp, Artificial Sequence
  chemically synthesized
gttgggcggtgggggcgcga

SEQ ID NO: 484 - DNA, 20 bp, Artificial Sequence
  chemically synthesized
tgggcggtgggggcgcgaaa

SEQ ID NO: 485 - DNA, 20 bp, Artificial Sequence
  chemically synthesized
gcggtgggggcgcgaaagag

SEQ ID NO: 486 - DNA, 20 bp, Artificial Sequence
  chemically synthesized
ggggcgcgaaagagtggcgt

SEQ ID NO: 487 - DNA, 20 bp, Artificial Sequence
  chemically synthesized
gggcgcgaaagagtggcgtt

SEQ ID NO: 488 - DNA, 20 bp, Artificial Sequence
  chemically synthesized
ggcgcgaaagagtggcgttg

SEQ ID NO: 489 - DNA, 20 bp, Artificial Sequence
  chemically synthesized
ttcaccattccacccacttt

SEQ ID NO: 490 - DNA, 20 bp, Artificial Sequence
  chemically synthesized
ccattccacccacttttggt

SEQ ID NO: 491 - DNA, 20 bp, Artificial Sequence
  chemically synthesized
cacccacttttggtgagacc

SEQ ID NO: 492 - DNA, 20 bp, Artificial Sequence
  chemically synthesized
acccacttttggtgagacct

SEQ ID NO: 493 - DNA, 20 bp, Artificial Sequence
  chemically synthesized
cccacttttggtgagacctg

SEQ ID NO: 494 - DNA, 20 bp, Artificial Sequence
  chemically synthesized
acttttggtgagacctgggg

SEQ ID NO: 495 - DNA, 20 bp, Artificial Sequence
  chemically synthesized
ttttggtgagacctggggtg

SEQ ID NO: 496 - DNA, 20 bp, Artificial Sequence
  chemically synthesized
tttggtgagacctggggtgg

SEQ ID NO: 497 - DNA, 20 bp, Artificial Sequence
  chemically synthesized
agacctggggtggaggtctc

SEQ ID NO: 498 - DNA, 20 bp, Artificial Sequence
  chemically synthesized
gacctggggtggaggtctct

SEQ ID NO: 499 - DNA, 20 bp, Artificial Sequence
  chemically synthesized
acctggggtggaggtctcta

SEQ ID NO: 500 - DNA, 20 bp, Artificial Sequence
  chemically synthesized
tggggtggaggtctctaggg

SEQ ID NO: 501 - DNA, 20 bp, Artificial Sequence
  chemically synthesized
ggggtggaggtctctagggt

SEQ ID NO: 502 - DNA, 20 bp, Artificial Sequence
  chemically synthesized
ggtggaggtctctagggtgg

SEQ ID NO: 503 - DNA, 20 bp, Artificial Sequence
  chemically synthesized
gtggaggtctctagggtggg

SEQ ID NO: 504 - DNA, 20 bp, Artificial Sequence
  chemically synthesized
ctctagggtgggaggctcct

SEQ ID NO: 505 - DNA, 20 bp, Artificial Sequence
  chemically synthesized
ctagggtgggaggctcctga

SEQ ID NO: 506 - DNA, 20 bp, Artificial Sequence
  chemically synthesized
agggtgggaggctcctgaga

SEQ ID NO: 507 - DNA, 20 bp, Artificial Sequence
  chemically synthesized
gggtgggaggctcctgagag

SEQ ID NO: 508 - DNA, 20 bp, Artificial Sequence
  chemically synthesized
ctcctgagagaggcctacct

SEQ ID NO: 509 - DNA, 20 bp, Artificial Sequence
  chemically synthesized
tcctgagagaggcctacctc

SEQ ID NO: 510 - DNA, 20 bp, Artificial Sequence
  chemically synthesized
ctcgggcctttccccactct

SEQ ID NO: 511 - DNA, 20 bp, Artificial Sequence
  chemically synthesized
ttggcaattgttcttttgcc

SEQ ID NO: 512 - DNA, 20 bp, Artificial Sequence
  chemically synthesized
gttcttttgcctggaaaatt

SEQ ID NO: 513 - DNA, 20 bp, Artificial Sequence
  chemically synthesized
ctggaaaattaagtatatgt

SEQ ID NO: 514 - DNA, 20 bp, Artificial Sequence
  chemically synthesized
gaactgaacaattctctttt

SEQ ID NO: 515 - DNA, 20 bp, Artificial Sequence
  chemically synthesized
tgaacaattctcttttcggc

SEQ ID NO: 516 - DNA, 20 bp, Artificial Sequence
  chemically synthesized
gaacaattctcttttcggct

SEQ ID NO: 517 - DNA, 20 bp, Artificial Sequence
  chemically synthesized
ttgcaatgtgctgtgtaatt

SEQ ID NO: 518 - DNA, 20 bp, Artificial Sequence
  chemically synthesized
gcaatgtgctgtgtaattaa

SEQ ID NO: 519 - DNA, 20 bp, Artificial Sequence
  chemically synthesized
caatgtgctgtgtaattaag

SEQ ID NO: 520 - DNA, 20 bp, Artificial Sequence
  chemically synthesized
aattaagaggcctctctaca

SEQ ID NO: 521 - DNA, 20 bp, Artificial Sequence
  chemically synthesized
agtactgataatgaacatgt

SEQ ID NO: 522 - DNA, 20 bp, Artificial Sequence
  chemically synthesized
taagcaatgcactcacttct

SEQ ID NO: 523 - DNA, 20 bp, Artificial Sequence
  chemically synthesized
tgatcttatttgattttcac

SEQ ID NO: 524 - DNA, 20 bp, Artificial Sequence
  chemically synthesized
gatcttatttgattttcact

SEQ ID NO: 525 - DNA, 20 bp, Artificial Sequence
  chemically synthesized
tatttgattttcactaggca

SEQ ID NO: 526 - DNA, 20 bp, Artificial Sequence
  chemically synthesized
atttgattttcactaggcat

SEQ ID NO: 527 - DNA, 20 bp, Artificial Sequence
  chemically synthesized
tttgattttcactaggcata

SEQ ID NO: 528 - DNA, 20 bp, Artificial Sequence
  chemically synthesized
tgattttcactaggcatagg

SEQ ID NO: 529 - DNA, 20 bp, Artificial Sequence
  chemically synthesized
gattttcactaggcataggg

SEQ ID NO: 530 - DNA, 20 bp, Artificial Sequence
  chemically synthesized
tttcactaggcatagggagg

SEQ ID NO: 531 - DNA, 20 bp, Artificial Sequence
  chemically synthesized
ttcactaggcatagggaggt

SEQ ID NO: 532 - DNA, 20 bp, Artificial Sequence
  chemically synthesized
cactaggcatagggaggtag

SEQ ID NO: 533 - DNA, 20 bp, Artificial Sequence
  chemically synthesized
taataatacgtttattttac

SEQ ID NO: 534 - DNA, 20 bp, Artificial Sequence
  chemically synthesized
taatacgtttattttactag

SEQ ID NO: 535 - DNA, 20 bp, Artificial Sequence
  chemically synthesized
ttattttactagaagttaac

SEQ ID NO: 536 - DNA, 20 bp, Artificial Sequence
  chemically synthesized
actagaagttaactggaatt

SEQ ID NO: 537 - DNA, 20 bp, Artificial Sequence
  chemically synthesized
tcagattatataactctttt

SEQ ID NO: 538 - DNA, 20 bp, Artificial Sequence
  chemically synthesized
cagattatataactcttttc

SEQ ID NO: 539 - DNA, 20 bp, Artificial Sequence
  chemically synthesized
ataactcttttcaggttaca

SEQ ID NO: 540 - DNA, 20 bp, Artificial Sequence
  chemically synthesized
tacaaagaacataaataatc

SEQ ID NO: 541 - DNA, 20 bp, Artificial Sequence
  chemically synthesized
tggttttctgatgttatttc

SEQ ID NO: 542 - DNA, 20 bp, Artificial Sequence
  chemically synthesized
tgatgttatttcaagtacta

SEQ ID NO: 543 - DNA, 20 bp, Artificial Sequence
  chemically synthesized
actacagctgcttctaatct

SEQ ID NO: 544 - DNA, 20 bp, Artificial Sequence
  chemically synthesized
ctgcttctaatcttagttga

SEQ ID NO: 545 - DNA, 20 bp, Artificial Sequence
  chemically synthesized
ttgacagtgattttgccctg

SEQ ID NO: 546 - DNA, 20 bp, Artificial Sequence
  chemically synthesized
agtgattttgccctgtagtg

SEQ ID NO: 547 - DNA, 20 bp, Artificial Sequence
  chemically synthesized
ttttgccctgtagtgtagca

SEQ ID NO: 548 - DNA, 20 bp, Artificial Sequence
  chemically synthesized
tagtgtagcacagtgttctg

SEQ ID NO: 549 - DNA, 20 bp, Artificial Sequence
  chemically synthesized
agtgtagcacagtgttctgt

SEQ ID NO: 550 - DNA, 20 bp, Artificial Sequence
  chemically synthesized
gtgttctgtgggtcacacgc

SEQ ID NO: 551 - DNA, 20 bp, Artificial Sequence
  chemically synthesized
tgtgggtcacacgccggcct

SEQ ID NO: 552 - DNA, 20 bp, Artificial Sequence
  chemically synthesized
gtcacacgccggcctcagca

SEQ ID NO: 553 - DNA, 20 bp, Artificial Sequence
  chemically synthesized
cggcctcagcacagcacttt

SEQ ID NO: 554 - DNA, 20 bp, Artificial Sequence
  chemically synthesized
cagcacagcactttgagttt

SEQ ID NO: 555 - DNA, 20 bp, Artificial Sequence
  chemically synthesized
atccacattttacacatgac

SEQ ID NO: 556 - DNA, 20 bp, Artificial Sequence
  chemically synthesized
attttacacatgacaagaat

SEQ ID NO: 557 - DNA, 20 bp, Artificial Sequence
  chemically synthesized
ttttacacatgacaagaatg

SEQ ID NO: 558 - DNA, 20 bp, Artificial Sequence
  chemically synthesized
cacatgacaagaatgaggca

SEQ ID NO: 559 - DNA, 20 bp, Artificial Sequence
  chemically synthesized
gacaagaatgaggcatggca

SEQ ID NO: 560 - DNA, 20 bp, Artificial Sequence
  chemically synthesized
gcatggcacggcctgcttcc

SEQ ID NO: 561 - DNA, 20 bp, Artificial Sequence
  chemically synthesized
ttcctggcaaatttattcaa

SEQ ID NO: 562 - DNA, 20 bp, Artificial Sequence
  chemically synthesized
aaatttattcaatggtacac

SEQ ID NO: 563 - DNA, 20 bp, Artificial Sequence
  chemically synthesized
aatttattcaatggtacact

SEQ ID NO: 564 - DNA, 20 bp, Artificial Sequence
  chemically synthesized
ttcaatggtacactgggctt

SEQ ID NO: 565 - DNA, 20 bp, Artificial Sequence
  chemically synthesized
aatggtacactgggctttgg

SEQ ID NO: 566 - DNA, 20 bp, Artificial Sequence
  chemically synthesized
ggtacactgggctttggtgg

SEQ ID NO: 567 - DNA, 20 bp, Artificial Sequence
  chemically synthesized
tacactgggctttggtggca

SEQ ID NO: 568 - DNA, 20 bp, Artificial Sequence
  chemically synthesized
gagctcatgtctccacttca

SEQ ID NO: 569 - DNA, 20 bp, Artificial Sequence
  chemically synthesized
tcttaaacatcacactgcat

SEQ ID NO: 570 - DNA, 20 bp, Artificial Sequence
  chemically synthesized
ttaaacatcacactgcatta

SEQ ID NO: 571 - DNA, 20 bp, Artificial Sequence
  chemically synthesized
taaacatcacactgcattag

SEQ ID NO: 572 - DNA, 20 bp, Artificial Sequence
  chemically synthesized
gaataataaaatttcatgtt

SEQ ID NO: 573 - DNA, 20 bp, Artificial Sequence
  chemically synthesized
taataaaatttcatgttgag

SEQ ID NO: 574 - DNA, 20 bp, Artificial Sequence
  chemically synthesized
cagaaatattcattgtttac

SEQ ID NO: 575 - DNA, 20 bp, Artificial Sequence
  chemically synthesized
cattgtttacaagtgtaaat

SEQ ID NO: 576 - DNA, 20 bp, Artificial Sequence
  chemically synthesized
ttacaagtgtaaatgagtcc

SEQ ID NO: 577 - DNA, 20 bp, Artificial Sequence
  chemically synthesized
agccatgtgttgcactgttc

SEQ ID NO: 578 - DNA, 20 bp, Artificial Sequence
  chemically synthesized
tgttgcactgttcaagcccc

SEQ ID NO: 579 - DNA, 20 bp, Artificial Sequence
  chemically synthesized
gttgcactgttcaagcccca

SEQ ID NO: 580 - DNA, 20 bp, Artificial Sequence
  chemically synthesized
ttgcactgttcaagccccaa

SEQ ID NO: 581 - DNA, 20 bp, Artificial Sequence
  chemically synthesized
gcactgttcaagccccaagg

SEQ ID NO: 582 - DNA, 20 bp, Artificial Sequence
  chemically synthesized
actgttcaagccccaaggga

SEQ ID NO: 583 - DNA, 20 bp, Artificial Sequence
  chemically synthesized
tgttcaagccccaagggaga

SEQ ID NO: 584 - DNA, 20 bp, Artificial Sequence
  chemically synthesized
tcaagccccaagggagagag

SEQ ID NO: 585 - DNA, 20 bp, Artificial Sequence
  chemically synthesized
caagccccaagggagagagc

SEQ ID NO: 586 - DNA, 20 bp, Artificial Sequence
  chemically synthesized
aagccccaagggagagagca

SEQ ID NO: 587 - DNA, 20 bp, Artificial Sequence
  chemically synthesized
aagggagagagcagggaaac

SEQ ID NO: 588 - DNA, 20 bp, Artificial Sequence
  chemically synthesized
ccctttgatattttgcattc

SEQ ID NO: 589 - DNA, 20 bp, Artificial Sequence
  chemically synthesized
tttgatattttgcattctag

SEQ ID NO: 590 - DNA, 20 bp, Artificial Sequence
  chemically synthesized
ttgatattttgcattctagt

SEQ ID NO: 591 - DNA, 20 bp, Artificial Sequence
  chemically synthesized
gatattttgcattctagtgg

SEQ ID NO: 592 - DNA, 20 bp, Artificial Sequence
  chemically synthesized
tattttgcattctagtggga

SEQ ID NO: 593 - DNA, 20 bp, Artificial Sequence
  chemically synthesized
ctagtgggagagatgacaat

SEQ ID NO: 594 - DNA, 20 bp, Artificial Sequence
  chemically synthesized
agagatgacaataagcaaat

SEQ ID NO: 595 - DNA, 20 bp, Artificial Sequence
  chemically synthesized
gatgacaataagcaaatgag

SEQ ID NO: 596 - DNA, 20 bp, Artificial Sequence
  chemically synthesized
acaataagcaaatgagcaga

SEQ ID NO: 597 - DNA, 20 bp, Artificial Sequence
  chemically synthesized
agcagaaagatatacaacat

SEQ ID NO: 598 - DNA, 20 bp, Artificial Sequence
  chemically synthesized
gcagaaagatatacaacatc

SEQ ID NO: 599 - DNA, 20 bp, Artificial Sequence
  chemically synthesized
tatacaacatcaggaaatca

SEQ ID NO: 600 - DNA, 20 bp, Artificial Sequence
  chemically synthesized
atacaacatcaggaaatcat

SEQ ID NO: 601 - DNA, 20 bp, Artificial Sequence
  chemically synthesized
caggaaatcatgggtgttgt

SEQ ID NO: 602 - DNA, 20 bp, Artificial Sequence
  chemically synthesized
gaaatcatgggtgttgtgag

SEQ ID NO: 603 - DNA, 20 bp, Artificial Sequence
  chemically synthesized
atcatgggtgttgtgagaag

SEQ ID NO: 604 - DNA, 20 bp, Artificial Sequence
  chemically synthesized
catgggtgttgtgagaagca

SEQ ID NO: 605 - DNA, 20 bp, Artificial Sequence
  chemically synthesized
gggtgttgtgagaagcagag

SEQ ID NO: 606 - DNA, 20 bp, Artificial Sequence
  chemically synthesized
gttgtgagaagcagagaagt

SEQ ID NO: 607 - DNA, 20 bp, Artificial Sequence
  chemically synthesized
ttgtgagaagcagagaagtc

SEQ ID NO: 608 - DNA, 20 bp, Artificial Sequence
  chemically synthesized
tgtgagaagcagagaagtca

SEQ ID NO: 609 - DNA, 20 bp, Artificial Sequence
  chemically synthesized
agaagcagagaagtcagggc

SEQ ID NO: 610 - DNA, 20 bp, Artificial Sequence
  chemically synthesized
gaagtcagggcaagtcactc

SEQ ID NO: 611 - DNA, 20 bp, Artificial Sequence
  chemically synthesized
aagtcagggcaagtcactct

SEQ ID NO: 612 - DNA, 20 bp, Artificial Sequence
  chemically synthesized
agtcagggcaagtcactctg

SEQ ID NO: 613 - DNA, 20 bp, Artificial Sequence
  chemically synthesized
tcactctggggctgacactt

SEQ ID NO: 614 - DNA, 20 bp, Artificial Sequence
  chemically synthesized
ctctggggctgacacttgag

SEQ ID NO: 615 - DNA, 20 bp, Artificial Sequence
  chemically synthesized
ctggggctgacacttgagca

SEQ ID NO: 616 - DNA, 20 bp, Artificial Sequence
  chemically synthesized
gacacttgagcagagacatg

SEQ ID NO: 617 - DNA, 20 bp, Artificial Sequence
  chemically synthesized
acacttgagcagagacatga

SEQ ID NO: 618 - DNA, 20 bp, Artificial Sequence
  chemically synthesized
agcagagacatgaaggaaat

SEQ ID NO: 619 - DNA, 20 bp, Artificial Sequence
  chemically synthesized
gaaataagaatgatattgac

SEQ ID NO: 620 - DNA, 20 bp, Artificial Sequence
  chemically synthesized
aaataagaatgatattgact

SEQ ID NO: 621 - DNA, 20 bp, Artificial Sequence
  chemically synthesized
ataagaatgatattgactgg

SEQ ID NO: 622 - DNA, 20 bp, Artificial Sequence
  chemically synthesized
agaatgatattgactgggag

SEQ ID NO: 623 - DNA, 20 bp, Artificial Sequence
  chemically synthesized
tgactgggagcagtatttcc

SEQ ID NO: 624 - DNA, 20 bp, Artificial Sequence
  chemically synthesized
gactgggagcagtatttccc

SEQ ID NO: 625 - DNA, 20 bp, Artificial Sequence
  chemically synthesized
cagtatttcccaggcaaact

SEQ ID NO: 626 - DNA, 20 bp, Artificial Sequence
  chemically synthesized
tatttcccaggcaaactgag

SEQ ID NO: 627 - DNA, 20 bp, Artificial Sequence
  chemically synthesized
atttcccaggcaaactgagt

SEQ ID NO: 628 - DNA, 20 bp, Artificial Sequence
  chemically synthesized
ccaggcaaactgagtgggcc

SEQ ID NO: 629 - DNA, 20 bp, Artificial Sequence
  chemically synthesized
gcaaactgagtgggcctggc

SEQ ID NO: 630 - DNA, 20 bp, Artificial Sequence
  chemically synthesized
actgagtgggcctggcaagt

SEQ ID NO: 631 - DNA, 20 bp, Artificial Sequence
  chemically synthesized
gcctggcaagttggattaaa

SEQ ID NO: 632 - DNA, 20 bp, Artificial Sequence
  chemically synthesized
tggcaagttggattaaaaag

SEQ ID NO: 633 - DNA, 20 bp, Artificial Sequence
  chemically synthesized
ggcaagttggattaaaaagc

SEQ ID NO: 634 - DNA, 20 bp, Artificial Sequence
  chemically synthesized
gattaaaaagcgggttttct

SEQ ID NO: 635 - DNA, 20 bp, Artificial Sequence
  chemically synthesized
actactcatgtgtgtgtgtg

SEQ ID NO: 636 - DNA, 20 bp, Artificial Sequence
  chemically synthesized
ctactcatgtgtgtgtgtgt

SEQ ID NO: 637 - DNA, 20 bp, Artificial Sequence
  chemically synthesized
tactcatgtgtgtgtgtgtg

SEQ ID NO: 638 - DNA, 20 bp, Artificial Sequence
  chemically synthesized
actcatgtgtgtgtgtgtgg

SEQ ID NO: 639 - DNA, 20 bp, Artificial Sequence
  chemically synthesized
ctcatgtgtgtgtgtgtggg

SEQ ID NO: 640 - DNA, 20 bp, Artificial Sequence
  chemically synthesized
tcatgtgtgtgtgtgtgggg

SEQ ID NO: 641 - DNA, 20 bp, Artificial Sequence
  chemically synthesized
catgtgtgtgtgtgtggggg

SEQ ID NO: 642 - DNA, 20 bp, Artificial Sequence
  chemically synthesized
atgtgtgtgtgtgtgggggg

SEQ ID NO: 643 - DNA, 20 bp, Artificial Sequence
  chemically synthesized
tgtgtgtgtgtgtggggggg

SEQ ID NO: 644 - DNA, 20 bp, Artificial Sequence
  chemically synthesized
gtgtgtgtgtgtgggggggg

SEQ ID NO: 645 - DNA, 20 bp, Artificial Sequence
  chemically synthesized
tgtgtgtgtgtggggggggg

SEQ ID NO: 646 - DNA, 20 bp, Artificial Sequence
  chemically synthesized
gtgtgtgtgggggggggggg

SEQ ID NO: 647 - DNA, 20 bp, Artificial Sequence
  chemically synthesized
tgtggggggggggggcggcg

SEQ ID NO: 648 - DNA, 20 bp, Artificial Sequence
  chemically synthesized
gtggggggggggggcggcgt

SEQ ID NO: 649 - DNA, 20 bp, Artificial Sequence
  chemically synthesized
tggggggggggggcggcgtg

SEQ ID NO: 650 - DNA, 20 bp, Artificial Sequence
  chemically synthesized
ggggggggggggcggcgtgg

SEQ ID NO: 651 - DNA, 20 bp, Artificial Sequence
  chemically synthesized
gggggggggcggcgtggggg

SEQ ID NO: 652 - DNA, 20 bp, Artificial Sequence
  chemically synthesized
ggggggggcggcgtgggggt

SEQ ID NO: 653 - DNA, 20 bp, Artificial Sequence
  chemically synthesized
gggggcggcgtgggggtggg

SEQ ID NO: 654 - DNA, 20 bp, Artificial Sequence
  chemically synthesized
ggggcggcgtgggggtggga

SEQ ID NO: 655 - DNA, 20 bp, Artificial Sequence
  chemically synthesized
gggcggcgtgggggtgggaa

SEQ ID NO: 656 - DNA, 20 bp, Artificial Sequence
  chemically synthesized
ggcggcgtgggggtgggaag

SEQ ID NO: 657 - DNA, 20 bp, Artificial Sequence
  chemically synthesized
gcggcgtgggggtgggaagg

SEQ ID NO: 658 - DNA, 20 bp, Artificial Sequence
  chemically synthesized
gggggactaccatctgcatg

SEQ ID NO: 659 - DNA, 20 bp, Artificial Sequence
  chemically synthesized
ggggactaccatctgcatgt

SEQ ID NO: 660 - DNA, 20 bp, Artificial Sequence
  chemically synthesized
ccatctgcatgtaggatgtc

SEQ ID NO: 661 - DNA, 20 bp, Artificial Sequence
  chemically synthesized
tctgcatgtaggatgtctag

SEQ ID NO: 662 - DNA, 20 bp, Artificial Sequence
  chemically synthesized
atcctgtcctccctactcac

SEQ ID NO: 663 - DNA, 20 bp, Artificial Sequence
  chemically synthesized
tcctgtcctccctactcact

SEQ ID NO: 664 - DNA, 20 bp, Artificial Sequence
  chemically synthesized
cctccctactcactaggtgc

SEQ ID NO: 665 - DNA, 20 bp, Artificial Sequence
  chemically synthesized
ctccctactcactaggtgct

SEQ ID NO: 666 - DNA, 20 bp, Artificial Sequence
  chemically synthesized
ccctactcactaggtgctag

SEQ ID NO: 667 - DNA, 20 bp, Artificial Sequence
  chemically synthesized
aggtgctaggagcactcccc

SEQ ID NO: 668 - DNA, 20 bp, Artificial Sequence
  chemically synthesized
aaactttgccacatgtcacc

SEQ ID NO: 669 - DNA, 20 bp, Artificial Sequence
  chemically synthesized
ctttgccacatgtcacctag

SEQ ID NO: 670 - DNA, 20 bp, Artificial Sequence
  chemically synthesized
tcacctagtagacaaactcc

SEQ ID NO: 671 - DNA, 20 bp, Artificial Sequence
  chemically synthesized
tagtagacaaactcctggtt

SEQ ID NO: 672 - DNA, 20 bp, Artificial Sequence
  chemically synthesized
tagacaaactcctggttaag

SEQ ID NO: 673 - DNA, 20 bp, Artificial Sequence
  chemically synthesized
aaactcctggttaagaagct

SEQ ID NO: 674 - DNA, 20 bp, Artificial Sequence
  chemically synthesized
aactcctggttaagaagctc

SEQ ID NO: 675 - DNA, 20 bp, Artificial Sequence
  chemically synthesized
tcgggttgaaaaaaataaac

SEQ ID NO: 676 - DNA, 20 bp, Artificial Sequence
  chemically synthesized
ggttgaaaaaaataaacaag

SEQ ID NO: 677 - DNA, 20 bp, Artificial Sequence
  chemically synthesized
aaaaaataaacaagtagtgc

SEQ ID NO: 678 - DNA, 20 bp, Artificial Sequence
  chemically synthesized
aaaaataaacaagtagtgct

SEQ ID NO: 679 - DNA, 20 bp, Artificial Sequence
  chemically synthesized
aaaataaacaagtagtgctg

SEQ ID NO: 680 - DNA, 20 bp, Artificial Sequence
  chemically synthesized
aataaacaagtagtgctggg

SEQ ID NO: 681 - DNA, 20 bp, Artificial Sequence
  chemically synthesized
aaacaagtagtgctggggag

SEQ ID NO: 682 - DNA, 20 bp, Artificial Sequence
  chemically synthesized
acaagtagtgctggggagta

SEQ ID NO: 683 - DNA, 20 bp, Artificial Sequence
  chemically synthesized
caagtagtgctggggagtag

SEQ ID NO: 684 - DNA, 20 bp, Artificial Sequence
  chemically synthesized
agtgctggggagtagaggcc

SEQ ID NO: 685 - DNA, 20 bp, Artificial Sequence
  chemically synthesized
gctggggagtagaggccaag

SEQ ID NO: 686 - DNA, 20 bp, Artificial Sequence
  chemically synthesized
ggggagtagaggccaagaag

SEQ ID NO: 687 - DNA, 20 bp, Artificial Sequence
  chemically synthesized
gggagtagaggccaagaagt

SEQ ID NO: 688 - DNA, 20 bp, Artificial Sequence
  chemically synthesized
agaggccaagaagtaggtaa

SEQ ID NO: 689 - DNA, 20 bp, Artificial Sequence
  chemically synthesized
gaggccaagaagtaggtaat

SEQ ID NO: 690 - DNA, 20 bp, Artificial Sequence
  chemically synthesized
caagaagtaggtaatgggct

SEQ ID NO: 691 - DNA, 20 bp, Artificial Sequence
  chemically synthesized
gaagtaggtaatgggctcag

SEQ ID NO: 692 - DNA, 20 bp, Artificial Sequence
  chemically synthesized
agtaggtaatgggctcagaa

SEQ ID NO: 693 - DNA, 20 bp, Artificial Sequence
  chemically synthesized
gtaggtaatgggctcagaag

SEQ ID NO: 694 - DNA, 20 bp, Artificial Sequence
  chemically synthesized
aggtaatgggctcagaagag

SEQ ID NO: 695 - DNA, 20 bp, Artificial Sequence
  chemically synthesized
tcagaagaggagccacaaac

SEQ ID NO: 696 - DNA, 20 bp, Artificial Sequence
  chemically synthesized
cagaagaggagccacaaaca

SEQ ID NO: 697 - DNA, 20 bp, Artificial Sequence
  chemically synthesized
gagccacaaacaaggttgtg

SEQ ID NO: 698 - DNA, 20 bp, Artificial Sequence
  chemically synthesized
agccacaaacaaggttgtgc

SEQ ID NO: 699 - DNA, 20 bp, Artificial Sequence
  chemically synthesized
caaggttgtgcaggcgcctg

SEQ ID NO: 700 - DNA, 20 bp, Artificial Sequence
  chemically synthesized
aaggttgtgcaggcgcctgt

SEQ ID NO: 701 - DNA, 20 bp, Artificial Sequence
  chemically synthesized
gtgcaggcgcctgtaggctg

SEQ ID NO: 702 - DNA, 20 bp, Artificial Sequence
  chemically synthesized
gtaggctgtggtgtgaattc

SEQ ID NO: 703 - DNA, 20 bp, Artificial Sequence
  chemically synthesized
ctgtggtgtgaattctagcc

SEQ ID NO: 704 - DNA, 20 bp, Artificial Sequence
  chemically synthesized
tgtggtgtgaattctagcca

SEQ ID NO: 705 - DNA, 20 bp, Artificial Sequence
  chemically synthesized
tggtgtgaattctagccaag

SEQ ID NO: 706 - DNA, 20 bp, Artificial Sequence
  chemically synthesized
gaattctagccaaggagtaa

SEQ ID NO: 707 - DNA, 20 bp, Artificial Sequence
  chemically synthesized
ggagtaacagtgatctgtca

SEQ ID NO: 708 - DNA, 20 bp, Artificial Sequence
  chemically synthesized
gagtaacagtgatctgtcac

SEQ ID NO: 709 - DNA, 20 bp, Artificial Sequence
  chemically synthesized
gatctgtcacaggcttttaa

SEQ ID NO: 710 - DNA, 20 bp, Artificial Sequence
  chemically synthesized
aggcttttaaaagattgctc

SEQ ID NO: 711 - DNA, 20 bp, Artificial Sequence
  chemically synthesized
agattgctctggctgctatg

SEQ ID NO: 712 - DNA, 20 bp, Artificial Sequence
  chemically synthesized
tgctctggctgctatgtgga

SEQ ID NO: 713 - DNA, 20 bp, Artificial Sequence
  chemically synthesized
tctggctgctatgtggaaag

SEQ ID NO: 714 - DNA, 20 bp, Artificial Sequence
  chemically synthesized
gctatgtggaaagcagaatg

SEQ ID NO: 715 - DNA, 20 bp, Artificial Sequence
  chemically synthesized
ctatgtggaaagcagaatga

SEQ ID NO: 716 - DNA, 20 bp, Artificial Sequence
  chemically synthesized
tatgtggaaagcagaatgaa

SEQ ID NO: 717 - DNA, 20 bp, Artificial Sequence
  chemically synthesized
tgtggaaagcagaatgaagg

SEQ ID NO: 718 - DNA, 20 bp, Artificial Sequence
  chemically synthesized
aagcagaatgaagggagcaa

SEQ ID NO: 719 - DNA, 20 bp, Artificial Sequence
  chemically synthesized
aatgaagggagcaacagtaa

SEQ ID NO: 720 - DNA, 20 bp, Artificial Sequence
  chemically synthesized
gaagggagcaacagtaaaag

SEQ ID NO: 721 - DNA, 20 bp, Artificial Sequence
  chemically synthesized
aagggagcaacagtaaaagc

SEQ ID NO: 722 - DNA, 20 bp, Artificial Sequence
  chemically synthesized
agggagcaacagtaaaagca

SEQ ID NO: 723 - DNA, 20 bp, Artificial Sequence
  chemically synthesized
ggagcaacagtaaaagcagg

SEQ ID NO: 724 - DNA, 20 bp, Artificial Sequence
  chemically synthesized
aacagtaaaagcagggagcc

SEQ ID NO: 725 - DNA, 20 bp, Artificial Sequence
  chemically synthesized
gtaaaagcagggagcccagc

SEQ ID NO: 726 - DNA, 20 bp, Artificial Sequence
  chemically synthesized
taaaagcagggagcccagcc

SEQ ID NO: 727 - DNA, 20 bp, Artificial Sequence
  chemically synthesized
aagcagggagcccagccagg

SEQ ID NO: 728 - DNA, 20 bp, Artificial Sequence
  chemically synthesized
ccagccaggaagctgttaca

SEQ ID NO: 729 - DNA, 20 bp, Artificial Sequence
  chemically synthesized
caggaagctgttacacagtc

SEQ ID NO: 730 - DNA, 20 bp, Artificial Sequence
  chemically synthesized
aggaagctgttacacagtcc

SEQ ID NO: 731 - DNA, 20 bp, Artificial Sequence
  chemically synthesized
agctgttacacagtccaggc

SEQ ID NO: 732 - DNA, 20 bp, Artificial Sequence
  chemically synthesized
ctgttacacagtccaggcaa

SEQ ID NO: 733 - DNA, 20 bp, Artificial Sequence
  chemically synthesized
tgttacacagtccaggcaag

SEQ ID NO: 734 - DNA, 20 bp, Artificial Sequence
  chemically synthesized
tacacagtccaggcaagagg

SEQ ID NO: 735 - DNA, 20 bp, Artificial Sequence
  chemically synthesized
acagtccaggcaagaggtag

SEQ ID NO: 736 - DNA, 20 bp, Artificial Sequence
  chemically synthesized
agtccaggcaagaggtagtg

SEQ ID NO: 737 - DNA, 20 bp, Artificial Sequence
  chemically synthesized
ccaggcaagaggtagtggag

SEQ ID NO: 738 - DNA, 20 bp, Artificial Sequence
  chemically synthesized
caggcaagaggtagtggagt

SEQ ID NO: 739 - DNA, 20 bp, Artificial Sequence
  chemically synthesized
caagaggtagtggagtgggc

SEQ ID NO: 740 - DNA, 20 bp, Artificial Sequence
  chemically synthesized
aagaggtagtggagtgggct

SEQ ID NO: 741 - DNA, 20 bp, Artificial Sequence
  chemically synthesized
aggtagtggagtgggctggg

SEQ ID NO: 742 - DNA, 20 bp, Artificial Sequence
  chemically synthesized
ggtagtggagtgggctgggt

SEQ ID NO: 743 - DNA, 20 bp, Artificial Sequence
  chemically synthesized
tggagtgggctgggtgggaa

SEQ ID NO: 744 - DNA, 20 bp, Artificial Sequence
  chemically synthesized
tgggctgggtgggaacagaa

SEQ ID NO: 745 - DNA, 20 bp, Artificial Sequence
  chemically synthesized
gggctgggtgggaacagaaa

SEQ ID NO: 746 - DNA, 20 bp, Artificial Sequence
  chemically synthesized
ggctgggtgggaacagaaaa

SEQ ID NO: 747 - DNA, 20 bp, Artificial Sequence
  chemically synthesized
ctgggtgggaacagaaaagg

SEQ ID NO: 748 - DNA, 20 bp, Artificial Sequence
  chemically synthesized
tgtctcctgaatatattctg

SEQ ID NO: 749 - DNA, 20 bp, Artificial Sequence
  chemically synthesized
gtctcctgaatatattctga

SEQ ID NO: 750 - DNA, 20 bp, Artificial Sequence
  chemically synthesized
tcctgaatatattctgaagg

SEQ ID NO: 751 - DNA, 20 bp, Artificial Sequence
  chemically synthesized
tattctgaaggaagttgctg

SEQ ID NO: 752 - DNA, 20 bp, Artificial Sequence
  chemically synthesized
attctgaaggaagttgctga

SEQ ID NO: 753 - DNA, 20 bp, Artificial Sequence
  chemically synthesized
tgaaggattctatgttgtgt

SEQ ID NO: 754 - DNA, 20 bp, Artificial Sequence
  chemically synthesized
aaggattctatgttgtgtga

SEQ ID NO: 755 - DNA, 20 bp, Artificial Sequence
  chemically synthesized
attctatgttgtgtgagaga

SEQ ID NO: 756 - DNA, 20 bp, Artificial Sequence
  chemically synthesized
tctatgttgtgtgagagaaa

SEQ ID NO: 757 - DNA, 20 bp, Artificial Sequence
  chemically synthesized
atgttgtgtgagagaaagag

SEQ ID NO: 758 - DNA, 20 bp, Artificial Sequence
  chemically synthesized
tgtgagagaaagagaagaat

SEQ ID NO: 759 - DNA, 20 bp, Artificial Sequence
  chemically synthesized
agagaaagagaagaattggc

SEQ ID NO: 760 - DNA, 20 bp, Artificial Sequence
  chemically synthesized
gagaaagagaagaattggct

SEQ ID NO: 761 - DNA, 20 bp, Artificial Sequence
  chemically synthesized
agagaagaattggctgggtg

SEQ ID NO: 762 - DNA, 20 bp, Artificial Sequence
  chemically synthesized
gaagaattggctgggtgtag

SEQ ID NO: 763 - DNA, 20 bp, Artificial Sequence
  chemically synthesized
tgggtgtagtagctcatgcc

SEQ ID NO: 764 - DNA, 20 bp, Artificial Sequence
  chemically synthesized
gggtgtagtagctcatgcca

SEQ ID NO: 765 - DNA, 20 bp, Artificial Sequence
  chemically synthesized
gtgtagtagctcatgccaag

SEQ ID NO: 766 - DNA, 20 bp, Artificial Sequence
  chemically synthesized
tgtagtagctcatgccaagg

SEQ ID NO: 767 - DNA, 20 bp, Artificial Sequence
  chemically synthesized
tagtagctcatgccaaggag

SEQ ID NO: 768 - DNA, 20 bp, Artificial Sequence
  chemically synthesized
agtagctcatgccaaggagg

SEQ ID NO: 769 - DNA, 20 bp, Artificial Sequence
  chemically synthesized
ctcatgccaaggaggaggcc

SEQ ID NO: 770 - DNA, 20 bp, Artificial Sequence
  chemically synthesized
tcatgccaaggaggaggcca

SEQ ID NO: 771 - DNA, 20 bp, Artificial Sequence
  chemically synthesized
atgccaaggaggaggccaag

SEQ ID NO: 772 - DNA, 20 bp, Artificial Sequence
  chemically synthesized
gccaaggaggaggccaagga

SEQ ID NO: 773 - DNA, 20 bp, Artificial Sequence
  chemically synthesized
aaggaggaggccaaggagag

SEQ ID NO: 774 - DNA, 20 bp, Artificial Sequence
  chemically synthesized
gccaaggagagcagattcct

SEQ ID NO: 775 - DNA, 20 bp, Artificial Sequence
  chemically synthesized
ggagagcagattcctgagct

SEQ ID NO: 776 - DNA, 20 bp, Artificial Sequence
  chemically synthesized
gagagcagattcctgagctc

SEQ ID NO: 777 - DNA, 20 bp, Artificial Sequence
  chemically synthesized
gagcagattcctgagctcag

SEQ ID NO: 778 - DNA, 20 bp, Artificial Sequence
  chemically synthesized
attcctgagctcaggagttc

SEQ ID NO: 779 - DNA, 20 bp, Artificial Sequence
  chemically synthesized
tgagctcaggagttcaagac

SEQ ID NO: 780 - DNA, 20 bp, Artificial Sequence
  chemically synthesized
tcaggagttcaagaccagcc

SEQ ID NO: 781 - DNA, 20 bp, Artificial Sequence
  chemically synthesized
caggagttcaagaccagcct

SEQ ID NO: 782 - DNA, 20 bp, Artificial Sequence
  chemically synthesized
caagaccagcctgggcaaca

SEQ ID NO: 783 - DNA, 20 bp, Artificial Sequence
  chemically synthesized
tctacaaaaaatacaaaaat

SEQ ID NO: 784 - DNA, 20 bp, Artificial Sequence
  chemically synthesized
caaaaaatacaaaaattagc

SEQ ID NO: 785 - DNA, 20 bp, Artificial Sequence
  chemically synthesized
aaaaaatacaaaaattagct

SEQ ID NO: 786 - DNA, 20 bp, Artificial Sequence
  chemically synthesized
atacaaaaattagctgggtg

SEQ ID NO: 787 - DNA, 20 bp, Artificial Sequence
  chemically synthesized
caaaaattagctgggtgtgg

SEQ ID NO: 788 - DNA, 20 bp, Artificial Sequence
  chemically synthesized
gtggcatgcacctgtgatcc

SEQ ID NO: 789 - DNA, 20 bp, Artificial Sequence
  chemically synthesized
cacctgtgatcctagctact

SEQ ID NO: 790 - DNA, 20 bp, Artificial Sequence
  chemically synthesized
acctgtgatcctagctactc

SEQ ID NO: 791 - DNA, 20 bp, Artificial Sequence
  chemically synthesized
ctgtgatcctagctactcgg

SEQ ID NO: 792 - DNA, 20 bp, Artificial Sequence
  chemically synthesized
tgtgatcctagctactcggg

SEQ ID NO: 793 - DNA, 20 bp, Artificial Sequence
  chemically synthesized
tcctagctactcgggaggct

SEQ ID NO: 794 - DNA, 20 bp, Artificial Sequence
  chemically synthesized
cctagctactcgggaggctg

SEQ ID NO: 795 - DNA, 20 bp, Artificial Sequence
  chemically synthesized
agctactcgggaggctgagg

SEQ ID NO: 796 - DNA, 20 bp, Artificial Sequence
  chemically synthesized
ctactcgggaggctgaggtg

SEQ ID NO: 797 - DNA, 20 bp, Artificial Sequence
  chemically synthesized
tactcgggaggctgaggtgg

SEQ ID NO: 798 - DNA, 20 bp, Artificial Sequence
  chemically synthesized
actcgggaggctgaggtgga

SEQ ID NO: 799 - DNA, 20 bp, Artificial Sequence
  chemically synthesized
tgaggtggagggtattgctt

SEQ ID NO: 800 - DNA, 20 bp, Artificial Sequence
  chemically synthesized
tggagggtattgcttgagcc

SEQ ID NO: 801 - DNA, 20 bp, Artificial Sequence
  chemically synthesized
ggagggtattgcttgagccc

SEQ ID NO: 802 - DNA, 20 bp, Artificial Sequence
  chemically synthesized
gggtattgcttgagcccagg

SEQ ID NO: 803 - DNA, 20 bp, Artificial Sequence
  chemically synthesized
ttgcttgagcccaggaagtt

SEQ ID NO: 804 - DNA, 20 bp, Artificial Sequence
  chemically synthesized
tgcttgagcccaggaagttg

SEQ ID NO: 805 - DNA, 20 bp, Artificial Sequence
  chemically synthesized
agcccaggaagttgaggctg

SEQ ID NO: 806 - DNA, 20 bp, Artificial Sequence
  chemically synthesized
caggaagttgaggctgcagt

SEQ ID NO: 807 - DNA, 20 bp, Artificial Sequence
  chemically synthesized
atgactgtgccactgtactt

SEQ ID NO: 808 - DNA, 20 bp, Artificial Sequence
  chemically synthesized
tgtgccactgtacttcagcc

SEQ ID NO: 809 - DNA, 20 bp, Artificial Sequence
  chemically synthesized
gtgccactgtacttcagcct

SEQ ID NO: 810 - DNA, 20 bp, Artificial Sequence
  chemically synthesized
ctgtacttcagcctaggtga

SEQ ID NO: 811 - DNA, 20 bp, Artificial Sequence
  chemically synthesized
gtacttcagcctaggtgaca

SEQ ID NO: 812 - DNA, 20 bp, Artificial Sequence
  chemically synthesized
ttcagcctaggtgacagagc

SEQ ID NO: 813 - DNA, 20 bp, Artificial Sequence
  chemically synthesized
tctcccctgaccccctgaaa

SEQ ID NO: 814 - DNA, 20 bp, Artificial Sequence
  chemically synthesized
tcccctgaccccctgaaaaa

SEQ ID NO: 815 - DNA, 20 bp, Artificial Sequence
  chemically synthesized
cctgaccccctgaaaaagag

SEQ ID NO: 816 - DNA, 20 bp, Artificial Sequence
  chemically synthesized
tgaccccctgaaaaagagaa

SEQ ID NO: 817 - DNA, 20 bp, Artificial Sequence
  chemically synthesized
cctgaaaaagagaagagtta

SEQ ID NO: 818 - DNA, 20 bp, Artificial Sequence
  chemically synthesized
gttctttattttaattttat

SEQ ID NO: 819 - DNA, 20 bp, Artificial Sequence
  chemically synthesized
tattttaattttattggcct

SEQ ID NO: 820 - DNA, 20 bp, Artificial Sequence
  chemically synthesized
tttaattttattggcctgag

SEQ ID NO: 821 - DNA, 20 bp, Artificial Sequence
  chemically synthesized
aattttattggcctgagcag

SEQ ID NO: 822 - DNA, 20 bp, Artificial Sequence
  chemically synthesized
attttattggcctgagcagt

SEQ ID NO: 823 - DNA, 20 bp, Artificial Sequence
  chemically synthesized
ttttattggcctgagcagtg

SEQ ID NO: 824 - DNA, 20 bp, Artificial Sequence
  chemically synthesized
ggcctgagcagtggggtaat

SEQ ID NO: 825 - DNA, 20 bp, Artificial Sequence
  chemically synthesized
taattggcaatgccatttct

SEQ ID NO: 826 - DNA, 20 bp, Artificial Sequence
  chemically synthesized
tggcaatgccatttctgaga

SEQ ID NO: 827 - DNA, 20 bp, Artificial Sequence
  chemically synthesized
atgccatttctgagatggtg

SEQ ID NO: 828 - DNA, 20 bp, Artificial Sequence
  chemically synthesized
tgccatttctgagatggtga

SEQ ID NO: 829 - DNA, 20 bp, Artificial Sequence
  chemically synthesized
catttctgagatggtgaagg

SEQ ID NO: 830 - DNA, 20 bp, Artificial Sequence
  chemically synthesized
tttctgagatggtgaaggca

SEQ ID NO: 831 - DNA, 20 bp, Artificial Sequence
  chemically synthesized
ttctgagatggtgaaggcag

SEQ ID NO: 832 - DNA, 20 bp, Artificial Sequence
  chemically synthesized
gagatggtgaaggcagagga

SEQ ID NO: 833 - DNA, 20 bp, Artificial Sequence
  chemically synthesized
gatggtgaaggcagaggaaa

SEQ ID NO: 834 - DNA, 20 bp, Artificial Sequence
  chemically synthesized
ggtgaaggcagaggaaagag

SEQ ID NO: 835 - DNA, 20 bp, Artificial Sequence
  chemically synthesized
aggcagaggaaagagcagtt

SEQ ID NO: 836 - DNA, 20 bp, Artificial Sequence
  chemically synthesized
ggcagaggaaagagcagttt

SEQ ID NO: 837 - DNA, 20 bp, Artificial Sequence
  chemically synthesized
gcagaggaaagagcagtttg

SEQ ID NO: 838 - DNA, 20 bp, Artificial Sequence
  chemically synthesized
agagcagtttggggtaaatc

SEQ ID NO: 839 - DNA, 20 bp, Artificial Sequence
  chemically synthesized
gagcagtttggggtaaatca

SEQ ID NO: 840 - DNA, 20 bp, Artificial Sequence
  chemically synthesized
gtaaatcaaggatctgcatt

SEQ ID NO: 841 - DNA, 20 bp, Artificial Sequence
  chemically synthesized
gatctgcatttggacatgtt

SEQ ID NO: 842 - DNA, 20 bp, Artificial Sequence
  chemically synthesized
catttggacatgttaagttt

SEQ ID NO: 843 - DNA, 20 bp, Artificial Sequence
  chemically synthesized
acatgttaagtttgagattc

SEQ ID NO: 844 - DNA, 20 bp, Artificial Sequence
  chemically synthesized
gttaagtttgagattccagt

SEQ ID NO: 845 - DNA, 20 bp, Artificial Sequence
  chemically synthesized
ttaagtttgagattccagtc

SEQ ID NO: 846 - DNA, 20 bp, Artificial Sequence
  chemically synthesized
gagattccagtcaggcttcc

SEQ ID NO: 847 - DNA, 20 bp, Artificial Sequence
  chemically synthesized
attccagtcaggcttccaag

SEQ ID NO: 848 - DNA, 20 bp, Artificial Sequence
  chemically synthesized
cagtcaggcttccaagtggt

SEQ ID NO: 849 - DNA, 20 bp, Artificial Sequence
  chemically synthesized
agtcaggcttccaagtggtg

SEQ ID NO: 850 - DNA, 20 bp, Artificial Sequence
  chemically synthesized
ttccaagtggtgaggccaca

SEQ ID NO: 851 - DNA, 20 bp, Artificial Sequence
  chemically synthesized
tccaagtggtgaggccacat

SEQ ID NO: 852 - DNA, 20 bp, Artificial Sequence
  chemically synthesized
aagtggtgaggccacatagg

SEQ ID NO: 853 - DNA, 20 bp, Artificial Sequence
  chemically synthesized
gtgaggccacataggcagtt

SEQ ID NO: 854 - DNA, 20 bp, Artificial Sequence
  chemically synthesized
ccacataggcagttcagtgt

SEQ ID NO: 855 - DNA, 20 bp, Artificial Sequence
  chemically synthesized
ggcagttcagtgtaagaatt

SEQ ID NO: 856 - DNA, 20 bp, Artificial Sequence
  chemically synthesized
gcagttcagtgtaagaattc

SEQ ID NO: 857 - DNA, 20 bp, Artificial Sequence
  chemically synthesized
cagtgtaagaattcaggacc

SEQ ID NO: 858 - DNA, 20 bp, Artificial Sequence
  chemically synthesized
agtgtaagaattcaggacca

SEQ ID NO: 859 - DNA, 20 bp, Artificial Sequence
  chemically synthesized
taagaattcaggaccaaggc

SEQ ID NO: 860 - DNA, 20 bp, Artificial Sequence
  chemically synthesized
aagaattcaggaccaaggct

SEQ ID NO: 861 - DNA, 20 bp, Artificial Sequence
  chemically synthesized
ttcaggaccaaggctgggca

SEQ ID NO: 862 - DNA, 20 bp, Artificial Sequence
  chemically synthesized
aggaccaaggctgggcacgg

SEQ ID NO: 863 - DNA, 20 bp, Artificial Sequence
  chemically synthesized
gtggctcacttctgtaatcc

SEQ ID NO: 864 - DNA, 20 bp, Artificial Sequence
  chemically synthesized
cttctgtaatcccagcactt

SEQ ID NO: 865 - DNA, 20 bp, Artificial Sequence
  chemically synthesized
ctgtaatcccagcactttgg

SEQ ID NO: 866 - DNA, 20 bp, Artificial Sequence
  chemically synthesized
atcccagcactttggtggct

SEQ ID NO: 867 - DNA, 20 bp, Artificial Sequence
  chemically synthesized
tcccagcactttggtggctg

SEQ ID NO: 868 - DNA, 20 bp, Artificial Sequence
  chemically synthesized
cagcactttggtggctgagg

SEQ ID NO: 869 - DNA, 20 bp, Artificial Sequence
  chemically synthesized
agcactttggtggctgaggc

SEQ ID NO: 870 - DNA, 20 bp, Artificial Sequence
  chemically synthesized
actttggtggctgaggcagg

SEQ ID NO: 871 - DNA, 20 bp, Artificial Sequence
  chemically synthesized
ctgaggcaggtagatcattt

SEQ ID NO: 872 - DNA, 20 bp, Artificial Sequence
  chemically synthesized
tgaggcaggtagatcatttg

SEQ ID NO: 873 - DNA, 20 bp, Artificial Sequence
  chemically synthesized
gcaggtagatcatttgaggt

SEQ ID NO: 874 - DNA, 20 bp, Artificial Sequence
  chemically synthesized
caggtagatcatttgaggtc

SEQ ID NO: 875 - DNA, 20 bp, Artificial Sequence
  chemically synthesized
ggtagatcatttgaggtcag

SEQ ID NO: 876 - DNA, 20 bp, Artificial Sequence
  chemically synthesized
tcatttgaggtcaggagttt

SEQ ID NO: 877 - DNA, 20 bp, Artificial Sequence
  chemically synthesized
tgaggtcaggagtttgagac

SEQ ID NO: 878 - DNA, 20 bp, Artificial Sequence
  chemically synthesized
tcaggagtttgagacaagct

SEQ ID NO: 879 - DNA, 20 bp, Artificial Sequence
  chemically synthesized
tgagacaagcttggccaaca

SEQ ID NO: 880 - DNA, 20 bp, Artificial Sequence
  chemically synthesized
tctactaaaaatacaaaaat

SEQ ID NO: 881 - DNA, 20 bp, Artificial Sequence
  chemically synthesized
taaaaatacaaaaattagcc

SEQ ID NO: 882 - DNA, 20 bp, Artificial Sequence
  chemically synthesized
atacaaaaattagcctggtg

SEQ ID NO: 883 - DNA, 20 bp, Artificial Sequence
  chemically synthesized
caaaaattagcctggtgtgg

SEQ ID NO: 884 - DNA, 20 bp, Artificial Sequence
  chemically synthesized
ggtgtggtggcgcacgccta

SEQ ID NO: 885 - DNA, 20 bp, Artificial Sequence
  chemically synthesized
gtggcgcacgcctatagtcc

SEQ ID NO: 886 - DNA, 20 bp, Artificial Sequence
  chemically synthesized
tggcgcacgcctatagtccc

SEQ ID NO: 887 - DNA, 20 bp, Artificial Sequence
  chemically synthesized
cgcctatagtcccaggtttt

SEQ ID NO: 888 - DNA, 20 bp, Artificial Sequence
  chemically synthesized
gcctatagtcccaggttttc

SEQ ID NO: 889 - DNA, 20 bp, Artificial Sequence
  chemically synthesized
ctatagtcccaggttttcag

SEQ ID NO: 890 - DNA, 20 bp, Artificial Sequence
  chemically synthesized
tatagtcccaggttttcagg

SEQ ID NO: 891 - DNA, 20 bp, Artificial Sequence
  chemically synthesized
tcccaggttttcaggaggct

SEQ ID NO: 892 - DNA, 20 bp, Artificial Sequence
  chemically synthesized
cccaggttttcaggaggctt

SEQ ID NO: 893 - DNA, 20 bp, Artificial Sequence
  chemically synthesized
aggttttcaggaggcttagg

SEQ ID NO: 894 - DNA, 20 bp, Artificial Sequence
  chemically synthesized
ggttttcaggaggcttaggt

SEQ ID NO: 895 - DNA, 20 bp, Artificial Sequence
  chemically synthesized
ttttcaggaggcttaggtag

SEQ ID NO: 896 - DNA, 20 bp, Artificial Sequence
  chemically synthesized
gtaggagaatcccttgaacc

SEQ ID NO: 897 - DNA, 20 bp, Artificial Sequence
  chemically synthesized
taggagaatcccttgaaccc

SEQ ID NO: 898 - DNA, 20 bp, Artificial Sequence
  chemically synthesized
ggagaatcccttgaacccag

SEQ ID NO: 899 - DNA, 20 bp, Artificial Sequence
  chemically synthesized
gagaatcccttgaacccagg

SEQ ID NO: 900 - DNA, 20 bp, Artificial Sequence
  chemically synthesized
tcccttgaacccaggaggtg

SEQ ID NO: 901 - DNA, 20 bp, Artificial Sequence
  chemically synthesized
cccttgaacccaggaggtgc

SEQ ID NO: 902 - DNA, 20 bp, Artificial Sequence
  chemically synthesized
aacccaggaggtgcaggttg

SEQ ID NO: 903 - DNA, 20 bp, Artificial Sequence
  chemically synthesized
caggaggtgcaggttgcagt

SEQ ID NO: 904 - DNA, 20 bp, Artificial Sequence
  chemically synthesized
ggtgcaggttgcagtgagct

SEQ ID NO: 905 - DNA, 20 bp, Artificial Sequence
  chemically synthesized
gagattgtgccactgcactc

SEQ ID NO: 906 - DNA, 20 bp, Artificial Sequence
  chemically synthesized
tgtgccactgcactccagcc

SEQ ID NO: 907 - DNA, 20 bp, Artificial Sequence
  chemically synthesized
gtgccactgcactccagcct

SEQ ID NO: 908 - DNA, 20 bp, Artificial Sequence
  chemically synthesized
ctgcactccagcctgggtga

SEQ ID NO: 909 - DNA, 20 bp, Artificial Sequence
  chemically synthesized
gcactccagcctgggtgata

SEQ ID NO: 910 - DNA, 20 bp, Artificial Sequence
  chemically synthesized
tccagcctgggtgatagagt

SEQ ID NO: 911 - DNA, 20 bp, Artificial Sequence
  chemically synthesized
aaaaaaaaaaaaaaaaactg

SEQ ID NO: 912 - DNA, 20 bp, Artificial Sequence
  chemically synthesized
aaaaaaaaaaaaaaaactga

SEQ ID NO: 913 - DNA, 20 bp, Artificial Sequence
  chemically synthesized
aaactgaaggaattattcct

SEQ ID NO: 914 - DNA, 20 bp, Artificial Sequence
  chemically synthesized
aactgaaggaattattcctc

SEQ ID NO: 915 - DNA, 20 bp, Artificial Sequence
  chemically synthesized
aggaattattcctcaggatt

SEQ ID NO: 916 - DNA, 20 bp, Artificial Sequence
  chemically synthesized
ggaattattcctcaggattt

SEQ ID NO: 917 - DNA, 20 bp, Artificial Sequence
  chemically synthesized
atttgggtctaatttgccct

SEQ ID NO: 918 - DNA, 20 bp, Artificial Sequence
  chemically synthesized
tgccctgagcaccaactcct

SEQ ID NO: 919 - DNA, 20 bp, Artificial Sequence
  chemically synthesized
actcctgagttcaactacca

SEQ ID NO: 920 - DNA, 20 bp, Artificial Sequence
  chemically synthesized
ctgagttcaactaccatggc

SEQ ID NO: 921 - DNA, 20 bp, Artificial Sequence
  chemically synthesized
agacacaccttaacattttc

SEQ ID NO: 922 - DNA, 20 bp, Artificial Sequence
  chemically synthesized
taacattttctagaatccac

SEQ ID NO: 923 - DNA, 20 bp, Artificial Sequence
  chemically synthesized
tttctagaatccaccagctt

SEQ ID NO: 924 - DNA, 20 bp, Artificial Sequence
  chemically synthesized
ctagaatccaccagctttag

SEQ ID NO: 925 - DNA, 20 bp, Artificial Sequence
  chemically synthesized
agaatccaccagctttagtg

SEQ ID NO: 926 - DNA, 20 bp, Artificial Sequence
  chemically synthesized
agtggagtctgtctaatcat

SEQ ID NO: 927 - DNA, 20 bp, Artificial Sequence
  chemically synthesized
gtctgtctaatcatgagtat

SEQ ID NO: 928 - DNA, 20 bp, Artificial Sequence
  chemically synthesized
tctaatcatgagtattggaa

SEQ ID NO: 929 - DNA, 20 bp, Artificial Sequence
  chemically synthesized
ctaatcatgagtattggaat

SEQ ID NO: 930 - DNA, 20 bp, Artificial Sequence
  chemically synthesized
atgagtattggaataggatc

SEQ ID NO: 931 - DNA, 20 bp, Artificial Sequence
  chemically synthesized
tgagtattggaataggatct

SEQ ID NO: 932 - DNA, 20 bp, Artificial Sequence
  chemically synthesized
gagtattggaataggatctg

SEQ ID NO: 933 - DNA, 20 bp, Artificial Sequence
  chemically synthesized
agtattggaataggatctgg

SEQ ID NO: 934 - DNA, 20 bp, Artificial Sequence
  chemically synthesized
attggaataggatctggggg

SEQ ID NO: 935 - DNA, 20 bp, Artificial Sequence
  chemically synthesized
gaataggatctgggggcagt

SEQ ID NO: 936 - DNA, 20 bp, Artificial Sequence
  chemically synthesized
aataggatctgggggcagtg

SEQ ID NO: 937 - DNA, 20 bp, Artificial Sequence
  chemically synthesized
ataggatctgggggcagtga

SEQ ID NO: 938 - DNA, 20 bp, Artificial Sequence
  chemically synthesized
taggatctgggggcagtgag

SEQ ID NO: 939 - DNA, 20 bp, Artificial Sequence
  chemically synthesized
aggatctgggggcagtgagg

SEQ ID NO: 940 - DNA, 20 bp, Artificial Sequence
  chemically synthesized
atctgggggcagtgaggggg

SEQ ID NO: 941 - DNA, 20 bp, Artificial Sequence
  chemically synthesized
tgggggcagtgagggggtgg

SEQ ID NO: 942 - DNA, 20 bp, Artificial Sequence
  chemically synthesized
gagggggtggcagccacgtg

SEQ ID NO: 943 - DNA, 20 bp, Artificial Sequence
  chemically synthesized
ggggtggcagccacgtgtgg

SEQ ID NO: 944 - DNA, 20 bp, Artificial Sequence
  chemically synthesized
ggtggcagccacgtgtggca

SEQ ID NO: 945 - DNA, 20 bp, Artificial Sequence
  chemically synthesized
cagccacgtgtggcagagaa

SEQ ID NO: 946 - DNA, 20 bp, Artificial Sequence
  chemically synthesized
tgtggcagagaaaagcacac

SEQ ID NO: 947 - DNA, 20 bp, Artificial Sequence
  chemically synthesized
gtggcagagaaaagcacaca

SEQ ID NO: 948 - DNA, 20 bp, Artificial Sequence
  chemically synthesized
cagagaaaagcacacaagga

SEQ ID NO: 949 - DNA, 20 bp, Artificial Sequence
  chemically synthesized
gagaaaagcacacaaggaaa

SEQ ID NO: 950 - DNA, 20 bp, Artificial Sequence
  chemically synthesized
gcacacaaggaaagagcacc

SEQ ID NO: 951 - DNA, 20 bp, Artificial Sequence
  chemically synthesized
cacacaaggaaagagcaccc

SEQ ID NO: 952 - DNA, 20 bp, Artificial Sequence
  chemically synthesized
gagcacccaggactgtcata

SEQ ID NO: 953 - DNA, 20 bp, Artificial Sequence
  chemically synthesized
cacccaggactgtcatatgg

SEQ ID NO: 954 - DNA, 20 bp, Artificial Sequence
  chemically synthesized
caggactgtcatatggaaga

SEQ ID NO: 955 - DNA, 20 bp, Artificial Sequence
  chemically synthesized
actgtcatatggaagaaaga

SEQ ID NO: 956 - DNA, 20 bp, Artificial Sequence
  chemically synthesized
ctgtcatatggaagaaagac

SEQ ID NO: 957 - DNA, 20 bp, Artificial Sequence
  chemically synthesized
caactcacccttcacaaaat

SEQ ID NO: 958 - DNA, 20 bp, Artificial Sequence
  chemically synthesized
aactcacccttcacaaaatg

SEQ ID NO: 959 - DNA, 20 bp, Artificial Sequence
  chemically synthesized
acccttcacaaaatgaggac

SEQ ID NO: 960 - DNA, 20 bp, Artificial Sequence
  chemically synthesized
cacaaaatgaggaccagaca

SEQ ID NO: 961 - DNA, 20 bp, Artificial Sequence
  chemically synthesized
tgaggaccagacacagctga

SEQ ID NO: 962 - DNA, 20 bp, Artificial Sequence
  chemically synthesized
ccagacacagctgatggtat

SEQ ID NO: 963 - DNA, 20 bp, Artificial Sequence
  chemically synthesized
gctgatggtatgagttgatg

SEQ ID NO: 964 - DNA, 20 bp, Artificial Sequence
  chemically synthesized
ctgatggtatgagttgatgc

SEQ ID NO: 965 - DNA, 20 bp, Artificial Sequence
  chemically synthesized
tatgagttgatgcaggtgtg

SEQ ID NO: 966 - DNA, 20 bp, Artificial Sequence
  chemically synthesized
tgagttgatgcaggtgtgtg

SEQ ID NO: 967 - DNA, 20 bp, Artificial Sequence
  chemically synthesized
tgctcccctcctactacaca

SEQ ID NO: 968 - DNA, 20 bp, Artificial Sequence
  chemically synthesized
ccctcctactacacatggtt

SEQ ID NO: 969 - DNA, 20 bp, Artificial Sequence
  chemically synthesized
cctcctactacacatggtta

SEQ ID NO: 970 - DNA, 20 bp, Artificial Sequence
  chemically synthesized
aaggcctgttgctctgtctc

SEQ ID NO: 971 - DNA, 20 bp, Artificial Sequence
  chemically synthesized
aggcctgttgctctgtctcc

SEQ ID NO: 972 - DNA, 20 bp, Artificial Sequence
  chemically synthesized
ctctctgcactacctcttca

SEQ ID NO: 973 - DNA, 20 bp, Artificial Sequence
  chemically synthesized
tctctgcactacctcttcat

SEQ ID NO: 974 - DNA, 20 bp, Artificial Sequence
  chemically synthesized
ctacctcttcatgggtgcct

SEQ ID NO: 975 - DNA, 20 bp, Artificial Sequence
  chemically synthesized
acctcttcatgggtgcctca

SEQ ID NO: 976 - DNA, 20 bp, Artificial Sequence
  chemically synthesized
tcttcatgggtgcctcagag

SEQ ID NO: 977 - DNA, 20 bp, Artificial Sequence
  chemically synthesized
cttcatgggtgcctcagagc

SEQ ID NO: 978 - DNA, 20 bp, Artificial Sequence
  chemically synthesized
ggtgcctcagagcaggacct

SEQ ID NO: 979 - DNA, 20 bp, Artificial Sequence
  chemically synthesized
ccttggtctttccttgtttg

SEQ ID NO: 980 - DNA, 20 bp, Artificial Sequence
  chemically synthesized
tctttccttgtttgaagctt

SEQ ID NO: 981 - DNA, 20 bp, Artificial Sequence
  chemically synthesized
ctttccttgtttgaagcttt

SEQ ID NO: 982 - DNA, 20 bp, Artificial Sequence
  chemically synthesized
gtttgaagctttgggctacg

SEQ ID NO: 983 - DNA, 20 bp, Artificial Sequence
  chemically synthesized
ctttgggctacgtggatgac

SEQ ID NO: 984 - DNA, 20 bp, Artificial Sequence
  chemically synthesized
tgttcgtgttctatgatcat

SEQ ID NO: 985 - DNA, 20 bp, Artificial Sequence
  chemically synthesized
ttcgtgttctatgatcatga

SEQ ID NO: 986 - DNA, 20 bp, Artificial Sequence
  chemically synthesized
tgatcatgagagtcgccgtg

SEQ ID NO: 987 - DNA, 20 bp, Artificial Sequence
  chemically synthesized
atcatgagagtcgccgtgtg

SEQ ID NO: 988 - DNA, 20 bp, Artificial Sequence
  chemically synthesized
gtgtggagccccgaactcca

SEQ ID NO: 989 - DNA, 20 bp, Artificial Sequence
  chemically synthesized
tgtggagccccgaactccat

SEQ ID NO: 990 - DNA, 20 bp, Artificial Sequence
  chemically synthesized
ccccgaactccatgggtttc

SEQ ID NO: 991 - DNA, 20 bp, Artificial Sequence
  chemically synthesized
cgaactccatgggtttccag

SEQ ID NO: 992 - DNA, 20 bp, Artificial Sequence
  chemically synthesized
tgggtttccagtagaatttc

SEQ ID NO: 993 - DNA, 20 bp, Artificial Sequence
  chemically synthesized
tttccagtagaatttcaagc

SEQ ID NO: 994 - DNA, 20 bp, Artificial Sequence
  chemically synthesized
gtagaatttcaagccagatg

SEQ ID NO: 995 - DNA, 20 bp, Artificial Sequence
  chemically synthesized
tttcaagccagatgtggctg

SEQ ID NO: 996 - DNA, 20 bp, Artificial Sequence
  chemically synthesized
agccagatgtggctgcagct

SEQ ID NO: 997 - DNA, 20 bp, Artificial Sequence
  chemically synthesized
agatgtggctgcagctgagt

SEQ ID NO: 998 - DNA, 20 bp, Artificial Sequence
  chemically synthesized
atgtggctgcagctgagtca

SEQ ID NO: 999 - DNA, 20 bp, Artificial Sequence
  chemically synthesized
gcagctgagtcagagtctga

SEQ ID NO: 1000 - DNA, 20 bp, Artificial Sequence
  chemically synthesized
cagctgagtcagagtctgaa

SEQ ID NO: 1001 - DNA, 20 bp, Artificial Sequence
  chemically synthesized
agctgagtcagagtctgaaa

SEQ ID NO: 1002 - DNA, 20 bp, Artificial Sequence
  chemically synthesized
tgagtcagagtctgaaaggg

SEQ ID NO: 1003 - DNA, 20 bp, Artificial Sequence
  chemically synthesized
gagtcagagtctgaaagggt

SEQ ID NO: 1004 - DNA, 20 bp, Artificial Sequence
  chemically synthesized
acatgttcactgttgacttc

SEQ ID NO: 1005 - DNA, 20 bp, Artificial Sequence
  chemically synthesized
tgttgacttctggactatta

SEQ ID NO: 1006 - DNA, 20 bp, Artificial Sequence
  chemically synthesized
attatggaaaatcacaacca

SEQ ID NO: 1007 - DNA, 20 bp, Artificial Sequence
  chemically synthesized
tggaaaatcacaaccacagc

SEQ ID NO: 1008 - DNA, 20 bp, Artificial Sequence
  chemically synthesized
ggaaaatcacaaccacagca

SEQ ID NO: 1009 - DNA, 20 bp, Artificial Sequence
  chemically synthesized
gaaaatcacaaccacagcaa

SEQ ID NO: 1010 - DNA, 20 bp, Artificial Sequence
  chemically synthesized
acaaccacagcaagggtatg

SEQ ID NO: 1011 - DNA, 20 bp, Artificial Sequence
  chemically synthesized
aaccacagcaagggtatgtg

SEQ ID NO: 1012 - DNA, 20 bp, Artificial Sequence
  chemically synthesized
ccacagcaagggtatgtgga

SEQ ID NO: 1013 - DNA, 20 bp, Artificial Sequence
  chemically synthesized
cacagcaagggtatgtggag

SEQ ID NO: 1014 - DNA, 20 bp, Artificial Sequence
  chemically synthesized
acagcaagggtatgtggaga

SEQ ID NO: 1015 - DNA, 20 bp, Artificial Sequence
  chemically synthesized
cagcaagggtatgtggagag

SEQ ID NO: 1016 - DNA, 20 bp, Artificial Sequence
  chemically synthesized
agcaagggtatgtggagagg

SEQ ID NO: 1017 - DNA, 20 bp, Artificial Sequence
  chemically synthesized
agagggggcctcaccttcct

SEQ ID NO: 1018 - DNA, 20 bp, Artificial Sequence
  chemically synthesized
gagggggcctcaccttcctg

SEQ ID NO: 1019 - DNA, 20 bp, Artificial Sequence
  chemically synthesized
cctcaccttcctgaggttgt

SEQ ID NO: 1020 - DNA, 20 bp, Artificial Sequence
  chemically synthesized
tcaccttcctgaggttgtca

SEQ ID NO: 1021 - DNA, 20 bp, Artificial Sequence
  chemically synthesized
tcatcttttcatgcatcttg

SEQ ID NO: 1022 - DNA, 20 bp, Artificial Sequence
  chemically synthesized
catcttttcatgcatcttga

SEQ ID NO: 1023 - DNA, 20 bp, Artificial Sequence
  chemically synthesized
ttcatgcatcttgaaggaaa

SEQ ID NO: 1024 - DNA, 20 bp, Artificial Sequence
  chemically synthesized
tgcatcttgaaggaaacagc

SEQ ID NO: 1025 - DNA, 20 bp, Artificial Sequence
  chemically synthesized
atcttgaaggaaacagctgg

SEQ ID NO: 1026 - DNA, 20 bp, Artificial Sequence
  chemically synthesized
aaggaaacagctggaagtct

SEQ ID NO: 1027 - DNA, 20 bp, Artificial Sequence
  chemically synthesized
aggaaacagctggaagtctg

SEQ ID NO: 1028 - DNA, 20 bp, Artificial Sequence
  chemically synthesized
gctggaagtctgaggtcttg

SEQ ID NO: 1029 - DNA, 20 bp, Artificial Sequence
  chemically synthesized
ctggaagtctgaggtcttgt

SEQ ID NO: 1030 - DNA, 20 bp, Artificial Sequence
  chemically synthesized
ggaagtctgaggtcttgtgg

SEQ ID NO: 1031 - DNA, 20 bp, Artificial Sequence
  chemically synthesized
agtctgaggtcttgtgggag

SEQ ID NO: 1032 - DNA, 20 bp, Artificial Sequence
  chemically synthesized
gtctgaggtcttgtgggagc

SEQ ID NO: 1033 - DNA, 20 bp, Artificial Sequence
  chemically synthesized
tctgaggtcttgtgggagca

SEQ ID NO: 1034 - DNA, 20 bp, Artificial Sequence
  chemically synthesized
gaggtcttgtgggagcaggg

SEQ ID NO: 1035 - DNA, 20 bp, Artificial Sequence
  chemically synthesized
ggtcttgtgggagcagggaa

SEQ ID NO: 1036 - DNA, 20 bp, Artificial Sequence
  chemically synthesized
gtcttgtgggagcagggaag

SEQ ID NO: 1037 - DNA, 20 bp, Artificial Sequence
  chemically synthesized
tcttgtgggagcagggaaga

SEQ ID NO: 1038 - DNA, 20 bp, Artificial Sequence
  chemically synthesized
tgtgggagcagggaagaggg

SEQ ID NO: 1039 - DNA, 20 bp, Artificial Sequence
  chemically synthesized
gtgggagcagggaagaggga

SEQ ID NO: 1040 - DNA, 20 bp, Artificial Sequence
  chemically synthesized
agggaaggaatttgcttcct

SEQ ID NO: 1041 - DNA, 20 bp, Artificial Sequence
  chemically synthesized
atttgcttcctgagatcatt

SEQ ID NO: 1042 - DNA, 20 bp, Artificial Sequence
  chemically synthesized
tcctgagatcatttggtcct

SEQ ID NO: 1043 - DNA, 20 bp, Artificial Sequence
  chemically synthesized
cctgagatcatttggtcctt

SEQ ID NO: 1044 - DNA, 20 bp, Artificial Sequence
  chemically synthesized
ctgagatcatttggtccttg

SEQ ID NO: 1045 - DNA, 20 bp, Artificial Sequence
  chemically synthesized
gatcatttggtccttgggga

SEQ ID NO: 1046 - DNA, 20 bp, Artificial Sequence
  chemically synthesized
catttggtccttggggatgg

SEQ ID NO: 1047 - DNA, 20 bp, Artificial Sequence
  chemically synthesized
gtccttggggatggtggaaa

SEQ ID NO: 1048 - DNA, 20 bp, Artificial Sequence
  chemically synthesized
tccttggggatggtggaaat

SEQ ID NO: 1049 - DNA, 20 bp, Artificial Sequence
  chemically synthesized
ccttggggatggtggaaata

SEQ ID NO: 1050 - DNA, 20 bp, Artificial Sequence
  chemically synthesized
gaaatagggacctattcctt

SEQ ID NO: 1051 - DNA, 20 bp, Artificial Sequence
  chemically synthesized
gggacctattcctttggttg

SEQ ID NO: 1052 - DNA, 20 bp, Artificial Sequence
  chemically synthesized
ttcctttggttgcagttaac

SEQ ID NO: 1053 - DNA, 20 bp, Artificial Sequence
  chemically synthesized
tcctttggttgcagttaaca

SEQ ID NO: 1054 - DNA, 20 bp, Artificial Sequence
  chemically synthesized
ttggttgcagttaacaaggc

SEQ ID NO: 1055 - DNA, 20 bp, Artificial Sequence
  chemically synthesized
tggttgcagttaacaaggct

SEQ ID NO: 1056 - DNA, 20 bp, Artificial Sequence
  chemically synthesized
ggttgcagttaacaaggctg

SEQ ID NO: 1057 - DNA, 20 bp, Artificial Sequence
  chemically synthesized
aacaaggctggggatttttc

SEQ ID NO: 1058 - DNA, 20 bp, Artificial Sequence
  chemically synthesized
caaggctggggatttttcca

SEQ ID NO: 1059 - DNA, 20 bp, Artificial Sequence
  chemically synthesized
ttccagagtcccacaccctg

SEQ ID NO: 1060 - DNA, 20 bp, Artificial Sequence
  chemically synthesized
tccagagtcccacaccctgc

SEQ ID NO: 1061 - DNA, 20 bp, Artificial Sequence
  chemically synthesized
ccacaccctgcaggtcatcc

SEQ ID NO: 1062 - DNA, 20 bp, Artificial Sequence
  chemically synthesized
cacaccctgcaggtcatcct

SEQ ID NO: 1063 - DNA, 20 bp, Artificial Sequence
  chemically synthesized
catcctgggctgtgaaatgc

SEQ ID NO: 1064 - DNA, 20 bp, Artificial Sequence
  chemically synthesized
cctgggctgtgaaatgcaag

SEQ ID NO: 1065 - DNA, 20 bp, Artificial Sequence
  chemically synthesized
tgtgaaatgcaagaagacaa

SEQ ID NO: 1066 - DNA, 20 bp, Artificial Sequence
  chemically synthesized
tgcaagaagacaacagtacc

SEQ ID NO: 1067 - DNA, 20 bp, Artificial Sequence
  chemically synthesized
gcaagaagacaacagtaccg

SEQ ID NO: 1068 - DNA, 20 bp, Artificial Sequence
  chemically synthesized
caagaagacaacagtaccga

SEQ ID NO: 1069 - DNA, 20 bp, Artificial Sequence
  chemically synthesized
acaacagtaccgagggctac

SEQ ID NO: 1070 - DNA, 20 bp, Artificial Sequence
  chemically synthesized
acagtaccgagggctactgg

SEQ ID NO: 1071 - DNA, 20 bp, Artificial Sequence
  chemically synthesized
accgagggctactggaagta

SEQ ID NO: 1072 - DNA, 20 bp, Artificial Sequence
  chemically synthesized
ccgagggctactggaagtac

SEQ ID NO: 1073 - DNA, 20 bp, Artificial Sequence
  chemically synthesized
tactggaagtacgggtatga

SEQ ID NO: 1074 - DNA, 20 bp, Artificial Sequence
  chemically synthesized
actggaagtacgggtatgat

SEQ ID NO: 1075 - DNA, 20 bp, Artificial Sequence
  chemically synthesized
ggaagtacgggtatgatggg

SEQ ID NO: 1076 - DNA, 20 bp, Artificial Sequence
  chemically synthesized
gaagtacgggtatgatgggc

SEQ ID NO: 1077 - DNA, 20 bp, Artificial Sequence
  chemically synthesized
tgaattctgccctgacacac

SEQ ID NO: 1078 - DNA, 20 bp, Artificial Sequence
  chemically synthesized
tctgccctgacacactggat

SEQ ID NO: 1079 - DNA, 20 bp, Artificial Sequence
  chemically synthesized
tgccctgacacactggattg

SEQ ID NO: 1080 - DNA, 20 bp, Artificial Sequence
  chemically synthesized
ccctgacacactggattgga

SEQ ID NO: 1081 - DNA, 20 bp, Artificial Sequence
  chemically synthesized
tgacacactggattggagag

SEQ ID NO: 1082 - DNA, 20 bp, Artificial Sequence
  chemically synthesized
cacactggattggagagcag

SEQ ID NO: 1083 - DNA, 20 bp, Artificial Sequence
  chemically synthesized
gattggagagcagcagaacc

SEQ ID NO: 1084 - DNA, 20 bp, Artificial Sequence
  chemically synthesized
attggagagcagcagaaccc

SEQ ID NO: 1085 - DNA, 20 bp, Artificial Sequence
  chemically synthesized
ttggagagcagcagaaccca

SEQ ID NO: 1086 - DNA, 20 bp, Artificial Sequence
  chemically synthesized
gagcagcagaacccagggcc

SEQ ID NO: 1087 - DNA, 20 bp, Artificial Sequence
  chemically synthesized
aacccagggcctggcccacc

SEQ ID NO: 1088 - DNA, 20 bp, Artificial Sequence
  chemically synthesized
cagggcctggcccaccaagc

SEQ ID NO: 1089 - DNA, 20 bp, Artificial Sequence
  chemically synthesized
gggcctggcccaccaagctg

SEQ ID NO: 1090 - DNA, 20 bp, Artificial Sequence
  chemically synthesized
cctggcccaccaagctggag

SEQ ID NO: 1091 - DNA, 20 bp, Artificial Sequence
  chemically synthesized
ctggcccaccaagctggagt

SEQ ID NO: 1092 - DNA, 20 bp, Artificial Sequence
  chemically synthesized
cccaccaagctggagtggga

SEQ ID NO: 1093 - DNA, 20 bp, Artificial Sequence
  chemically synthesized
ccaccaagctggagtgggaa

SEQ ID NO: 1094 - DNA, 20 bp, Artificial Sequence
  chemically synthesized
agctggagtgggaaaggcac

SEQ ID NO: 1095 - DNA, 20 bp, Artificial Sequence
  chemically synthesized
agtgggaaaggcacaagatt

SEQ ID NO: 1096 - DNA, 20 bp, Artificial Sequence
  chemically synthesized
gtgggaaaggcacaagattc

SEQ ID NO: 1097 - DNA, 20 bp, Artificial Sequence
  chemically synthesized
gaaaggcacaagattcgggc

SEQ ID NO: 1098 - DNA, 20 bp, Artificial Sequence
  chemically synthesized
aaaggcacaagattcgggcc

SEQ ID NO: 1099 - DNA, 20 bp, Artificial Sequence
  chemically synthesized
ggcacaagattcgggccagg

SEQ ID NO: 1100 - DNA, 20 bp, Artificial Sequence
  chemically synthesized
aagattcgggccaggcagaa

SEQ ID NO: 1101 - DNA, 20 bp, Artificial Sequence
  chemically synthesized
agattcgggccaggcagaac

SEQ ID NO: 1102 - DNA, 20 bp, Artificial Sequence
  chemically synthesized
gattcgggccaggcagaaca

SEQ ID NO: 1103 - DNA, 20 bp, Artificial Sequence
  chemically synthesized
caggcagaacagggcctacc

SEQ ID NO: 1104 - DNA, 20 bp, Artificial Sequence
  chemically synthesized
ggcagaacagggcctacctg

SEQ ID NO: 1105 - DNA, 20 bp, Artificial Sequence
  chemically synthesized
cagaacagggcctacctgga

SEQ ID NO: 1106 - DNA, 20 bp, Artificial Sequence
  chemically synthesized
agaacagggcctacctggag

SEQ ID NO: 1107 - DNA, 20 bp, Artificial Sequence
  chemically synthesized
gaacagggcctacctggaga

SEQ ID NO: 1108 - DNA, 20 bp, Artificial Sequence
  chemically synthesized
tggagagggactgccctgca

SEQ ID NO: 1109 - DNA, 20 bp, Artificial Sequence
  chemically synthesized
gggactgccctgcacagctg

SEQ ID NO: 1110 - DNA, 20 bp, Artificial Sequence
  chemically synthesized
actgccctgcacagctgcag

SEQ ID NO: 1111 - DNA, 20 bp, Artificial Sequence
  chemically synthesized
tgcacagctgcagcagttgc

SEQ ID NO: 1112 - DNA, 20 bp, Artificial Sequence
  chemically synthesized
cacagctgcagcagttgctg

SEQ ID NO: 1113 - DNA, 20 bp, Artificial Sequence
  chemically synthesized
gctgcagcagttgctggagc

SEQ ID NO: 1114 - DNA, 20 bp, Artificial Sequence
  chemically synthesized
ctgcagcagttgctggagct

SEQ ID NO: 1115 - DNA, 20 bp, Artificial Sequence
  chemically synthesized
tgcagcagttgctggagctg

SEQ ID NO: 1116 - DNA, 20 bp, Artificial Sequence
  chemically synthesized
cagcagttgctggagctggg

SEQ ID NO: 1117 - DNA, 20 bp, Artificial Sequence
  chemically synthesized
gcagttgctggagctgggga

SEQ ID NO: 1118 - DNA, 20 bp, Artificial Sequence
  chemically synthesized
cagttgctggagctggggag

SEQ ID NO: 1119 - DNA, 20 bp, Artificial Sequence
  chemically synthesized
ggagctggggagaggtgttt

SEQ ID NO: 1120 - DNA, 20 bp, Artificial Sequence
  chemically synthesized
gagaggtgttttggaccaac

SEQ ID NO: 1121 - DNA, 20 bp, Artificial Sequence
  chemically synthesized
agaggtgttttggaccaaca

SEQ ID NO: 1122 - DNA, 20 bp, Artificial Sequence
  chemically synthesized
tgttttggaccaacaaggta

SEQ ID NO: 1123 - DNA, 20 bp, Artificial Sequence
  chemically synthesized
tttggaccaacaaggtatgg

SEQ ID NO: 1124 - DNA, 20 bp, Artificial Sequence
  chemically synthesized
acacttctgcccctatactc

SEQ ID NO: 1125 - DNA, 20 bp, Artificial Sequence
  chemically synthesized
cttctgcccctatactctag

SEQ ID NO: 1126 - DNA, 20 bp, Artificial Sequence
  chemically synthesized
ctgcccctatactctagtgg

SEQ ID NO: 1127 - DNA, 20 bp, Artificial Sequence
  chemically synthesized
gcccctatactctagtggca

SEQ ID NO: 1128 - DNA, 20 bp, Artificial Sequence
  chemically synthesized
cctatactctagtggcagag

SEQ ID NO: 1129 - DNA, 20 bp, Artificial Sequence
  chemically synthesized
tatactctagtggcagagtg

SEQ ID NO: 1130 - DNA, 20 bp, Artificial Sequence
  chemically synthesized
atactctagtggcagagtgg

SEQ ID NO: 1131 - DNA, 20 bp, Artificial Sequence
  chemically synthesized
actctagtggcagagtggag

SEQ ID NO: 1132 - DNA, 20 bp, Artificial Sequence
  chemically synthesized
ctctagtggcagagtggagg

SEQ ID NO: 1133 - DNA, 20 bp, Artificial Sequence
  chemically synthesized
tggcagagtggaggaggttg

SEQ ID NO: 1134 - DNA, 20 bp, Artificial Sequence
  chemically synthesized
ggcagagtggaggaggttgc

SEQ ID NO: 1135 - DNA, 20 bp, Artificial Sequence
  chemically synthesized
gcagagtggaggaggttgca

SEQ ID NO: 1136 - DNA, 20 bp, Artificial Sequence
  chemically synthesized
gtggaggaggttgcagggca

SEQ ID NO: 1137 - DNA, 20 bp, Artificial Sequence
  chemically synthesized
gttgcagggcacggaatccc

SEQ ID NO: 1138 - DNA, 20 bp, Artificial Sequence
  chemically synthesized
cagggcacggaatccctggt

SEQ ID NO: 1139 - DNA, 20 bp, Artificial Sequence
  chemically synthesized
gggcacggaatccctggttg

SEQ ID NO: 1140 - DNA, 20 bp, Artificial Sequence
  chemically synthesized
ggaatccctggttggagttt

SEQ ID NO: 1141 - DNA, 20 bp, Artificial Sequence
  chemically synthesized
aatccctggttggagtttca

SEQ ID NO: 1142 - DNA, 20 bp, Artificial Sequence
  chemically synthesized
atccctggttggagtttcag

SEQ ID NO: 1143 - DNA, 20 bp, Artificial Sequence
  chemically synthesized
cctggttggagtttcagagg

SEQ ID NO: 1144 - DNA, 20 bp, Artificial Sequence
  chemically synthesized
ttggagtttcagaggtggct

SEQ ID NO: 1145 - DNA, 20 bp, Artificial Sequence
  chemically synthesized
tggagtttcagaggtggctg

SEQ ID NO: 1146 - DNA, 20 bp, Artificial Sequence
  chemically synthesized
ctgtgtgcctctccaaattc

SEQ ID NO: 1147 - DNA, 20 bp, Artificial Sequence
  chemically synthesized
tgtgtgcctctccaaattct

SEQ ID NO: 1148 - DNA, 20 bp, Artificial Sequence
  chemically synthesized
gtgcctctccaaattctggg

SEQ ID NO: 1149 - DNA, 20 bp, Artificial Sequence
  chemically synthesized
tgcctctccaaattctggga

SEQ ID NO: 1150 - DNA, 20 bp, Artificial Sequence
  chemically synthesized
gcctctccaaattctgggaa

SEQ ID NO: 1151 - DNA, 20 bp, Artificial Sequence
  chemically synthesized
ggaagggactttctcaatcc

SEQ ID NO: 1152 - DNA, 20 bp, Artificial Sequence
  chemically synthesized
aagggactttctcaatccta

SEQ ID NO: 1153 - DNA, 20 bp, Artificial Sequence
  chemically synthesized
agagtctctaccttataatt

SEQ ID NO: 1154 - DNA, 20 bp, Artificial Sequence
  chemically synthesized
accttataattgagatgtat

SEQ ID NO: 1155 - DNA, 20 bp, Artificial Sequence
  chemically synthesized
tataattgagatgtatgaga

SEQ ID NO: 1156 - DNA, 20 bp, Artificial Sequence
  chemically synthesized
gagatgtatgagacagccac

SEQ ID NO: 1157 - DNA, 20 bp, Artificial Sequence
  chemically synthesized
tatgagacagccacaagtca

SEQ ID NO: 1158 - DNA, 20 bp, Artificial Sequence
  chemically synthesized
atgagacagccacaagtcat

SEQ ID NO: 1159 - DNA, 20 bp, Artificial Sequence
  chemically synthesized
atttcttttctccatgcata

SEQ ID NO: 1160 - DNA, 20 bp, Artificial Sequence
  chemically synthesized
ttctccatgcatatggctca

SEQ ID NO: 1161 - DNA, 20 bp, Artificial Sequence
  chemically synthesized
tctccatgcatatggctcaa

SEQ ID NO: 1162 - DNA, 20 bp, Artificial Sequence
  chemically synthesized
ctccatgcatatggctcaaa

SEQ ID NO: 1163 - DNA, 20 bp, Artificial Sequence
  chemically synthesized
catgcatatggctcaaaggg

SEQ ID NO: 1164 - DNA, 20 bp, Artificial Sequence
  chemically synthesized
ggctcaaagggaagtgtcta

SEQ ID NO: 1165 - DNA, 20 bp, Artificial Sequence
  chemically synthesized
atttatacctgttaaaaatt

SEQ ID NO: 1166 - DNA, 20 bp, Artificial Sequence
  chemically synthesized
gttaaaaattcagaaatgtc

SEQ ID NO: 1167 - DNA, 20 bp, Artificial Sequence
  chemically synthesized
ttaaaaattcagaaatgtca

SEQ ID NO: 1168 - DNA, 20 bp, Artificial Sequence
  chemically synthesized
aaattcagaaatgtcaaggc

SEQ ID NO: 1169 - DNA, 20 bp, Artificial Sequence
  chemically synthesized
aattcagaaatgtcaaggcc

SEQ ID NO: 1170 - DNA, 20 bp, Artificial Sequence
  chemically synthesized
agaaatgtcaaggccgggca

SEQ ID NO: 1171 - DNA, 20 bp, Artificial Sequence
  chemically synthesized
aatgtcaaggccgggcacgg

SEQ ID NO: 1172 - DNA, 20 bp, Artificial Sequence
  chemically synthesized
gtggctcacccctgtaatcc

SEQ ID NO: 1173 - DNA, 20 bp, Artificial Sequence
  chemically synthesized
cccctgtaatcccagcactt

SEQ ID NO: 1174 - DNA, 20 bp, Artificial Sequence
  chemically synthesized
ccctgtaatcccagcacttt

SEQ ID NO: 1175 - DNA, 20 bp, Artificial Sequence
  chemically synthesized
ctgtaatcccagcactttgg

SEQ ID NO: 1176 - DNA, 20 bp, Artificial Sequence
  chemically synthesized
tgtaatcccagcactttggg

SEQ ID NO: 1177 - DNA, 20 bp, Artificial Sequence
  chemically synthesized
tcccagcactttgggaggcc

SEQ ID NO: 1178 - DNA, 20 bp, Artificial Sequence
  chemically synthesized
cccagcactttgggaggccg

SEQ ID NO: 1179 - DNA, 20 bp, Artificial Sequence
  chemically synthesized
agcactttgggaggccgagg

SEQ ID NO: 1180 - DNA, 20 bp, Artificial Sequence
  chemically synthesized
gcactttgggaggccgaggc

SEQ ID NO: 1181 - DNA, 20 bp, Artificial Sequence
  chemically synthesized
ctttgggaggccgaggcggg

SEQ ID NO: 1182 - DNA, 20 bp, Artificial Sequence
  chemically synthesized
aggccgaggcgggtggtcac

SEQ ID NO: 1183 - DNA, 20 bp, Artificial Sequence
  chemically synthesized
ggccgaggcgggtggtcaca

SEQ ID NO: 1184 - DNA, 20 bp, Artificial Sequence
  chemically synthesized
gaggcgggtggtcacaaggt

SEQ ID NO: 1185 - DNA, 20 bp, Artificial Sequence
  chemically synthesized
aggcgggtggtcacaaggtc

SEQ ID NO: 1186 - DNA, 20 bp, Artificial Sequence
  chemically synthesized
gcgggtggtcacaaggtcag

SEQ ID NO: 1187 - DNA, 20 bp, Artificial Sequence
  chemically synthesized
ggtcacaaggtcaggagttt

SEQ ID NO: 1188 - DNA, 20 bp, Artificial Sequence
  chemically synthesized
caaggtcaggagtttgagac

SEQ ID NO: 1189 - DNA, 20 bp, Artificial Sequence
  chemically synthesized
tgagaccagcctgaccaaca

SEQ ID NO: 1190 - DNA, 20 bp, Artificial Sequence
  chemically synthesized
ctctaaaaaaatacaaaaat

SEQ ID NO: 1191 - DNA, 20 bp, Artificial Sequence
  chemically synthesized
aaaaaaatacaaaaattagc

SEQ ID NO: 1192 - DNA, 20 bp, Artificial Sequence
  chemically synthesized
atacaaaaattagctggtca

SEQ ID NO: 1193 - DNA, 20 bp, Artificial Sequence
  chemically synthesized
gtcacagtcatgcgcacctg

SEQ ID NO: 1194 - DNA, 20 bp, Artificial Sequence
  chemically synthesized
gtcatgcgcacctgtagtcc

SEQ ID NO: 1195 - DNA, 20 bp, Artificial Sequence
  chemically synthesized
cacctgtagtcccagctaat

SEQ ID NO: 1196 - DNA, 20 bp, Artificial Sequence
  chemically synthesized
ctgtagtcccagctaattgg

SEQ ID NO: 1197 - DNA, 20 bp, Artificial Sequence
  chemically synthesized
tgtagtcccagctaattgga

SEQ ID NO: 1198 - DNA, 20 bp, Artificial Sequence
  chemically synthesized
tcccagctaattggaaggct

SEQ ID NO: 1199 - DNA, 20 bp, Artificial Sequence
  chemically synthesized
cccagctaattggaaggctg

SEQ ID NO: 1200 - DNA, 20 bp, Artificial Sequence
  chemically synthesized
agctaattggaaggctgagg

SEQ ID NO: 1201 - DNA, 20 bp, Artificial Sequence
  chemically synthesized
gctaattggaaggctgaggc

SEQ ID NO: 1202 - DNA, 20 bp, Artificial Sequence
  chemically synthesized
taattggaaggctgaggcag

SEQ ID NO: 1203 - DNA, 20 bp, Artificial Sequence
  chemically synthesized
gcaggagcatcgcttgaacc

SEQ ID NO: 1204 - DNA, 20 bp, Artificial Sequence
  chemically synthesized
caggagcatcgcttgaacct

SEQ ID NO: 1205 - DNA, 20 bp, Artificial Sequence
  chemically synthesized
gagcatcgcttgaacctggg

SEQ ID NO: 1206 - DNA, 20 bp, Artificial Sequence
  chemically synthesized
catcgcttgaacctgggaag

SEQ ID NO: 1207 - DNA, 20 bp, Artificial Sequence
  chemically synthesized
cgcttgaacctgggaagcgg

SEQ ID NO: 1208 - DNA, 20 bp, Artificial Sequence
  chemically synthesized
tgggaagcggaagttgcact

SEQ ID NO: 1209 - DNA, 20 bp, Artificial Sequence
  chemically synthesized
agcggaagttgcactgagcc

SEQ ID NO: 1210 - DNA, 20 bp, Artificial Sequence
  chemically synthesized
aagatcgcgccactgcactc

SEQ ID NO: 1211 - DNA, 20 bp, Artificial Sequence
  chemically synthesized
cgcgccactgcactccagcc

SEQ ID NO: 1212 - DNA, 20 bp, Artificial Sequence
  chemically synthesized
gcgccactgcactccagcct

SEQ ID NO: 1213 - DNA, 20 bp, Artificial Sequence
  chemically synthesized
ccactgcactccagcctagg

SEQ ID NO: 1214 - DNA, 20 bp, Artificial Sequence
  chemically synthesized
ctgcactccagcctaggcag

SEQ ID NO: 1215 - DNA, 20 bp, Artificial Sequence
  chemically synthesized
gcactccagcctaggcagca

SEQ ID NO: 1216 - DNA, 20 bp, Artificial Sequence
  chemically synthesized
tccagcctaggcagcagagt

SEQ ID NO: 1217 - DNA, 20 bp, Artificial Sequence
  chemically synthesized
aaaaaaaaaaaaaaaaaaaa

SEQ ID NO: 1218 - DNA, 20 bp, Artificial Sequence
  chemically synthesized
aaaaaaaaaaaaaaaaaaaa

SEQ ID NO: 1219 - DNA, 20 bp, Artificial Sequence
  chemically synthesized
aaaaaaaaaaaaagagaatt

SEQ ID NO: 1220 - DNA, 20 bp, Artificial Sequence
  chemically synthesized
aaaaaaaaaaagagaattca

SEQ ID NO: 1221 - DNA, 20 bp, Artificial Sequence
  chemically synthesized
aaaagagaattcagagatct

SEQ ID NO: 1222 - DNA, 20 bp, Artificial Sequence
  chemically synthesized
ctcagctatcatatgaatac

SEQ ID NO: 1223 - DNA, 20 bp, Artificial Sequence
  chemically synthesized
tcagctatcatatgaatacc

SEQ ID NO: 1224 - DNA, 20 bp, Artificial Sequence
  chemically synthesized
gaataccaggacaaaatatc

SEQ ID NO: 1225 - DNA, 20 bp, Artificial Sequence
  chemically synthesized
accaggacaaaatatcaagt

SEQ ID NO: 1226 - DNA, 20 bp, Artificial Sequence
  chemically synthesized
ccaggacaaaatatcaagtg

SEQ ID NO: 1227 - DNA, 20 bp, Artificial Sequence
  chemically synthesized
tatcaagtgaggccacttat

SEQ ID NO: 1228 - DNA, 20 bp, Artificial Sequence
  chemically synthesized
tcaagtgaggccacttatca

SEQ ID NO: 1229 - DNA, 20 bp, Artificial Sequence
  chemically synthesized
agtgaggccacttatcagag

SEQ ID NO: 1230 - DNA, 20 bp, Artificial Sequence
  chemically synthesized
gaggccacttatcagagtag

SEQ ID NO: 1231 - DNA, 20 bp, Artificial Sequence
  chemically synthesized
atcagagtagaagaatcctt

SEQ ID NO: 1232 - DNA, 20 bp, Artificial Sequence
  chemically synthesized
tcagagtagaagaatccttt

SEQ ID NO: 1233 - DNA, 20 bp, Artificial Sequence
  chemically synthesized
agaagaatcctttaggttaa

SEQ ID NO: 1234 - DNA, 20 bp, Artificial Sequence
  chemically synthesized
taggttaaaagtttctttca

SEQ ID NO: 1235 - DNA, 20 bp, Artificial Sequence
  chemically synthesized
aaagtttctttcatagaaca

SEQ ID NO: 1236 - DNA, 20 bp, Artificial Sequence
  chemically synthesized
gaacatagcaataatcactg

SEQ ID NO: 1237 - DNA, 20 bp, Artificial Sequence
  chemically synthesized
actgaagctacctatcttac

SEQ ID NO: 1238 - DNA, 20 bp, Artificial Sequence
  chemically synthesized
cttcttataacaatgcctcc

SEQ ID NO: 1239 - DNA, 20 bp, Artificial Sequence
  chemically synthesized
ttcttataacaatgcctcct

SEQ ID NO: 1240 - DNA, 20 bp, Artificial Sequence
  chemically synthesized
caatgcctcctaggttgacc

SEQ ID NO: 1241 - DNA, 20 bp, Artificial Sequence
  chemically synthesized
aatgcctcctaggttgaccc

SEQ ID NO: 1242 - DNA, 20 bp, Artificial Sequence
  chemically synthesized
aatcattttcaatgcacata

SEQ ID NO: 1243 - DNA, 20 bp, Artificial Sequence
  chemically synthesized
atcattttcaatgcacataa

SEQ ID NO: 1244 - DNA, 20 bp, Artificial Sequence
  chemically synthesized
tcattttcaatgcacataaa

SEQ ID NO: 1245 - DNA, 20 bp, Artificial Sequence
  chemically synthesized
taaagggcaattttatctat

SEQ ID NO: 1246 - DNA, 20 bp, Artificial Sequence
  chemically synthesized
caattttatctatcagaaca

SEQ ID NO: 1247 - DNA, 20 bp, Artificial Sequence
  chemically synthesized
atctatcagaacaaagaaca

SEQ ID NO: 1248 - DNA, 20 bp, Artificial Sequence
  chemically synthesized
tctatcagaacaaagaacat

SEQ ID NO: 1249 - DNA, 20 bp, Artificial Sequence
  chemically synthesized
agaacaaagaacatgggtaa

SEQ ID NO: 1250 - DNA, 20 bp, Artificial Sequence
  chemically synthesized
agatatgtatatttacatgt

SEQ ID NO: 1251 - DNA, 20 bp, Artificial Sequence
  chemically synthesized
gatatgtatatttacatgtg

SEQ ID NO: 1252 - DNA, 20 bp, Artificial Sequence
  chemically synthesized
tatgtatatttacatgtgag

SEQ ID NO: 1253 - DNA, 20 bp, Artificial Sequence
  chemically synthesized
tatttacatgtgaggagaac

SEQ ID NO: 1254 - DNA, 20 bp, Artificial Sequence
  chemically synthesized
agctgatctgactgctctcc

SEQ ID NO: 1255 - DNA, 20 bp, Artificial Sequence
  chemically synthesized
ctctccaagtgacactgtgt

SEQ ID NO: 1256 - DNA, 20 bp, Artificial Sequence
  chemically synthesized
ctccaagtgacactgtgtta

SEQ ID NO: 1257 - DNA, 20 bp, Artificial Sequence
  chemically synthesized
actgtgttagagtccaatct

SEQ ID NO: 1258 - DNA, 20 bp, Artificial Sequence
  chemically synthesized
ctgtgttagagtccaatctt

SEQ ID NO: 1259 - DNA, 20 bp, Artificial Sequence
  chemically synthesized
tccaatcttaggacacaaaa

SEQ ID NO: 1260 - DNA, 20 bp, Artificial Sequence
  chemically synthesized
acaaaatggtgtctctcctg

SEQ ID NO: 1261 - DNA, 20 bp, Artificial Sequence
  chemically synthesized
gtagcttgtttttttctgaa

SEQ ID NO: 1262 - DNA, 20 bp, Artificial Sequence
  chemically synthesized
tagcttgtttttttctgaaa

SEQ ID NO: 1263 - DNA, 20 bp, Artificial Sequence
  chemically synthesized
agcttgtttttttctgaaaa

SEQ ID NO: 1264 - DNA, 20 bp, Artificial Sequence
  chemically synthesized
tatttccttcctccaaccta

SEQ ID NO: 1265 - DNA, 20 bp, Artificial Sequence
  chemically synthesized
ttccttcctccaacctatag

SEQ ID NO: 1266 - DNA, 20 bp, Artificial Sequence
  chemically synthesized
tccttcctccaacctataga

SEQ ID NO: 1267 - DNA, 20 bp, Artificial Sequence
  chemically synthesized
ttcctccaacctatagaagg

SEQ ID NO: 1268 - DNA, 20 bp, Artificial Sequence
  chemically synthesized
caacctatagaaggaagtga

SEQ ID NO: 1269 - DNA, 20 bp, Artificial Sequence
  chemically synthesized
atagaaggaagtgaaagttc

SEQ ID NO: 1270 - DNA, 20 bp, Artificial Sequence
  chemically synthesized
agtgaaagttccagtcttcc

SEQ ID NO: 1271 - DNA, 20 bp, Artificial Sequence
  chemically synthesized
aaagttccagtcttcctggc

SEQ ID NO: 1272 - DNA, 20 bp, Artificial Sequence
  chemically synthesized
aagttccagtcttcctggca

SEQ ID NO: 1273 - DNA, 20 bp, Artificial Sequence
  chemically synthesized
agttccagtcttcctggcaa

SEQ ID NO: 1274 - DNA, 20 bp, Artificial Sequence
  chemically synthesized
gtcttcctggcaagggtaaa

SEQ ID NO: 1275 - DNA, 20 bp, Artificial Sequence
  chemically synthesized
catccttcctctttcctgtc

SEQ ID NO: 1276 - DNA, 20 bp, Artificial Sequence
  chemically synthesized
ttcctgtcaagtgcctcctt

SEQ ID NO: 1277 - DNA, 20 bp, Artificial Sequence
  chemically synthesized
gtcaagtgcctcctttggtg

SEQ ID NO: 1278 - DNA, 20 bp, Artificial Sequence
  chemically synthesized
tcaagtgcctcctttggtga

SEQ ID NO: 1279 - DNA, 20 bp, Artificial Sequence
  chemically synthesized
gacacatcatgtgacctctt

SEQ ID NO: 1280 - DNA, 20 bp, Artificial Sequence
  chemically synthesized
cctcttcagtgaccactcta

SEQ ID NO: 1281 - DNA, 20 bp, Artificial Sequence
  chemically synthesized
cagtgaccactctacggtgt

SEQ ID NO: 1282 - DNA, 20 bp, Artificial Sequence
  chemically synthesized
agtgaccactctacggtgtc

SEQ ID NO: 1283 - DNA, 20 bp, Artificial Sequence
  chemically synthesized
gggccttgaactactacccc

SEQ ID NO: 1284 - DNA, 20 bp, Artificial Sequence
  chemically synthesized
acccccagaacatcaccatg

SEQ ID NO: 1285 - DNA, 20 bp, Artificial Sequence
  chemically synthesized
cccagaacatcaccatgaag

SEQ ID NO: 1286 - DNA, 20 bp, Artificial Sequence
  chemically synthesized
acatcaccatgaagtggctg

SEQ ID NO: 1287 - DNA, 20 bp, Artificial Sequence
  chemically synthesized
catcaccatgaagtggctga

SEQ ID NO: 1288 - DNA, 20 bp, Artificial Sequence
  chemically synthesized
ccatgaagtggctgaaggat

SEQ ID NO: 1289 - DNA, 20 bp, Artificial Sequence
  chemically synthesized
tgaagtggctgaaggataag

SEQ ID NO: 1290 - DNA, 20 bp, Artificial Sequence
  chemically synthesized
gctgaaggataagcagccaa

SEQ ID NO: 1291 - DNA, 20 bp, Artificial Sequence
  chemically synthesized
ataagcagccaatggatgcc

SEQ ID NO: 1292 - DNA, 20 bp, Artificial Sequence
  chemically synthesized
taagcagccaatggatgcca

SEQ ID NO: 1293 - DNA, 20 bp, Artificial Sequence
  chemically synthesized
agcagccaatggatgccaag

SEQ ID NO: 1294 - DNA, 20 bp, Artificial Sequence
  chemically synthesized
tgccaaggagttcgaaccta

SEQ ID NO: 1295 - DNA, 20 bp, Artificial Sequence
  chemically synthesized
cctaaagacgtattgcccaa

SEQ ID NO: 1296 - DNA, 20 bp, Artificial Sequence
  chemically synthesized
ctaaagacgtattgcccaat

SEQ ID NO: 1297 - DNA, 20 bp, Artificial Sequence
  chemically synthesized
taaagacgtattgcccaatg

SEQ ID NO: 1298 - DNA, 20 bp, Artificial Sequence
  chemically synthesized
gacgtattgcccaatgggga

SEQ ID NO: 1299 - DNA, 20 bp, Artificial Sequence
  chemically synthesized
acgtattgcccaatggggat

SEQ ID NO: 1300 - DNA, 20 bp, Artificial Sequence
  chemically synthesized
ccaatggggatgggacctac

SEQ ID NO: 1301 - DNA, 20 bp, Artificial Sequence
  chemically synthesized
caatggggatgggacctacc

SEQ ID NO: 1302 - DNA, 20 bp, Artificial Sequence
  chemically synthesized
aatggggatgggacctacca

SEQ ID NO: 1303 - DNA, 20 bp, Artificial Sequence
  chemically synthesized
gggatgggacctaccagggc

SEQ ID NO: 1304 - DNA, 20 bp, Artificial Sequence
  chemically synthesized
ctaccagggctggataacct

SEQ ID NO: 1305 - DNA, 20 bp, Artificial Sequence
  chemically synthesized
ataaccttggctgtaccccc

SEQ ID NO: 1306 - DNA, 20 bp, Artificial Sequence
  chemically synthesized
taaccttggctgtaccccct

SEQ ID NO: 1307 - DNA, 20 bp, Artificial Sequence
  chemically synthesized
aaccttggctgtaccccctg

SEQ ID NO: 1308 - DNA, 20 bp, Artificial Sequence
  chemically synthesized
cttggctgtaccccctgggg

SEQ ID NO: 1309 - DNA, 20 bp, Artificial Sequence
  chemically synthesized
tggctgtaccccctggggaa

SEQ ID NO: 1310 - DNA, 20 bp, Artificial Sequence
  chemically synthesized
ctgtaccccctggggaagag

SEQ ID NO: 1311 - DNA, 20 bp, Artificial Sequence
  chemically synthesized
gtaccccctggggaagagca

SEQ ID NO: 1312 - DNA, 20 bp, Artificial Sequence
  chemically synthesized
aagagcagagatatacgtgc

SEQ ID NO: 1313 - DNA, 20 bp, Artificial Sequence
  chemically synthesized
agagcagagatatacgtgcc

SEQ ID NO: 1314 - DNA, 20 bp, Artificial Sequence
  chemically synthesized
gcagagatatacgtgccagg

SEQ ID NO: 1315 - DNA, 20 bp, Artificial Sequence
  chemically synthesized
agagatatacgtgccaggtg

SEQ ID NO: 1316 - DNA, 20 bp, Artificial Sequence
  chemically synthesized
tacgtgccaggtggagcacc

SEQ ID NO: 1317 - DNA, 20 bp, Artificial Sequence
  chemically synthesized
acgtgccaggtggagcaccc

SEQ ID NO: 1318 - DNA, 20 bp, Artificial Sequence
  chemically synthesized
ccaggtggagcacccaggcc

SEQ ID NO: 1319 - DNA, 20 bp, Artificial Sequence
  chemically synthesized
tggagcacccaggcctggat

SEQ ID NO: 1320 - DNA, 20 bp, Artificial Sequence
  chemically synthesized
atcagcccctcattgtgatc

SEQ ID NO: 1321 - DNA, 20 bp, Artificial Sequence
  chemically synthesized
tcagcccctcattgtgatct

SEQ ID NO: 1322 - DNA, 20 bp, Artificial Sequence
  chemically synthesized
cagcccctcattgtgatctg

SEQ ID NO: 1323 - DNA, 20 bp, Artificial Sequence
  chemically synthesized
atctggggtatgtgactgat

SEQ ID NO: 1324 - DNA, 20 bp, Artificial Sequence
  chemically synthesized
ctggggtatgtgactgatga

SEQ ID NO: 1325 - DNA, 20 bp, Artificial Sequence
  chemically synthesized
ggtatgtgactgatgagagc

SEQ ID NO: 1326 - DNA, 20 bp, Artificial Sequence
  chemically synthesized
gtatgtgactgatgagagcc

SEQ ID NO: 1327 - DNA, 20 bp, Artificial Sequence
  chemically synthesized
atgtgactgatgagagccag

SEQ ID NO: 1328 - DNA, 20 bp, Artificial Sequence
  chemically synthesized
actgatgagagccaggagct

SEQ ID NO: 1329 - DNA, 20 bp, Artificial Sequence
  chemically synthesized
caggagctgagaaaatctat

SEQ ID NO: 1330 - DNA, 20 bp, Artificial Sequence
  chemically synthesized
aggagctgagaaaatctatt

SEQ ID NO: 1331 - DNA, 20 bp, Artificial Sequence
  chemically synthesized
ggagctgagaaaatctattg

SEQ ID NO: 1332 - DNA, 20 bp, Artificial Sequence
  chemically synthesized
gagctgagaaaatctattgg

SEQ ID NO: 1333 - DNA, 20 bp, Artificial Sequence
  chemically synthesized
gagaaaatctattgggggtt

SEQ ID NO: 1334 - DNA, 20 bp, Artificial Sequence
  chemically synthesized
gaaaatctattgggggttga

SEQ ID NO: 1335 - DNA, 20 bp, Artificial Sequence
  chemically synthesized
aaaatctattgggggttgag

SEQ ID NO: 1336 - DNA, 20 bp, Artificial Sequence
  chemically synthesized
aatctattgggggttgagag

SEQ ID NO: 1337 - DNA, 20 bp, Artificial Sequence
  chemically synthesized
gggggttgagaggagtgcct

SEQ ID NO: 1338 - DNA, 20 bp, Artificial Sequence
  chemically synthesized
ggggttgagaggagtgcctg

SEQ ID NO: 1339 - DNA, 20 bp, Artificial Sequence
  chemically synthesized
ggttgagaggagtgcctgag

SEQ ID NO: 1340 - DNA, 20 bp, Artificial Sequence
  chemically synthesized
gttgagaggagtgcctgagg

SEQ ID NO: 1341 - DNA, 20 bp, Artificial Sequence
  chemically synthesized
agtgcctgaggaggtaatta

SEQ ID NO: 1342 - DNA, 20 bp, Artificial Sequence
  chemically synthesized
gcctgaggaggtaattatgg

SEQ ID NO: 1343 - DNA, 20 bp, Artificial Sequence
  chemically synthesized
gaggaggtaattatggcagt

SEQ ID NO: 1344 - DNA, 20 bp, Artificial Sequence
  chemically synthesized
ggtaattatggcagtgagat

SEQ ID NO: 1345 - DNA, 20 bp, Artificial Sequence
  chemically synthesized
gtaattatggcagtgagatg

SEQ ID NO: 1346 - DNA, 20 bp, Artificial Sequence
  chemically synthesized
gatgaggatctgctctttgt

SEQ ID NO: 1347 - DNA, 20 bp, Artificial Sequence
  chemically synthesized
atgaggatctgctctttgtt

SEQ ID NO: 1348 - DNA, 20 bp, Artificial Sequence
  chemically synthesized
tgaggatctgctctttgtta

SEQ ID NO: 1349 - DNA, 20 bp, Artificial Sequence
  chemically synthesized
gaggatctgctctttgttag

SEQ ID NO: 1350 - DNA, 20 bp, Artificial Sequence
  chemically synthesized
aggatctgctctttgttagg

SEQ ID NO: 1351 - DNA, 20 bp, Artificial Sequence
  chemically synthesized
atctgctctttgttaggggg

SEQ ID NO: 1352 - DNA, 20 bp, Artificial Sequence
  chemically synthesized
tctgctctttgttagggggt

SEQ ID NO: 1353 - DNA, 20 bp, Artificial Sequence
  chemically synthesized
tctttgttagggggtgggct

SEQ ID NO: 1354 - DNA, 20 bp, Artificial Sequence
  chemically synthesized
ctttgttagggggtgggctg

SEQ ID NO: 1355 - DNA, 20 bp, Artificial Sequence
  chemically synthesized
tttgttagggggtgggctga

SEQ ID NO: 1356 - DNA, 20 bp, Artificial Sequence
  chemically synthesized
gttagggggtgggctgaggg

SEQ ID NO: 1357 - DNA, 20 bp, Artificial Sequence
  chemically synthesized
tgggctgagggtggcaatca

SEQ ID NO: 1358 - DNA, 20 bp, Artificial Sequence
  chemically synthesized
gggctgagggtggcaatcaa

SEQ ID NO: 1359 - DNA, 20 bp, Artificial Sequence
  chemically synthesized
ttaacttgctttttctgttt

SEQ ID NO: 1360 - DNA, 20 bp, Artificial Sequence
  chemically synthesized
aacttgctttttctgtttta

SEQ ID NO: 1361 - DNA, 20 bp, Artificial Sequence
  chemically synthesized
gttttagagccctcaccgtc

SEQ ID NO: 1362 - DNA, 20 bp, Artificial Sequence
  chemically synthesized
gccctcaccgtctggcaccc

SEQ ID NO: 1363 - DNA, 20 bp, Artificial Sequence
  chemically synthesized
ccgtctggcaccctagtcat

SEQ ID NO: 1364 - DNA, 20 bp, Artificial Sequence
  chemically synthesized
gtctggcaccctagtcattg

SEQ ID NO: 1365 - DNA, 20 bp, Artificial Sequence
  chemically synthesized
accctagtcattggagtcat

SEQ ID NO: 1366 - DNA, 20 bp, Artificial Sequence
  chemically synthesized
ctagtcattggagtcatcag

SEQ ID NO: 1367 - DNA, 20 bp, Artificial Sequence
  chemically synthesized
tttgtcgtcatcttgttcat

SEQ ID NO: 1368 - DNA, 20 bp, Artificial Sequence
  chemically synthesized
ggaattttgttcataatatt

SEQ ID NO: 1369 - DNA, 20 bp, Artificial Sequence
  chemically synthesized
gaattttgttcataatatta

SEQ ID NO: 1370 - DNA, 20 bp, Artificial Sequence
  chemically synthesized
ttttgttcataatattaagg

SEQ ID NO: 1371 - DNA, 20 bp, Artificial Sequence
  chemically synthesized
ttgttcataatattaaggaa

SEQ ID NO: 1372 - DNA, 20 bp, Artificial Sequence
  chemically synthesized
tgttcataatattaaggaag

SEQ ID NO: 1373 - DNA, 20 bp, Artificial Sequence
  chemically synthesized
tcataatattaaggaagagg

SEQ ID NO: 1374 - DNA, 20 bp, Artificial Sequence
  chemically synthesized
cataatattaaggaagaggc

SEQ ID NO: 1375 - DNA, 20 bp, Artificial Sequence
  chemically synthesized
ataatattaaggaagaggca

SEQ ID NO: 1376 - DNA, 20 bp, Artificial Sequence
  chemically synthesized
ttaaggaagaggcagggttc

SEQ ID NO: 1377 - DNA, 20 bp, Artificial Sequence
  chemically synthesized
ggaagaggcagggttcaagt

SEQ ID NO: 1378 - DNA, 20 bp, Artificial Sequence
  chemically synthesized
agaggcagggttcaagtgag

SEQ ID NO: 1379 - DNA, 20 bp, Artificial Sequence
  chemically synthesized
gaggcagggttcaagtgagt

SEQ ID NO: 1380 - DNA, 20 bp, Artificial Sequence
  chemically synthesized
gggttcaagtgagtaggaac

SEQ ID NO: 1381 - DNA, 20 bp, Artificial Sequence
  chemically synthesized
ggttcaagtgagtaggaaca

SEQ ID NO: 1382 - DNA, 20 bp, Artificial Sequence
  chemically synthesized
gttcaagtgagtaggaacaa

SEQ ID NO: 1383 - DNA, 20 bp, Artificial Sequence
  chemically synthesized
ttcaagtgagtaggaacaag

SEQ ID NO: 1384 - DNA, 20 bp, Artificial Sequence
  chemically synthesized
tcaagtgagtaggaacaagg

SEQ ID NO: 1385 - DNA, 20 bp, Artificial Sequence
  chemically synthesized
agtgagtaggaacaaggggg

SEQ ID NO: 1386 - DNA, 20 bp, Artificial Sequence
  chemically synthesized
ggaacaagggggaagtctct

SEQ ID NO: 1387 - DNA, 20 bp, Artificial Sequence
  chemically synthesized
gtctcttagtacctctgccc

SEQ ID NO: 1388 - DNA, 20 bp, Artificial Sequence
  chemically synthesized
tctcttagtacctctgcccc

SEQ ID NO: 1389 - DNA, 20 bp, Artificial Sequence
  chemically synthesized
ctcttagtacctctgcccca

SEQ ID NO: 1390 - DNA, 20 bp, Artificial Sequence
  chemically synthesized
agtacctctgccccagggca

SEQ ID NO: 1391 - DNA, 20 bp, Artificial Sequence
  chemically synthesized
acctctgccccagggcacag

SEQ ID NO: 1392 - DNA, 20 bp, Artificial Sequence
  chemically synthesized
cctctgccccagggcacagt

SEQ ID NO: 1393 - DNA, 20 bp, Artificial Sequence
  chemically synthesized
ctgccccagggcacagtggg

SEQ ID NO: 1394 - DNA, 20 bp, Artificial Sequence
  chemically synthesized
gccccagggcacagtgggaa

SEQ ID NO: 1395 - DNA, 20 bp, Artificial Sequence
  chemically synthesized
ccccagggcacagtgggaag

SEQ ID NO: 1396 - DNA, 20 bp, Artificial Sequence
  chemically synthesized
cccagggcacagtgggaaga

SEQ ID NO: 1397 - DNA, 20 bp, Artificial Sequence
  chemically synthesized
ccagggcacagtgggaagag

SEQ ID NO: 1398 - DNA, 20 bp, Artificial Sequence
  chemically synthesized
gggcacagtgggaagagggg

SEQ ID NO: 1399 - DNA, 20 bp, Artificial Sequence
  chemically synthesized
gcacagtgggaagaggggca

SEQ ID NO: 1400 - DNA, 20 bp, Artificial Sequence
  chemically synthesized
cacagtgggaagaggggcag

SEQ ID NO: 1401 - DNA, 20 bp, Artificial Sequence
  chemically synthesized
acagtgggaagaggggcaga

SEQ ID NO: 1402 - DNA, 20 bp, Artificial Sequence
  chemically synthesized
cagtgggaagaggggcagag

SEQ ID NO: 1403 - DNA, 20 bp, Artificial Sequence
  chemically synthesized
gaagaggggcagaggggatc

SEQ ID NO: 1404 - DNA, 20 bp, Artificial Sequence
  chemically synthesized
cagaggggatctggcatcca

SEQ ID NO: 1405 - DNA, 20 bp, Artificial Sequence
  chemically synthesized
agaggggatctggcatccat

SEQ ID NO: 1406 - DNA, 20 bp, Artificial Sequence
  chemically synthesized
ggggatctggcatccatggg

SEQ ID NO: 1407 - DNA, 20 bp, Artificial Sequence
  chemically synthesized
tttttctcatttatattctt

SEQ ID NO: 1408 - DNA, 20 bp, Artificial Sequence
  chemically synthesized
ttttctcatttatattcttt

SEQ ID NO: 1409 - DNA, 20 bp, Artificial Sequence
  chemically synthesized
tttctcatttatattctttg

SEQ ID NO: 1410 - DNA, 20 bp, Artificial Sequence
  chemically synthesized
tttatattctttggggacac

SEQ ID NO: 1411 - DNA, 20 bp, Artificial Sequence
  chemically synthesized
atattctttggggacaccag

SEQ ID NO: 1412 - DNA, 20 bp, Artificial Sequence
  chemically synthesized
tggggacaccagcagctccc

SEQ ID NO: 1413 - DNA, 20 bp, Artificial Sequence
  chemically synthesized
ggggacaccagcagctccct

SEQ ID NO: 1414 - DNA, 20 bp, Artificial Sequence
  chemically synthesized
ggacaccagcagctccctgg

SEQ ID NO: 1415 - DNA, 20 bp, Artificial Sequence
  chemically synthesized
accagcagctccctgggaga

SEQ ID NO: 1416 - DNA, 20 bp, Artificial Sequence
  chemically synthesized
ccctgggagacagaaaataa

SEQ ID NO: 1417 - DNA, 20 bp, Artificial Sequence
  chemically synthesized
cagaaaataatggttctccc

SEQ ID NO: 1418 - DNA, 20 bp, Artificial Sequence
  chemically synthesized
aatggttctccccagaatga

SEQ ID NO: 1419 - DNA, 20 bp, Artificial Sequence
  chemically synthesized
tctaattcaacaaacatctt

SEQ ID NO: 1420 - DNA, 20 bp, Artificial Sequence
  chemically synthesized
taattcaacaaacatcttca

SEQ ID NO: 1421 - DNA, 20 bp, Artificial Sequence
  chemically synthesized
cagagcacctactattttgc

SEQ ID NO: 1422 - DNA, 20 bp, Artificial Sequence
  chemically synthesized
gagcacctactattttgcaa

SEQ ID NO: 1423 - DNA, 20 bp, Artificial Sequence
  chemically synthesized
ctattttgcaagagctgttt

SEQ ID NO: 1424 - DNA, 20 bp, Artificial Sequence
  chemically synthesized
tattttgcaagagctgttta

SEQ ID NO: 1425 - DNA, 20 bp, Artificial Sequence
  chemically synthesized
tttgcaagagctgtttaagg

SEQ ID NO: 1426 - DNA, 20 bp, Artificial Sequence
  chemically synthesized
aagagctgtttaaggtagta

SEQ ID NO: 1427 - DNA, 20 bp, Artificial Sequence
  chemically synthesized
agagctgtttaaggtagtac

SEQ ID NO: 1428 - DNA, 20 bp, Artificial Sequence
  chemically synthesized
gagctgtttaaggtagtaca

SEQ ID NO: 1429 - DNA, 20 bp, Artificial Sequence
  chemically synthesized
agctgtttaaggtagtacag

SEQ ID NO: 1430 - DNA, 20 bp, Artificial Sequence
  chemically synthesized
taaggtagtacaggggcttt

SEQ ID NO: 1431 - DNA, 20 bp, Artificial Sequence
  chemically synthesized
aaggtagtacaggggctttg

SEQ ID NO: 1432 - DNA, 20 bp, Artificial Sequence
  chemically synthesized
agtacaggggctttgaggtt

SEQ ID NO: 1433 - DNA, 20 bp, Artificial Sequence
  chemically synthesized
acaggggctttgaggttgag

SEQ ID NO: 1434 - DNA, 20 bp, Artificial Sequence
  chemically synthesized
ttgaggttgagaagtcactg

SEQ ID NO: 1435 - DNA, 20 bp, Artificial Sequence
  chemically synthesized
gaagtcactgtggctattct

SEQ ID NO: 1436 - DNA, 20 bp, Artificial Sequence
  chemically synthesized
ctattctcagaacccaaatc

SEQ ID NO: 1437 - DNA, 20 bp, Artificial Sequence
  chemically synthesized
ttctcagaacccaaatctgg

SEQ ID NO: 1438 - DNA, 20 bp, Artificial Sequence
  chemically synthesized
tctcagaacccaaatctggt

SEQ ID NO: 1439 - DNA, 20 bp, Artificial Sequence
  chemically synthesized
ctcagaacccaaatctggta

SEQ ID NO: 1440 - DNA, 20 bp, Artificial Sequence
  chemically synthesized
ctggtagggaatgaaattga

SEQ ID NO: 1441 - DNA, 20 bp, Artificial Sequence
  chemically synthesized
tagggaatgaaattgatagc

SEQ ID NO: 1442 - DNA, 20 bp, Artificial Sequence
  chemically synthesized
aaattgatagcaagtaaatg

SEQ ID NO: 1443 - DNA, 20 bp, Artificial Sequence
  chemically synthesized
atagcaagtaaatgtagtta

SEQ ID NO: 1444 - DNA, 20 bp, Artificial Sequence
  chemically synthesized
gcaagtaaatgtagttaaag

SEQ ID NO: 1445 - DNA, 20 bp, Artificial Sequence
  chemically synthesized
gtagttaaagaagaccccat

SEQ ID NO: 1446 - DNA, 20 bp, Artificial Sequence
  chemically synthesized
tagttaaagaagaccccatg

SEQ ID NO: 1447 - DNA, 20 bp, Artificial Sequence
  chemically synthesized
gaagaccccatgaggtccta

SEQ ID NO: 1448 - DNA, 20 bp, Artificial Sequence
  chemically synthesized
gaccccatgaggtcctaaag

SEQ ID NO: 1449 - DNA, 20 bp, Artificial Sequence
  chemically synthesized
accccatgaggtcctaaagc

SEQ ID NO: 1450 - DNA, 20 bp, Artificial Sequence
  chemically synthesized
ccatgaggtcctaaagcagg

SEQ ID NO: 1451 - DNA, 20 bp, Artificial Sequence
  chemically synthesized
catgaggtcctaaagcaggc

SEQ ID NO: 1452 - DNA, 20 bp, Artificial Sequence
  chemically synthesized
gaggtcctaaagcaggcagg

SEQ ID NO: 1453 - DNA, 20 bp, Artificial Sequence
  chemically synthesized
gcaggcaggaagcaaatgct

SEQ ID NO: 1454 - DNA, 20 bp, Artificial Sequence
  chemically synthesized
caggcaggaagcaaatgctt

SEQ ID NO: 1455 - DNA, 20 bp, Artificial Sequence
  chemically synthesized
aggcaggaagcaaatgctta

SEQ ID NO: 1456 - DNA, 20 bp, Artificial Sequence
  chemically synthesized
agcaaatgcttagggtgtca

SEQ ID NO: 1457 - DNA, 20 bp, Artificial Sequence
  chemically synthesized
gcaaatgcttagggtgtcaa

SEQ ID NO: 1458 - DNA, 20 bp, Artificial Sequence
  chemically synthesized
atgcttagggtgtcaaagga

SEQ ID NO: 1459 - DNA, 20 bp, Artificial Sequence
  chemically synthesized
aaggaaagaatgatcacatt

SEQ ID NO: 1460 - DNA, 20 bp, Artificial Sequence
  chemically synthesized
aaagaatgatcacattcagc

SEQ ID NO: 1461 - DNA, 20 bp, Artificial Sequence
  chemically synthesized
aagaatgatcacattcagct

SEQ ID NO: 1462 - DNA, 20 bp, Artificial Sequence
  chemically synthesized
agaatgatcacattcagctg

SEQ ID NO: 1463 - DNA, 20 bp, Artificial Sequence
  chemically synthesized
atcacattcagctggggatc

SEQ ID NO: 1464 - DNA, 20 bp, Artificial Sequence
  chemically synthesized
cattcagctggggatcaaga

SEQ ID NO: 1465 - DNA, 20 bp, Artificial Sequence
  chemically synthesized
tggggatcaagatagccttc

SEQ ID NO: 1466 - DNA, 20 bp, Artificial Sequence
  chemically synthesized
agatagccttctggatcttg

SEQ ID NO: 1467 - DNA, 20 bp, Artificial Sequence
  chemically synthesized
gatagccttctggatcttga

SEQ ID NO: 1468 - DNA, 20 bp, Artificial Sequence
  chemically synthesized
tagccttctggatcttgaag

SEQ ID NO: 1469 - DNA, 20 bp, Artificial Sequence
  chemically synthesized
ccttctggatcttgaaggag

SEQ ID NO: 1470 - DNA, 20 bp, Artificial Sequence
  chemically synthesized
ctggatcttgaaggagaagc

SEQ ID NO: 1471 - DNA, 20 bp, Artificial Sequence
  chemically synthesized
aaggagaagctggattccat

SEQ ID NO: 1472 - DNA, 20 bp, Artificial Sequence
  chemically synthesized
aggagaagctggattccatt

SEQ ID NO: 1473 - DNA, 20 bp, Artificial Sequence
  chemically synthesized
gaagctggattccattaggt

SEQ ID NO: 1474 - DNA, 20 bp, Artificial Sequence
  chemically synthesized
aagctggattccattaggtg

SEQ ID NO: 1475 - DNA, 20 bp, Artificial Sequence
  chemically synthesized
gattccattaggtgaggttg

SEQ ID NO: 1476 - DNA, 20 bp, Artificial Sequence
  chemically synthesized
ttaggtgaggttgaagatga

SEQ ID NO: 1477 - DNA, 20 bp, Artificial Sequence
  chemically synthesized
taggtgaggttgaagatgat

SEQ ID NO: 1478 - DNA, 20 bp, Artificial Sequence
  chemically synthesized
ggtgaggttgaagatgatgg

SEQ ID NO: 1479 - DNA, 20 bp, Artificial Sequence
  chemically synthesized
gtgaggttgaagatgatggg

SEQ ID NO: 1480 - DNA, 20 bp, Artificial Sequence
  chemically synthesized
aagatgatgggaggtctaca

SEQ ID NO: 1481 - DNA, 20 bp, Artificial Sequence
  chemically synthesized
tgatgggaggtctacacaga

SEQ ID NO: 1482 - DNA, 20 bp, Artificial Sequence
  chemically synthesized
atgggaggtctacacagacg

SEQ ID NO: 1483 - DNA, 20 bp, Artificial Sequence
  chemically synthesized
acagacggagcaaccatgcc

SEQ ID NO: 1484 - DNA, 20 bp, Artificial Sequence
  chemically synthesized
gacggagcaaccatgccaag

SEQ ID NO: 1485 - DNA, 20 bp, Artificial Sequence
  chemically synthesized
acggagcaaccatgccaagt

SEQ ID NO: 1486 - DNA, 20 bp, Artificial Sequence
  chemically synthesized
ggagcaaccatgccaagtag

SEQ ID NO: 1487 - DNA, 20 bp, Artificial Sequence
  chemically synthesized
agcaaccatgccaagtagga

SEQ ID NO: 1488 - DNA, 20 bp, Artificial Sequence
  chemically synthesized
catgccaagtaggagagtat

SEQ ID NO: 1489 - DNA, 20 bp, Artificial Sequence
  chemically synthesized
atgccaagtaggagagtata

SEQ ID NO: 1490 - DNA, 20 bp, Artificial Sequence
  chemically synthesized
taggagagtataaggcatac

SEQ ID NO: 1491 - DNA, 20 bp, Artificial Sequence
  chemically synthesized
aggagagtataaggcatact

SEQ ID NO: 1492 - DNA, 20 bp, Artificial Sequence
  chemically synthesized
gagagtataaggcatactgg

SEQ ID NO: 1493 - DNA, 20 bp, Artificial Sequence
  chemically synthesized
tataaggcatactgggagat

SEQ ID NO: 1494 - DNA, 20 bp, Artificial Sequence
  chemically synthesized
aattactgtaccttaaccct

SEQ ID NO: 1495 - DNA, 20 bp, Artificial Sequence
  chemically synthesized
accttaaccctgagtttgcg

SEQ ID NO: 1496 - DNA, 20 bp, Artificial Sequence
  chemically synthesized
ttctaccccctgaacatctg

SEQ ID NO: 1497 - DNA, 20 bp, Artificial Sequence
  chemically synthesized
ccccctgaacatctgtggtg

SEQ ID NO: 1498 - DNA, 20 bp, Artificial Sequence
  chemically synthesized
cccctgaacatctgtggtgt

SEQ ID NO: 1499 - DNA, 20 bp, Artificial Sequence
  chemically synthesized
ccctgaacatctgtggtgta

SEQ ID NO: 1500 - DNA, 20 bp, Artificial Sequence
  chemically synthesized
aacatctgtggtgtagggaa

SEQ ID NO: 1501 - DNA, 20 bp, Artificial Sequence
  chemically synthesized
catctgtggtgtagggaaaa

SEQ ID NO: 1502 - DNA, 20 bp, Artificial Sequence
  chemically synthesized
tggtgtagggaaaagagaat

SEQ ID NO: 1503 - DNA, 20 bp, Artificial Sequence
  chemically synthesized
gtagggaaaagagaatcaga

SEQ ID NO: 1504 - DNA, 20 bp, Artificial Sequence
  chemically synthesized
gggaaaagagaatcagaaag

SEQ ID NO: 1505 - DNA, 20 bp, Artificial Sequence
  chemically synthesized
aaagagaatcagaaagaagc

SEQ ID NO: 1506 - DNA, 20 bp, Artificial Sequence
  chemically synthesized
cagaaagaagccagctcata

SEQ ID NO: 1507 - DNA, 20 bp, Artificial Sequence
  chemically synthesized
gaaagaagccagctcataca

SEQ ID NO: 1508 - DNA, 20 bp, Artificial Sequence
  chemically synthesized
agccagctcatacagagtcc

SEQ ID NO: 1509 - DNA, 20 bp, Artificial Sequence
  chemically synthesized
gccagctcatacagagtcca

SEQ ID NO: 1510 - DNA, 20 bp, Artificial Sequence
  chemically synthesized
ccagctcatacagagtccaa

SEQ ID NO: 1511 - DNA, 20 bp, Artificial Sequence
  chemically synthesized
tacagagtccaagggtcttt

SEQ ID NO: 1512 - DNA, 20 bp, Artificial Sequence
  chemically synthesized
acagagtccaagggtctttt

SEQ ID NO: 1513 - DNA, 20 bp, Artificial Sequence
  chemically synthesized
ccaagggtcttttgggatat

SEQ ID NO: 1514 - DNA, 20 bp, Artificial Sequence
  chemically synthesized
caagggtcttttgggatatt

SEQ ID NO: 1515 - DNA, 20 bp, Artificial Sequence
  chemically synthesized
ggatattgggttatgatcac

SEQ ID NO: 1516 - DNA, 20 bp, Artificial Sequence
  chemically synthesized
gatattgggttatgatcact

SEQ ID NO: 1517 - DNA, 20 bp, Artificial Sequence
  chemically synthesized
atattgggttatgatcactg

SEQ ID NO: 1518 - DNA, 20 bp, Artificial Sequence
  chemically synthesized
tgatcactggggtgtcattg

SEQ ID NO: 1519 - DNA, 20 bp, Artificial Sequence
  chemically synthesized
gatcactggggtgtcattga

SEQ ID NO: 1520 - DNA, 20 bp, Artificial Sequence
  chemically synthesized
gggtgtcattgaaggatcct

SEQ ID NO: 1521 - DNA, 20 bp, Artificial Sequence
  chemically synthesized
gtcattgaaggatcctaaga

SEQ ID NO: 1522 - DNA, 20 bp, Artificial Sequence
  chemically synthesized
tcattgaaggatcctaagaa

SEQ ID NO: 1523 - DNA, 20 bp, Artificial Sequence
  chemically synthesized
attgaaggatcctaagaaag

SEQ ID NO: 1524 - DNA, 20 bp, Artificial Sequence
  chemically synthesized
ttgaaggatcctaagaaagg

SEQ ID NO: 1525 - DNA, 20 bp, Artificial Sequence
  chemically synthesized
ggaccacgatctcccttata

SEQ ID NO: 1526 - DNA, 20 bp, Artificial Sequence
  chemically synthesized
tatatggtgaatgtgttgtt

SEQ ID NO: 1527 - DNA, 20 bp, Artificial Sequence
  chemically synthesized
atggtgaatgtgttgttaag

SEQ ID NO: 1528 - DNA, 20 bp, Artificial Sequence
  chemically synthesized
tgaatgtgttgttaagaagt

SEQ ID NO: 1529 - DNA, 20 bp, Artificial Sequence
  chemically synthesized
gtgttgttaagaagttagat

SEQ ID NO: 1530 - DNA, 20 bp, Artificial Sequence
  chemically synthesized
gttgttaagaagttagatga

SEQ ID NO: 1531 - DNA, 20 bp, Artificial Sequence
  chemically synthesized
ttgttaagaagttagatgag

SEQ ID NO: 1532 - DNA, 20 bp, Artificial Sequence
  chemically synthesized
taagaagttagatgagaggt

SEQ ID NO: 1533 - DNA, 20 bp, Artificial Sequence
  chemically synthesized
aagaagttagatgagaggtg

SEQ ID NO: 1534 - DNA, 20 bp, Artificial Sequence
  chemically synthesized
gaagttagatgagaggtgag

SEQ ID NO: 1535 - DNA, 20 bp, Artificial Sequence
  chemically synthesized
tagatgagaggtgaggagac

SEQ ID NO: 1536 - DNA, 20 bp, Artificial Sequence
  chemically synthesized
tgagaggtgaggagaccagt

SEQ ID NO: 1537 - DNA, 20 bp, Artificial Sequence
  chemically synthesized
aggtgaggagaccagttaga

SEQ ID NO: 1538 - DNA, 20 bp, Artificial Sequence
  chemically synthesized
agaccagttagaaagccaat

SEQ ID NO: 1539 - DNA, 20 bp, Artificial Sequence
  chemically synthesized
agaaagccaataagcatttc

SEQ ID NO: 1540 - DNA, 20 bp, Artificial Sequence
  chemically synthesized
gccaataagcatttccagat

SEQ ID NO: 1541 - DNA, 20 bp, Artificial Sequence
  chemically synthesized
caataagcatttccagatga

SEQ ID NO: 1542 - DNA, 20 bp, Artificial Sequence
  chemically synthesized
catttccagatgagagataa

SEQ ID NO: 1543 - DNA, 20 bp, Artificial Sequence
  chemically synthesized
taatggttcttgaaatccaa

SEQ ID NO: 1544 - DNA, 20 bp, Artificial Sequence
  chemically synthesized
tcttgaaatccaatagtgcc

SEQ ID NO: 1545 - DNA, 20 bp, Artificial Sequence
  chemically synthesized
cttgaaatccaatagtgccc

SEQ ID NO: 1546 - DNA, 20 bp, Artificial Sequence
  chemically synthesized
atagtgcccaggtctaaatt

SEQ ID NO: 1547 - DNA, 20 bp, Artificial Sequence
  chemically synthesized
tgcccaggtctaaattgaga

SEQ ID NO: 1548 - DNA, 20 bp, Artificial Sequence
  chemically synthesized
gcccaggtctaaattgagat

SEQ ID NO: 1549 - DNA, 20 bp, Artificial Sequence
  chemically synthesized
ctaaattgagatgggtgaat

SEQ ID NO: 1550 - DNA, 20 bp, Artificial Sequence
  chemically synthesized
taaattgagatgggtgaatg

SEQ ID NO: 1551 - DNA, 20 bp, Artificial Sequence
  chemically synthesized
gatgggtgaatgaggaaaat

SEQ ID NO: 1552 - DNA, 20 bp, Artificial Sequence
  chemically synthesized
atgggtgaatgaggaaaata

SEQ ID NO: 1553 - DNA, 20 bp, Artificial Sequence
  chemically synthesized
ggtgaatgaggaaaataagg

SEQ ID NO: 1554 - DNA, 20 bp, Artificial Sequence
  chemically synthesized
tgaatgaggaaaataaggaa

SEQ ID NO: 1555 - DNA, 20 bp, Artificial Sequence
  chemically synthesized
aatgaggaaaataaggaaga

SEQ ID NO: 1556 - DNA, 20 bp, Artificial Sequence
  chemically synthesized
gaggaaaataaggaagagag

SEQ ID NO: 1557 - DNA, 20 bp, Artificial Sequence
  chemically synthesized
ggaaaataaggaagagagaa

SEQ ID NO: 1558 - DNA, 20 bp, Artificial Sequence
  chemically synthesized
gaaaataaggaagagagaag

SEQ ID NO: 1559 - DNA, 20 bp, Artificial Sequence
  chemically synthesized
ataaggaagagagaagaggc

SEQ ID NO: 1560 - DNA, 20 bp, Artificial Sequence
  chemically synthesized
ggaagagagaagaggcaaga

SEQ ID NO: 1561 - DNA, 20 bp, Artificial Sequence
  chemically synthesized
agaagaggcaagatggtgcc

SEQ ID NO: 1562 - DNA, 20 bp, Artificial Sequence
  chemically synthesized
gaagaggcaagatggtgcct

SEQ ID NO: 1563 - DNA, 20 bp, Artificial Sequence
  chemically synthesized
ggtttgtgatgcctctttcc

SEQ ID NO: 1564 - DNA, 20 bp, Artificial Sequence
  chemically synthesized
gtttgtgatgcctctttcct

SEQ ID NO: 1565 - DNA, 20 bp, Artificial Sequence
  chemically synthesized
tcctgggtctcttgtctcca

SEQ ID NO: 1566 - DNA, 20 bp, Artificial Sequence
  chemically synthesized
cctgggtctcttgtctccac

SEQ ID NO: 1567 - DNA, 20 bp, Artificial Sequence
  chemically synthesized
tgggtctcttgtctccacag

SEQ ID NO: 1568 - DNA, 20 bp, Artificial Sequence
  chemically synthesized
gggtctcttgtctccacagg

SEQ ID NO: 1569 - DNA, 20 bp, Artificial Sequence
  chemically synthesized
gtctcttgtctccacaggag

SEQ ID NO: 1570 - DNA, 20 bp, Artificial Sequence
  chemically synthesized
tgtctccacaggaggagcca

SEQ ID NO: 1571 - DNA, 20 bp, Artificial Sequence
  chemically synthesized
gtctccacaggaggagccat

SEQ ID NO: 1572 - DNA, 20 bp, Artificial Sequence
  chemically synthesized
tctccacaggaggagccatg

SEQ ID NO: 1573 - DNA, 20 bp, Artificial Sequence
  chemically synthesized
agccatggggcactacgtct

SEQ ID NO: 1574 - DNA, 20 bp, Artificial Sequence
  chemically synthesized
actacgtcttagctgaacgt

SEQ ID NO: 1575 - DNA, 20 bp, Artificial Sequence
  chemically synthesized
agctgaacgtgagtgacacg

SEQ ID NO: 1576 - DNA, 20 bp, Artificial Sequence
  chemically synthesized
cgtgagtgacacgcagcctg

SEQ ID NO: 1577 - DNA, 20 bp, Artificial Sequence
  chemically synthesized
cgcagcctgcagactcactg

SEQ ID NO: 1578 - DNA, 20 bp, Artificial Sequence
  chemically synthesized
gcagcctgcagactcactgt

SEQ ID NO: 1579 - DNA, 20 bp, Artificial Sequence
  chemically synthesized
gcctgcagactcactgtggg

SEQ ID NO: 1580 - DNA, 20 bp, Artificial Sequence
  chemically synthesized
cctgcagactcactgtggga

SEQ ID NO: 1581 - DNA, 20 bp, Artificial Sequence
  chemically synthesized
tgcagactcactgtgggaag

SEQ ID NO: 1582 - DNA, 20 bp, Artificial Sequence
  chemically synthesized
ctgtgggaaggagacaaaac

SEQ ID NO: 1583 - DNA, 20 bp, Artificial Sequence
  chemically synthesized
gtgggaaggagacaaaacta

SEQ ID NO: 1584 - DNA, 20 bp, Artificial Sequence
  chemically synthesized
gagacaaaactagagactca

SEQ ID NO: 1585 - DNA, 20 bp, Artificial Sequence
  chemically synthesized
gacaaaactagagactcaaa

SEQ ID NO: 1586 - DNA, 20 bp, Artificial Sequence
  chemically synthesized
acaaaactagagactcaaag

SEQ ID NO: 1587 - DNA, 20 bp, Artificial Sequence
  chemically synthesized
caaaactagagactcaaaga

SEQ ID NO: 1588 - DNA, 20 bp, Artificial Sequence
  chemically synthesized
aaactagagactcaaagagg

SEQ ID NO: 1589 - DNA, 20 bp, Artificial Sequence
  chemically synthesized
caaagagggagtgcatttat

SEQ ID NO: 1590 - DNA, 20 bp, Artificial Sequence
  chemically synthesized
tttatgagctcttcatgttt

SEQ ID NO: 1591 - DNA, 20 bp, Artificial Sequence
  chemically synthesized
ttatgagctcttcatgtttc

SEQ ID NO: 1592 - DNA, 20 bp, Artificial Sequence
  chemically synthesized
atgagctcttcatgtttcag

SEQ ID NO: 1593 - DNA, 20 bp, Artificial Sequence
  chemically synthesized
gagctcttcatgtttcagga

SEQ ID NO: 1594 - DNA, 20 bp, Artificial Sequence
  chemically synthesized
gctcttcatgtttcaggaga

SEQ ID NO: 1595 - DNA, 20 bp, Artificial Sequence
  chemically synthesized
gagagagttgaacctaaaca

SEQ ID NO: 1596 - DNA, 20 bp, Artificial Sequence
  chemically synthesized
cctgacgaactccttgattt

SEQ ID NO: 1597 - DNA, 20 bp, Artificial Sequence
  chemically synthesized
tctctgttcatttcctcaaa

SEQ ID NO: 1598 - DNA, 20 bp, Artificial Sequence
  chemically synthesized
ctcaaaaagatttccccatt

SEQ ID NO: 1599 - DNA, 20 bp, Artificial Sequence
  chemically synthesized
tcaaaaagatttccccattt

SEQ ID NO: 1600 - DNA, 20 bp, Artificial Sequence
  chemically synthesized
atttccccatttaggtttct

SEQ ID NO: 1601 - DNA, 20 bp, Artificial Sequence
  chemically synthesized
gtttctgagttcctgcatgc

SEQ ID NO: 1602 - DNA, 20 bp, Artificial Sequence
  chemically synthesized
tcctgcatgccggtgatccc

SEQ ID NO: 1603 - DNA, 20 bp, Artificial Sequence
  chemically synthesized
cctagctgtgacctctcccc

SEQ ID NO: 1604 - DNA, 20 bp, Artificial Sequence
  chemically synthesized
aactgtctctcatgaacctc

SEQ ID NO: 1605 - DNA, 20 bp, Artificial Sequence
  chemically synthesized
catgaacctcaagctgcatc

SEQ ID NO: 1606 - DNA, 20 bp, Artificial Sequence
  chemically synthesized
tgaacctcaagctgcatcta

SEQ ID NO: 1607 - DNA, 20 bp, Artificial Sequence
  chemically synthesized
gaacctcaagctgcatctag

SEQ ID NO: 1608 - DNA, 20 bp, Artificial Sequence
  chemically synthesized
cttcatttcctccgtcacct

SEQ ID NO: 1609 - DNA, 20 bp, Artificial Sequence
  chemically synthesized
tcatttcctccgtcacctca

SEQ ID NO: 1610 - DNA, 20 bp, Artificial Sequence
  chemically synthesized
gtcatttcatttcctatttt

SEQ ID NO: 1611 - DNA, 20 bp, Artificial Sequence
  chemically synthesized
atttcatttcctatttttgg

SEQ ID NO: 1612 - DNA, 20 bp, Artificial Sequence
  chemically synthesized
ttcatttcctatttttggaa

SEQ ID NO: 1613 - DNA, 20 bp, Artificial Sequence
  chemically synthesized
tcatttcctatttttggaag

SEQ ID NO: 1614 - DNA, 20 bp, Artificial Sequence
  chemically synthesized
ggaagaggactccttaaatt

SEQ ID NO: 1615 - DNA, 20 bp, Artificial Sequence
  chemically synthesized
gaagaggactccttaaattt

SEQ ID NO: 1616 - DNA, 20 bp, Artificial Sequence
  chemically synthesized
aagaggactccttaaatttg

SEQ ID NO: 1617 - DNA, 20 bp, Artificial Sequence
  chemically synthesized
agaggactccttaaatttgg

SEQ ID NO: 1618 - DNA, 20 bp, Artificial Sequence
  chemically synthesized
catgattcattttaacatct

SEQ ID NO: 1619 - DNA, 20 bp, Artificial Sequence
  chemically synthesized
ttcattttaacatctgagaa

SEQ ID NO: 1620 - DNA, 20 bp, Artificial Sequence
  chemically synthesized
ctgagaaaagctttgaaccc

SEQ ID NO: 1621 - DNA, 20 bp, Artificial Sequence
  chemically synthesized
tgagaaaagctttgaaccct

SEQ ID NO: 1622 - DNA, 20 bp, Artificial Sequence
  chemically synthesized
aagctttgaaccctgggacg

SEQ ID NO: 1623 - DNA, 20 bp, Artificial Sequence
  chemically synthesized
tttgaaccctgggacgtggc

SEQ ID NO: 1624 - DNA, 20 bp, Artificial Sequence
  chemically synthesized
gtggctagtcataaccttac

SEQ ID NO: 1625 - DNA, 20 bp, Artificial Sequence
  chemically synthesized
acatgtatctatgcattttc

SEQ ID NO: 1626 - DNA, 20 bp, Artificial Sequence
  chemically synthesized
aatcctctctctgtgttacc

SEQ ID NO: 1627 - DNA, 20 bp, Artificial Sequence
  chemically synthesized
ccagtaactcatctgtcacc

SEQ ID NO: 1628 - DNA, 20 bp, Artificial Sequence
  chemically synthesized
actcatctgtcaccaagcct

SEQ ID NO: 1629 - DNA, 20 bp, Artificial Sequence
  chemically synthesized
ctcatctgtcaccaagcctt

SEQ ID NO: 1630 - DNA, 20 bp, Artificial Sequence
  chemically synthesized
tcatctgtcaccaagccttg

SEQ ID NO: 1631 - DNA, 20 bp, Artificial Sequence
  chemically synthesized
cttccatctgattgtgatgt

SEQ ID NO: 1632 - DNA, 20 bp, Artificial Sequence
  chemically synthesized
tgattgtgatgtgagttgca

SEQ ID NO: 1633 - DNA, 20 bp, Artificial Sequence
  chemically synthesized
atgtgagttgcacagctatg

SEQ ID NO: 1634 - DNA, 20 bp, Artificial Sequence
  chemically synthesized
tgtgagttgcacagctatga

SEQ ID NO: 1635 - DNA, 20 bp, Artificial Sequence
  chemically synthesized
aaggctgtacactgcacgaa

SEQ ID NO: 1636 - DNA, 20 bp, Artificial Sequence
  chemically synthesized
gctgtacactgcacgaatgg

SEQ ID NO: 1637 - DNA, 20 bp, Artificial Sequence
  chemically synthesized
tgtacactgcacgaatggaa

SEQ ID NO: 1638 - DNA, 20 bp, Artificial Sequence
  chemically synthesized
gtacactgcacgaatggaag

SEQ ID NO: 1639 - DNA, 20 bp, Artificial Sequence
  chemically synthesized
aatggaagaggcacctgtcc

SEQ ID NO: 1640 - DNA, 20 bp, Artificial Sequence
  chemically synthesized
agaggcacctgtcccagaaa

SEQ ID NO: 1641 - DNA, 20 bp, Artificial Sequence
  chemically synthesized
ctgtcccagaaaaagcatca

SEQ ID NO: 1642 - DNA, 20 bp, Artificial Sequence
  chemically synthesized
aaaagcatcatggctatctg

SEQ ID NO: 1643 - DNA, 20 bp, Artificial Sequence
  chemically synthesized
aaagcatcatggctatctgt

SEQ ID NO: 1644 - DNA, 20 bp, Artificial Sequence
  chemically synthesized
gcatcatggctatctgtggg

SEQ ID NO: 1645 - DNA, 20 bp, Artificial Sequence
  chemically synthesized
gctatctgtgggtagtatga

SEQ ID NO: 1646 - DNA, 20 bp, Artificial Sequence
  chemically synthesized
ctatctgtgggtagtatgat

SEQ ID NO: 1647 - DNA, 20 bp, Artificial Sequence
  chemically synthesized
ggtagtatgatgggtgtttt

SEQ ID NO: 1648 - DNA, 20 bp, Artificial Sequence
  chemically synthesized
agtatgatgggtgtttttag

SEQ ID NO: 1649 - DNA, 20 bp, Artificial Sequence
  chemically synthesized
gtatgatgggtgtttttagc

SEQ ID NO: 1650 - DNA, 20 bp, Artificial Sequence
  chemically synthesized
tgatgggtgtttttagcagg

SEQ ID NO: 1651 - DNA, 20 bp, Artificial Sequence
  chemically synthesized
gatgggtgtttttagcaggt

SEQ ID NO: 1652 - DNA, 20 bp, Artificial Sequence
  chemically synthesized
tgggtgtttttagcaggtag

SEQ ID NO: 1653 - DNA, 20 bp, Artificial Sequence
  chemically synthesized
gggtgtttttagcaggtagg

SEQ ID NO: 1654 - DNA, 20 bp, Artificial Sequence
  chemically synthesized
gtaggaggcaaatatcttga

SEQ ID NO: 1655 - DNA, 20 bp, Artificial Sequence
  chemically synthesized
taggaggcaaatatcttgaa

SEQ ID NO: 1656 - DNA, 20 bp, Artificial Sequence
  chemically synthesized
aggaggcaaatatcttgaaa

SEQ ID NO: 1657 - DNA, 20 bp, Artificial Sequence
  chemically synthesized
ggaggcaaatatcttgaaag

SEQ ID NO: 1658 - DNA, 20 bp, Artificial Sequence
  chemically synthesized
atatcttgaaaggggttgtg

SEQ ID NO: 1659 - DNA, 20 bp, Artificial Sequence
  chemically synthesized
atcttgaaaggggttgtgaa

SEQ ID NO: 1660 - DNA, 20 bp, Artificial Sequence
  chemically synthesized
tcttgaaaggggttgtgaag

SEQ ID NO: 1661 - DNA, 20 bp, Artificial Sequence
  chemically synthesized
gaagaggtgttttttctaat

SEQ ID NO: 1662 - DNA, 20 bp, Artificial Sequence
  chemically synthesized
tgttttttctaattggcatg

SEQ ID NO: 1663 - DNA, 20 bp, Artificial Sequence
  chemically synthesized
gttttttctaattggcatga

SEQ ID NO: 1664 - DNA, 20 bp, Artificial Sequence
  chemically synthesized
attggcatgaaggtgtcata

SEQ ID NO: 1665 - DNA, 20 bp, Artificial Sequence
  chemically synthesized
aggtgtcatacagatttgca

SEQ ID NO: 1666 - DNA, 20 bp, Artificial Sequence
  chemically synthesized
tacagatttgcaaagtttaa

SEQ ID NO: 1667 - DNA, 20 bp, Artificial Sequence
  chemically synthesized
agtttaatggtgccttcatt

SEQ ID NO: 1668 - DNA, 20 bp, Artificial Sequence
  chemically synthesized
gtttaatggtgccttcattt

SEQ ID NO: 1669 - DNA, 20 bp, Artificial Sequence
  chemically synthesized
cttcatttgggatgctactc

SEQ ID NO: 1670 - DNA, 20 bp, Artificial Sequence
  chemically synthesized
gggatgctactctagtattc

SEQ ID NO: 1671 - DNA, 20 bp, Artificial Sequence
  chemically synthesized
actctagtattccagacctg

SEQ ID NO: 1672 - DNA, 20 bp, Artificial Sequence
  chemically synthesized
aatcacaataattttctacc

SEQ ID NO: 1673 - DNA, 20 bp, Artificial Sequence
  chemically synthesized
ctgataatgaaaattatgat

SEQ ID NO: 1674 - DNA, 20 bp, Artificial Sequence
  chemically synthesized
tgataatgaaaattatgata

SEQ ID NO: 1675 - DNA, 20 bp, Artificial Sequence
  chemically synthesized
aattatgataaggatgataa

SEQ ID NO: 1676 - DNA, 20 bp, Artificial Sequence
  chemically synthesized
acttcgtgtccgactcttct

SEQ ID NO: 1677 - DNA, 20 bp, Artificial Sequence
  chemically synthesized
acttcttacaataattctat

SEQ ID NO: 1678 - DNA, 20 bp, Artificial Sequence
  chemically synthesized
cttacaataattctatgaga

SEQ ID NO: 1679 - DNA, 20 bp, Artificial Sequence
  chemically synthesized
ttacaataattctatgagat

SEQ ID NO: 1680 - DNA, 20 bp, Artificial Sequence
  chemically synthesized
ccccatttcttttttaaatg

SEQ ID NO: 1681 - DNA, 20 bp, Artificial Sequence
  chemically synthesized
atttcttttttaaatgaaga

SEQ ID NO: 1682 - DNA, 20 bp, Artificial Sequence
  chemically synthesized
ttttttaaatgaagaaagtg

SEQ ID NO: 1683 - DNA, 20 bp, Artificial Sequence
  chemically synthesized
tttaaatgaagaaagtgaag

SEQ ID NO: 1684 - DNA, 20 bp, Artificial Sequence
  chemically synthesized
ttaaatgaagaaagtgaagt

SEQ ID NO: 1685 - DNA, 20 bp, Artificial Sequence
  chemically synthesized
atgaagaaagtgaagtaggc

SEQ ID NO: 1686 - DNA, 20 bp, Artificial Sequence
  chemically synthesized
tgaagaaagtgaagtaggcc

SEQ ID NO: 1687 - DNA, 20 bp, Artificial Sequence
  chemically synthesized
aaagtgaagtaggccgggca

SEQ ID NO: 1688 - DNA, 20 bp, Artificial Sequence
  chemically synthesized
gtgaagtaggccgggcacgg

SEQ ID NO: 1689 - DNA, 20 bp, Artificial Sequence
  chemically synthesized
gtggctcacgcctgtaatcc

SEQ ID NO: 1690 - DNA, 20 bp, Artificial Sequence
  chemically synthesized
cgcctgtaatcccagcactt

SEQ ID NO: 1691 - DNA, 20 bp, Artificial Sequence
  chemically synthesized
gcctgtaatcccagcacttt

SEQ ID NO: 1692 - DNA, 20 bp, Artificial Sequence
  chemically synthesized
ctgtaatcccagcactttgg

SEQ ID NO: 1693 - DNA, 20 bp, Artificial Sequence
  chemically synthesized
tgtaatcccagcactttggg

SEQ ID NO: 1694 - DNA, 20 bp, Artificial Sequence
  chemically synthesized
cccagcactttgggaggcca

SEQ ID NO: 1695 - DNA, 20 bp, Artificial Sequence
  chemically synthesized
agcactttgggaggccaaag

SEQ ID NO: 1696 - DNA, 20 bp, Artificial Sequence
  chemically synthesized
gcactttgggaggccaaagc

SEQ ID NO: 1697 - DNA, 20 bp, Artificial Sequence
  chemically synthesized
ctttgggaggccaaagcggg

SEQ ID NO: 1698 - DNA, 20 bp, Artificial Sequence
  chemically synthesized
ggccaaagcgggtggatcac

SEQ ID NO: 1699 - DNA, 20 bp, Artificial Sequence
  chemically synthesized
gccaaagcgggtggatcacg

SEQ ID NO: 1700 - DNA, 20 bp, Artificial Sequence
  chemically synthesized
aagcgggtggatcacgaggt

SEQ ID NO: 1701 - DNA, 20 bp, Artificial Sequence
  chemically synthesized
agcgggtggatcacgaggtc

SEQ ID NO: 1702 - DNA, 20 bp, Artificial Sequence
  chemically synthesized
cgggtggatcacgaggtcag

SEQ ID NO: 1703 - DNA, 20 bp, Artificial Sequence
  chemically synthesized
gatcacgaggtcaggagatc

SEQ ID NO: 1704 - DNA, 20 bp, Artificial Sequence
  chemically synthesized
tcaggagatcgagaccatcc

SEQ ID NO: 1705 - DNA, 20 bp, Artificial Sequence
  chemically synthesized
cgagaccatcctggctaaca

SEQ ID NO: 1706 - DNA, 20 bp, Artificial Sequence
  chemically synthesized
ctaataaaaatacaaaaaat

SEQ ID NO: 1707 - DNA, 20 bp, Artificial Sequence
  chemically synthesized
taaaaatacaaaaaattagc

SEQ ID NO: 1708 - DNA, 20 bp, Artificial Sequence
  chemically synthesized
aaaaatacaaaaaattagct

SEQ ID NO: 1709 - DNA, 20 bp, Artificial Sequence
  chemically synthesized
tacaaaaaattagctgggcg

SEQ ID NO: 1710 - DNA, 20 bp, Artificial Sequence
  chemically synthesized
aaaaaattagctgggcgtgg

SEQ ID NO: 1711 - DNA, 20 bp, Artificial Sequence
  chemically synthesized
aaattagctgggcgtggtgg

SEQ ID NO: 1712 - DNA, 20 bp, Artificial Sequence
  chemically synthesized
ggcgtggtggcagacgcctg

SEQ ID NO: 1713 - DNA, 20 bp, Artificial Sequence
  chemically synthesized
gtggcagacgcctgtagtcc

SEQ ID NO: 1714 - DNA, 20 bp, Artificial Sequence
  chemically synthesized
cgcctgtagtcccagctact

SEQ ID NO: 1715 - DNA, 20 bp, Artificial Sequence
  chemically synthesized
ctgtagtcccagctactcgg

SEQ ID NO: 1716 - DNA, 20 bp, Artificial Sequence
  chemically synthesized
tgtagtcccagctactcgga

SEQ ID NO: 1717 - DNA, 20 bp, Artificial Sequence
  chemically synthesized
tcccagctactcggaaggct

SEQ ID NO: 1718 - DNA, 20 bp, Artificial Sequence
  chemically synthesized
cccagctactcggaaggctg

SEQ ID NO: 1719 - DNA, 20 bp, Artificial Sequence
  chemically synthesized
agctactcggaaggctgagg

SEQ ID NO: 1720 - DNA, 20 bp, Artificial Sequence
  chemically synthesized
gctactcggaaggctgaggc

SEQ ID NO: 1721 - DNA, 20 bp, Artificial Sequence
  chemically synthesized
tactcggaaggctgaggcag

SEQ ID NO: 1722 - DNA, 20 bp, Artificial Sequence
  chemically synthesized
ggaaggctgaggcaggagaa

SEQ ID NO: 1723 - DNA, 20 bp, Artificial Sequence
  chemically synthesized
gcaggagaatggcatgaacc

SEQ ID NO: 1724 - DNA, 20 bp, Artificial Sequence
  chemically synthesized
caggagaatggcatgaaccc

SEQ ID NO: 1725 - DNA, 20 bp, Artificial Sequence
  chemically synthesized
ggagaatggcatgaacccag

SEQ ID NO: 1726 - DNA, 20 bp, Artificial Sequence
  chemically synthesized
gagaatggcatgaacccagg

SEQ ID NO: 1727 - DNA, 20 bp, Artificial Sequence
  chemically synthesized
aatggcatgaacccaggagg

SEQ ID NO: 1728 - DNA, 20 bp, Artificial Sequence
  chemically synthesized
tggcatgaacccaggaggca

SEQ ID NO: 1729 - DNA, 20 bp, Artificial Sequence
  chemically synthesized
aacccaggaggcagagcttg

SEQ ID NO: 1730 - DNA, 20 bp, Artificial Sequence
  chemically synthesized
caggaggcagagcttgcagt

SEQ ID NO: 1731 - DNA, 20 bp, Artificial Sequence
  chemically synthesized
ggcagagcttgcagtgagcc

SEQ ID NO: 1732 - DNA, 20 bp, Artificial Sequence
  chemically synthesized
gagtttgcgccactgcactc

SEQ ID NO: 1733 - DNA, 20 bp, Artificial Sequence
  chemically synthesized
tgcgccactgcactccagcc

SEQ ID NO: 1734 - DNA, 20 bp, Artificial Sequence
  chemically synthesized
gcgccactgcactccagcct

SEQ ID NO: 1735 - DNA, 20 bp, Artificial Sequence
  chemically synthesized
ctgcactccagcctaggtga

SEQ ID NO: 1736 - DNA, 20 bp, Artificial Sequence
  chemically synthesized
gcactccagcctaggtgaca

SEQ ID NO: 1737 - DNA, 20 bp, Artificial Sequence
  chemically synthesized
tccagcctaggtgacagagt

SEQ ID NO: 1738 - DNA, 20 bp, Artificial Sequence
  chemically synthesized
aataaaaaaatgaaaaaaaa

SEQ ID NO: 1739 - DNA, 20 bp, Artificial Sequence
  chemically synthesized
aaaaaatgaaaaaaaaaaga

SEQ ID NO: 1740 - DNA, 20 bp, Artificial Sequence
  chemically synthesized
atgaaaaaaaaaagaaagtg

SEQ ID NO: 1741 - DNA, 20 bp, Artificial Sequence
  chemically synthesized
aaaaaaaagaaagtgaagta

SEQ ID NO: 1742 - DNA, 20 bp, Artificial Sequence
  chemically synthesized
aaaaaagaaagtgaagtata

SEQ ID NO: 1743 - DNA, 20 bp, Artificial Sequence
  chemically synthesized
gtgaagtatagagtatctca

SEQ ID NO: 1744 - DNA, 20 bp, Artificial Sequence
  chemically synthesized
tagagtatctcatagtttgt

SEQ ID NO: 1745 - DNA, 20 bp, Artificial Sequence
  chemically synthesized
atctcatagtttgtcagtga

SEQ ID NO: 1746 - DNA, 20 bp, Artificial Sequence
  chemically synthesized
tagtttgtcagtgatagaaa

SEQ ID NO: 1747 - DNA, 20 bp, Artificial Sequence
  chemically synthesized
agtttgtcagtgatagaaac

SEQ ID NO: 1748 - DNA, 20 bp, Artificial Sequence
  chemically synthesized
atagaaacaggtttcaaact

SEQ ID NO: 1749 - DNA, 20 bp, Artificial Sequence
  chemically synthesized
tctgaccgtttgatacatct

SEQ ID NO: 1750 - DNA, 20 bp, Artificial Sequence
  chemically synthesized
atctcagacaccactacatt

SEQ ID NO: 1751 - DNA, 20 bp, Artificial Sequence
  chemically synthesized
tcagacaccactacattcag

SEQ ID NO: 1752 - DNA, 20 bp, Artificial Sequence
  chemically synthesized
caccactacattcagtagtt

SEQ ID NO: 1753 - DNA, 20 bp, Artificial Sequence
  chemically synthesized
cattcagtagtttagatgcc

SEQ ID NO: 1754 - DNA, 20 bp, Artificial Sequence
  chemically synthesized
gtttagatgcctagaataaa

SEQ ID NO: 1755 - DNA, 20 bp, Artificial Sequence
  chemically synthesized
ttagatgcctagaataaata

SEQ ID NO: 1756 - DNA, 20 bp, Artificial Sequence
  chemically synthesized
gatgcctagaataaatagag

SEQ ID NO: 1757 - DNA, 20 bp, Artificial Sequence
  chemically synthesized
atgcctagaataaatagaga

SEQ ID NO: 1758 - DNA, 20 bp, Artificial Sequence
  chemically synthesized
cctagaataaatagagaagg

SEQ ID NO: 1759 - DNA, 20 bp, Artificial Sequence
  chemically synthesized
ctagaataaatagagaagga

SEQ ID NO: 1760 - DNA, 20 bp, Artificial Sequence
  chemically synthesized
agaataaatagagaaggaag

SEQ ID NO: 1761 - DNA, 20 bp, Artificial Sequence
  chemically synthesized
taaatagagaaggaaggaga

SEQ ID NO: 1762 - DNA, 20 bp, Artificial Sequence
  chemically synthesized
tgtctcattgtgtttcttct

SEQ ID NO: 1763 - DNA, 20 bp, Artificial Sequence
  chemically synthesized
tcattgtgtttcttctgagt

SEQ ID NO: 1764 - DNA, 20 bp, Artificial Sequence
  chemically synthesized
gagtgagcttgaatcacatg

SEQ ID NO: 1765 - DNA, 20 bp, Artificial Sequence
  chemically synthesized
agtgagcttgaatcacatga

SEQ ID NO: 1766 - DNA, 20 bp, Artificial Sequence
  chemically synthesized
gtgagcttgaatcacatgaa

SEQ ID NO: 1767 - DNA, 20 bp, Artificial Sequence
  chemically synthesized
tgagcttgaatcacatgaag

SEQ ID NO: 1768 - DNA, 20 bp, Artificial Sequence
  chemically synthesized
ttgaatcacatgaaggggaa

SEQ ID NO: 1769 - DNA, 20 bp, Artificial Sequence
  chemically synthesized
aatcacatgaaggggaacag

SEQ ID NO: 1770 - DNA, 20 bp, Artificial Sequence
  chemically synthesized
gaaaacaaccaactgatcct

SEQ ID NO: 1771 - DNA, 20 bp, Artificial Sequence
  chemically synthesized
agctgtcatgtttcctttaa

SEQ ID NO: 1772 - DNA, 20 bp, Artificial Sequence
  chemically synthesized
gtttcctttaaaagtccctg

SEQ ID NO: 1773 - DNA, 20 bp, Artificial Sequence
  chemically synthesized
tttcctttaaaagtccctga

SEQ ID NO: 1774 - DNA, 20 bp, Artificial Sequence
  chemically synthesized
cctttaaaagtccctgaagg

SEQ ID NO: 1775 - DNA, 20 bp, Artificial Sequence
  chemically synthesized
ctttaaaagtccctgaagga

SEQ ID NO: 1776 - DNA, 20 bp, Artificial Sequence
  chemically synthesized
aagtccctgaaggaaggtcc

SEQ ID NO: 1777 - DNA, 20 bp, Artificial Sequence
  chemically synthesized
tgctcctctgttgctctctt

SEQ ID NO: 1778 - DNA, 20 bp, Artificial Sequence
  chemically synthesized
ctctttggcattcatttctt

SEQ ID NO: 1779 - DNA, 20 bp, Artificial Sequence
  chemically synthesized
catttctttggaccctacgc

SEQ ID NO: 1780 - DNA, 20 bp, Artificial Sequence
  chemically synthesized
atttctttggaccctacgca

SEQ ID NO: 1781 - DNA, 20 bp, Artificial Sequence
  chemically synthesized
ccctacgcaaggactgtaat

SEQ ID NO: 1782 - DNA, 20 bp, Artificial Sequence
  chemically synthesized
tacgcaaggactgtaattgg

SEQ ID NO: 1783 - DNA, 20 bp, Artificial Sequence
  chemically synthesized
acgcaaggactgtaattggt

SEQ ID NO: 1784 - DNA, 20 bp, Artificial Sequence
  chemically synthesized
cgcaaggactgtaattggtg

SEQ ID NO: 1785 - DNA, 20 bp, Artificial Sequence
  chemically synthesized
aggactgtaattggtgggga

SEQ ID NO: 1786 - DNA, 20 bp, Artificial Sequence
  chemically synthesized
ctgtaattggtggggacagc

SEQ ID NO: 1787 - DNA, 20 bp, Artificial Sequence
  chemically synthesized
taattggtggggacagctag

SEQ ID NO: 1788 - DNA, 20 bp, Artificial Sequence
  chemically synthesized
gggacagctagtggccctgc

SEQ ID NO: 1789 - DNA, 20 bp, Artificial Sequence
  chemically synthesized
ggacagctagtggccctgct

SEQ ID NO: 1790 - DNA, 20 bp, Artificial Sequence
  chemically synthesized
gccctgctgggcttcacaca

SEQ ID NO: 1791 - DNA, 20 bp, Artificial Sequence
  chemically synthesized
ttcacacacggtgtcctccc

SEQ ID NO: 1792 - DNA, 20 bp, Artificial Sequence
  chemically synthesized
tcacacacggtgtcctccct

SEQ ID NO: 1793 - DNA, 20 bp, Artificial Sequence
  chemically synthesized
acacggtgtcctccctaggc

SEQ ID NO: 1794 - DNA, 20 bp, Artificial Sequence
  chemically synthesized
cctccctaggccagtgcctc

SEQ ID NO: 1795 - DNA, 20 bp, Artificial Sequence
  chemically synthesized
tccctaggccagtgcctctg

SEQ ID NO: 1796 - DNA, 20 bp, Artificial Sequence
  chemically synthesized
taggccagtgcctctggagt

SEQ ID NO: 1797 - DNA, 20 bp, Artificial Sequence
  chemically synthesized
tgcctctggagtcagaactc

SEQ ID NO: 1798 - DNA, 20 bp, Artificial Sequence
  chemically synthesized
ctctggagtcagaactctgg

SEQ ID NO: 1799 - DNA, 20 bp, Artificial Sequence
  chemically synthesized
tggtggtatttccctcaatg

SEQ ID NO: 1800 - DNA, 20 bp, Artificial Sequence
  chemically synthesized
tggtatttccctcaatgaag

SEQ ID NO: 1801 - DNA, 20 bp, Artificial Sequence
  chemically synthesized
gtatttccctcaatgaagtg

SEQ ID NO: 1802 - DNA, 20 bp, Artificial Sequence
  chemically synthesized
ttccctcaatgaagtggagt

SEQ ID NO: 1803 - DNA, 20 bp, Artificial Sequence
  chemically synthesized
ggagtaagctctctcatttt

SEQ ID NO: 1804 - DNA, 20 bp, Artificial Sequence
  chemically synthesized
taagctctctcattttgaga

SEQ ID NO: 1805 - DNA, 20 bp, Artificial Sequence
  chemically synthesized
ctcattttgagatggtataa

SEQ ID NO: 1806 - DNA, 20 bp, Artificial Sequence
  chemically synthesized
attttgagatggtataatgg

SEQ ID NO: 1807 - DNA, 20 bp, Artificial Sequence
  chemically synthesized
atggtataatggaagccacc

SEQ ID NO: 1808 - DNA, 20 bp, Artificial Sequence
  chemically synthesized
gtataatggaagccaccaag

SEQ ID NO: 1809 - DNA, 20 bp, Artificial Sequence
  chemically synthesized
atggaagccaccaagtggct

SEQ ID NO: 1810 - DNA, 20 bp, Artificial Sequence
  chemically synthesized
ggaagccaccaagtggctta

SEQ ID NO: 1811 - DNA, 20 bp, Artificial Sequence
  chemically synthesized
gaagccaccaagtggcttag

SEQ ID NO: 1812 - DNA, 20 bp, Artificial Sequence
  chemically synthesized
caagtggcttagaggatgcc

SEQ ID NO: 1813 - DNA, 20 bp, Artificial Sequence
  chemically synthesized
aagtggcttagaggatgccc

SEQ ID NO: 1814 - DNA, 20 bp, Artificial Sequence
  chemically synthesized
aggatgcccaggtccttcca

SEQ ID NO: 1815 - DNA, 20 bp, Artificial Sequence
  chemically synthesized
gatgcccaggtccttccatg

SEQ ID NO: 1816 - DNA, 20 bp, Artificial Sequence
  chemically synthesized
aggtccttccatggagccac

SEQ ID NO: 1817 - DNA, 20 bp, Artificial Sequence
  chemically synthesized
ggtccttccatggagccact

SEQ ID NO: 1818 - DNA, 20 bp, Artificial Sequence
  chemically synthesized
gtccttccatggagccactg

SEQ ID NO: 1819 - DNA, 20 bp, Artificial Sequence
  chemically synthesized
ccatggagccactggggttc

SEQ ID NO: 1820 - DNA, 20 bp, Artificial Sequence
  chemically synthesized
cattaaaaaaaaaatctaac

SEQ ID NO: 1821 - DNA, 20 bp, Artificial Sequence
  chemically synthesized
attaaaaaaaaaatctaacc

SEQ ID NO: 1822 - DNA, 20 bp, Artificial Sequence
  chemically synthesized
aaaaatctaaccaggacatt

SEQ ID NO: 1823 - DNA, 20 bp, Artificial Sequence
  chemically synthesized
aaaatctaaccaggacattc

SEQ ID NO: 1824 - DNA, 20 bp, Artificial Sequence
  chemically synthesized
ccaggacattcaggaattgc

SEQ ID NO: 1825 - DNA, 20 bp, Artificial Sequence
  chemically synthesized
attcaggaattgctagattc

SEQ ID NO: 1826 - DNA, 20 bp, Artificial Sequence
  chemically synthesized
ttcaggaattgctagattct

SEQ ID NO: 1827 - DNA, 20 bp, Artificial Sequence
  chemically synthesized
attgctagattctgggaaat

SEQ ID NO: 1828 - DNA, 20 bp, Artificial Sequence
  chemically synthesized
aatcagttcaccatgttcaa

SEQ ID NO: 1829 - DNA, 20 bp, Artificial Sequence
  chemically synthesized
tcagttcaccatgttcaaaa

SEQ ID NO: 1830 - DNA, 20 bp, Artificial Sequence
  chemically synthesized
agagtctttttttttttttt

SEQ ID NO: 1831 - DNA, 20 bp, Artificial Sequence
  chemically synthesized
ttttttgagactctattgcc

SEQ ID NO: 1832 - DNA, 20 bp, Artificial Sequence
  chemically synthesized
tttttgagactctattgccc

SEQ ID NO: 1833 - DNA, 20 bp, Artificial Sequence
  chemically synthesized
tgagactctattgcccaggc

SEQ ID NO: 1834 - DNA, 20 bp, Artificial Sequence
  chemically synthesized
agactctattgcccaggctg

SEQ ID NO: 1835 - DNA, 20 bp, Artificial Sequence
  chemically synthesized
ttgcccaggctggagtgcaa

SEQ ID NO: 1836 - DNA, 20 bp, Artificial Sequence
  chemically synthesized
ggagtgcaatggcatgatct

SEQ ID NO: 1837 - DNA, 20 bp, Artificial Sequence
  chemically synthesized
tcactgtaacctctgcctcc

SEQ ID NO: 1838 - DNA, 20 bp, Artificial Sequence
  chemically synthesized
cactgtaacctctgcctccc

SEQ ID NO: 1839 - DNA, 20 bp, Artificial Sequence
  chemically synthesized
aacctctgcctcccaggttc

SEQ ID NO: 1840 - DNA, 20 bp, Artificial Sequence
  chemically synthesized
ttcaagcgattctcctgtct

SEQ ID NO: 1841 - DNA, 20 bp, Artificial Sequence
  chemically synthesized
ttctcctgtctcagcctccc

SEQ ID NO: 1842 - DNA, 20 bp, Artificial Sequence
  chemically synthesized
tcctgtctcagcctcccaag

SEQ ID NO: 1843 - DNA, 20 bp, Artificial Sequence
  chemically synthesized
gtctcagcctcccaagtagc

SEQ ID NO: 1844 - DNA, 20 bp, Artificial Sequence
  chemically synthesized
tctcagcctcccaagtagct

SEQ ID NO: 1845 - DNA, 20 bp, Artificial Sequence
  chemically synthesized
ctcccaagtagctgggatta

SEQ ID NO: 1846 - DNA, 20 bp, Artificial Sequence
  chemically synthesized
tcccaagtagctgggattac

SEQ ID NO: 1847 - DNA, 20 bp, Artificial Sequence
  chemically synthesized
caggcgtgcaccaccatgcc

SEQ ID NO: 1848 - DNA, 20 bp, Artificial Sequence
  chemically synthesized
ccggctaatttttgtatttt

SEQ ID NO: 1849 - DNA, 20 bp, Artificial Sequence
  chemically synthesized
gctaatttttgtatttttag

SEQ ID NO: 1850 - DNA, 20 bp, Artificial Sequence
  chemically synthesized
taatttttgtatttttagta

SEQ ID NO: 1851 - DNA, 20 bp, Artificial Sequence
  chemically synthesized
ttttgtatttttagtagaga

SEQ ID NO: 1852 - DNA, 20 bp, Artificial Sequence
  chemically synthesized
tttgtatttttagtagagac

SEQ ID NO: 1853 - DNA, 20 bp, Artificial Sequence
  chemically synthesized
ttgtatttttagtagagaca

SEQ ID NO: 1854 - DNA, 20 bp, Artificial Sequence
  chemically synthesized
gagacagggtttcaccatgt

SEQ ID NO: 1855 - DNA, 20 bp, Artificial Sequence
  chemically synthesized
cagggtttcaccatgttggc

SEQ ID NO: 1856 - DNA, 20 bp, Artificial Sequence
  chemically synthesized
agggtttcaccatgttggcc

SEQ ID NO: 1857 - DNA, 20 bp, Artificial Sequence
  chemically synthesized
tttcaccatgttggccaggc

SEQ ID NO: 1858 - DNA, 20 bp, Artificial Sequence
  chemically synthesized
acctcgtgatccgcctgcct

SEQ ID NO: 1859 - DNA, 20 bp, Artificial Sequence
  chemically synthesized
ccgcctgcctcggcctccca

SEQ ID NO: 1860 - DNA, 20 bp, Artificial Sequence
  chemically synthesized
cctcggcctcccaaagtgct

SEQ ID NO: 1861 - DNA, 20 bp, Artificial Sequence
  chemically synthesized
ctcccaaagtgctgagatta

SEQ ID NO: 1862 - DNA, 20 bp, Artificial Sequence
  chemically synthesized
tcccaaagtgctgagattac

SEQ ID NO: 1863 - DNA, 20 bp, Artificial Sequence
  chemically synthesized
agtgctgagattacaggtgt

SEQ ID NO: 1864 - DNA, 20 bp, Artificial Sequence
  chemically synthesized
caggtgtgagccaccctgcc

SEQ ID NO: 1865 - DNA, 20 bp, Artificial Sequence
  chemically synthesized
ccaccctgcccagccgtcaa

SEQ ID NO: 1866 - DNA, 20 bp, Artificial Sequence
  chemically synthesized
accctgcccagccgtcaaaa

SEQ ID NO: 1867 - DNA, 20 bp, Artificial Sequence
  chemically synthesized
agagtcttaatatatatatc

SEQ ID NO: 1868 - DNA, 20 bp, Artificial Sequence
  chemically synthesized
tcttaatatatatatccaga

SEQ ID NO: 1869 - DNA, 20 bp, Artificial Sequence
  chemically synthesized
tttatgttactacatgcact

SEQ ID NO: 1870 - DNA, 20 bp, Artificial Sequence
  chemically synthesized
tgcacttggctgcataaatg

SEQ ID NO: 1871 - DNA, 20 bp, Artificial Sequence
  chemically synthesized
tggctgcataaatgtggtac

SEQ ID NO: 1872 - DNA, 20 bp, Artificial Sequence
  chemically synthesized
ggtacaagcattctgtcttg

SEQ ID NO: 1873 - DNA, 20 bp, Artificial Sequence
  chemically synthesized
gtacaagcattctgtcttga

SEQ ID NO: 1874 - DNA, 20 bp, Artificial Sequence
  chemically synthesized
tacaagcattctgtcttgaa

SEQ ID NO: 1875 - DNA, 20 bp, Artificial Sequence
  chemically synthesized
aagcattctgtcttgaaggg

SEQ ID NO: 1876 - DNA, 20 bp, Artificial Sequence
  chemically synthesized
agcattctgtcttgaagggc

SEQ ID NO: 1877 - DNA, 20 bp, Artificial Sequence
  chemically synthesized
gtcttgaagggcaggtgctt

SEQ ID NO: 1878 - DNA, 20 bp, Artificial Sequence
  chemically synthesized
tcttgaagggcaggtgcttc

SEQ ID NO: 1879 - DNA, 20 bp, Artificial Sequence
  chemically synthesized
gtgcttcaggataccatata

SEQ ID NO: 1880 - DNA, 20 bp, Artificial Sequence
  chemically synthesized
tcaggataccatatacagct

SEQ ID NO: 1881 - DNA, 20 bp, Artificial Sequence
  chemically synthesized
ggataccatatacagctcag

SEQ ID NO: 1882 - DNA, 20 bp, Artificial Sequence
  chemically synthesized
cagctcagaagtttcttctt

SEQ ID NO: 1883 - DNA, 20 bp, Artificial Sequence
  chemically synthesized
agctcagaagtttcttcttt

SEQ ID NO: 1884 - DNA, 20 bp, Artificial Sequence
  chemically synthesized
cttctttaggcattaaattt

SEQ ID NO: 1885 - DNA, 20 bp, Artificial Sequence
  chemically synthesized
ttaggcattaaattttagca

SEQ ID NO: 1886 - DNA, 20 bp, Artificial Sequence
  chemically synthesized
taaaccattttctttttttg

SEQ ID NO: 1887 - DNA, 20 bp, Artificial Sequence
  chemically synthesized
ccattttctttttttgtggt

SEQ ID NO: 1888 - DNA, 20 bp, Artificial Sequence
  chemically synthesized
ttctttttttgtggttagaa

SEQ ID NO: 1889 - DNA, 20 bp, Artificial Sequence
  chemically synthesized
ttgtggttagaaaagttatg

SEQ ID NO: 1890 - DNA, 20 bp, Artificial Sequence
  chemically synthesized
tagaaaagttatgtagaaaa

SEQ ID NO: 1891 - DNA, 20 bp, Artificial Sequence
  chemically synthesized
aatgtgatttacgctcattg

SEQ ID NO: 1892 - DNA, 20 bp, Artificial Sequence
  chemically synthesized
gatttacgctcattgtagaa

SEQ ID NO: 1893 - DNA, 20 bp, Artificial Sequence
  chemically synthesized
ctataaaatgaatacaatta

SEQ ID NO: 1894 - DNA, 20 bp, Artificial Sequence
  chemically synthesized
aattaaagctgttatttaat

SEQ ID NO: 1895 - DNA, 20 bp, Artificial Sequence
  chemically synthesized
aaagctgttatttaattagc

SEQ ID NO: 1896 - DNA, 20 bp, Artificial Sequence
  chemically synthesized
acaacttgtctattacctgt

SEQ ID NO: 1897 - DNA, 20 bp, Artificial Sequence
  chemically synthesized
tatactgcatgattttattg

SEQ ID NO: 1898 - DNA, 20 bp, Artificial Sequence
  chemically synthesized
acttaatcgctttgtcattt

SEQ ID NO: 1899 - DNA, 20 bp, Artificial Sequence
  chemically synthesized
ttaatcgctttgtcattttg

SEQ ID NO: 1900 - DNA, 20 bp, Artificial Sequence
  chemically synthesized
tttctttacattttgtctta

SEQ ID NO: 1901 - DNA, 20 bp, Artificial Sequence
  chemically synthesized
ggaatattttcattcaactg

SEQ ID NO: 1902 - DNA, 20 bp, Artificial Sequence
  chemically synthesized
atattttcattcaactgtgg

SEQ ID NO: 1903 - DNA, 20 bp, Artificial Sequence
  chemically synthesized
ttaatcgtgtttcttcactc

SEQ ID NO: 1904 - DNA, 20 bp, Artificial Sequence
  chemically synthesized
taatcgtgtttcttcactct

SEQ ID NO: 1905 - DNA, 20 bp, Artificial Sequence
  chemically synthesized
aatcgtgtttcttcactcta

SEQ ID NO: 1906 - DNA, 20 bp, Artificial Sequence
  chemically synthesized
ctctagggacattgtcgtct

SEQ ID NO: 1907 - DNA, 20 bp, Artificial Sequence
  chemically synthesized
gacattgtcgtctaagttgt

SEQ ID NO: 1908 - DNA, 20 bp, Artificial Sequence
  chemically synthesized
tcgtctaagttgtaagacat

SEQ ID NO: 1909 - DNA, 20 bp, Artificial Sequence
  chemically synthesized
taagacattggttattttac

SEQ ID NO: 1910 - DNA, 20 bp, Artificial Sequence
  chemically synthesized
ttaccagcaaaccattctga

SEQ ID NO: 1911 - DNA, 20 bp, Artificial Sequence
  chemically synthesized
ttaatatcttactatactga

SEQ ID NO: 1912 - DNA, 20 bp, Artificial Sequence
  chemically synthesized
atatcttactatactgaaag

SEQ ID NO: 1913 - DNA, 20 bp, Artificial Sequence
  chemically synthesized
tactgaaagcagactgctat

SEQ ID NO: 1914 - DNA, 20 bp, Artificial Sequence
  chemically synthesized
actgaaagcagactgctata

SEQ ID NO: 1915 - DNA, 20 bp, Artificial Sequence
  chemically synthesized
cacttactcttctacctcat

SEQ ID NO: 1916 - DNA, 20 bp, Artificial Sequence
  chemically synthesized
acttactcttctacctcata

SEQ ID NO: 1917 - DNA, 20 bp, Artificial Sequence
  chemically synthesized
atatgttacaattaatttat

SEQ ID NO: 1918 - DNA, 20 bp, Artificial Sequence
  chemically synthesized
tatgttacaattaatttatt

SEQ ID NO: 1919 - DNA, 20 bp, Artificial Sequence
  chemically synthesized
ttacaattaatttattaggt

SEQ ID NO: 1920 - DNA, 20 bp, Artificial Sequence
  chemically synthesized
ggtaagcatttgttttatat

SEQ ID NO: 1921 - DNA, 20 bp, Artificial Sequence
  chemically synthesized
tatattggttttatttcacc

SEQ ID NO: 1922 - DNA, 20 bp, Artificial Sequence
  chemically synthesized
atattggttttatttcacct

SEQ ID NO: 1923 - DNA, 20 bp, Artificial Sequence
  chemically synthesized
ggttttatttcacctgggct

SEQ ID NO: 1924 - DNA, 20 bp, Artificial Sequence
  chemically synthesized
ttcacctgggctgagatttc

SEQ ID NO: 1925 - DNA, 20 bp, Artificial Sequence
  chemically synthesized
tgagatttcaagaaacaccc

SEQ ID NO: 1926 - DNA, 20 bp, Artificial Sequence
  chemically synthesized
aagaaacaccccagtcttca

SEQ ID NO: 1927 - DNA, 20 bp, Artificial Sequence
  chemically synthesized
ctaacacatttactaaacat

SEQ ID NO: 1928 - DNA, 20 bp, Artificial Sequence
  chemically synthesized
ttactaaacatcagcaactg

SEQ ID NO: 1929 - DNA, 20 bp, Artificial Sequence
  chemically synthesized
tggcctgttaatttttttaa

SEQ ID NO: 1930 - DNA, 20 bp, Artificial Sequence
  chemically synthesized
atttttttaatagaaatttt

SEQ ID NO: 1931 - DNA, 20 bp, Artificial Sequence
  chemically synthesized
tttaagtcctcattttcttt

SEQ ID NO: 1932 - DNA, 20 bp, Artificial Sequence
  chemically synthesized
attttctttcggtgtttttt

SEQ ID NO: 1933 - DNA, 20 bp, Artificial Sequence
  chemically synthesized
ttttttaagcttaatttttc

SEQ ID NO: 1934 - DNA, 20 bp, Artificial Sequence
  chemically synthesized
ggctttattcataaattctt

SEQ ID NO: 1935 - DNA, 20 bp, Artificial Sequence
  chemically synthesized
gctttattcataaattctta

SEQ ID NO: 1936 - DNA, 20 bp, Artificial Sequence
  chemically synthesized
caactacatttgaaaaatca

SEQ ID NO: 1937 - DNA, 20 bp, Artificial Sequence
  chemically synthesized
tttaaattcttattcacctc

SEQ ID NO: 1938 - DNA, 20 bp, Artificial Sequence
  chemically synthesized
gcaaaaccattcacaaacca

SEQ ID NO: 1939 - DNA, 20 bp, Artificial Sequence
  chemically synthesized
aaaccattcacaaaccatgg

SEQ ID NO: 1940 - DNA, 20 bp, Artificial Sequence
  chemically synthesized
attcacaaaccatggtagta

SEQ ID NO: 1941 - DNA, 20 bp, Artificial Sequence
  chemically synthesized
tcacaaaccatggtagtaaa

SEQ ID NO: 1942 - DNA, 20 bp, Artificial Sequence
  chemically synthesized
caaaccatggtagtaaagag

SEQ ID NO: 1943 - DNA, 20 bp, Artificial Sequence
  chemically synthesized
aaaccatggtagtaaagaga

SEQ ID NO: 1944 - DNA, 20 bp, Artificial Sequence
  chemically synthesized
aaccatggtagtaaagagaa

SEQ ID NO: 1945 - DNA, 20 bp, Artificial Sequence
  chemically synthesized
gtaaagagaagggtgacacc

SEQ ID NO: 1946 - DNA, 20 bp, Artificial Sequence
  chemically synthesized
aagagaagggtgacacctgg

SEQ ID NO: 1947 - DNA, 20 bp, Artificial Sequence
  chemically synthesized
agggtgacacctggtggcca

SEQ ID NO: 1948 - DNA, 20 bp, Artificial Sequence
  chemically synthesized
gggtgacacctggtggccat

SEQ ID NO: 1949 - DNA, 20 bp, Artificial Sequence
  chemically synthesized
ggccataggtaaatgtacca

SEQ ID NO: 1950 - DNA, 20 bp, Artificial Sequence
  chemically synthesized
cataggtaaatgtaccacgg

SEQ ID NO: 1951 - DNA, 20 bp, Artificial Sequence
  chemically synthesized
gtaaatgtaccacggtggtc

SEQ ID NO: 1952 - DNA, 20 bp, Artificial Sequence
  chemically synthesized
taccacggtggtccggtgac

SEQ ID NO: 1953 - DNA, 20 bp, Artificial Sequence
  chemically synthesized
ccacggtggtccggtgacca

SEQ ID NO: 1954 - DNA, 20 bp, Artificial Sequence
  chemically synthesized
tggtccggtgaccagagatg

SEQ ID NO: 1955 - DNA, 20 bp, Artificial Sequence
  chemically synthesized
gtgaccagagatgcagcgct

SEQ ID NO: 1956 - DNA, 20 bp, Artificial Sequence
  chemically synthesized
tgaccagagatgcagcgctg

SEQ ID NO: 1957 - DNA, 20 bp, Artificial Sequence
  chemically synthesized
gaccagagatgcagcgctga

SEQ ID NO: 1958 - DNA, 20 bp, Artificial Sequence
  chemically synthesized
cagcgctgagggttttcctg

SEQ ID NO: 1959 - DNA, 20 bp, Artificial Sequence
  chemically synthesized
agcgctgagggttttcctga

SEQ ID NO: 1960 - DNA, 20 bp, Artificial Sequence
  chemically synthesized
tgagggttttcctgaaggta

SEQ ID NO: 1961 - DNA, 20 bp, Artificial Sequence
  chemically synthesized
gagggttttcctgaaggtaa

SEQ ID NO: 1962 - DNA, 20 bp, Artificial Sequence
  chemically synthesized
ttcctgaaggtaaaggaata

SEQ ID NO: 1963 - DNA, 20 bp, Artificial Sequence
  chemically synthesized
gaaggtaaaggaataaagaa

SEQ ID NO: 1964 - DNA, 20 bp, Artificial Sequence
  chemically synthesized
aaggtaaaggaataaagaat

SEQ ID NO: 1965 - DNA, 20 bp, Artificial Sequence
  chemically synthesized
gtaaaggaataaagaatggg

SEQ ID NO: 1966 - DNA, 20 bp, Artificial Sequence
  chemically synthesized
aaaggaataaagaatgggtg

SEQ ID NO: 1967 - DNA, 20 bp, Artificial Sequence
  chemically synthesized
aaggaataaagaatgggtgg

SEQ ID NO: 1968 - DNA, 20 bp, Artificial Sequence
  chemically synthesized
aggaataaagaatgggtgga

SEQ ID NO: 1969 - DNA, 20 bp, Artificial Sequence
  chemically synthesized
ggaataaagaatgggtggag

SEQ ID NO: 1970 - DNA, 20 bp, Artificial Sequence
  chemically synthesized
atgggtggaggggcgtgcac

SEQ ID NO: 1971 - DNA, 20 bp, Artificial Sequence
  chemically synthesized
cgtgcactggaaatcacttg

SEQ ID NO: 1972 - DNA, 20 bp, Artificial Sequence
  chemically synthesized
tgcactggaaatcacttgta

SEQ ID NO: 1973 - DNA, 20 bp, Artificial Sequence
  chemically synthesized
tggaaatcacttgtagagaa

SEQ ID NO: 1974 - DNA, 20 bp, Artificial Sequence
  chemically synthesized
agaaaagcccctgaaaattt

SEQ ID NO: 1975 - DNA, 20 bp, Artificial Sequence
  chemically synthesized
gaaaatttgagaaaacaaac

SEQ ID NO: 1976 - DNA, 20 bp, Artificial Sequence
  chemically synthesized
acaaacaagaaactacttac

SEQ ID NO: 1977 - DNA, 20 bp, Artificial Sequence
  chemically synthesized
ttaccagctatttgaattgc

SEQ ID NO: 1978 - DNA, 20 bp, Artificial Sequence
  chemically synthesized
tatttgaattgctggaatca

SEQ ID NO: 1979 - DNA, 20 bp, Artificial Sequence
  chemically synthesized
atttgaattgctggaatcac

SEQ ID NO: 1980 - DNA, 20 bp, Artificial Sequence
  chemically synthesized
tggaatcacaggccattgct

SEQ ID NO: 1981 - DNA, 20 bp, Artificial Sequence
  chemically synthesized
cattgctgagctgcctgaac

SEQ ID NO: 1982 - DNA, 20 bp, Artificial Sequence
  chemically synthesized
attgctgagctgcctgaact

SEQ ID NO: 1983 - DNA, 20 bp, Artificial Sequence
  chemically synthesized
tgcctgaactgggaacacaa

SEQ ID NO: 1984 - DNA, 20 bp, Artificial Sequence
  chemically synthesized
ctgaactgggaacacaacag

SEQ ID NO: 1985 - DNA, 20 bp, Artificial Sequence
  chemically synthesized
tgaactgggaacacaacaga

SEQ ID NO: 1986 - DNA, 20 bp, Artificial Sequence
  chemically synthesized
aaaccactctgataatcatt

SEQ ID NO: 1987 - DNA, 20 bp, Artificial Sequence
  chemically synthesized
actctgataatcattgagtc

SEQ ID NO: 1988 - DNA, 20 bp, Artificial Sequence
  chemically synthesized
gataatcattgagtcaagta

SEQ ID NO: 1989 - DNA, 20 bp, Artificial Sequence
  chemically synthesized
aatcattgagtcaagtacag

SEQ ID NO: 1990 - DNA, 20 bp, Artificial Sequence
  chemically synthesized
atcattgagtcaagtacagc

SEQ ID NO: 1991 - DNA, 20 bp, Artificial Sequence
  chemically synthesized
gtcaagtacagcaggtgatt

SEQ ID NO: 1992 - DNA, 20 bp, Artificial Sequence
  chemically synthesized
tcaagtacagcaggtgattg

SEQ ID NO: 1993 - DNA, 20 bp, Artificial Sequence
  chemically synthesized
gcaggtgattgaggactgct

SEQ ID NO: 1994 - DNA, 20 bp, Artificial Sequence
  chemically synthesized
aggtgattgaggactgctga

SEQ ID NO: 1995 - DNA, 20 bp, Artificial Sequence
  chemically synthesized
ggtgattgaggactgctgag

SEQ ID NO: 1996 - DNA, 20 bp, Artificial Sequence
  chemically synthesized
ttgaggactgctgagaggta

SEQ ID NO: 1997 - DNA, 20 bp, Artificial Sequence
  chemically synthesized
tgaggactgctgagaggtac

SEQ ID NO: 1998 - DNA, 20 bp, Artificial Sequence
  chemically synthesized
atgtcatcttataatactgt

SEQ ID NO: 1999 - DNA, 20 bp, Artificial Sequence
  chemically synthesized
ccccaaatttttcataaact

SEQ ID NO: 2000 - DNA, 20 bp, Artificial Sequence
  chemically synthesized
tatttctgactttcaaatta

SEQ ID NO: 2001 - DNA, 20 bp, Artificial Sequence
  chemically synthesized
aaattaaagattttcacatg

SEQ ID NO: 2002 - DNA, 20 bp, Artificial Sequence
  chemically synthesized
aattaaagattttcacatgc

SEQ ID NO: 2003 - DNA, 20 bp, Artificial Sequence
  chemically synthesized
tgtaattgtgattctctctg

SEQ ID NO: 2004 - DNA, 20 bp, Artificial Sequence
  chemically synthesized
gtaattgtgattctctctgt

SEQ ID NO: 2005 - DNA, 20 bp, Artificial Sequence
  chemically synthesized
gtgattctctctgtaggctt

SEQ ID NO: 2006 - DNA, 20 bp, Artificial Sequence
  chemically synthesized
tgattctctctgtaggcttt

SEQ ID NO: 2007 - DNA, 20 bp, Artificial Sequence
  chemically synthesized
gttcttttccttttttgcat

SEQ ID NO: 2008 - DNA, 20 bp, Artificial Sequence
  chemically synthesized
aacttctacactctaacatg

SEQ ID NO: 2009 - DNA, 20 bp, Artificial Sequence
  chemically synthesized
agaatgttactacaatatta

SEQ ID NO: 2010 - DNA, 20 bp, Artificial Sequence
  chemically synthesized
tgtatgacaattttatttga

SEQ ID NO: 2011 - DNA, 20 bp, Artificial Sequence
  chemically synthesized
gacaattttatttgaaagcc

SEQ ID NO: 2012 - DNA, 20 bp, Artificial Sequence
  chemically synthesized
acaattttatttgaaagcct

SEQ ID NO: 2013 - DNA, 20 bp, Artificial Sequence
  chemically synthesized
tacttgatatgcatgcattc

SEQ ID NO: 2014 - DNA, 20 bp, Artificial Sequence
  chemically synthesized
tgcatgcattctggtatctc

SEQ ID NO: 2015 - DNA, 20 bp, Artificial Sequence
  chemically synthesized
atctcaagcattctatttct

SEQ ID NO: 2016 - DNA, 20 bp, Artificial Sequence
  chemically synthesized
ctatttctgagtaattgttt

SEQ ID NO: 2017 - DNA, 20 bp, Artificial Sequence
  chemically synthesized
tatttctgagtaattgttta

SEQ ID NO: 2018 - DNA, 20 bp, Artificial Sequence
  chemically synthesized
ctgagtaattgtttaaggtg

SEQ ID NO: 2019 - DNA, 20 bp, Artificial Sequence
  chemically synthesized
agtaattgtttaaggtgtag

SEQ ID NO: 2020 - DNA, 20 bp, Artificial Sequence
  chemically synthesized
taattgtttaaggtgtagaa

SEQ ID NO: 2021 - DNA, 20 bp, Artificial Sequence
  chemically synthesized
tgtttaaggtgtagaagaga

SEQ ID NO: 2022 - DNA, 20 bp, Artificial Sequence
  chemically synthesized
aggtgtagaagagatagata

SEQ ID NO: 2023 - DNA, 20 bp, Artificial Sequence
  chemically synthesized
tgtagaagagatagatatgg

SEQ ID NO: 2024 - DNA, 20 bp, Artificial Sequence
  chemically synthesized
agagatagatatggtggatt

SEQ ID NO: 2025 - DNA, 20 bp, Artificial Sequence
  chemically synthesized
agatagatatggtggatttg

SEQ ID NO: 2026 - DNA, 20 bp, Artificial Sequence
  chemically synthesized
cttatatattttctatttct

SEQ ID NO: 2027 - DNA, 20 bp, Artificial Sequence
  chemically synthesized
tatattttctatttcttgga

SEQ ID NO: 2028 - DNA, 20 bp, Artificial Sequence
  chemically synthesized
tggatgaatttgtacattaa

SEQ ID NO: 2029 - DNA, 20 bp, Artificial Sequence
  chemically synthesized
tgtacattaaaagttttcca

SEQ ID NO: 2030 - DNA, 20 bp, Artificial Sequence
  chemically synthesized
acattaaaagttttccatgg

SEQ ID NO: 2031 - DNA, 20 bp, Artificial Sequence
  chemically synthesized
tttcaaaaactttttttttc

SEQ ID NO: 2032 - DNA, 20 bp, Artificial Sequence
  chemically synthesized
ttcaaaaactttttttttcc

SEQ ID NO: 2033 - DNA, 20 bp, Artificial Sequence
  chemically synthesized
aaaactttttttttccggga

SEQ ID NO: 2034 - DNA, 20 bp, Artificial Sequence
  chemically synthesized
tttttttccgggatggattg

SEQ ID NO: 2035 - DNA, 20 bp, Artificial Sequence
  chemically synthesized
ttttttccgggatggattga

SEQ ID NO: 2036 - DNA, 20 bp, Artificial Sequence
  chemically synthesized
cacaatgcaatatattaatg

SEQ ID NO: 2037 - DNA, 20 bp, Artificial Sequence
  chemically synthesized
ccatgaatatatataatctt

SEQ ID NO: 2038 - DNA, 20 bp, Artificial Sequence
  chemically synthesized
taatcttaagaaaatttttt

SEQ ID NO: 2039 - DNA, 20 bp, Artificial Sequence
  chemically synthesized
agccaattattattacttac

SEQ ID NO: 2040 - DNA, 20 bp, Artificial Sequence
  chemically synthesized
tattattacttactagatat

SEQ ID NO: 2041 - DNA, 20 bp, Artificial Sequence
  chemically synthesized
attattacttactagatatt

SEQ ID NO: 2042 - DNA, 20 bp, Artificial Sequence
  chemically synthesized
atcttaatttaattcctcca

SEQ ID NO: 2043 - DNA, 20 bp, Artificial Sequence
  chemically synthesized
attcctccaaagaatcttat

SEQ ID NO: 2044 - DNA, 20 bp, Artificial Sequence
  chemically synthesized
ttcctccaaagaatcttatg

SEQ ID NO: 2045 - DNA, 20 bp, Artificial Sequence
  chemically synthesized
ctccaaagaatcttatgagg

SEQ ID NO: 2046 - DNA, 20 bp, Artificial Sequence
  chemically synthesized
tccaaagaatcttatgaggt

SEQ ID NO: 2047 - DNA, 20 bp, Artificial Sequence
  chemically synthesized
aaagaatcttatgaggtagg

SEQ ID NO: 2048 - DNA, 20 bp, Artificial Sequence
  chemically synthesized
aagaatcttatgaggtaggt

SEQ ID NO: 2049 - DNA, 20 bp, Artificial Sequence
  chemically synthesized
gaatcttatgaggtaggtag

SEQ ID NO: 2050 - DNA, 20 bp, Artificial Sequence
  chemically synthesized
tatgttgctgttatgaaacc

SEQ ID NO: 2051 - DNA, 20 bp, Artificial Sequence
  chemically synthesized
atgttgctgttatgaaacca

SEQ ID NO: 2052 - DNA, 20 bp, Artificial Sequence
  chemically synthesized
gctgttatgaaaccaaggca

SEQ ID NO: 2053 - DNA, 20 bp, Artificial Sequence
  chemically synthesized
tgttatgaaaccaaggcaca

SEQ ID NO: 2054 - DNA, 20 bp, Artificial Sequence
  chemically synthesized
ttatgaaaccaaggcacaga

SEQ ID NO: 2055 - DNA, 20 bp, Artificial Sequence
  chemically synthesized
tatgaaaccaaggcacagag

SEQ ID NO: 2056 - DNA, 20 bp, Artificial Sequence
  chemically synthesized
aaaccaaggcacagagaggt

SEQ ID NO: 2057 - DNA, 20 bp, Artificial Sequence
  chemically synthesized
agaggttagttaacttgctg

SEQ ID NO: 2058 - DNA, 20 bp, Artificial Sequence
  chemically synthesized
tgctgaagaaaatgatgtgc

SEQ ID NO: 2059 - DNA, 20 bp, Artificial Sequence
  chemically synthesized
gatgtgctggatttttattc

SEQ ID NO: 2060 - DNA, 20 bp, Artificial Sequence
  chemically synthesized
gatttttattctagctattc

SEQ ID NO: 2061 - DNA, 20 bp, Artificial Sequence
  chemically synthesized
aactacacaaccttatgtct

SEQ ID NO: 2062 - DNA, 20 bp, Artificial Sequence
  chemically synthesized
cacaaccttatgtctgagcc

SEQ ID NO: 2063 - DNA, 20 bp, Artificial Sequence
  chemically synthesized
acaaccttatgtctgagcca

SEQ ID NO: 2064 - DNA, 20 bp, Artificial Sequence
  chemically synthesized
gtctgagccaaggaaacata

SEQ ID NO: 2065 - DNA, 20 bp, Artificial Sequence
  chemically synthesized
agccaaggaaacatacggtg

SEQ ID NO: 2066 - DNA, 20 bp, Artificial Sequence
  chemically synthesized
ggaaacatacggtgtggcaa

SEQ ID NO: 2067 - DNA, 20 bp, Artificial Sequence
  chemically synthesized
ggcaacagttaccatgtttt

SEQ ID NO: 2068 - DNA, 20 bp, Artificial Sequence
  chemically synthesized
gcaacagttaccatgttttt

SEQ ID NO: 2069 - DNA, 20 bp, Artificial Sequence
  chemically synthesized
agttaccatgtttttaggaa

SEQ ID NO: 2070 - DNA, 20 bp, Artificial Sequence
  chemically synthesized
taccatgtttttaggaacag

SEQ ID NO: 2071 - DNA, 20 bp, Artificial Sequence
  chemically synthesized
agcactcctaatgtttgctg

SEQ ID NO: 2072 - DNA, 20 bp, Artificial Sequence
  chemically synthesized
gcactcctaatgtttgctgc

SEQ ID NO: 2073 - DNA, 20 bp, Artificial Sequence
  chemically synthesized
cactcctaatgtttgctgca

SEQ ID NO: 2074 - DNA, 20 bp, Artificial Sequence
  chemically synthesized
taatgtttgctgcagggaaa

SEQ ID NO: 2075 - DNA, 20 bp, Artificial Sequence
  chemically synthesized
aatgtttgctgcagggaaaa

SEQ ID NO: 2076 - DNA, 20 bp, Artificial Sequence
  chemically synthesized
ctgcagggaaaaaggaatct

SEQ ID NO: 2077 - DNA, 20 bp, Artificial Sequence
  chemically synthesized
aaatattttgaaatatcttt

SEQ ID NO: 2078 - DNA, 20 bp, Artificial Sequence
  chemically synthesized
tcagatgtattttaaaattt

SEQ ID NO: 2079 - DNA, 20 bp, Artificial Sequence
  chemically synthesized
cagatgtattttaaaattta

SEQ ID NO: 2080 - DNA, 20 bp, Artificial Sequence
  chemically synthesized
aaatttaaggatattttgtt

SEQ ID NO: 2081 - DNA, 20 bp, Artificial Sequence
  chemically synthesized
gatattttgttcagttcata

SEQ ID NO: 2082 - DNA, 20 bp, Artificial Sequence
  chemically synthesized
agaatttttttttttttctc

SEQ ID NO: 2083 - DNA, 20 bp, Artificial Sequence
  chemically synthesized
tttttttttttttctcgaga

SEQ ID NO: 2084 - DNA, 20 bp, Artificial Sequence
  chemically synthesized
tttttttttttctcgagatg

SEQ ID NO: 2085 - DNA, 20 bp, Artificial Sequence
  chemically synthesized
tggagtctcactctatcacc

SEQ ID NO: 2086 - DNA, 20 bp, Artificial Sequence
  chemically synthesized
ggagtctcactctatcaccc

SEQ ID NO: 2087 - DNA, 20 bp, Artificial Sequence
  chemically synthesized
tctcactctatcacccaggc

SEQ ID NO: 2088 - DNA, 20 bp, Artificial Sequence
  chemically synthesized
ctatcacccaggctggaatg

SEQ ID NO: 2089 - DNA, 20 bp, Artificial Sequence
  chemically synthesized
tcacccaggctggaatgcag

SEQ ID NO: 2090 - DNA, 20 bp, Artificial Sequence
  chemically synthesized
ggaatgcagtggcatgatct

SEQ ID NO: 2091 - DNA, 20 bp, Artificial Sequence
  chemically synthesized
tcactgcaacctctgcctcc

SEQ ID NO: 2092 - DNA, 20 bp, Artificial Sequence
  chemically synthesized
cactgcaacctctgcctcct

SEQ ID NO: 2093 - DNA, 20 bp, Artificial Sequence
  chemically synthesized
aacctctgcctcctgggttc

SEQ ID NO: 2094 - DNA, 20 bp, Artificial Sequence
  chemically synthesized
ttcaagcaattttcctgcct

SEQ ID NO: 2095 - DNA, 20 bp, Artificial Sequence
  chemically synthesized
ttttcctgcctcagcctccc

SEQ ID NO: 2096 - DNA, 20 bp, Artificial Sequence
  chemically synthesized
tcctgcctcagcctcccaag

SEQ ID NO: 2097 - DNA, 20 bp, Artificial Sequence
  chemically synthesized
cctcagcctcccaagtggct

SEQ ID NO: 2098 - DNA, 20 bp, Artificial Sequence
  chemically synthesized
ctcccaagtggctgagacta

SEQ ID NO: 2099 - DNA, 20 bp, Artificial Sequence
  chemically synthesized
tcccaagtggctgagactac

SEQ ID NO: 2100 - DNA, 20 bp, Artificial Sequence
  chemically synthesized
caggcgcatgccaccatgca

SEQ ID NO: 2101 - DNA, 20 bp, Artificial Sequence
  chemically synthesized
gctaattttttttgtatttt

SEQ ID NO: 2102 - DNA, 20 bp, Artificial Sequence
  chemically synthesized
aattttttttgtatttttag

SEQ ID NO: 2103 - DNA, 20 bp, Artificial Sequence
  chemically synthesized
ttttttttgtatttttagta

SEQ ID NO: 2104 - DNA, 20 bp, Artificial Sequence
  chemically synthesized
ttttgtatttttagtagaga

SEQ ID NO: 2105 - DNA, 20 bp, Artificial Sequence
  chemically synthesized
ttgtatttttagtagagatg

SEQ ID NO: 2106 - DNA, 20 bp, Artificial Sequence
  chemically synthesized
gagatggagtttcaccatgt

SEQ ID NO: 2107 - DNA, 20 bp, Artificial Sequence
  chemically synthesized
tggagtttcaccatgttggc

SEQ ID NO: 2108 - DNA, 20 bp, Artificial Sequence
  chemically synthesized
ggagtttcaccatgttggcc

SEQ ID NO: 2109 - DNA, 20 bp, Artificial Sequence
  chemically synthesized
tttcaccatgttggccaggc

SEQ ID NO: 2110 - DNA, 20 bp, Artificial Sequence
  chemically synthesized
ctcaaatgatccgccctttt

SEQ ID NO: 2111 - DNA, 20 bp, Artificial Sequence
  chemically synthesized
ccgccctttttggcctccca

SEQ ID NO: 2112 - DNA, 20 bp, Artificial Sequence
  chemically synthesized
tttttggcctcccaaagtgc

SEQ ID NO: 2113 - DNA, 20 bp, Artificial Sequence
  chemically synthesized
ttttggcctcccaaagtgct

SEQ ID NO: 2114 - DNA, 20 bp, Artificial Sequence
  chemically synthesized
ctcccaaagtgctgggatta

SEQ ID NO: 2115 - DNA, 20 bp, Artificial Sequence
  chemically synthesized
tcccaaagtgctgggattac

SEQ ID NO: 2116 - DNA, 20 bp, Artificial Sequence
  chemically synthesized
agtgctgggattacaggcgt

SEQ ID NO: 2117 - DNA, 20 bp, Artificial Sequence
  chemically synthesized
caggcgtgagctaccgcgcc

SEQ ID NO: 2118 - DNA, 20 bp, Artificial Sequence
  chemically synthesized
taacttgttttgttgttgtt

SEQ ID NO: 2119 - DNA, 20 bp, Artificial Sequence
  chemically synthesized
ttgttttgttgttgttgaga

SEQ ID NO: 2120 - DNA, 20 bp, Artificial Sequence
  chemically synthesized
tgttttgttgttgttgagac

SEQ ID NO: 2121 - DNA, 20 bp, Artificial Sequence
  chemically synthesized
gttttgttgttgttgagaca

SEQ ID NO: 2122 - DNA, 20 bp, Artificial Sequence
  chemically synthesized
ttgttgttgagacagggtct

SEQ ID NO: 2123 - DNA, 20 bp, Artificial Sequence
  chemically synthesized
cagggtctcagtctgacacc

SEQ ID NO: 2124 - DNA, 20 bp, Artificial Sequence
  chemically synthesized
agggtctcagtctgacacca

SEQ ID NO: 2125 - DNA, 20 bp, Artificial Sequence
  chemically synthesized
tctcagtctgacaccaaggc

SEQ ID NO: 2126 - DNA, 20 bp, Artificial Sequence
  chemically synthesized
ctgacaccaaggctggtgtg

SEQ ID NO: 2127 - DNA, 20 bp, Artificial Sequence
  chemically synthesized
ggtgtgcagtactgcgatca

SEQ ID NO: 2128 - DNA, 20 bp, Artificial Sequence
  chemically synthesized
actgcgatcacggctcactg

SEQ ID NO: 2129 - DNA, 20 bp, Artificial Sequence
  chemically synthesized
cactgcagtctcgacctcct

SEQ ID NO: 2130 - DNA, 20 bp, Artificial Sequence
  chemically synthesized
agtctcgacctcctgagctc

SEQ ID NO: 2131 - DNA, 20 bp, Artificial Sequence
  chemically synthesized
ctcaagtgatcctcccacct

SEQ ID NO: 2132 - DNA, 20 bp, Artificial Sequence
  chemically synthesized
tcctcccacctcagcctact

SEQ ID NO: 2133 - DNA, 20 bp, Artificial Sequence
  chemically synthesized
tcccacctcagcctactgag

SEQ ID NO: 2134 - DNA, 20 bp, Artificial Sequence
  chemically synthesized
acctcagcctactgagtagc

SEQ ID NO: 2135 - DNA, 20 bp, Artificial Sequence
  chemically synthesized
cctcagcctactgagtagct

SEQ ID NO: 2136 - DNA, 20 bp, Artificial Sequence
  chemically synthesized
gtagctgggaccaccacgcc

SEQ ID NO: 2137 - DNA, 20 bp, Artificial Sequence
  chemically synthesized
ttttctattatttattgaaa

SEQ ID NO: 2138 - DNA, 20 bp, Artificial Sequence
  chemically synthesized
tttctattatttattgaaac

SEQ ID NO: 2139 - DNA, 20 bp, Artificial Sequence
  chemically synthesized
ttatttattgaaacgggttc

SEQ ID NO: 2140 - DNA, 20 bp, Artificial Sequence
  chemically synthesized
cgggttctggctatgttgcc

SEQ ID NO: 2141 - DNA, 20 bp, Artificial Sequence
  chemically synthesized
gggttctggctatgttgccc

SEQ ID NO: 2142 - DNA, 20 bp, Artificial Sequence
  chemically synthesized
tctggctatgttgcccaggt

SEQ ID NO: 2143 - DNA, 20 bp, Artificial Sequence
  chemically synthesized
cccaggttggtcttgaactc

SEQ ID NO: 2144 - DNA, 20 bp, Artificial Sequence
  chemically synthesized
caggttggtcttgaactccg

SEQ ID NO: 2145 - DNA, 20 bp, Artificial Sequence
  chemically synthesized
ctcatgcgatccacccacct

SEQ ID NO: 2146 - DNA, 20 bp, Artificial Sequence
  chemically synthesized
ccacccacctcagcgtccga

SEQ ID NO: 2147 - DNA, 20 bp, Artificial Sequence
  chemically synthesized
cacccacctcagcgtccgaa

SEQ ID NO: 2148 - DNA, 20 bp, Artificial Sequence
  chemically synthesized
tcagcgtccgaaaggattat

SEQ ID NO: 2149 - DNA, 20 bp, Artificial Sequence
  chemically synthesized
cagcgtccgaaaggattatc

SEQ ID NO: 2150 - DNA, 20 bp, Artificial Sequence
  chemically synthesized
gcgtccgaaaggattatcag

SEQ ID NO: 2151 - DNA, 20 bp, Artificial Sequence
  chemically synthesized
ccgaaaggattatcaggagt

SEQ ID NO: 2152 - DNA, 20 bp, Artificial Sequence
  chemically synthesized
caggagtgagccaccgtgcc

SEQ ID NO: 2153 - DNA, 20 bp, Artificial Sequence
  chemically synthesized
catttattctctttatcatt

SEQ ID NO: 2154 - DNA, 20 bp, Artificial Sequence
  chemically synthesized
atttattctctttatcattc

SEQ ID NO: 2155 - DNA, 20 bp, Artificial Sequence
  chemically synthesized
tttattctctttatcattca

SEQ ID NO: 2156 - DNA, 20 bp, Artificial Sequence
  chemically synthesized
tattctctttatcattcagg

SEQ ID NO: 2157 - DNA, 20 bp, Artificial Sequence
  chemically synthesized
ttatcattcagggagaaatt

SEQ ID NO: 2158 - DNA, 20 bp, Artificial Sequence
  chemically synthesized
tatcattcagggagaaattt

SEQ ID NO: 2159 - DNA, 20 bp, Artificial Sequence
  chemically synthesized
atcattcagggagaaatttg

SEQ ID NO: 2160 - DNA, 20 bp, Artificial Sequence
  chemically synthesized
ttcagggagaaatttgggga

SEQ ID NO: 2161 - DNA, 20 bp, Artificial Sequence
  chemically synthesized
gggagaaatttggggatgga

SEQ ID NO: 2162 - DNA, 20 bp, Artificial Sequence
  chemically synthesized
tttggggatggatagccttg

SEQ ID NO: 2163 - DNA, 20 bp, Artificial Sequence
  chemically synthesized
gccttgaagcatcatccacc

SEQ ID NO: 2164 - DNA, 20 bp, Artificial Sequence
  chemically synthesized
caccaagttattttatacac

SEQ ID NO: 2165 - DNA, 20 bp, Artificial Sequence
  chemically synthesized
gttattttatacaccagatt

SEQ ID NO: 2166 - DNA, 20 bp, Artificial Sequence
  chemically synthesized
atacaccagatttagataca

SEQ ID NO: 2167 - DNA, 20 bp, Artificial Sequence
  chemically synthesized
tatttaaaaaaatcaaattc

SEQ ID NO: 2168 - DNA, 20 bp, Artificial Sequence
  chemically synthesized
aaattctagcttttactctg

SEQ ID NO: 2169 - DNA, 20 bp, Artificial Sequence
  chemically synthesized
tttactctgaagattctaaa

SEQ ID NO: 2170 - DNA, 20 bp, Artificial Sequence
  chemically synthesized
gaagattctaaaaagaattt

SEQ ID NO: 2171 - DNA, 20 bp, Artificial Sequence
  chemically synthesized
agattctaaaaagaattttg

SEQ ID NO: 2172 - DNA, 20 bp, Artificial Sequence
  chemically synthesized
ggagtctttaattcatactt

SEQ ID NO: 2173 - DNA, 20 bp, Artificial Sequence
  chemically synthesized
gagtctttaattcatacttc

SEQ ID NO: 2174 - DNA, 20 bp, Artificial Sequence
  chemically synthesized
agtctttaattcatacttca

SEQ ID NO: 2175 - DNA, 20 bp, Artificial Sequence
  chemically synthesized
gtctttaattcatacttcag

SEQ ID NO: 2176 - DNA, 20 bp, Artificial Sequence
  chemically synthesized
tttaattcatacttcagggg

SEQ ID NO: 2177 - DNA, 20 bp, Artificial Sequence
  chemically synthesized
ttaattcatacttcaggggc

SEQ ID NO: 2178 - DNA, 20 bp, Artificial Sequence
  chemically synthesized
taattcatacttcaggggca

SEQ ID NO: 2179 - DNA, 20 bp, Artificial Sequence
  chemically synthesized
aattcatacttcaggggcag

SEQ ID NO: 2180 - DNA, 20 bp, Artificial Sequence
  chemically synthesized
tacttcaggggcaggggaat

SEQ ID NO: 2181 - DNA, 20 bp, Artificial Sequence
  chemically synthesized
accaatattcgtataacttt

SEQ ID NO: 2182 - DNA, 20 bp, Artificial Sequence
  chemically synthesized
attcgtataactttcagtgc

SEQ ID NO: 2183 - DNA, 20 bp, Artificial Sequence
  chemically synthesized
actttcagtgcaagtcacgt

SEQ ID NO: 2184 - DNA, 20 bp, Artificial Sequence
  chemically synthesized
caagtcacgttagctaactg

SEQ ID NO: 2185 - DNA, 20 bp, Artificial Sequence
  chemically synthesized
ttagctaactgtagtctatt

SEQ ID NO: 2186 - DNA, 20 bp, Artificial Sequence
  chemically synthesized
ttgatttattccttaaaact

SEQ ID NO: 2187 - DNA, 20 bp, Artificial Sequence
  chemically synthesized
ttaaaactgagtcactatga

SEQ ID NO: 2188 - DNA, 20 bp, Artificial Sequence
  chemically synthesized
cttttttgtttttttttttc

SEQ ID NO: 2189 - DNA, 20 bp, Artificial Sequence
  chemically synthesized
tttgtttttttttttcgaga

SEQ ID NO: 2190 - DNA, 20 bp, Artificial Sequence
  chemically synthesized
tgtttttttttttcgagacg

SEQ ID NO: 2191 - DNA, 20 bp, Artificial Sequence
  chemically synthesized
acggagctcgccctgtctcc

SEQ ID NO: 2192 - DNA, 20 bp, Artificial Sequence
  chemically synthesized
cggagctcgccctgtctccc

SEQ ID NO: 2193 - DNA, 20 bp, Artificial Sequence
  chemically synthesized
gctcgccctgtctcccaggc

SEQ ID NO: 2194 - DNA, 20 bp, Artificial Sequence
  chemically synthesized
tcgccctgtctcccaggctg

SEQ ID NO: 2195 - DNA, 20 bp, Artificial Sequence
  chemically synthesized
ctgtctcccaggctggagtg

SEQ ID NO: 2196 - DNA, 20 bp, Artificial Sequence
  chemically synthesized
tctcccaggctggagtgcgg

SEQ ID NO: 2197 - DNA, 20 bp, Artificial Sequence
  chemically synthesized
ggagtgcggtggtgcgatct

SEQ ID NO: 2198 - DNA, 20 bp, Artificial Sequence
  chemically synthesized
tcactgcaatctccgcctcc

SEQ ID NO: 2199 - DNA, 20 bp, Artificial Sequence
  chemically synthesized
cactgcaatctccgcctccc

SEQ ID NO: 2200 - DNA, 20 bp, Artificial Sequence
  chemically synthesized
aatctccgcctcccaggttc

SEQ ID NO: 2201 - DNA, 20 bp, Artificial Sequence
  chemically synthesized
ttcaagcgattctcctgccc

SEQ ID NO: 2202 - DNA, 20 bp, Artificial Sequence
  chemically synthesized
ttctcctgccccagcctcct

SEQ ID NO: 2203 - DNA, 20 bp, Artificial Sequence
  chemically synthesized
tcctgccccagcctcctgag

SEQ ID NO: 2204 - DNA, 20 bp, Artificial Sequence
  chemically synthesized
gccccagcctcctgagtagc

SEQ ID NO: 2205 - DNA, 20 bp, Artificial Sequence
  chemically synthesized
ccccagcctcctgagtagct

SEQ ID NO: 2206 - DNA, 20 bp, Artificial Sequence
  chemically synthesized
ctcctgagtagctgggacta

SEQ ID NO: 2207 - DNA, 20 bp, Artificial Sequence
  chemically synthesized
tcctgagtagctgggactac

SEQ ID NO: 2208 - DNA, 20 bp, Artificial Sequence
  chemically synthesized
caggcacacaccaccacgcc

SEQ ID NO: 2209 - DNA, 20 bp, Artificial Sequence
  chemically synthesized
ccagctaatgtttgtatttt

SEQ ID NO: 2210 - DNA, 20 bp, Artificial Sequence
  chemically synthesized
gctaatgtttgtatttttag

SEQ ID NO: 2211 - DNA, 20 bp, Artificial Sequence
  chemically synthesized
taatgtttgtatttttagta

SEQ ID NO: 2212 - DNA, 20 bp, Artificial Sequence
  chemically synthesized
gtttgtatttttagtagaga

SEQ ID NO: 2213 - DNA, 20 bp, Artificial Sequence
  chemically synthesized
tttgtatttttagtagagac

SEQ ID NO: 2214 - DNA, 20 bp, Artificial Sequence
  chemically synthesized
ttgtatttttagtagagaca

SEQ ID NO: 2215 - DNA, 20 bp, Artificial Sequence
  chemically synthesized
gagacagggtttcatcattt

SEQ ID NO: 2216 - DNA, 20 bp, Artificial Sequence
  chemically synthesized
cagggtttcatcattttggt

SEQ ID NO: 2217 - DNA, 20 bp, Artificial Sequence
  chemically synthesized
agggtttcatcattttggtc

SEQ ID NO: 2218 - DNA, 20 bp, Artificial Sequence
  chemically synthesized
tttcatcattttggtcaggc

SEQ ID NO: 2219 - DNA, 20 bp, Artificial Sequence
  chemically synthesized
tgaactcctgacctcgtgat

SEQ ID NO: 2220 - DNA, 20 bp, Artificial Sequence
  chemically synthesized
cagcctgcctcgacctccca

SEQ ID NO: 2221 - DNA, 20 bp, Artificial Sequence
  chemically synthesized
gcctcgacctcccaaagtgc

SEQ ID NO: 2222 - DNA, 20 bp, Artificial Sequence
  chemically synthesized
cctcgacctcccaaagtgct

SEQ ID NO: 2223 - DNA, 20 bp, Artificial Sequence
  chemically synthesized
ctcccaaagtgctgggatta

SEQ ID NO: 2224 - DNA, 20 bp, Artificial Sequence
  chemically synthesized
agtgctgggattacagtcat

SEQ ID NO: 2225 - DNA, 20 bp, Artificial Sequence
  chemically synthesized
cagtcatgagccactgcacc

SEQ ID NO: 2226 - DNA, 20 bp, Artificial Sequence
  chemically synthesized
agccactgcacccggctgaa

SEQ ID NO: 2227 - DNA, 20 bp, Artificial Sequence
  chemically synthesized
tgaatggcactttcataaaa

SEQ ID NO: 2228 - DNA, 20 bp, Artificial Sequence
  chemically synthesized
ccaacttcactactgccccc

SEQ ID NO: 2229 - DNA, 20 bp, Artificial Sequence
  chemically synthesized
aacttcactactgcccccaa

SEQ ID NO: 2230 - DNA, 20 bp, Artificial Sequence
  chemically synthesized
aagagttttactatgtatat

SEQ ID NO: 2231 - DNA, 20 bp, Artificial Sequence
  chemically synthesized
agagttttactatgtatatg

SEQ ID NO: 2232 - DNA, 20 bp, Artificial Sequence
  chemically synthesized
gagttttactatgtatatga

SEQ ID NO: 2233 - DNA, 20 bp, Artificial Sequence
  chemically synthesized
tatatgagggcatctgtttt

SEQ ID NO: 2234 - DNA, 20 bp, Artificial Sequence
  chemically synthesized
gagggcatctgttttaagta

SEQ ID NO: 2235 - DNA, 20 bp, Artificial Sequence
  chemically synthesized
agggcatctgttttaagtat

SEQ ID NO: 2236 - DNA, 20 bp, Artificial Sequence
  chemically synthesized
taagtatgggtataatgtta

SEQ ID NO: 2237 - DNA, 20 bp, Artificial Sequence
  chemically synthesized
aagtatgggtataatgttac

SEQ ID NO: 2238 - DNA, 20 bp, Artificial Sequence
  chemically synthesized
ttacgggtttttctttgtgt

SEQ ID NO: 2239 - DNA, 20 bp, Artificial Sequence
  chemically synthesized
ggtttttctttgtgtaagtt

SEQ ID NO: 2240 - DNA, 20 bp, Artificial Sequence
  chemically synthesized
gtttttctttgtgtaagttt

SEQ ID NO: 2241 - DNA, 20 bp, Artificial Sequence
  chemically synthesized
tgtgctttctgtgtgctatt

SEQ ID NO: 2242 - DNA, 20 bp, Artificial Sequence
  chemically synthesized
ctttctgtgtgctattaaga

SEQ ID NO: 2243 - DNA, 20 bp, Artificial Sequence
  chemically synthesized
gtgctattaagaaagtattc

SEQ ID NO: 2244 - DNA, 20 bp, Artificial Sequence
  chemically synthesized
tgctattaagaaagtattca

SEQ ID NO: 2245 - DNA, 20 bp, Artificial Sequence
  chemically synthesized
gctattaagaaagtattcaa

SEQ ID NO: 2246 - DNA, 20 bp, Artificial Sequence
  chemically synthesized
aatttttgaaacaaatgttt

SEQ ID NO: 2247 - DNA, 20 bp, Artificial Sequence
  chemically synthesized
tttttgaaacaaatgtttaa

SEQ ID NO: 2248 - DNA, 20 bp, Artificial Sequence
  chemically synthesized
tttgaaacaaatgtttaaga

SEQ ID NO: 2249 - DNA, 20 bp, Artificial Sequence
  chemically synthesized
ttgaaacaaatgtttaagag

SEQ ID NO: 2250 - DNA, 20 bp, Artificial Sequence
  chemically synthesized
tgtttaagagaggataatgt

SEQ ID NO: 2251 - DNA, 20 bp, Artificial Sequence
  chemically synthesized
aatgttagaaattatctttc

SEQ ID NO: 2252 - DNA, 20 bp, Artificial Sequence
  chemically synthesized
ttagaaattatctttccagc

SEQ ID NO: 2253 - DNA, 20 bp, Artificial Sequence
  chemically synthesized
attatctttccagccagacc

SEQ ID NO: 2254 - DNA, 20 bp, Artificial Sequence
  chemically synthesized
atctttccagccagacctgg

SEQ ID NO: 2255 - DNA, 20 bp, Artificial Sequence
  chemically synthesized
ccagacctggtggctcacgc

SEQ ID NO: 2256 - DNA, 20 bp, Artificial Sequence
  chemically synthesized
gtggctcacgccagtaatcc

SEQ ID NO: 2257 - DNA, 20 bp, Artificial Sequence
  chemically synthesized
cgccagtaatcctagcattt

SEQ ID NO: 2258 - DNA, 20 bp, Artificial Sequence
  chemically synthesized
gccagtaatcctagcatttt

SEQ ID NO: 2259 - DNA, 20 bp, Artificial Sequence
  chemically synthesized
cagtaatcctagcattttgg

SEQ ID NO: 2260 - DNA, 20 bp, Artificial Sequence
  chemically synthesized
agtaatcctagcattttggg

SEQ ID NO: 2261 - DNA, 20 bp, Artificial Sequence
  chemically synthesized
tcctagcattttgggaggac

SEQ ID NO: 2262 - DNA, 20 bp, Artificial Sequence
  chemically synthesized
cctagcattttgggaggaca

SEQ ID NO: 2263 - DNA, 20 bp, Artificial Sequence
  chemically synthesized
agcattttgggaggacaagg

SEQ ID NO: 2264 - DNA, 20 bp, Artificial Sequence
  chemically synthesized
gcattttgggaggacaaggt

SEQ ID NO: 2265 - DNA, 20 bp, Artificial Sequence
  chemically synthesized
ttttgggaggacaaggtggg

SEQ ID NO: 2266 - DNA, 20 bp, Artificial Sequence
  chemically synthesized
acaaggtgggcagatcactt

SEQ ID NO: 2267 - DNA, 20 bp, Artificial Sequence
  chemically synthesized
gtgggcagatcacttaagcc

SEQ ID NO: 2268 - DNA, 20 bp, Artificial Sequence
  chemically synthesized
tgggcagatcacttaagccc

SEQ ID NO: 2269 - DNA, 20 bp, Artificial Sequence
  chemically synthesized
tcacttaagcccaggaattc

SEQ ID NO: 2270 - DNA, 20 bp, Artificial Sequence
  chemically synthesized
taagcccaggaattcaagac

SEQ ID NO: 2271 - DNA, 20 bp, Artificial Sequence
  chemically synthesized
ccaggaattcaagaccagcc

SEQ ID NO: 2272 - DNA, 20 bp, Artificial Sequence
  chemically synthesized
caagaccagcctggacaaca

SEQ ID NO: 2273 - DNA, 20 bp, Artificial Sequence
  chemically synthesized
aagaccagcctggacaacac

SEQ ID NO: 2274 - DNA, 20 bp, Artificial Sequence
  chemically synthesized
agaccagcctggacaacaca

SEQ ID NO: 2275 - DNA, 20 bp, Artificial Sequence
  chemically synthesized
cagcctggacaacacaggga

SEQ ID NO: 2276 - DNA, 20 bp, Artificial Sequence
  chemically synthesized
ctctacaaaatatacaaaat

SEQ ID NO: 2277 - DNA, 20 bp, Artificial Sequence
  chemically synthesized
tacaaaatatacaaaattag

SEQ ID NO: 2278 - DNA, 20 bp, Artificial Sequence
  chemically synthesized
aatatacaaaattagtggcc

SEQ ID NO: 2279 - DNA, 20 bp, Artificial Sequence
  chemically synthesized
acaaaattagtggccgagcg

SEQ ID NO: 2280 - DNA, 20 bp, Artificial Sequence
  chemically synthesized
aaattagtggccgagcgtgg

SEQ ID NO: 2281 - DNA, 20 bp, Artificial Sequence
  chemically synthesized
gtggctcacgcctgtaatcc

SEQ ID NO: 2282 - DNA, 20 bp, Artificial Sequence
  chemically synthesized
cgcctgtaatcccagcactt

SEQ ID NO: 2283 - DNA, 20 bp, Artificial Sequence
  chemically synthesized
gcctgtaatcccagcacttt

SEQ ID NO: 2284 - DNA, 20 bp, Artificial Sequence
  chemically synthesized
ctgtaatcccagcactttgg

SEQ ID NO: 2285 - DNA, 20 bp, Artificial Sequence
  chemically synthesized
tgtaatcccagcactttggg

SEQ ID NO: 2286 - DNA, 20 bp, Artificial Sequence
  chemically synthesized
tcccagcactttgggaggcc

SEQ ID NO: 2287 - DNA, 20 bp, Artificial Sequence
  chemically synthesized
cccagcactttgggaggccg

SEQ ID NO: 2288 - DNA, 20 bp, Artificial Sequence
  chemically synthesized
agcactttgggaggccgagg

SEQ ID NO: 2289 - DNA, 20 bp, Artificial Sequence
  chemically synthesized
gcactttgggaggccgaggc

SEQ ID NO: 2290 - DNA, 20 bp, Artificial Sequence
  chemically synthesized
ctttgggaggccgaggcggg

SEQ ID NO: 2291 - DNA, 20 bp, Artificial Sequence
  chemically synthesized
ccgaggcgggcagatcacct

SEQ ID NO: 2292 - DNA, 20 bp, Artificial Sequence
  chemically synthesized
cgaggcgggcagatcacctg

SEQ ID NO: 2293 - DNA, 20 bp, Artificial Sequence
  chemically synthesized
gcgggcagatcacctgaggt

SEQ ID NO: 2294 - DNA, 20 bp, Artificial Sequence
  chemically synthesized
cgggcagatcacctgaggtc

SEQ ID NO: 2295 - DNA, 20 bp, Artificial Sequence
  chemically synthesized
ggcagatcacctgaggtcag

SEQ ID NO: 2296 - DNA, 20 bp, Artificial Sequence
  chemically synthesized
tcacctgaggtcaggagttc

SEQ ID NO: 2297 - DNA, 20 bp, Artificial Sequence
  chemically synthesized
tgaggtcaggagttccagac

SEQ ID NO: 2298 - DNA, 20 bp, Artificial Sequence
  chemically synthesized
gttccagaccagcctcaaca

SEQ ID NO: 2299 - DNA, 20 bp, Artificial Sequence
  chemically synthesized
tccagaccagcctcaacatg

SEQ ID NO: 2300 - DNA, 20 bp, Artificial Sequence
  chemically synthesized
ctctactaaaaatacaaaat

SEQ ID NO: 2301 - DNA, 20 bp, Artificial Sequence
  chemically synthesized
actaaaaatacaaaattagc

SEQ ID NO: 2302 - DNA, 20 bp, Artificial Sequence
  chemically synthesized
ctaaaaatacaaaattagct

SEQ ID NO: 2303 - DNA, 20 bp, Artificial Sequence
  chemically synthesized
aatacaaaattagctgggcg

SEQ ID NO: 2304 - DNA, 20 bp, Artificial Sequence
  chemically synthesized
gtgatgcatgcctgtaatcc

SEQ ID NO: 2305 - DNA, 20 bp, Artificial Sequence
  chemically synthesized
tgcctgtaatcccagctact

SEQ ID NO: 2306 - DNA, 20 bp, Artificial Sequence
  chemically synthesized
gcctgtaatcccagctactc

SEQ ID NO: 2307 - DNA, 20 bp, Artificial Sequence
  chemically synthesized
ctgtaatcccagctactcgg

SEQ ID NO: 2308 - DNA, 20 bp, Artificial Sequence
  chemically synthesized
tgtaatcccagctactcggg

SEQ ID NO: 2309 - DNA, 20 bp, Artificial Sequence
  chemically synthesized
tcccagctactcgggaggct

SEQ ID NO: 2310 - DNA, 20 bp, Artificial Sequence
  chemically synthesized
cccagctactcgggaggctg

SEQ ID NO: 2311 - DNA, 20 bp, Artificial Sequence
  chemically synthesized
agctactcgggaggctgagg

SEQ ID NO: 2312 - DNA, 20 bp, Artificial Sequence
  chemically synthesized
gctactcgggaggctgaggc

SEQ ID NO: 2313 - DNA, 20 bp, Artificial Sequence
  chemically synthesized
tactcgggaggctgaggcag

SEQ ID NO: 2314 - DNA, 20 bp, Artificial Sequence
  chemically synthesized
gcaggagaattgcttgaacc

SEQ ID NO: 2315 - DNA, 20 bp, Artificial Sequence
  chemically synthesized
caggagaattgcttgaacct

SEQ ID NO: 2316 - DNA, 20 bp, Artificial Sequence
  chemically synthesized
ggagaattgcttgaacctgg

SEQ ID NO: 2317 - DNA, 20 bp, Artificial Sequence
  chemically synthesized
gagaattgcttgaacctggg

SEQ ID NO: 2318 - DNA, 20 bp, Artificial Sequence
  chemically synthesized
aattgcttgaacctgggagg

SEQ ID NO: 2319 - DNA, 20 bp, Artificial Sequence
  chemically synthesized
ttgcttgaacctgggaggta

SEQ ID NO: 2320 - DNA, 20 bp, Artificial Sequence
  chemically synthesized
tgcttgaacctgggaggtag

SEQ ID NO: 2321 - DNA, 20 bp, Artificial Sequence
  chemically synthesized
aacctgggaggtagaggttg

SEQ ID NO: 2322 - DNA, 20 bp, Artificial Sequence
  chemically synthesized
tgggaggtagaggttgcggt

SEQ ID NO: 2323 - DNA, 20 bp, Artificial Sequence
  chemically synthesized
ggtagaggttgcggtgagcc

SEQ ID NO: 2324 - DNA, 20 bp, Artificial Sequence
  chemically synthesized
gagatcccgccattgcactc

SEQ ID NO: 2325 - DNA, 20 bp, Artificial Sequence
  chemically synthesized
cccgccattgcactccagcc

SEQ ID NO: 2326 - DNA, 20 bp, Artificial Sequence
  chemically synthesized
ccgccattgcactccagcct

SEQ ID NO: 2327 - DNA, 20 bp, Artificial Sequence
  chemically synthesized
tgcactccagcctgggcaac

SEQ ID NO: 2328 - DNA, 20 bp, Artificial Sequence
  chemically synthesized
cactccagcctgggcaacaa

SEQ ID NO: 2329 - DNA, 20 bp, Artificial Sequence
  chemically synthesized
aacaaacaaataaacaaaat

SEQ ID NO: 2330 - DNA, 20 bp, Artificial Sequence
  chemically synthesized
aacaaataaacaaaattagt

SEQ ID NO: 2331 - DNA, 20 bp, Artificial Sequence
  chemically synthesized
acaaataaacaaaattagtc

SEQ ID NO: 2332 - DNA, 20 bp, Artificial Sequence
  chemically synthesized
taaacaaaattagtcaggtg

SEQ ID NO: 2333 - DNA, 20 bp, Artificial Sequence
  chemically synthesized
ggtgtggttgtgcacacctg

SEQ ID NO: 2334 - DNA, 20 bp, Artificial Sequence
  chemically synthesized
gttgtgcacacctgtagtcc

SEQ ID NO: 2335 - DNA, 20 bp, Artificial Sequence
  chemically synthesized
cacctgtagtcccagctact

SEQ ID NO: 2336 - DNA, 20 bp, Artificial Sequence
  chemically synthesized
acctgtagtcccagctactt

SEQ ID NO: 2337 - DNA, 20 bp, Artificial Sequence
  chemically synthesized
ctgtagtcccagctacttgg

SEQ ID NO: 2338 - DNA, 20 bp, Artificial Sequence
  chemically synthesized
tgtagtcccagctacttggg

SEQ ID NO: 2339 - DNA, 20 bp, Artificial Sequence
  chemically synthesized
tcccagctacttgggaggct

SEQ ID NO: 2340 - DNA, 20 bp, Artificial Sequence
  chemically synthesized
cccagctacttgggaggctg

SEQ ID NO: 2341 - DNA, 20 bp, Artificial Sequence
  chemically synthesized
agctacttgggaggctgagg

SEQ ID NO: 2342 - DNA, 20 bp, Artificial Sequence
  chemically synthesized
gctacttgggaggctgaggt

SEQ ID NO: 2343 - DNA, 20 bp, Artificial Sequence
  chemically synthesized
tacttgggaggctgaggtgg

SEQ ID NO: 2344 - DNA, 20 bp, Artificial Sequence
  chemically synthesized
acttgggaggctgaggtggg

SEQ ID NO: 2345 - DNA, 20 bp, Artificial Sequence
  chemically synthesized
ctgaggtgggaggatcactt

SEQ ID NO: 2346 - DNA, 20 bp, Artificial Sequence
  chemically synthesized
gtgggaggatcacttgagcc

SEQ ID NO: 2347 - DNA, 20 bp, Artificial Sequence
  chemically synthesized
tgggaggatcacttgagccc

SEQ ID NO: 2348 - DNA, 20 bp, Artificial Sequence
  chemically synthesized
gggaggatcacttgagcccg

SEQ ID NO: 2349 - DNA, 20 bp, Artificial Sequence
  chemically synthesized
aggatcacttgagcccgggg

SEQ ID NO: 2350 - DNA, 20 bp, Artificial Sequence
  chemically synthesized
cacttgagcccggggaagtg

SEQ ID NO: 2351 - DNA, 20 bp, Artificial Sequence
  chemically synthesized
acttgagcccggggaagtgt

SEQ ID NO: 2352 - DNA, 20 bp, Artificial Sequence
  chemically synthesized
ggggaagtgtaggctaccat

SEQ ID NO: 2353 - DNA, 20 bp, Artificial Sequence
  chemically synthesized
taggctaccatgagccatca

SEQ ID NO: 2354 - DNA, 20 bp, Artificial Sequence
  chemically synthesized
atcatggtgccactgtactc

SEQ ID NO: 2355 - DNA, 20 bp, Artificial Sequence
  chemically synthesized
ggtgccactgtactccagtc

SEQ ID NO: 2356 - DNA, 20 bp, Artificial Sequence
  chemically synthesized
gtgccactgtactccagtct

SEQ ID NO: 2357 - DNA, 20 bp, Artificial Sequence
  chemically synthesized
aaattttaaaatcttaaaaa

SEQ ID NO: 2358 - DNA, 20 bp, Artificial Sequence
  chemically synthesized
ttaaaatcttaaaaaaagaa

SEQ ID NO: 2359 - DNA, 20 bp, Artificial Sequence
  chemically synthesized
aagaaaagaaattttctgtc

SEQ ID NO: 2360 - DNA, 20 bp, Artificial Sequence
  chemically synthesized
tctttatttttaacaaatcg

SEQ ID NO: 2361 - DNA, 20 bp, Artificial Sequence
  chemically synthesized
aacaaatcgaagtgtattaa

SEQ ID NO: 2362 - DNA, 20 bp, Artificial Sequence
  chemically synthesized
aagtgtattaatagtgttta

SEQ ID NO: 2363 - DNA, 20 bp, Artificial Sequence
  chemically synthesized
agtgtattaatagtgtttat

SEQ ID NO: 2364 - DNA, 20 bp, Artificial Sequence
  chemically synthesized
tgtattaatagtgtttatgg

SEQ ID NO: 2365 - DNA, 20 bp, Artificial Sequence
  chemically synthesized
ttatgggagcgtgcccacac

SEQ ID NO: 2366 - DNA, 20 bp, Artificial Sequence
  chemically synthesized
tatgggagcgtgcccacaca

SEQ ID NO: 2367 - DNA, 20 bp, Artificial Sequence
  chemically synthesized
ggagcgtgcccacacaagga

SEQ ID NO: 2368 - DNA, 20 bp, Artificial Sequence
  chemically synthesized
cgtgcccacacaaggacagc

SEQ ID NO: 2369 - DNA, 20 bp, Artificial Sequence
  chemically synthesized
ccacacaaggacagcaagcc

SEQ ID NO: 2370 - DNA, 20 bp, Artificial Sequence
  chemically synthesized
cacacaaggacagcaagcct

SEQ ID NO: 2371 - DNA, 20 bp, Artificial Sequence
  chemically synthesized
acaaggacagcaagcctagg

SEQ ID NO: 2372 - DNA, 20 bp, Artificial Sequence
  chemically synthesized
acagcaagcctaggaagtgc

SEQ ID NO: 2373 - DNA, 20 bp, Artificial Sequence
  chemically synthesized
aagcctaggaagtgcaagtc

SEQ ID NO: 2374 - DNA, 20 bp, Artificial Sequence
  chemically synthesized
gtgaaataatttaaactgaa

SEQ ID NO: 2375 - DNA, 20 bp, Artificial Sequence
  chemically synthesized
taatttaaactgaaaagaaa

SEQ ID NO: 2376 - DNA, 20 bp, Artificial Sequence
  chemically synthesized
tttaaactgaaaagaaaaag

SEQ ID NO: 2377 - DNA, 20 bp, Artificial Sequence
  chemically synthesized
taaactgaaaagaaaaagca

SEQ ID NO: 2378 - DNA, 20 bp, Artificial Sequence
  chemically synthesized
aaaaagcagagatttttttc

SEQ ID NO: 2379 - DNA, 20 bp, Artificial Sequence
  chemically synthesized
gcagagatttttttctagaa

SEQ ID NO: 2380 - DNA, 20 bp, Artificial Sequence
  chemically synthesized
agatttttttctagaaaagt

SEQ ID NO: 2381 - DNA, 20 bp, Artificial Sequence
  chemically synthesized
gatttttttctagaaaagta

SEQ ID NO: 2382 - DNA, 20 bp, Artificial Sequence
  chemically synthesized
tttttttctagaaaagtaag

SEQ ID NO: 2383 - DNA, 20 bp, Artificial Sequence
  chemically synthesized
ttttctagaaaagtaaggag

SEQ ID NO: 2384 - DNA, 20 bp, Artificial Sequence
  chemically synthesized
ttctagaaaagtaaggagtg

SEQ ID NO: 2385 - DNA, 20 bp, Artificial Sequence
  chemically synthesized
tctagaaaagtaaggagtgg

SEQ ID NO: 2386 - DNA, 20 bp, Artificial Sequence
  chemically synthesized
gtggaggtaaaaaaaaaaca

SEQ ID NO: 2387 - DNA, 20 bp, Artificial Sequence
  chemically synthesized
gaggtaaaaaaaaaacacag

SEQ ID NO: 2388 - DNA, 20 bp, Artificial Sequence
  chemically synthesized
ggtaaaaaaaaaacacagca

SEQ ID NO: 2389 - DNA, 20 bp, Artificial Sequence
  chemically synthesized
aaaaaaacacagcagagaca

SEQ ID NO: 2390 - DNA, 20 bp, Artificial Sequence
  chemically synthesized
aaaaaacacagcagagacac

SEQ ID NO: 2391 - DNA, 20 bp, Artificial Sequence
  chemically synthesized
gcagagacacaggtatgcta

SEQ ID NO: 2392 - DNA, 20 bp, Artificial Sequence
  chemically synthesized
acaggtatgctacggaacca

SEQ ID NO: 2393 - DNA, 20 bp, Artificial Sequence
  chemically synthesized
caggtatgctacggaaccaa

SEQ ID NO: 2394 - DNA, 20 bp, Artificial Sequence
  chemically synthesized
cggaaccaaaggtgtgccaa

SEQ ID NO: 2395 - DNA, 20 bp, Artificial Sequence
  chemically synthesized
aggtgtgccaatggtactga

SEQ ID NO: 2396 - DNA, 20 bp, Artificial Sequence
  chemically synthesized
atggtactgacagtttaatt

SEQ ID NO: 2397 - DNA, 20 bp, Artificial Sequence
  chemically synthesized
taattcagaaaaaaatgaat

SEQ ID NO: 2398 - DNA, 20 bp, Artificial Sequence
  chemically synthesized
gaaaaaaatgaatcagaaaa

SEQ ID NO: 2399 - DNA, 20 bp, Artificial Sequence
  chemically synthesized
gaaaatggatatttttaaat

SEQ ID NO: 2400 - DNA, 20 bp, Artificial Sequence
  chemically synthesized
atggatatttttaaataagt

SEQ ID NO: 2401 - DNA, 20 bp, Artificial Sequence
  chemically synthesized
tggatatttttaaataagtt

SEQ ID NO: 2402 - DNA, 20 bp, Artificial Sequence
  chemically synthesized
aataagttaggttgctgaaa

SEQ ID NO: 2403 - DNA, 20 bp, Artificial Sequence
  chemically synthesized
taagttaggttgctgaaaaa

SEQ ID NO: 2404 - DNA, 20 bp, Artificial Sequence
  chemically synthesized
gttgctgaaaaagagaaatg

SEQ ID NO: 2405 - DNA, 20 bp, Artificial Sequence
  chemically synthesized
ttttttctgaattaaactgt

SEQ ID NO: 2406 - DNA, 20 bp, Artificial Sequence
  chemically synthesized
aattaaactgtcagtaccat

SEQ ID NO: 2407 - DNA, 20 bp, Artificial Sequence
  chemically synthesized
cagtaccattggcacacctt

SEQ ID NO: 2408 - DNA, 20 bp, Artificial Sequence
  chemically synthesized
ttggcacacctttggttccg

SEQ ID NO: 2409 - DNA, 20 bp, Artificial Sequence
  chemically synthesized
acctccactccttacttttc

SEQ ID NO: 2410 - DNA, 20 bp, Artificial Sequence
  chemically synthesized
aaatctctgctttttctttt

SEQ ID NO: 2411 - DNA, 20 bp, Artificial Sequence
  chemically synthesized
agtttaaattatttcacaaa

SEQ ID NO: 2412 - DNA, 20 bp, Artificial Sequence
  chemically synthesized
ttttcttgacttgcacttcc

SEQ ID NO: 2413 - DNA, 20 bp, Artificial Sequence
  chemically synthesized
tttcttgacttgcacttcct

SEQ ID NO: 2414 - DNA, 20 bp, Artificial Sequence
  chemically synthesized
ctaggcttgctgtccttgtg

SEQ ID NO: 2415 - DNA, 20 bp, Artificial Sequence
  chemically synthesized
taggcttgctgtccttgtgt

SEQ ID NO: 2416 - DNA, 20 bp, Artificial Sequence
  chemically synthesized
acttcgatttgttaaaaata

SEQ ID NO: 2417 - DNA, 20 bp, Artificial Sequence
  chemically synthesized
ttgttaaaaataaagatatc

SEQ ID NO: 2418 - DNA, 20 bp, Artificial Sequence
  chemically synthesized
taaaaataaagatatctgga

SEQ ID NO: 2419 - DNA, 20 bp, Artificial Sequence
  chemically synthesized
aaaatttcttttcttttttt

SEQ ID NO: 2420 - DNA, 20 bp, Artificial Sequence
  chemically synthesized
tttaatgtttatttttttcc

SEQ ID NO: 2421 - DNA, 20 bp, Artificial Sequence
  chemically synthesized
tgtttatttttttcctagac

SEQ ID NO: 2422 - DNA, 20 bp, Artificial Sequence
  chemically synthesized
tttatttttttcctagactg

SEQ ID NO: 2423 - DNA, 20 bp, Artificial Sequence
  chemically synthesized
ttttttcctagactggagta

SEQ ID NO: 2424 - DNA, 20 bp, Artificial Sequence
  chemically synthesized
tttcctagactggagtacag

SEQ ID NO: 2425 - DNA, 20 bp, Artificial Sequence
  chemically synthesized
ggagtacagtggcaccatga

SEQ ID NO: 2426 - DNA, 20 bp, Artificial Sequence
  chemically synthesized
agtggcaccatgatggctca

SEQ ID NO: 2427 - DNA, 20 bp, Artificial Sequence
  chemically synthesized
ggcaccatgatggctcatgg

SEQ ID NO: 2428 - DNA, 20 bp, Artificial Sequence
  chemically synthesized
catggtagcctacacttccc

SEQ ID NO: 2429 - DNA, 20 bp, Artificial Sequence
  chemically synthesized
atggtagcctacacttcccc

SEQ ID NO: 2430 - DNA, 20 bp, Artificial Sequence
  chemically synthesized
gcctacacttccccgggctc

SEQ ID NO: 2431 - DNA, 20 bp, Artificial Sequence
  chemically synthesized
ctcaagtgatcctcccacct

SEQ ID NO: 2432 - DNA, 20 bp, Artificial Sequence
  chemically synthesized
tcctcccacctcagcctccc

SEQ ID NO: 2433 - DNA, 20 bp, Artificial Sequence
  chemically synthesized
tcccacctcagcctcccaag

SEQ ID NO: 2434 - DNA, 20 bp, Artificial Sequence
  chemically synthesized
acctcagcctcccaagtagc

SEQ ID NO: 2435 - DNA, 20 bp, Artificial Sequence
  chemically synthesized
cctcagcctcccaagtagct

SEQ ID NO: 2436 - DNA, 20 bp, Artificial Sequence
  chemically synthesized
ctcccaagtagctgggacta

SEQ ID NO: 2437 - DNA, 20 bp, Artificial Sequence
  chemically synthesized
tcccaagtagctgggactac

SEQ ID NO: 2438 - DNA, 20 bp, Artificial Sequence
  chemically synthesized
atttgtttgttttgtttttt

SEQ ID NO: 2439 - DNA, 20 bp, Artificial Sequence
  chemically synthesized
gtttgttttgttttttgaga

SEQ ID NO: 2440 - DNA, 20 bp, Artificial Sequence
  chemically synthesized
ttgttttgttttttgagatg

SEQ ID NO: 2441 - DNA, 20 bp, Artificial Sequence
  chemically synthesized
ggagtttcgctcttgttgcc

SEQ ID NO: 2442 - DNA, 20 bp, Artificial Sequence
  chemically synthesized
gagtttcgctcttgttgccc

SEQ ID NO: 2443 - DNA, 20 bp, Artificial Sequence
  chemically synthesized
ttcgctcttgttgcccaggc

SEQ ID NO: 2444 - DNA, 20 bp, Artificial Sequence
  chemically synthesized
cgctcttgttgcccaggctg

SEQ ID NO: 2445 - DNA, 20 bp, Artificial Sequence
  chemically synthesized
ttgcccaggctggagtgcaa

SEQ ID NO: 2446 - DNA, 20 bp, Artificial Sequence
  chemically synthesized
cccaggctggagtgcaatgg

SEQ ID NO: 2447 - DNA, 20 bp, Artificial Sequence
  chemically synthesized
ccaggctggagtgcaatggc

SEQ ID NO: 2448 - DNA, 20 bp, Artificial Sequence
  chemically synthesized
ggagtgcaatggcgggatct

SEQ ID NO: 2449 - DNA, 20 bp, Artificial Sequence
  chemically synthesized
tcaccgcaacctctacctcc

SEQ ID NO: 2450 - DNA, 20 bp, Artificial Sequence
  chemically synthesized
caccgcaacctctacctccc

SEQ ID NO: 2451 - DNA, 20 bp, Artificial Sequence
  chemically synthesized
aacctctacctcccaggttc

SEQ ID NO: 2452 - DNA, 20 bp, Artificial Sequence
  chemically synthesized
ttcaagcaattctcctgcct

SEQ ID NO: 2453 - DNA, 20 bp, Artificial Sequence
  chemically synthesized
ttctcctgcctcagcctccc

SEQ ID NO: 2454 - DNA, 20 bp, Artificial Sequence
  chemically synthesized
tcctgcctcagcctcccgag

SEQ ID NO: 2455 - DNA, 20 bp, Artificial Sequence
  chemically synthesized
gcctcagcctcccgagtagc

SEQ ID NO: 2456 - DNA, 20 bp, Artificial Sequence
  chemically synthesized
cctcagcctcccgagtagct

SEQ ID NO: 2457 - DNA, 20 bp, Artificial Sequence
  chemically synthesized
ctcccgagtagctgggatta

SEQ ID NO: 2458 - DNA, 20 bp, Artificial Sequence
  chemically synthesized
tcccgagtagctgggattac

SEQ ID NO: 2459 - DNA, 20 bp, Artificial Sequence
  chemically synthesized
caggcatgcatcaccacgcc

SEQ ID NO: 2460 - DNA, 20 bp, Artificial Sequence
  chemically synthesized
cccagctaattttgtatttt

SEQ ID NO: 2461 - DNA, 20 bp, Artificial Sequence
  chemically synthesized
agctaattttgtatttttag

SEQ ID NO: 2462 - DNA, 20 bp, Artificial Sequence
  chemically synthesized
ctaattttgtatttttagta

SEQ ID NO: 2463 - DNA, 20 bp, Artificial Sequence
  chemically synthesized
ttttgtatttttagtagaga

SEQ ID NO: 2464 - DNA, 20 bp, Artificial Sequence
  chemically synthesized
tttgtatttttagtagagac

SEQ ID NO: 2465 - DNA, 20 bp, Artificial Sequence
  chemically synthesized
ttgtatttttagtagagacg

SEQ ID NO: 2466 - DNA, 20 bp, Artificial Sequence
  chemically synthesized
agacggggtttctccatgtt

SEQ ID NO: 2467 - DNA, 20 bp, Artificial Sequence
  chemically synthesized
gacggggtttctccatgttg

SEQ ID NO: 2468 - DNA, 20 bp, Artificial Sequence
  chemically synthesized
gggtttctccatgttgaggc

SEQ ID NO: 2469 - DNA, 20 bp, Artificial Sequence
  chemically synthesized
tctccatgttgaggctggtc

SEQ ID NO: 2470 - DNA, 20 bp, Artificial Sequence
  chemically synthesized
tggtctggaactcctgacct

SEQ ID NO: 2471 - DNA, 20 bp, Artificial Sequence
  chemically synthesized
ggtctggaactcctgacctc

SEQ ID NO: 2472 - DNA, 20 bp, Artificial Sequence
  chemically synthesized
ctcaggtgatctgcccgcct

SEQ ID NO: 2473 - DNA, 20 bp, Artificial Sequence
  chemically synthesized
ctgcccgcctcggcctccca

SEQ ID NO: 2474 - DNA, 20 bp, Artificial Sequence
  chemically synthesized
gcctcggcctcccaaagtgc

SEQ ID NO: 2475 - DNA, 20 bp, Artificial Sequence
  chemically synthesized
cctcggcctcccaaagtgct

SEQ ID NO: 2476 - DNA, 20 bp, Artificial Sequence
  chemically synthesized
ctcccaaagtgctgggatta

SEQ ID NO: 2477 - DNA, 20 bp, Artificial Sequence
  chemically synthesized
tcccaaagtgctgggattac

SEQ ID NO: 2478 - DNA, 20 bp, Artificial Sequence
  chemically synthesized
agtgctgggattacaggcgt

SEQ ID NO: 2479 - DNA, 20 bp, Artificial Sequence
  chemically synthesized
caggcgtgagccaccacgct

SEQ ID NO: 2480 - DNA, 20 bp, Artificial Sequence
  chemically synthesized
cactaattttgtatattttg

SEQ ID NO: 2481 - DNA, 20 bp, Artificial Sequence
  chemically synthesized
ctaattttgtatattttgta

SEQ ID NO: 2482 - DNA, 20 bp, Artificial Sequence
  chemically synthesized
ttttgtatattttgtagaga

SEQ ID NO: 2483 - DNA, 20 bp, Artificial Sequence
  chemically synthesized
tttgtatattttgtagagat

SEQ ID NO: 2484 - DNA, 20 bp, Artificial Sequence
  chemically synthesized
tgggctttccctgtgttgtc

SEQ ID NO: 2485 - DNA, 20 bp, Artificial Sequence
  chemically synthesized
gggctttccctgtgttgtcc

SEQ ID NO: 2486 - DNA, 20 bp, Artificial Sequence
  chemically synthesized
tttccctgtgttgtccaggc

SEQ ID NO: 2487 - DNA, 20 bp, Artificial Sequence
  chemically synthesized
ccaggctggtcttgaattcc

SEQ ID NO: 2488 - DNA, 20 bp, Artificial Sequence
  chemically synthesized
caggctggtcttgaattcct

SEQ ID NO: 2489 - DNA, 20 bp, Artificial Sequence
  chemically synthesized
ggtcttgaattcctgggctt

SEQ ID NO: 2490 - DNA, 20 bp, Artificial Sequence
  chemically synthesized
accttgtcctcccaaaatgc

SEQ ID NO: 2491 - DNA, 20 bp, Artificial Sequence
  chemically synthesized
ccttgtcctcccaaaatgct

SEQ ID NO: 2492 - DNA, 20 bp, Artificial Sequence
  chemically synthesized
tcccaaaatgctaggattac

SEQ ID NO: 2493 - DNA, 20 bp, Artificial Sequence
  chemically synthesized
aatgctaggattactggcgt

SEQ ID NO: 2494 - DNA, 20 bp, Artificial Sequence
  chemically synthesized
ggattactggcgtgagccac

SEQ ID NO: 2495 - DNA, 20 bp, Artificial Sequence
  chemically synthesized
gattactggcgtgagccacc

SEQ ID NO: 2496 - DNA, 20 bp, Artificial Sequence
  chemically synthesized
ctggcgtgagccaccaggtc

SEQ ID NO: 2497 - DNA, 20 bp, Artificial Sequence
  chemically synthesized
cgtgagccaccaggtctggc

SEQ ID NO: 2498 - DNA, 20 bp, Artificial Sequence
  chemically synthesized
agccaccaggtctggctgga

SEQ ID NO: 2499 - DNA, 20 bp, Artificial Sequence
  chemically synthesized
ttcaaaaattttacaaacat

SEQ ID NO: 2500 - DNA, 20 bp, Artificial Sequence
  chemically synthesized
caaaaattttacaaacatga

SEQ ID NO: 2501 - DNA, 20 bp, Artificial Sequence
  chemically synthesized
tcccttgaatactttcttaa

SEQ ID NO: 2502 - DNA, 20 bp, Artificial Sequence
  chemically synthesized
aatactttcttaatagcaca

SEQ ID NO: 2503 - DNA, 20 bp, Artificial Sequence
  chemically synthesized
ctttcttaatagcacacaga

SEQ ID NO: 2504 - DNA, 20 bp, Artificial Sequence
  chemically synthesized
aatagcacacagaaagcaca

SEQ ID NO: 2505 - DNA, 20 bp, Artificial Sequence
  chemically synthesized
tgtgaacccaaacttacaca

SEQ ID NO: 2506 - DNA, 20 bp, Artificial Sequence
  chemically synthesized
cattatacccatacttaaaa

SEQ ID NO: 2507 - DNA, 20 bp, Artificial Sequence
  chemically synthesized
aacagatgccctcatataca

SEQ ID NO: 2508 - DNA, 20 bp, Artificial Sequence
  chemically synthesized
catatacatagtaaaactct

SEQ ID NO: 2509 - DNA, 20 bp, Artificial Sequence
  chemically synthesized
atatacatagtaaaactctt

SEQ ID NO: 2510 - DNA, 20 bp, Artificial Sequence
  chemically synthesized
tatacatagtaaaactcttg

SEQ ID NO: 2511 - DNA, 20 bp, Artificial Sequence
  chemically synthesized
atacatagtaaaactcttgg

SEQ ID NO: 2512 - DNA, 20 bp, Artificial Sequence
  chemically synthesized
catagtaaaactcttggggg

SEQ ID NO: 2513 - DNA, 20 bp, Artificial Sequence
  chemically synthesized
agtaaaactcttgggggcag

SEQ ID NO: 2514 - DNA, 20 bp, Artificial Sequence
  chemically synthesized
aactcttgggggcagtagtg

SEQ ID NO: 2515 - DNA, 20 bp, Artificial Sequence
  chemically synthesized
cttgggggcagtagtgaagt

SEQ ID NO: 2516 - DNA, 20 bp, Artificial Sequence
  chemically synthesized
ggttatttactgttttatga

SEQ ID NO: 2517 - DNA, 20 bp, Artificial Sequence
  chemically synthesized
tgttttatgaaagtgccatt

SEQ ID NO: 2518 - DNA, 20 bp, Artificial Sequence
  chemically synthesized
ttatgaaagtgccattcagc

SEQ ID NO: 2519 - DNA, 20 bp, Artificial Sequence
  chemically synthesized
tatgaaagtgccattcagcc

SEQ ID NO: 2520 - DNA, 20 bp, Artificial Sequence
  chemically synthesized
aagtgccattcagccgggtg

SEQ ID NO: 2521 - DNA, 20 bp, Artificial Sequence
  chemically synthesized
tgccattcagccgggtgcag

SEQ ID NO: 2522 - DNA, 20 bp, Artificial Sequence
  chemically synthesized
gtggctcatgactgtaatcc

SEQ ID NO: 2523 - DNA, 20 bp, Artificial Sequence
  chemically synthesized
tgactgtaatcccagcactt

SEQ ID NO: 2524 - DNA, 20 bp, Artificial Sequence
  chemically synthesized
gactgtaatcccagcacttt

SEQ ID NO: 2525 - DNA, 20 bp, Artificial Sequence
  chemically synthesized
ctgtaatcccagcactttgg

SEQ ID NO: 2526 - DNA, 20 bp, Artificial Sequence
  chemically synthesized
tgtaatcccagcactttggg

SEQ ID NO: 2527 - DNA, 20 bp, Artificial Sequence
  chemically synthesized
tcccagcactttgggaggtc

SEQ ID NO: 2528 - DNA, 20 bp, Artificial Sequence
  chemically synthesized
cccagcactttgggaggtcg

SEQ ID NO: 2529 - DNA, 20 bp, Artificial Sequence
  chemically synthesized
agcactttgggaggtcgagg

SEQ ID NO: 2530 - DNA, 20 bp, Artificial Sequence
  chemically synthesized
gcactttgggaggtcgaggc

SEQ ID NO: 2531 - DNA, 20 bp, Artificial Sequence
  chemically synthesized
ggtcgaggcaggctgatcac

SEQ ID NO: 2532 - DNA, 20 bp, Artificial Sequence
  chemically synthesized
gtcgaggcaggctgatcacg

SEQ ID NO: 2533 - DNA, 20 bp, Artificial Sequence
  chemically synthesized
aggcaggctgatcacgaggt

SEQ ID NO: 2534 - DNA, 20 bp, Artificial Sequence
  chemically synthesized
ggcaggctgatcacgaggtc

SEQ ID NO: 2535 - DNA, 20 bp, Artificial Sequence
  chemically synthesized
caggctgatcacgaggtcag

SEQ ID NO: 2536 - DNA, 20 bp, Artificial Sequence
  chemically synthesized
gatcacgaggtcaggagttc

SEQ ID NO: 2537 - DNA, 20 bp, Artificial Sequence
  chemically synthesized
cgaggtcaggagttcaagac

SEQ ID NO: 2538 - DNA, 20 bp, Artificial Sequence
  chemically synthesized
tctactaaaaatacaaacat

SEQ ID NO: 2539 - DNA, 20 bp, Artificial Sequence
  chemically synthesized
ctaaaaatacaaacattagc

SEQ ID NO: 2540 - DNA, 20 bp, Artificial Sequence
  chemically synthesized
taaaaatacaaacattagct

SEQ ID NO: 2541 - DNA, 20 bp, Artificial Sequence
  chemically synthesized
atacaaacattagctgggcg

SEQ ID NO: 2542 - DNA, 20 bp, Artificial Sequence
  chemically synthesized
caaacattagctgggcgtgg

SEQ ID NO: 2543 - DNA, 20 bp, Artificial Sequence
  chemically synthesized
ggcgtggtggtgtgtgcctg

SEQ ID NO: 2544 - DNA, 20 bp, Artificial Sequence
  chemically synthesized
gtggtgtgtgcctgtagtcc

SEQ ID NO: 2545 - DNA, 20 bp, Artificial Sequence
  chemically synthesized
tgcctgtagtcccagctact

SEQ ID NO: 2546 - DNA, 20 bp, Artificial Sequence
  chemically synthesized
gcctgtagtcccagctactc

SEQ ID NO: 2547 - DNA, 20 bp, Artificial Sequence
  chemically synthesized
ctgtagtcccagctactcag

SEQ ID NO: 2548 - DNA, 20 bp, Artificial Sequence
  chemically synthesized
tgtagtcccagctactcagg

SEQ ID NO: 2549 - DNA, 20 bp, Artificial Sequence
  chemically synthesized
gtcccagctactcaggaggc

SEQ ID NO: 2550 - DNA, 20 bp, Artificial Sequence
  chemically synthesized
tcccagctactcaggaggct

SEQ ID NO: 2551 - DNA, 20 bp, Artificial Sequence
  chemically synthesized
cccagctactcaggaggctg

SEQ ID NO: 2552 - DNA, 20 bp, Artificial Sequence
  chemically synthesized
agctactcaggaggctgggg

SEQ ID NO: 2553 - DNA, 20 bp, Artificial Sequence
  chemically synthesized
gctactcaggaggctggggc

SEQ ID NO: 2554 - DNA, 20 bp, Artificial Sequence
  chemically synthesized
tactcaggaggctggggcag

SEQ ID NO: 2555 - DNA, 20 bp, Artificial Sequence
  chemically synthesized
gcaggagaatcgcttgaacc

SEQ ID NO: 2556 - DNA, 20 bp, Artificial Sequence
  chemically synthesized
caggagaatcgcttgaacct

SEQ ID NO: 2557 - DNA, 20 bp, Artificial Sequence
  chemically synthesized
ggagaatcgcttgaacctgg

SEQ ID NO: 2558 - DNA, 20 bp, Artificial Sequence
  chemically synthesized
gagaatcgcttgaacctggg

SEQ ID NO: 2559 - DNA, 20 bp, Artificial Sequence
  chemically synthesized
aatcgcttgaacctgggagg

SEQ ID NO: 2560 - DNA, 20 bp, Artificial Sequence
  chemically synthesized
tcgcttgaacctgggaggcg

SEQ ID NO: 2561 - DNA, 20 bp, Artificial Sequence
  chemically synthesized
aacctgggaggcggagattg

SEQ ID NO: 2562 - DNA, 20 bp, Artificial Sequence
  chemically synthesized
tgggaggcggagattgcagt

SEQ ID NO: 2563 - DNA, 20 bp, Artificial Sequence
  chemically synthesized
ggcggagattgcagtgagcc

SEQ ID NO: 2564 - DNA, 20 bp, Artificial Sequence
  chemically synthesized
gagatcgcaccaccgcactc

SEQ ID NO: 2565 - DNA, 20 bp, Artificial Sequence
  chemically synthesized
cgcaccaccgcactccagcc

SEQ ID NO: 2566 - DNA, 20 bp, Artificial Sequence
  chemically synthesized
gcaccaccgcactccagcct

SEQ ID NO: 2567 - DNA, 20 bp, Artificial Sequence
  chemically synthesized
accaccgcactccagcctgg

SEQ ID NO: 2568 - DNA, 20 bp, Artificial Sequence
  chemically synthesized
ccgcactccagcctgggaga

SEQ ID NO: 2569 - DNA, 20 bp, Artificial Sequence
  chemically synthesized
cgcactccagcctgggagac

SEQ ID NO: 2570 - DNA, 20 bp, Artificial Sequence
  chemically synthesized
gcactccagcctgggagaca

SEQ ID NO: 2571 - DNA, 20 bp, Artificial Sequence
  chemically synthesized
tccagcctgggagacagggc

SEQ ID NO: 2572 - DNA, 20 bp, Artificial Sequence
  chemically synthesized
ctcgaaaaaaaaaaacaaaa

SEQ ID NO: 2573 - DNA, 20 bp, Artificial Sequence
  chemically synthesized
aaaacaaaaaagtgccgtca

SEQ ID NO: 2574 - DNA, 20 bp, Artificial Sequence
  chemically synthesized
aaagtgccgtcatagtgact

SEQ ID NO: 2575 - DNA, 20 bp, Artificial Sequence
  chemically synthesized
cgtcatagtgactcagtttt

SEQ ID NO: 2576 - DNA, 20 bp, Artificial Sequence
  chemically synthesized
gtcatagtgactcagtttta

SEQ ID NO: 2577 - DNA, 20 bp, Artificial Sequence
  chemically synthesized
tcagttttaaggaataaatc

SEQ ID NO: 2578 - DNA, 20 bp, Artificial Sequence
  chemically synthesized
cagttttaaggaataaatca

SEQ ID NO: 2579 - DNA, 20 bp, Artificial Sequence
  chemically synthesized
atcaaggatatttaactcaa

SEQ ID NO: 2580 - DNA, 20 bp, Artificial Sequence
  chemically synthesized
atatttaactcaatagacta

SEQ ID NO: 2581 - DNA, 20 bp, Artificial Sequence
  chemically synthesized
ttaactcaatagactacagt

SEQ ID NO: 2582 - DNA, 20 bp, Artificial Sequence
  chemically synthesized
gctaacgtgacttgcactga

SEQ ID NO: 2583 - DNA, 20 bp, Artificial Sequence
  chemically synthesized
actgaaagttatacgaatat

SEQ ID NO: 2584 - DNA, 20 bp, Artificial Sequence
  chemically synthesized
tacttattcccctgcccctg

SEQ ID NO: 2585 - DNA, 20 bp, Artificial Sequence
  chemically synthesized
tgcccctgaagtatgaatta

SEQ ID NO: 2586 - DNA, 20 bp, Artificial Sequence
  chemically synthesized
aaagactccaaaattctttt

SEQ ID NO: 2587 - DNA, 20 bp, Artificial Sequence
  chemically synthesized
aaaattctttttagaatctt

SEQ ID NO: 2588 - DNA, 20 bp, Artificial Sequence
  chemically synthesized
aattctttttagaatcttca

SEQ ID NO: 2589 - DNA, 20 bp, Artificial Sequence
  chemically synthesized
ttttagaatcttcagagtaa

SEQ ID NO: 2590 - DNA, 20 bp, Artificial Sequence
  chemically synthesized
agaatcttcagagtaaaagc

SEQ ID NO: 2591 - DNA, 20 bp, Artificial Sequence
  chemically synthesized
aaatactttgtatctaaatc

SEQ ID NO: 2592 - DNA, 20 bp, Artificial Sequence
  chemically synthesized
atctggtgtataaaataact

SEQ ID NO: 2593 - DNA, 20 bp, Artificial Sequence
  chemically synthesized
tggtgtataaaataacttgg

SEQ ID NO: 2594 - DNA, 20 bp, Artificial Sequence
  chemically synthesized
aacttggtggatgatgcttc

SEQ ID NO: 2595 - DNA, 20 bp, Artificial Sequence
  chemically synthesized
acttggtggatgatgcttca

SEQ ID NO: 2596 - DNA, 20 bp, Artificial Sequence
  chemically synthesized
aaatttctccctgaatgata

SEQ ID NO: 2597 - DNA, 20 bp, Artificial Sequence
  chemically synthesized
atttctccctgaatgataaa

SEQ ID NO: 2598 - DNA, 20 bp, Artificial Sequence
  chemically synthesized
aaatgaatatgtcaattcaa

SEQ ID NO: 2599 - DNA, 20 bp, Artificial Sequence
  chemically synthesized
gaatatgtcaattcaaaagt

SEQ ID NO: 2600 - DNA, 20 bp, Artificial Sequence
  chemically synthesized
caattcaaaagttagaaatt

SEQ ID NO: 2601 - DNA, 20 bp, Artificial Sequence
  chemically synthesized
tcaaaagttagaaatttggc

SEQ ID NO: 2602 - DNA, 20 bp, Artificial Sequence
  chemically synthesized
caaaagttagaaatttggcc

SEQ ID NO: 2603 - DNA, 20 bp, Artificial Sequence
  chemically synthesized
gttagaaatttggccgggca

SEQ ID NO: 2604 - DNA, 20 bp, Artificial Sequence
  chemically synthesized
agaaatttggccgggcacgg

SEQ ID NO: 2605 - DNA, 20 bp, Artificial Sequence
  chemically synthesized
ctcactcctgataatccttt

SEQ ID NO: 2606 - DNA, 20 bp, Artificial Sequence
  chemically synthesized
tgataatcctttcggacgct

SEQ ID NO: 2607 - DNA, 20 bp, Artificial Sequence
  chemically synthesized
gataatcctttcggacgctg

SEQ ID NO: 2608 - DNA, 20 bp, Artificial Sequence
  chemically synthesized
aatcctttcggacgctgagg

SEQ ID NO: 2609 - DNA, 20 bp, Artificial Sequence
  chemically synthesized
atcctttcggacgctgaggt

SEQ ID NO: 2610 - DNA, 20 bp, Artificial Sequence
  chemically synthesized
ctttcggacgctgaggtggg

SEQ ID NO: 2611 - DNA, 20 bp, Artificial Sequence
  chemically synthesized
ctgaggtgggtggatcgcat

SEQ ID NO: 2612 - DNA, 20 bp, Artificial Sequence
  chemically synthesized
tgggtggatcgcatgagctc

SEQ ID NO: 2613 - DNA, 20 bp, Artificial Sequence
  chemically synthesized
ggtggatcgcatgagctccg

SEQ ID NO: 2614 - DNA, 20 bp, Artificial Sequence
  chemically synthesized
tcgcatgagctccggagttc

SEQ ID NO: 2615 - DNA, 20 bp, Artificial Sequence
  chemically synthesized
tccggagttcaagaccaacc

SEQ ID NO: 2616 - DNA, 20 bp, Artificial Sequence
  chemically synthesized
ccggagttcaagaccaacct

SEQ ID NO: 2617 - DNA, 20 bp, Artificial Sequence
  chemically synthesized
caagaccaacctgggcaaca

SEQ ID NO: 2618 - DNA, 20 bp, Artificial Sequence
  chemically synthesized
accaacctgggcaacatagc

SEQ ID NO: 2619 - DNA, 20 bp, Artificial Sequence
  chemically synthesized
gaacccgtttcaataaataa

SEQ ID NO: 2620 - DNA, 20 bp, Artificial Sequence
  chemically synthesized
aataaataatagaaaaaaat

SEQ ID NO: 2621 - DNA, 20 bp, Artificial Sequence
  chemically synthesized
aataatagaaaaaaatgagc

SEQ ID NO: 2622 - DNA, 20 bp, Artificial Sequence
  chemically synthesized
ataatagaaaaaaatgagcc

SEQ ID NO: 2623 - DNA, 20 bp, Artificial Sequence
  chemically synthesized
agaaaaaaatgagccaggcg

SEQ ID NO: 2624 - DNA, 20 bp, Artificial Sequence
  chemically synthesized
aaaaaatgagccaggcgtgg

SEQ ID NO: 2625 - DNA, 20 bp, Artificial Sequence
  chemically synthesized
tgagccaggcgtggtggtcc

SEQ ID NO: 2626 - DNA, 20 bp, Artificial Sequence
  chemically synthesized
gcgtggtggtcccagctact

SEQ ID NO: 2627 - DNA, 20 bp, Artificial Sequence
  chemically synthesized
tggtggtcccagctactcag

SEQ ID NO: 2628 - DNA, 20 bp, Artificial Sequence
  chemically synthesized
ggtggtcccagctactcagt

SEQ ID NO: 2629 - DNA, 20 bp, Artificial Sequence
  chemically synthesized
tcccagctactcagtaggct

SEQ ID NO: 2630 - DNA, 20 bp, Artificial Sequence
  chemically synthesized
cccagctactcagtaggctg

SEQ ID NO: 2631 - DNA, 20 bp, Artificial Sequence
  chemically synthesized
agctactcagtaggctgagg

SEQ ID NO: 2632 - DNA, 20 bp, Artificial Sequence
  chemically synthesized
gctactcagtaggctgaggt

SEQ ID NO: 2633 - DNA, 20 bp, Artificial Sequence
  chemically synthesized
tactcagtaggctgaggtgg

SEQ ID NO: 2634 - DNA, 20 bp, Artificial Sequence
  chemically synthesized
actcagtaggctgaggtggg

SEQ ID NO: 2635 - DNA, 20 bp, Artificial Sequence
  chemically synthesized
ctgaggtgggaggatcactt

SEQ ID NO: 2636 - DNA, 20 bp, Artificial Sequence
  chemically synthesized
gtgggaggatcacttgagct

SEQ ID NO: 2637 - DNA, 20 bp, Artificial Sequence
  chemically synthesized
tgggaggatcacttgagctc

SEQ ID NO: 2638 - DNA, 20 bp, Artificial Sequence
  chemically synthesized
ggaggatcacttgagctcag

SEQ ID NO: 2639 - DNA, 20 bp, Artificial Sequence
  chemically synthesized
gaggatcacttgagctcagg

SEQ ID NO: 2640 - DNA, 20 bp, Artificial Sequence
  chemically synthesized
tcacttgagctcaggaggtc

SEQ ID NO: 2641 - DNA, 20 bp, Artificial Sequence
  chemically synthesized
agctcaggaggtcgagactg

SEQ ID NO: 2642 - DNA, 20 bp, Artificial Sequence
  chemically synthesized
caggaggtcgagactgcagt

SEQ ID NO: 2643 - DNA, 20 bp, Artificial Sequence
  chemically synthesized
actgcagtgagccgtgatcg

SEQ ID NO: 2644 - DNA, 20 bp, Artificial Sequence
  chemically synthesized
gtgatcgcagtactgcacac

SEQ ID NO: 2645 - DNA, 20 bp, Artificial Sequence
  chemically synthesized
gcagtactgcacaccagcct

SEQ ID NO: 2646 - DNA, 20 bp, Artificial Sequence
  chemically synthesized
ctgcacaccagccttggtgt

SEQ ID NO: 2647 - DNA, 20 bp, Artificial Sequence
  chemically synthesized
accagccttggtgtcagact

SEQ ID NO: 2648 - DNA, 20 bp, Artificial Sequence
  chemically synthesized
tgtctcaacaacaacaaaac

SEQ ID NO: 2649 - DNA, 20 bp, Artificial Sequence
  chemically synthesized
tcaacaacaacaaaacaagt

SEQ ID NO: 2650 - DNA, 20 bp, Artificial Sequence
  chemically synthesized
aacaaaacaagttagaaatt

SEQ ID NO: 2651 - DNA, 20 bp, Artificial Sequence
  chemically synthesized
aaacaagttagaaatttggc

SEQ ID NO: 2652 - DNA, 20 bp, Artificial Sequence
  chemically synthesized
aacaagttagaaatttggct

SEQ ID NO: 2653 - DNA, 20 bp, Artificial Sequence
  chemically synthesized
gttagaaatttggctgggcg

SEQ ID NO: 2654 - DNA, 20 bp, Artificial Sequence
  chemically synthesized
agaaatttggctgggcgcgg

SEQ ID NO: 2655 - DNA, 20 bp, Artificial Sequence
  chemically synthesized
gtagctcacgcctgtaatcc

SEQ ID NO: 2656 - DNA, 20 bp, Artificial Sequence
  chemically synthesized
cgcctgtaatcccagcactt

SEQ ID NO: 2657 - DNA, 20 bp, Artificial Sequence
  chemically synthesized
gcctgtaatcccagcacttt

SEQ ID NO: 2658 - DNA, 20 bp, Artificial Sequence
  chemically synthesized
ctgtaatcccagcactttgg

SEQ ID NO: 2659 - DNA, 20 bp, Artificial Sequence
  chemically synthesized
tgtaatcccagcactttggg

SEQ ID NO: 2660 - DNA, 20 bp, Artificial Sequence
  chemically synthesized
cagcactttgggaggccaaa

SEQ ID NO: 2661 - DNA, 20 bp, Artificial Sequence
  chemically synthesized
agcactttgggaggccaaaa

SEQ ID NO: 2662 - DNA, 20 bp, Artificial Sequence
  chemically synthesized
gcactttgggaggccaaaaa

SEQ ID NO: 2663 - DNA, 20 bp, Artificial Sequence
  chemically synthesized
ctttgggaggccaaaaaggg

SEQ ID NO: 2664 - DNA, 20 bp, Artificial Sequence
  chemically synthesized
ccaaaaagggcggatcattt

SEQ ID NO: 2665 - DNA, 20 bp, Artificial Sequence
  chemically synthesized
caaaaagggcggatcatttg

SEQ ID NO: 2666 - DNA, 20 bp, Artificial Sequence
  chemically synthesized
aagggcggatcatttgaggt

SEQ ID NO: 2667 - DNA, 20 bp, Artificial Sequence
  chemically synthesized
agggcggatcatttgaggtc

SEQ ID NO: 2668 - DNA, 20 bp, Artificial Sequence
  chemically synthesized
ggcggatcatttgaggtcag

SEQ ID NO: 2669 - DNA, 20 bp, Artificial Sequence
  chemically synthesized
tcatttgaggtcaggagttc

SEQ ID NO: 2670 - DNA, 20 bp, Artificial Sequence
  chemically synthesized
tgaggtcaggagttcgagac

SEQ ID NO: 2671 - DNA, 20 bp, Artificial Sequence
  chemically synthesized
tcaggagttcgagaccagcc

SEQ ID NO: 2672 - DNA, 20 bp, Artificial Sequence
  chemically synthesized
cgagaccagcctggccaaca

SEQ ID NO: 2673 - DNA, 20 bp, Artificial Sequence
  chemically synthesized
actaaaaatacaaaaaaaat

SEQ ID NO: 2674 - DNA, 20 bp, Artificial Sequence
  chemically synthesized
caaaaaaaattagccgtgca

SEQ ID NO: 2675 - DNA, 20 bp, Artificial Sequence
  chemically synthesized
aaaaaattagccgtgcatgg

SEQ ID NO: 2676 - DNA, 20 bp, Artificial Sequence
  chemically synthesized
tgcatggtggcatgcgcctg

SEQ ID NO: 2677 - DNA, 20 bp, Artificial Sequence
  chemically synthesized
gtggcatgcgcctgtagtct

SEQ ID NO: 2678 - DNA, 20 bp, Artificial Sequence
  chemically synthesized
cgcctgtagtctcagccact

SEQ ID NO: 2679 - DNA, 20 bp, Artificial Sequence
  chemically synthesized
gcctgtagtctcagccactt

SEQ ID NO: 2680 - DNA, 20 bp, Artificial Sequence
  chemically synthesized
ctgtagtctcagccacttgg

SEQ ID NO: 2681 - DNA, 20 bp, Artificial Sequence
  chemically synthesized
tgtagtctcagccacttggg

SEQ ID NO: 2682 - DNA, 20 bp, Artificial Sequence
  chemically synthesized
tctcagccacttgggaggct

SEQ ID NO: 2683 - DNA, 20 bp, Artificial Sequence
  chemically synthesized
ctcagccacttgggaggctg

SEQ ID NO: 2684 - DNA, 20 bp, Artificial Sequence
  chemically synthesized
agccacttgggaggctgagg

SEQ ID NO: 2685 - DNA, 20 bp, Artificial Sequence
  chemically synthesized
gccacttgggaggctgaggc

SEQ ID NO: 2686 - DNA, 20 bp, Artificial Sequence
  chemically synthesized
gcaggaaaattgcttgaacc

SEQ ID NO: 2687 - DNA, 20 bp, Artificial Sequence
  chemically synthesized
caggaaaattgcttgaaccc

SEQ ID NO: 2688 - DNA, 20 bp, Artificial Sequence
  chemically synthesized
ggaaaattgcttgaacccag

SEQ ID NO: 2689 - DNA, 20 bp, Artificial Sequence
  chemically synthesized
gaaaattgcttgaacccagg

SEQ ID NO: 2690 - DNA, 20 bp, Artificial Sequence
  chemically synthesized
aattgcttgaacccaggagg

SEQ ID NO: 2691 - DNA, 20 bp, Artificial Sequence
  chemically synthesized
ttgcttgaacccaggaggca

SEQ ID NO: 2692 - DNA, 20 bp, Artificial Sequence
  chemically synthesized
tgcttgaacccaggaggcag

SEQ ID NO: 2693 - DNA, 20 bp, Artificial Sequence
  chemically synthesized
aacccaggaggcagaggttg

SEQ ID NO: 2694 - DNA, 20 bp, Artificial Sequence
  chemically synthesized
caggaggcagaggttgcagt

SEQ ID NO: 2695 - DNA, 20 bp, Artificial Sequence
  chemically synthesized
ggcagaggttgcagtgagcc

SEQ ID NO: 2696 - DNA, 20 bp, Artificial Sequence
  chemically synthesized
gagatcatgccactgcattc

SEQ ID NO: 2697 - DNA, 20 bp, Artificial Sequence
  chemically synthesized
catgccactgcattccagcc

SEQ ID NO: 2698 - DNA, 20 bp, Artificial Sequence
  chemically synthesized
atgccactgcattccagcct

SEQ ID NO: 2699 - DNA, 20 bp, Artificial Sequence
  chemically synthesized
ctgcattccagcctgggtga

SEQ ID NO: 2700 - DNA, 20 bp, Artificial Sequence
  chemically synthesized
gcattccagcctgggtgata

SEQ ID NO: 2701 - DNA, 20 bp, Artificial Sequence
  chemically synthesized
tccagcctgggtgatagagt

SEQ ID NO: 2702 - DNA, 20 bp, Artificial Sequence
  chemically synthesized
atagagtgagactccatctc

SEQ ID NO: 2703 - DNA, 20 bp, Artificial Sequence
  chemically synthesized
aaattttaaaatacatctga

SEQ ID NO: 2704 - DNA, 20 bp, Artificial Sequence
  chemically synthesized
gaaagatatttcaaaatatt

SEQ ID NO: 2705 - DNA, 20 bp, Artificial Sequence
  chemically synthesized
aaagatatttcaaaatattt

SEQ ID NO: 2706 - DNA, 20 bp, Artificial Sequence
  chemically synthesized
aatatttaggaaaaaaatta

SEQ ID NO: 2707 - DNA, 20 bp, Artificial Sequence
  chemically synthesized
atatttaggaaaaaaattat

SEQ ID NO: 2708 - DNA, 20 bp, Artificial Sequence
  chemically synthesized
tatttaggaaaaaaattata

SEQ ID NO: 2709 - DNA, 20 bp, Artificial Sequence
  chemically synthesized
aggaaaaaaattatagggat

SEQ ID NO: 2710 - DNA, 20 bp, Artificial Sequence
  chemically synthesized
ggaaaaaaattatagggatc

SEQ ID NO: 2711 - DNA, 20 bp, Artificial Sequence
  chemically synthesized
atagggatcaggcaaattct

SEQ ID NO: 2712 - DNA, 20 bp, Artificial Sequence
  chemically synthesized
ctgagattcctttttccctg

SEQ ID NO: 2713 - DNA, 20 bp, Artificial Sequence
  chemically synthesized
tttttccctgcagcaaacat

SEQ ID NO: 2714 - DNA, 20 bp, Artificial Sequence
  chemically synthesized
ttttccctgcagcaaacatt

SEQ ID NO: 2715 - DNA, 20 bp, Artificial Sequence
  chemically synthesized
ttccctgcagcaaacattag

SEQ ID NO: 2716 - DNA, 20 bp, Artificial Sequence
  chemically synthesized
tgctgctgttcctaaaaaca

SEQ ID NO: 2717 - DNA, 20 bp, Artificial Sequence
  chemically synthesized
tgccacaccgtatgtttcct

SEQ ID NO: 2718 - DNA, 20 bp, Artificial Sequence
  chemically synthesized
caccgtatgtttccttggct

SEQ ID NO: 2719 - DNA, 20 bp, Artificial Sequence
  chemically synthesized
tgtttccttggctcagacat

SEQ ID NO: 2720 - DNA, 20 bp, Artificial Sequence
  chemically synthesized
gtttccttggctcagacata

SEQ ID NO: 2721 - DNA, 20 bp, Artificial Sequence
  chemically synthesized
ggctcagacataaggttgtg

SEQ ID NO: 2722 - DNA, 20 bp, Artificial Sequence
  chemically synthesized
aggttgtgtagttgttattc

SEQ ID NO: 2723 - DNA, 20 bp, Artificial Sequence
  chemically synthesized
gtgtagttgttattccagaa

SEQ ID NO: 2724 - DNA, 20 bp, Artificial Sequence
  chemically synthesized
agttgttattccagaatagc

SEQ ID NO: 2725 - DNA, 20 bp, Artificial Sequence
  chemically synthesized
gaatagctagaataaaaatc

SEQ ID NO: 2726 - DNA, 20 bp, Artificial Sequence
  chemically synthesized
atccagcacatcattttctt

SEQ ID NO: 2727 - DNA, 20 bp, Artificial Sequence
  chemically synthesized
agcacatcattttcttcagc

SEQ ID NO: 2728 - DNA, 20 bp, Artificial Sequence
  chemically synthesized
taactaacctctctgtgcct

SEQ ID NO: 2729 - DNA, 20 bp, Artificial Sequence
  chemically synthesized
tctgtgccttggtttcataa

SEQ ID NO: 2730 - DNA, 20 bp, Artificial Sequence
  chemically synthesized
tggtttcataacagcaacat

SEQ ID NO: 2731 - DNA, 20 bp, Artificial Sequence
  chemically synthesized
taacagcaacataagcataa

SEQ ID NO: 2732 - DNA, 20 bp, Artificial Sequence
  chemically synthesized
gcaacataagcataacagaa

SEQ ID NO: 2733 - DNA, 20 bp, Artificial Sequence
  chemically synthesized
acataagcataacagaatag

SEQ ID NO: 2734 - DNA, 20 bp, Artificial Sequence
  chemically synthesized
gcataacagaatagcagcaa

SEQ ID NO: 2735 - DNA, 20 bp, Artificial Sequence
  chemically synthesized
atagctcctacctacctcat

SEQ ID NO: 2736 - DNA, 20 bp, Artificial Sequence
  chemically synthesized
acctacctcataagattctt

SEQ ID NO: 2737 - DNA, 20 bp, Artificial Sequence
  chemically synthesized
ctacctcataagattctttg

SEQ ID NO: 2738 - DNA, 20 bp, Artificial Sequence
  chemically synthesized
tacctcataagattctttgg

SEQ ID NO: 2739 - DNA, 20 bp, Artificial Sequence
  chemically synthesized
ttctttggaggaattaaatt

SEQ ID NO: 2740 - DNA, 20 bp, Artificial Sequence
  chemically synthesized
ggaggaattaaattaagatt

SEQ ID NO: 2741 - DNA, 20 bp, Artificial Sequence
  chemically synthesized
ttaaattaagattcagaaca

SEQ ID NO: 2742 - DNA, 20 bp, Artificial Sequence
  chemically synthesized
tcagaacacagcctaatatc

SEQ ID NO: 2743 - DNA, 20 bp, Artificial Sequence
  chemically synthesized
aacacagcctaatatctagt

SEQ ID NO: 2744 - DNA, 20 bp, Artificial Sequence
  chemically synthesized
atctagtaagtaataataat

SEQ ID NO: 2745 - DNA, 20 bp, Artificial Sequence
  chemically synthesized
ttggctaaaaaaattttctt

SEQ ID NO: 2746 - DNA, 20 bp, Artificial Sequence
  chemically synthesized
cttaagattatatatattca

SEQ ID NO: 2747 - DNA, 20 bp, Artificial Sequence
  chemically synthesized
ttaagattatatatattcat

SEQ ID NO: 2748 - DNA, 20 bp, Artificial Sequence
  chemically synthesized
taagattatatatattcatg

SEQ ID NO: 2749 - DNA, 20 bp, Artificial Sequence
  chemically synthesized
tatatatattcatggggtac

SEQ ID NO: 2750 - DNA, 20 bp, Artificial Sequence
  chemically synthesized
tacattaatatattgcattg

SEQ ID NO: 2751 - DNA, 20 bp, Artificial Sequence
  chemically synthesized
atattgcattgtggtgaaat

SEQ ID NO: 2752 - DNA, 20 bp, Artificial Sequence
  chemically synthesized
tattgcattgtggtgaaatc

SEQ ID NO: 2753 - DNA, 20 bp, Artificial Sequence
  chemically synthesized
attgcattgtggtgaaatca

SEQ ID NO: 2754 - DNA, 20 bp, Artificial Sequence
  chemically synthesized
tcagggccttcaatccatcc

SEQ ID NO: 2755 - DNA, 20 bp, Artificial Sequence
  chemically synthesized
caatccatcccggaaaaaaa

SEQ ID NO: 2756 - DNA, 20 bp, Artificial Sequence
  chemically synthesized
ggaaaaaaaaagtttttgaa

SEQ ID NO: 2757 - DNA, 20 bp, Artificial Sequence
  chemically synthesized
ttttgaaaagatttctgcca

SEQ ID NO: 2758 - DNA, 20 bp, Artificial Sequence
  chemically synthesized
atgtacaaattcatccatcc

SEQ ID NO: 2759 - DNA, 20 bp, Artificial Sequence
  chemically synthesized
aaattcatccatccaagaaa

SEQ ID NO: 2760 - DNA, 20 bp, Artificial Sequence
  chemically synthesized
ccaagaaatagaaaatatat

SEQ ID NO: 2761 - DNA, 20 bp, Artificial Sequence
  chemically synthesized
ctacaccttaaacaattact

SEQ ID NO: 2762 - DNA, 20 bp, Artificial Sequence
  chemically synthesized
cttaaacaattactcagaaa

SEQ ID NO: 2763 - DNA, 20 bp, Artificial Sequence
  chemically synthesized
tactcagaaatagaatgctt

SEQ ID NO: 2764 - DNA, 20 bp, Artificial Sequence
  chemically synthesized
aaatagaatgcttgagatac

SEQ ID NO: 2765 - DNA, 20 bp, Artificial Sequence
  chemically synthesized
taccagaatgcatgcatatc

SEQ ID NO: 2766 - DNA, 20 bp, Artificial Sequence
  chemically synthesized
tatcaagtaataaatgcatg

SEQ ID NO: 2767 - DNA, 20 bp, Artificial Sequence
  chemically synthesized
atcaagtaataaatgcatgc

SEQ ID NO: 2768 - DNA, 20 bp, Artificial Sequence
  chemically synthesized
tgcaggatgtcaacgcatcc

SEQ ID NO: 2769 - DNA, 20 bp, Artificial Sequence
  chemically synthesized
gcaggatgtcaacgcatcct

SEQ ID NO: 2770 - DNA, 20 bp, Artificial Sequence
  chemically synthesized
tacaaaatactttaatattg

SEQ ID NO: 2771 - DNA, 20 bp, Artificial Sequence
  chemically synthesized
tgtagtaacattctacatgt

SEQ ID NO: 2772 - DNA, 20 bp, Artificial Sequence
  chemically synthesized
tagtaacattctacatgtta

SEQ ID NO: 2773 - DNA, 20 bp, Artificial Sequence
  chemically synthesized
acattctacatgttagagtg

SEQ ID NO: 2774 - DNA, 20 bp, Artificial Sequence
  chemically synthesized
ttctacatgttagagtgtag

SEQ ID NO: 2775 - DNA, 20 bp, Artificial Sequence
  chemically synthesized
agttaatcgctgatgcaaaa

SEQ ID NO: 2776 - DNA, 20 bp, Artificial Sequence
  chemically synthesized
gttaatcgctgatgcaaaaa

SEQ ID NO: 2777 - DNA, 20 bp, Artificial Sequence
  chemically synthesized
tcgctgatgcaaaaaaggaa

SEQ ID NO: 2778 - DNA, 20 bp, Artificial Sequence
  chemically synthesized
aaaagaacacattataccca

SEQ ID NO: 2779 - DNA, 20 bp, Artificial Sequence
  chemically synthesized
cacattatacccaaagccta

SEQ ID NO: 2780 - DNA, 20 bp, Artificial Sequence
  chemically synthesized
cattatacccaaagcctaca

SEQ ID NO: 2781 - DNA, 20 bp, Artificial Sequence
  chemically synthesized
ttatacccaaagcctacaga

SEQ ID NO: 2782 - DNA, 20 bp, Artificial Sequence
  chemically synthesized
agaatcacaattacaaatat

SEQ ID NO: 2783 - DNA, 20 bp, Artificial Sequence
  chemically synthesized
tgtgaaaatctttaatttga

SEQ ID NO: 2784 - DNA, 20 bp, Artificial Sequence
  chemically synthesized
aaaatctttaatttgaaagt

SEQ ID NO: 2785 - DNA, 20 bp, Artificial Sequence
  chemically synthesized
agtcagaaatatttaaatga

SEQ ID NO: 2786 - DNA, 20 bp, Artificial Sequence
  chemically synthesized
aatgatagtcattgttaaat

SEQ ID NO: 2787 - DNA, 20 bp, Artificial Sequence
  chemically synthesized
gtcattgttaaatcagattg

SEQ ID NO: 2788 - DNA, 20 bp, Artificial Sequence
  chemically synthesized
tcagattgtggtttgaaaaa

SEQ ID NO: 2789 - DNA, 20 bp, Artificial Sequence
  chemically synthesized
attgtggtttgaaaaaaagt

SEQ ID NO: 2790 - DNA, 20 bp, Artificial Sequence
  chemically synthesized
aaaaaagttagtttaaaact

SEQ ID NO: 2791 - DNA, 20 bp, Artificial Sequence
  chemically synthesized
aactgagtttatgaaaaatt

SEQ ID NO: 2792 - DNA, 20 bp, Artificial Sequence
  chemically synthesized
actgagtttatgaaaaattt

SEQ ID NO: 2793 - DNA, 20 bp, Artificial Sequence
  chemically synthesized
ctgagtttatgaaaaatttg

SEQ ID NO: 2794 - DNA, 20 bp, Artificial Sequence
  chemically synthesized
tatgaaaaatttggggattt

SEQ ID NO: 2795 - DNA, 20 bp, Artificial Sequence
  chemically synthesized
tgaaaaatttggggatttta

SEQ ID NO: 2796 - DNA, 20 bp, Artificial Sequence
  chemically synthesized
aaatttggggattttagaga

SEQ ID NO: 2797 - DNA, 20 bp, Artificial Sequence
  chemically synthesized
ttttgtttttaaatgtgtgt

SEQ ID NO: 2798 - DNA, 20 bp, Artificial Sequence
  chemically synthesized
taaatgtgtgtgagtttgtg

SEQ ID NO: 2799 - DNA, 20 bp, Artificial Sequence
  chemically synthesized
aatgttttataaaatactga

SEQ ID NO: 2800 - DNA, 20 bp, Artificial Sequence
  chemically synthesized
taaaatactgacagtattat

SEQ ID NO: 2801 - DNA, 20 bp, Artificial Sequence
  chemically synthesized
acattattataatacaacat

SEQ ID NO: 2802 - DNA, 20 bp, Artificial Sequence
  chemically synthesized
ataatacaacataagaattt

SEQ ID NO: 2803 - DNA, 20 bp, Artificial Sequence
  chemically synthesized
gaattttggcctgtacctct

SEQ ID NO: 2804 - DNA, 20 bp, Artificial Sequence
  chemically synthesized
ttttggcctgtacctctcag

SEQ ID NO: 2805 - DNA, 20 bp, Artificial Sequence
  chemically synthesized
gtacttgactcaatgattat

SEQ ID NO: 2806 - DNA, 20 bp, Artificial Sequence
  chemically synthesized
acttgactcaatgattatca

SEQ ID NO: 2807 - DNA, 20 bp, Artificial Sequence
  chemically synthesized
tgactcaatgattatcagag

SEQ ID NO: 2808 - DNA, 20 bp, Artificial Sequence
  chemically synthesized
ttttccttctgttgtgttcc

SEQ ID NO: 2809 - DNA, 20 bp, Artificial Sequence
  chemically synthesized
cttctgttgtgttcccagtt

SEQ ID NO: 2810 - DNA, 20 bp, Artificial Sequence
  chemically synthesized
ttctgttgtgttcccagttc

SEQ ID NO: 2811 - DNA, 20 bp, Artificial Sequence
  chemically synthesized
tgttgtgttcccagttcagg

SEQ ID NO: 2812 - DNA, 20 bp, Artificial Sequence
  chemically synthesized
tgttcccagttcaggcagct

SEQ ID NO: 2813 - DNA, 20 bp, Artificial Sequence
  chemically synthesized
cagttcaggcagctcagcaa

SEQ ID NO: 2814 - DNA, 20 bp, Artificial Sequence
  chemically synthesized
tcagcaatggcctgtgattc

SEQ ID NO: 2815 - DNA, 20 bp, Artificial Sequence
  chemically synthesized
tgtgattccagcaattcaaa

SEQ ID NO: 2816 - DNA, 20 bp, Artificial Sequence
  chemically synthesized
attccagcaattcaaatagc

SEQ ID NO: 2817 - DNA, 20 bp, Artificial Sequence
  chemically synthesized
cagcaattcaaatagctggt

SEQ ID NO: 2818 - DNA, 20 bp, Artificial Sequence
  chemically synthesized
caattcaaatagctggtaag

SEQ ID NO: 2819 - DNA, 20 bp, Artificial Sequence
  chemically synthesized
tgtttgttttctcaaatttt

SEQ ID NO: 2820 - DNA, 20 bp, Artificial Sequence
  chemically synthesized
gtttgttttctcaaattttc

SEQ ID NO: 2821 - DNA, 20 bp, Artificial Sequence
  chemically synthesized
tttgttttctcaaattttca

SEQ ID NO: 2822 - DNA, 20 bp, Artificial Sequence
  chemically synthesized
ttgttttctcaaattttcag

SEQ ID NO: 2823 - DNA, 20 bp, Artificial Sequence
  chemically synthesized
tttcaggggcttttctctac

SEQ ID NO: 2824 - DNA, 20 bp, Artificial Sequence
  chemically synthesized
ttttctctacaagtgatttc

SEQ ID NO: 2825 - DNA, 20 bp, Artificial Sequence
  chemically synthesized
attctttattcctttacctt

SEQ ID NO: 2826 - DNA, 20 bp, Artificial Sequence
  chemically synthesized
ttctttattcctttaccttc

SEQ ID NO: 2827 - DNA, 20 bp, Artificial Sequence
  chemically synthesized
tttaccttcaggaaaaccct

SEQ ID NO: 2828 - DNA, 20 bp, Artificial Sequence
  chemically synthesized
aaccctcagcgctgcatctc

SEQ ID NO: 2829 - DNA, 20 bp, Artificial Sequence
  chemically synthesized
agcgctgcatctctggtcac

SEQ ID NO: 2830 - DNA, 20 bp, Artificial Sequence
  chemically synthesized
ctctggtcaccggaccaccg

SEQ ID NO: 2831 - DNA, 20 bp, Artificial Sequence
  chemically synthesized
caccgtggtacatttaccta

SEQ ID NO: 2832 - DNA, 20 bp, Artificial Sequence
  chemically synthesized
gtacatttacctatggccac

SEQ ID NO: 2833 - DNA, 20 bp, Artificial Sequence
  chemically synthesized
tacatttacctatggccacc

SEQ ID NO: 2834 - DNA, 20 bp, Artificial Sequence
  chemically synthesized
cacccttctctttactacca

SEQ ID NO: 2835 - DNA, 20 bp, Artificial Sequence
  chemically synthesized
ttactaccatggtttgtgaa

SEQ ID NO: 2836 - DNA, 20 bp, Artificial Sequence
  chemically synthesized
tggtttgtgaatggttttgc

SEQ ID NO: 2837 - DNA, 20 bp, Artificial Sequence
  chemically synthesized
gtttgtgaatggttttgcca

SEQ ID NO: 2838 - DNA, 20 bp, Artificial Sequence
  chemically synthesized
tttgtgaatggttttgccag

SEQ ID NO: 2839 - DNA, 20 bp, Artificial Sequence
  chemically synthesized
tggttttgccagaggtgaat

SEQ ID NO: 2840 - DNA, 20 bp, Artificial Sequence
  chemically synthesized
gtgaataagaatttaaaatg

SEQ ID NO: 2841 - DNA, 20 bp, Artificial Sequence
  chemically synthesized
tgaataagaatttaaaatgc

SEQ ID NO: 2842 - DNA, 20 bp, Artificial Sequence
  chemically synthesized
ggtctttgatttttcaaatg

SEQ ID NO: 2843 - DNA, 20 bp, Artificial Sequence
  chemically synthesized
tttcaaatgtagttgacctt

SEQ ID NO: 2844 - DNA, 20 bp, Artificial Sequence
  chemically synthesized
accttaagaatttatgaata

SEQ ID NO: 2845 - DNA, 20 bp, Artificial Sequence
  chemically synthesized
taagaatttatgaataaagc

SEQ ID NO: 2846 - DNA, 20 bp, Artificial Sequence
  chemically synthesized
tgaataaagccagaaaaatt

SEQ ID NO: 2847 - DNA, 20 bp, Artificial Sequence
  chemically synthesized
ttaagcttaaaaaacaccga

SEQ ID NO: 2848 - DNA, 20 bp, Artificial Sequence
  chemically synthesized
aaaaaacaccgaaagaaaat

SEQ ID NO: 2849 - DNA, 20 bp, Artificial Sequence
  chemically synthesized
aaaaacaccgaaagaaaatg

SEQ ID NO: 2850 - DNA, 20 bp, Artificial Sequence
  chemically synthesized
atttctattaaaaaaattaa

SEQ ID NO: 2851 - DNA, 20 bp, Artificial Sequence
  chemically synthesized
tttctattaaaaaaattaac

SEQ ID NO: 2852 - DNA, 20 bp, Artificial Sequence
  chemically synthesized
ttaaaaaaattaacaggcca

SEQ ID NO: 2853 - DNA, 20 bp, Artificial Sequence
  chemically synthesized
aggccacagttgctgatgtt

SEQ ID NO: 2854 - DNA, 20 bp, Artificial Sequence
  chemically synthesized
ctgatgtttagtaaatgtgt

SEQ ID NO: 2855 - DNA, 20 bp, Artificial Sequence
  chemically synthesized
tagtgaaatgtgttactgtg

SEQ ID NO: 2856 - DNA, 20 bp, Artificial Sequence
  chemically synthesized
aaatgtgttactgtgaagac

SEQ ID NO: 2857 - DNA, 20 bp, Artificial Sequence
  chemically synthesized
aatgtgttactgtgaagact

SEQ ID NO: 2858 - DNA, 20 bp, Artificial Sequence
  chemically synthesized
atgtgttactgtgaagactg

SEQ ID NO: 2859 - DNA, 20 bp, Artificial Sequence
  chemically synthesized
tggggtgtttcttgaaatct

SEQ ID NO: 2860 - DNA, 20 bp, Artificial Sequence
  chemically synthesized
tgtttcttgaaatctcagcc

SEQ ID NO: 2861 - DNA, 20 bp, Artificial Sequence
  chemically synthesized
gtttcttgaaatctcagccc

SEQ ID NO: 2862 - DNA, 20 bp, Artificial Sequence
  chemically synthesized
aattgtaacatattccttat

SEQ ID NO: 2863 - DNA, 20 bp, Artificial Sequence
  chemically synthesized
attgtaacatattccttatg

SEQ ID NO: 2864 - DNA, 20 bp, Artificial Sequence
  chemically synthesized
gtaacatattccttatgagg

SEQ ID NO: 2865 - DNA, 20 bp, Artificial Sequence
  chemically synthesized
acatattccttatgaggtag

SEQ ID NO: 2866 - DNA, 20 bp, Artificial Sequence
  chemically synthesized
atattccttatgaggtagaa

SEQ ID NO: 2867 - DNA, 20 bp, Artificial Sequence
  chemically synthesized
tccttatgaggtagaagagt

SEQ ID NO: 2868 - DNA, 20 bp, Artificial Sequence
  chemically synthesized
atgaggtagaagagtaagtg

SEQ ID NO: 2869 - DNA, 20 bp, Artificial Sequence
  chemically synthesized
gaagagtaagtgaagcctta

SEQ ID NO: 2870 - DNA, 20 bp, Artificial Sequence
  chemically synthesized
gagtaagtgaagccttatag

SEQ ID NO: 2871 - DNA, 20 bp, Artificial Sequence
  chemically synthesized
gccttatagcagtctgcttt

SEQ ID NO: 2872 - DNA, 20 bp, Artificial Sequence
  chemically synthesized
atagcagtctgctttcagta

SEQ ID NO: 2873 - DNA, 20 bp, Artificial Sequence
  chemically synthesized
cagtctgctttcagtatagt

SEQ ID NO: 2874 - DNA, 20 bp, Artificial Sequence
  chemically synthesized
tttcagtatagtaagatatt

SEQ ID NO: 2875 - DNA, 20 bp, Artificial Sequence
  chemically synthesized
tcagtatagtaagatattaa

SEQ ID NO: 2876 - DNA, 20 bp, Artificial Sequence
  chemically synthesized
agtatagtaagatattaaga

SEQ ID NO: 2877 - DNA, 20 bp, Artificial Sequence
  chemically synthesized
aataatttgtcatatgcttt

SEQ ID NO: 2878 - DNA, 20 bp, Artificial Sequence
  chemically synthesized
tttgtcatatgctttcagaa

SEQ ID NO: 2879 - DNA, 20 bp, Artificial Sequence
  chemically synthesized
atgctttcagaatggtttgc

SEQ ID NO: 2880 - DNA, 20 bp, Artificial Sequence
  chemically synthesized
ataaccaatgtcttacaact

SEQ ID NO: 2881 - DNA, 20 bp, Artificial Sequence
  chemically synthesized
aacttagacgacaatgtccc

SEQ ID NO: 2882 - DNA, 20 bp, Artificial Sequence
  chemically synthesized
cttagacgacaatgtcccta

SEQ ID NO: 2883 - DNA, 20 bp, Artificial Sequence
  chemically synthesized
acgacaatgtccctagagtg

SEQ ID NO: 2884 - DNA, 20 bp, Artificial Sequence
  chemically synthesized
gtgaagaaacacgattaatt

SEQ ID NO: 2885 - DNA, 20 bp, Artificial Sequence
  chemically synthesized
cacgattaattcggctacca

SEQ ID NO: 2886 - DNA, 20 bp, Artificial Sequence
  chemically synthesized
gttgaatgaaaatattccgt

SEQ ID NO: 2887 - DNA, 20 bp, Artificial Sequence
  chemically synthesized
attccgtaagacaaaatgta

SEQ ID NO: 2888 - DNA, 20 bp, Artificial Sequence
  chemically synthesized
aagacaaaatgtaaagaaat

SEQ ID NO: 2889 - DNA, 20 bp, Artificial Sequence
  chemically synthesized
acaaaatgtaaagaaattag

SEQ ID NO: 2890 - DNA, 20 bp, Artificial Sequence
  chemically synthesized
taaatgtctccaaaatgaca

SEQ ID NO: 2891 - DNA, 20 bp, Artificial Sequence
  chemically synthesized
tccaaaatgacaaagcgatt

SEQ ID NO: 2892 - DNA, 20 bp, Artificial Sequence
  chemically synthesized
aagcgattaagtatatacac

SEQ ID NO: 2893 - DNA, 20 bp, Artificial Sequence
  chemically synthesized
agtatatacacaagatgaac

SEQ ID NO: 2894 - DNA, 20 bp, Artificial Sequence
  chemically synthesized
agaacttcaataaaatcatg

SEQ ID NO: 2895 - DNA, 20 bp, Artificial Sequence
  chemically synthesized
aatacaatatacatttatta

SEQ ID NO: 2896 - DNA, 20 bp, Artificial Sequence
  chemically synthesized
taatgcaacaataatactaa

SEQ ID NO: 2897 - DNA, 20 bp, Artificial Sequence
  chemically synthesized
aatgcaacaataatactaac

SEQ ID NO: 2898 - DNA, 20 bp, Artificial Sequence
  chemically synthesized
acaataatactaacaggtaa

SEQ ID NO: 2899 - DNA, 20 bp, Artificial Sequence
  chemically synthesized
aatactaacaggtaatagac

SEQ ID NO: 2900 - DNA, 20 bp, Artificial Sequence
  chemically synthesized
ggtaatagacaagttgttaa

SEQ ID NO: 2901 - DNA, 20 bp, Artificial Sequence
  chemically synthesized
agttgttaatagtttttcac

SEQ ID NO: 2902 - DNA, 20 bp, Artificial Sequence
  chemically synthesized
ttcactggctaattaaataa

SEQ ID NO: 2903 - DNA, 20 bp, Artificial Sequence
  chemically synthesized
ctttaattgtattcatttta

SEQ ID NO: 2904 - DNA, 20 bp, Artificial Sequence
  chemically synthesized
ttttatagcttttctacaat

SEQ ID NO: 2905 - DNA, 20 bp, Artificial Sequence
  chemically synthesized
aacttttctaaccacaaaaa

SEQ ID NO: 2906 - DNA, 20 bp, Artificial Sequence
  chemically synthesized
ctaaccacaaaaaaagaaaa

SEQ ID NO: 2907 - DNA, 20 bp, Artificial Sequence
  chemically synthesized
aaaaaaagaaaatggtttaa

SEQ ID NO: 2908 - DNA, 20 bp, Artificial Sequence
  chemically synthesized
aaaagaaaatggtttaaaag

SEQ ID NO: 2909 - DNA, 20 bp, Artificial Sequence
  chemically synthesized
aagaaaatggtttaaaagaa

SEQ ID NO: 2910 - DNA, 20 bp, Artificial Sequence
  chemically synthesized
aatggtttaaaagaagagat

SEQ ID NO: 2911 - DNA, 20 bp, Artificial Sequence
  chemically synthesized
ttgctaaaatttaatgccta

SEQ ID NO: 2912 - DNA, 20 bp, Artificial Sequence
  chemically synthesized
ctaaaatttaatgcctaaag

SEQ ID NO: 2913 - DNA, 20 bp, Artificial Sequence
  chemically synthesized
tgcctaaagaagaaacttct

SEQ ID NO: 2914 - DNA, 20 bp, Artificial Sequence
  chemically synthesized
agaaacttctgagctgtata

SEQ ID NO: 2915 - DNA, 20 bp, Artificial Sequence
  chemically synthesized
gagctgtatatggtatcctg

SEQ ID NO: 2916 - DNA, 20 bp, Artificial Sequence
  chemically synthesized
tcctgaagcacctgcccttc

SEQ ID NO: 2917 - DNA, 20 bp, Artificial Sequence
  chemically synthesized
gaagcacctgcccttcaaga

SEQ ID NO: 2918 - DNA, 20 bp, Artificial Sequence
  chemically synthesized
atgcttgtaccacatttatg

SEQ ID NO: 2919 - DNA, 20 bp, Artificial Sequence
  chemically synthesized
tgtaccacatttatgcagcc

SEQ ID NO: 2920 - DNA, 20 bp, Artificial Sequence
  chemically synthesized
tttatgcagccaagtgcatg

SEQ ID NO: 2921 - DNA, 20 bp, Artificial Sequence
  chemically synthesized
caagtgcatgtagtaacata

SEQ ID NO: 2922 - DNA, 20 bp, Artificial Sequence
  chemically synthesized
taaagtaaacacatgccatc

SEQ ID NO: 2923 - DNA, 20 bp, Artificial Sequence
  chemically synthesized
gccatctggatatatatatt

SEQ ID NO: 2924 - DNA, 20 bp, Artificial Sequence
  chemically synthesized
atatattaagactcttttga

SEQ ID NO: 2925 - DNA, 20 bp, Artificial Sequence
  chemically synthesized
attaagactcttttgacggc

SEQ ID NO: 2926 - DNA, 20 bp, Artificial Sequence
  chemically synthesized
ttaagactcttttgacggct

SEQ ID NO: 2927 - DNA, 20 bp, Artificial Sequence
  chemically synthesized
agactcttttgacggctggg

SEQ ID NO: 2928 - DNA, 20 bp, Artificial Sequence
  chemically synthesized
gactcttttgacggctgggc

SEQ ID NO: 2929 - DNA, 20 bp, Artificial Sequence
  chemically synthesized
actcttttgacggctgggca

SEQ ID NO: 2930 - DNA, 20 bp, Artificial Sequence
  chemically synthesized
cttttgacggctgggcaggg

SEQ ID NO: 2931 - DNA, 20 bp, Artificial Sequence
  chemically synthesized
gtggctcacacctgtaatct

SEQ ID NO: 2932 - DNA, 20 bp, Artificial Sequence
  chemically synthesized
cacctgtaatctcagcactt

SEQ ID NO: 2933 - DNA, 20 bp, Artificial Sequence
  chemically synthesized
acctgtaatctcagcacttt

SEQ ID NO: 2934 - DNA, 20 bp, Artificial Sequence
  chemically synthesized
ctgtaatctcagcactttgg

SEQ ID NO: 2935 - DNA, 20 bp, Artificial Sequence
  chemically synthesized
tgtaatctcagcactttggg

SEQ ID NO: 2936 - DNA, 20 bp, Artificial Sequence
  chemically synthesized
tctcagcactttgggaggcc

SEQ ID NO: 2937 - DNA, 20 bp, Artificial Sequence
  chemically synthesized
ctcagcactttgggaggccg

SEQ ID NO: 2938 - DNA, 20 bp, Artificial Sequence
  chemically synthesized
agcactttgggaggccgagg

SEQ ID NO: 2939 - DNA, 20 bp, Artificial Sequence
  chemically synthesized
gcactttgggaggccgaggc

SEQ ID NO: 2940 - DNA, 20 bp, Artificial Sequence
  chemically synthesized
ctttgggaggccgaggcagg

SEQ ID NO: 2941 - DNA, 20 bp, Artificial Sequence
  chemically synthesized
ggccgaggcaggcggatcac

SEQ ID NO: 2942 - DNA, 20 bp, Artificial Sequence
  chemically synthesized
gccgaggcaggcggatcacg

SEQ ID NO: 2943 - DNA, 20 bp, Artificial Sequence
  chemically synthesized
aggcaggcggatcacgaggt

SEQ ID NO: 2944 - DNA, 20 bp, Artificial Sequence
  chemically synthesized
ggcaggcggatcacgaggtc

SEQ ID NO: 2945 - DNA, 20 bp, Artificial Sequence
  chemically synthesized
caggcggatcacgaggtcag

SEQ ID NO: 2946 - DNA, 20 bp, Artificial Sequence
  chemically synthesized
ggcggatcacgaggtcagga

SEQ ID NO: 2947 - DNA, 20 bp, Artificial Sequence
  chemically synthesized
tcacgaggtcaggagagttc

SEQ ID NO: 2948 - DNA, 20 bp, Artificial Sequence
  chemically synthesized
aggtcaggagagttcgagac

SEQ ID NO: 2949 - DNA, 20 bp, Artificial Sequence
  chemically synthesized
aggagagttcgagaccagcc

SEQ ID NO: 2950 - DNA, 20 bp, Artificial Sequence
  chemically synthesized
cgagaccagcctggccaaca

SEQ ID NO: 2951 - DNA, 20 bp, Artificial Sequence
  chemically synthesized
tctactaaaaatacaaaaat

SEQ ID NO: 2952 - DNA, 20 bp, Artificial Sequence
  chemically synthesized
ctaaaaatacaaaaattagc

SEQ ID NO: 2953 - DNA, 20 bp, Artificial Sequence
  chemically synthesized
taaaaatacaaaaattagcc

SEQ ID NO: 2954 - DNA, 20 bp, Artificial Sequence
  chemically synthesized
atacaaaaattagccgggca

SEQ ID NO: 2955 - DNA, 20 bp, Artificial Sequence
  chemically synthesized
caaaaattagccgggcatgg

SEQ ID NO: 2956 - DNA, 20 bp, Artificial Sequence
  chemically synthesized
gtggtgcacgcctgtaatcc

SEQ ID NO: 2957 - DNA, 20 bp, Artificial Sequence
  chemically synthesized
cgcctgtaatcccagctact

SEQ ID NO: 2958 - DNA, 20 bp, Artificial Sequence
  chemically synthesized
gcctgtaatcccagctactt

SEQ ID NO: 2959 - DNA, 20 bp, Artificial Sequence
  chemically synthesized
ctgtaatcccagctacttgg

SEQ ID NO: 2960 - DNA, 20 bp, Artificial Sequence
  chemically synthesized
tgtaatcccagctacttggg

SEQ ID NO: 2961 - DNA, 20 bp, Artificial Sequence
  chemically synthesized
tcccagctacttgggaggct

SEQ ID NO: 2962 - DNA, 20 bp, Artificial Sequence
  chemically synthesized
agctacttgggaggctgaga

SEQ ID NO: 2963 - DNA, 20 bp, Artificial Sequence
  chemically synthesized
gctacttgggaggctgagac

SEQ ID NO: 2964 - DNA, 20 bp, Artificial Sequence
  chemically synthesized
tacttgggaggctgagacag

SEQ ID NO: 2965 - DNA, 20 bp, Artificial Sequence
  chemically synthesized
acaggagaatcgcttgaacc

SEQ ID NO: 2966 - DNA, 20 bp, Artificial Sequence
  chemically synthesized
caggagaatcgcttgaacct

SEQ ID NO: 2967 - DNA, 20 bp, Artificial Sequence
  chemically synthesized
ggagaatcgcttgaacctgg

SEQ ID NO: 2968 - DNA, 20 bp, Artificial Sequence
  chemically synthesized
gagaatcgcttgaacctggg

SEQ ID NO: 2969 - DNA, 20 bp, Artificial Sequence
  chemically synthesized
aatcgcttgaacctgggagg

SEQ ID NO: 2970 - DNA, 20 bp, Artificial Sequence
  chemically synthesized
tcgcttgaacctgggaggca

SEQ ID NO: 2971 - DNA, 20 bp, Artificial Sequence
  chemically synthesized
cgcttgaacctgggaggcag

SEQ ID NO: 2972 - DNA, 20 bp, Artificial Sequence
  chemically synthesized
aacctgggaggcagaggtta

SEQ ID NO: 2973 - DNA, 20 bp, Artificial Sequence
  chemically synthesized
tgggaggcagaggttacagt

SEQ ID NO: 2974 - DNA, 20 bp, Artificial Sequence
  chemically synthesized
ggcagaggttacagtgagcc

SEQ ID NO: 2975 - DNA, 20 bp, Artificial Sequence
  chemically synthesized
gagatcatgccattgcactc

SEQ ID NO: 2976 - DNA, 20 bp, Artificial Sequence
  chemically synthesized
catgccattgcactccagcc

SEQ ID NO: 2977 - DNA, 20 bp, Artificial Sequence
  chemically synthesized
atgccattgcactccagcct

SEQ ID NO: 2978 - DNA, 20 bp, Artificial Sequence
  chemically synthesized
ttgcactccagcctgggcaa

SEQ ID NO: 2979 - DNA, 20 bp, Artificial Sequence
  chemically synthesized
gcactccagcctgggcaata

SEQ ID NO: 2980 - DNA, 20 bp, Artificial Sequence
  chemically synthesized
agagtctcaaaaaaaaaaaa

SEQ ID NO: 2981 - DNA, 20 bp, Artificial Sequence
  chemically synthesized
aaaaaagactcttttgaaca

SEQ ID NO: 2982 - DNA, 20 bp, Artificial Sequence
  chemically synthesized
aacatggtgaactgatttcc

SEQ ID NO: 2983 - DNA, 20 bp, Artificial Sequence
  chemically synthesized
tgaactgatttcccagaatc

SEQ ID NO: 2984 - DNA, 20 bp, Artificial Sequence
  chemically synthesized
ctagcaattcctgaatgtcc

SEQ ID NO: 2985 - DNA, 20 bp, Artificial Sequence
  chemically synthesized
caattcctgaatgtcctggt

SEQ ID NO: 2986 - DNA, 20 bp, Artificial Sequence
  chemically synthesized
attttttttttaatgtgcac

SEQ ID NO: 2987 - DNA, 20 bp, Artificial Sequence
  chemically synthesized
tttaatgtgcaccggaaccc

SEQ ID NO: 2988 - DNA, 20 bp, Artificial Sequence
  chemically synthesized
aatgtgcaccggaaccccag

SEQ ID NO: 2989 - DNA, 20 bp, Artificial Sequence
  chemically synthesized
ccggaaccccagtggctcca

SEQ ID NO: 2990 - DNA, 20 bp, Artificial Sequence
  chemically synthesized
gaaccccagtggctccatgg

SEQ ID NO: 2991 - DNA, 20 bp, Artificial Sequence
  chemically synthesized
aaccccagtggctccatgga

SEQ ID NO: 2992 - DNA, 20 bp, Artificial Sequence
  chemically synthesized
agtggctccatggaaggacc

SEQ ID NO: 2993 - DNA, 20 bp, Artificial Sequence
  chemically synthesized
gtggctccatggaaggacct

SEQ ID NO: 2994 - DNA, 20 bp, Artificial Sequence
  chemically synthesized
gaaggacctgggcatcctct

SEQ ID NO: 2995 - DNA, 20 bp, Artificial Sequence
  chemically synthesized
tgggcatcctctaagccact

SEQ ID NO: 2996 - DNA, 20 bp, Artificial Sequence
  chemically synthesized
gcatcctctaagccacttgg

SEQ ID NO: 2997 - DNA, 20 bp, Artificial Sequence
  chemically synthesized
ccattataccatctcaaaat

SEQ ID NO: 2998 - DNA, 20 bp, Artificial Sequence
  chemically synthesized
attataccatctcaaaatga

SEQ ID NO: 2999 - DNA, 20 bp, Artificial Sequence
  chemically synthesized
tataccatctcaaaatgaga

SEQ ID NO: 3000 - DNA, 20 bp, Artificial Sequence
  chemically synthesized
agagcttactccacttcatt

SEQ ID NO: 3001 - DNA, 20 bp, Artificial Sequence
  chemically synthesized
gagcttactccacttcattg

SEQ ID NO: 3002 - DNA, 20 bp, Artificial Sequence
  chemically synthesized
agcttactccacttcattga

SEQ ID NO: 3003 - DNA, 20 bp, Artificial Sequence
  chemically synthesized
ttcattgagggaaataccac

SEQ ID NO: 3004 - DNA, 20 bp, Artificial Sequence
  chemically synthesized
cattgagggaaataccacca

SEQ ID NO: 3005 - DNA, 20 bp, Artificial Sequence
  chemically synthesized
taccaccagagttctgactc

SEQ ID NO: 3006 - DNA, 20 bp, Artificial Sequence
  chemically synthesized
ccaccagagttctgactcca

SEQ ID NO: 3007 - DNA, 20 bp, Artificial Sequence
  chemically synthesized
caccagagttctgactccag

SEQ ID NO: 3008 - DNA, 20 bp, Artificial Sequence
  chemically synthesized
agttctgactccagaggcac

SEQ ID NO: 3009 - DNA, 20 bp, Artificial Sequence
  chemically synthesized
tgactccagaggcactggcc

SEQ ID NO: 3010 - DNA, 20 bp, Artificial Sequence
  chemically synthesized
gactccagaggcactggcct

SEQ ID NO: 3011 - DNA, 20 bp, Artificial Sequence
  chemically synthesized
actccagaggcactggccta

SEQ ID NO: 3012 - DNA, 20 bp, Artificial Sequence
  chemically synthesized
tccagaggcactggcctagg

SEQ ID NO: 3013 - DNA, 20 bp, Artificial Sequence
  chemically synthesized
ccagaggcactggcctaggg

SEQ ID NO: 3014 - DNA, 20 bp, Artificial Sequence
  chemically synthesized
tagggaggacaccgtgtgtg

SEQ ID NO: 3015 - DNA, 20 bp, Artificial Sequence
  chemically synthesized
aggacaccgtgtgtgaagcc

SEQ ID NO: 3016 - DNA, 20 bp, Artificial Sequence
  chemically synthesized
acaccgtgtgtgaagcccag

SEQ ID NO: 3017 - DNA, 20 bp, Artificial Sequence
  chemically synthesized
caccgtgtgtgaagcccagc

SEQ ID NO: 3018 - DNA, 20 bp, Artificial Sequence
  chemically synthesized
accgtgtgtgaagcccagca

SEQ ID NO: 3019 - DNA, 20 bp, Artificial Sequence
  chemically synthesized
gtgaagcccagcagggccac

SEQ ID NO: 3020 - DNA, 20 bp, Artificial Sequence
  chemically synthesized
ctagctgtccccaccaatta

SEQ ID NO: 3021 - DNA, 20 bp, Artificial Sequence
  chemically synthesized
caccaattacagtccttgcg

SEQ ID NO: 3022 - DNA, 20 bp, Artificial Sequence
  chemically synthesized
accaattacagtccttgcgt

SEQ ID NO: 3023 - DNA, 20 bp, Artificial Sequence
  chemically synthesized
ccaattacagtccttgcgta

SEQ ID NO: 3024 - DNA, 20 bp, Artificial Sequence
  chemically synthesized
cagtccttgcgtagggtcca

SEQ ID NO: 3025 - DNA, 20 bp, Artificial Sequence
  chemically synthesized
gtccaaagaaatgaatgcca

SEQ ID NO: 3026 - DNA, 20 bp, Artificial Sequence
  chemically synthesized
ccaaagaaatgaatgccaaa

SEQ ID NO: 3027 - DNA, 20 bp, Artificial Sequence
  chemically synthesized
aaagaaatgaatgccaaaga

SEQ ID NO: 3028 - DNA, 20 bp, Artificial Sequence
  chemically synthesized
atgaatgccaaagagagcaa

SEQ ID NO: 3029 - DNA, 20 bp, Artificial Sequence
  chemically synthesized
gaatgccaaagagagcaaca

SEQ ID NO: 3030 - DNA, 20 bp, Artificial Sequence
  chemically synthesized
aatgccaaagagagcaacag

SEQ ID NO: 3031 - DNA, 20 bp, Artificial Sequence
  chemically synthesized
tgccaaagagagcaacagag

SEQ ID NO: 3032 - DNA, 20 bp, Artificial Sequence
  chemically synthesized
aaagagagcaacagaggagc

SEQ ID NO: 3033 - DNA, 20 bp, Artificial Sequence
  chemically synthesized
aagagagcaacagaggagca

SEQ ID NO: 3034 - DNA, 20 bp, Artificial Sequence
  chemically synthesized
agagagcaacagaggagcaa

SEQ ID NO: 3035 - DNA, 20 bp, Artificial Sequence
  chemically synthesized
agagcaacagaggagcaagg

SEQ ID NO: 3036 - DNA, 20 bp, Artificial Sequence
  chemically synthesized
ggagcaagggagtcacattc

SEQ ID NO: 3037 - DNA, 20 bp, Artificial Sequence
  chemically synthesized
gagcaagggagtcacattcc

SEQ ID NO: 3038 - DNA, 20 bp, Artificial Sequence
  chemically synthesized
cacattccaggaccttcctt

SEQ ID NO: 3039 - DNA, 20 bp, Artificial Sequence
  chemically synthesized
acattccaggaccttccttc

SEQ ID NO: 3040 - DNA, 20 bp, Artificial Sequence
  chemically synthesized
cattccaggaccttccttca

SEQ ID NO: 3041 - DNA, 20 bp, Artificial Sequence
  chemically synthesized
ccttccttcagggactttta

SEQ ID NO: 3042 - DNA, 20 bp, Artificial Sequence
  chemically synthesized
cttccttcagggacttttaa

SEQ ID NO: 3043 - DNA, 20 bp, Artificial Sequence
  chemically synthesized
gacttttaaaggaaacatga

SEQ ID NO: 3044 - DNA, 20 bp, Artificial Sequence
  chemically synthesized
ttaaaggaaacatgacagct

SEQ ID NO: 3045 - DNA, 20 bp, Artificial Sequence
  chemically synthesized
taaaggaaacatgacagctg

SEQ ID NO: 3046 - DNA, 20 bp, Artificial Sequence
  chemically synthesized
gaaacatgacagctgaggat

SEQ ID NO: 3047 - DNA, 20 bp, Artificial Sequence
  chemically synthesized
catgacagctgaggatcagt

SEQ ID NO: 3048 - DNA, 20 bp, Artificial Sequence
  chemically synthesized
tgttccccttcatgtgattc

SEQ ID NO: 3049 - DNA, 20 bp, Artificial Sequence
  chemically synthesized
tcatgtgattcaagctcact

SEQ ID NO: 3050 - DNA, 20 bp, Artificial Sequence
  chemically synthesized
tgtgattcaagctcactcag

SEQ ID NO: 3051 - DNA, 20 bp, Artificial Sequence
  chemically synthesized
tcactcagaagaaacacaat

SEQ ID NO: 3052 - DNA, 20 bp, Artificial Sequence
  chemically synthesized
cagaagaaacacaatgagac

SEQ ID NO: 3053 - DNA, 20 bp, Artificial Sequence
  chemically synthesized
gaagaaacacaatgagacaa

SEQ ID NO: 3054 - DNA, 20 bp, Artificial Sequence
  chemically synthesized
gaaacacaatgagacaagag

SEQ ID NO: 3055 - DNA, 20 bp, Artificial Sequence
  chemically synthesized
aacacaatgagacaagagaa

SEQ ID NO: 3056 - DNA, 20 bp, Artificial Sequence
  chemically synthesized
ccttccttctctatttattc

SEQ ID NO: 3057 - DNA, 20 bp, Artificial Sequence
  chemically synthesized
cttccttctctatttattct

SEQ ID NO: 3058 - DNA, 20 bp, Artificial Sequence
  chemically synthesized
ggcatctaaactactgaatg

SEQ ID NO: 3059 - DNA, 20 bp, Artificial Sequence
  chemically synthesized
atctaaactactgaatgtag

SEQ ID NO: 3060 - DNA, 20 bp, Artificial Sequence
  chemically synthesized
tactgaatgtagtggtgtct

SEQ ID NO: 3061 - DNA, 20 bp, Artificial Sequence
  chemically synthesized
ggtgtctgagatgtatcaaa

SEQ ID NO: 3062 - DNA, 20 bp, Artificial Sequence
  chemically synthesized
tctgagatgtatcaaacggt

SEQ ID NO: 3063 - DNA, 20 bp, Artificial Sequence
  chemically synthesized
atcaaacggtcagattgact

SEQ ID NO: 3064 - DNA, 20 bp, Artificial Sequence
  chemically synthesized
ttctatcactgacaaactat

SEQ ID NO: 3065 - DNA, 20 bp, Artificial Sequence
  chemically synthesized
atttttatttttattttttt

SEQ ID NO: 3066 - DNA, 20 bp, Artificial Sequence
  chemically synthesized
ttatttttatttttttgaga

SEQ ID NO: 3067 - DNA, 20 bp, Artificial Sequence
  chemically synthesized
atttttatttttttgagatg

SEQ ID NO: 3068 - DNA, 20 bp, Artificial Sequence
  chemically synthesized
tggagtctcactctgtcacc

SEQ ID NO: 3069 - DNA, 20 bp, Artificial Sequence
  chemically synthesized
ggagtctcactctgtcacct

SEQ ID NO: 3070 - DNA, 20 bp, Artificial Sequence
  chemically synthesized
tctcactctgtcacctaggc

SEQ ID NO: 3071 - DNA, 20 bp, Artificial Sequence
  chemically synthesized
tcactctgtcacctaggctg

SEQ ID NO: 3072 - DNA, 20 bp, Artificial Sequence
  chemically synthesized
ctgtcacctaggctggagtg

SEQ ID NO: 3073 - DNA, 20 bp, Artificial Sequence
  chemically synthesized
tcacctaggctggagtgcag

SEQ ID NO: 3074 - DNA, 20 bp, Artificial Sequence
  chemically synthesized
ggagtgcagtggcgcaaact

SEQ ID NO: 3075 - DNA, 20 bp, Artificial Sequence
  chemically synthesized
gcgcaaactcggctcactgc

SEQ ID NO: 3076 - DNA, 20 bp, Artificial Sequence
  chemically synthesized
tcactgcaagctctgcctcc

SEQ ID NO: 3077 - DNA, 20 bp, Artificial Sequence
  chemically synthesized
cactgcaagctctgcctcct

SEQ ID NO: 3078 - DNA, 20 bp, Artificial Sequence
  chemically synthesized
ttcatgccattctcctgcct

SEQ ID NO: 3079 - DNA, 20 bp, Artificial Sequence
  chemically synthesized
ttctcctgcctcagccttcc

SEQ ID NO: 3080 - DNA, 20 bp, Artificial Sequence
  chemically synthesized
tcctgcctcagccttccgag

SEQ ID NO: 3081 - DNA, 20 bp, Artificial Sequence
  chemically synthesized
gcctcagccttccgagtagc

SEQ ID NO: 3082 - DNA, 20 bp, Artificial Sequence
  chemically synthesized
cctcagccttccgagtagct

SEQ ID NO: 3083 - DNA, 20 bp, Artificial Sequence
  chemically synthesized
cttccgagtagctgggacta

SEQ ID NO: 3084 - DNA, 20 bp, Artificial Sequence
  chemically synthesized
ttccgagtagctgggactac

SEQ ID NO: 3085 - DNA, 20 bp, Artificial Sequence
  chemically synthesized
caggcgtctgccaccacgcc

SEQ ID NO: 3086 - DNA, 20 bp, Artificial Sequence
  chemically synthesized
ctaattttttgtatttttat

SEQ ID NO: 3087 - DNA, 20 bp, Artificial Sequence
  chemically synthesized
aattttttgtatttttatta

SEQ ID NO: 3088 - DNA, 20 bp, Artificial Sequence
  chemically synthesized
ttttgtatttttattagaga

SEQ ID NO: 3089 - DNA, 20 bp, Artificial Sequence
  chemically synthesized
tttgtatttttattagagat

SEQ ID NO: 3090 - DNA, 20 bp, Artificial Sequence
  chemically synthesized
ttgtatttttattagagatg

SEQ ID NO: 3091 - DNA, 20 bp, Artificial Sequence
  chemically synthesized
gagatggggtttcaccatgt

SEQ ID NO: 3092 - DNA, 20 bp, Artificial Sequence
  chemically synthesized
tggggtttcaccatgttagc

SEQ ID NO: 3093 - DNA, 20 bp, Artificial Sequence
  chemically synthesized
ggggtttcaccatgttagcc

SEQ ID NO: 3094 - DNA, 20 bp, Artificial Sequence
  chemically synthesized
tttcaccatgttagccagga

SEQ ID NO: 3095 - DNA, 20 bp, Artificial Sequence
  chemically synthesized
acctcgtgatccacccgctt

SEQ ID NO: 3096 - DNA, 20 bp, Artificial Sequence
  chemically synthesized
ccacccgctttggcctccca

SEQ ID NO: 3097 - DNA, 20 bp, Artificial Sequence
  chemically synthesized
gctttggcctcccaaagtgc

SEQ ID NO: 3098 - DNA, 20 bp, Artificial Sequence
  chemically synthesized
ctttggcctcccaaagtgct

SEQ ID NO: 3099 - DNA, 20 bp, Artificial Sequence
  chemically synthesized
ctcccaaagtgctgggatta

SEQ ID NO: 3100 - DNA, 20 bp, Artificial Sequence
  chemically synthesized
tcccaaagtgctgggattac

SEQ ID NO: 3101 - DNA, 20 bp, Artificial Sequence
  chemically synthesized
agtgctgggattacaggcgt

SEQ ID NO: 3102 - DNA, 20 bp, Artificial Sequence
  chemically synthesized
caggcgtgagccaccgtgcc

SEQ ID NO: 3103 - DNA, 20 bp, Artificial Sequence
  chemically synthesized
ttcactttcttcatttaaaa

SEQ ID NO: 3104 - DNA, 20 bp, Artificial Sequence
  chemically synthesized
ttcttcatttaaaaaagaaa

SEQ ID NO: 3105 - DNA, 20 bp, Artificial Sequence
  chemically synthesized
tcttcatttaaaaaagaaat

SEQ ID NO: 3106 - DNA, 20 bp, Artificial Sequence
  chemically synthesized
cttcatttaaaaaagaaatg

SEQ ID NO: 3107 - DNA, 20 bp, Artificial Sequence
  chemically synthesized
taaaaaagaaatggggataa

SEQ ID NO: 3108 - DNA, 20 bp, Artificial Sequence
  chemically synthesized
ggataatagtacctatctca

SEQ ID NO: 3109 - DNA, 20 bp, Artificial Sequence
  chemically synthesized
ctatctcatagaattattgt

SEQ ID NO: 3110 - DNA, 20 bp, Artificial Sequence
  chemically synthesized
tctcatagaattattgtaag

SEQ ID NO: 3111 - DNA, 20 bp, Artificial Sequence
  chemically synthesized
attattgtaagaagtgcatg

SEQ ID NO: 3112 - DNA, 20 bp, Artificial Sequence
  chemically synthesized
gtgcatgcagtaatgcatgt

SEQ ID NO: 3113 - DNA, 20 bp, Artificial Sequence
  chemically synthesized
catgcagtaatgcatgtaag

SEQ ID NO: 3114 - DNA, 20 bp, Artificial Sequence
  chemically synthesized
atgcagtaatgcatgtaagt

SEQ ID NO: 3115 - DNA, 20 bp, Artificial Sequence
  chemically synthesized
aatgcatgtaagtaggtgct

SEQ ID NO: 3116 - DNA, 20 bp, Artificial Sequence
  chemically synthesized
gcatgtaagtaggtgctcag

SEQ ID NO: 3117 - DNA, 20 bp, Artificial Sequence
  chemically synthesized
atgtaagtaggtgctcagaa

SEQ ID NO: 3118 - DNA, 20 bp, Artificial Sequence
  chemically synthesized
aagtaggtgctcagaagagt

SEQ ID NO: 3119 - DNA, 20 bp, Artificial Sequence
  chemically synthesized
gctcagaagagtcggacacg

SEQ ID NO: 3120 - DNA, 20 bp, Artificial Sequence
  chemically synthesized
agaagagtcggacacgaagt

SEQ ID NO: 3121 - DNA, 20 bp, Artificial Sequence
  chemically synthesized
cttatcataattttcattat

SEQ ID NO: 3122 - DNA, 20 bp, Artificial Sequence
  chemically synthesized
ataattttcattatcagaac

SEQ ID NO: 3123 - DNA, 20 bp, Artificial Sequence
  chemically synthesized
taattttcattatcagaaca

SEQ ID NO: 3124 - DNA, 20 bp, Artificial Sequence
  chemically synthesized
attttcattatcagaacaag

SEQ ID NO: 3125 - DNA, 20 bp, Artificial Sequence
  chemically synthesized
tttcattatcagaacaagga

SEQ ID NO: 3126 - DNA, 20 bp, Artificial Sequence
  chemically synthesized
ttatcagaacaaggagagac

SEQ ID NO: 3127 - DNA, 20 bp, Artificial Sequence
  chemically synthesized
tatcagaacaaggagagacc

SEQ ID NO: 3128 - DNA, 20 bp, Artificial Sequence
  chemically synthesized
cagaacaaggagagaccagg

SEQ ID NO: 3129 - DNA, 20 bp, Artificial Sequence
  chemically synthesized
agaaaattattgtgattctt

SEQ ID NO: 3130 - DNA, 20 bp, Artificial Sequence
  chemically synthesized
gaaaattattgtgattcttc

SEQ ID NO: 3131 - DNA, 20 bp, Artificial Sequence
  chemically synthesized
ttattgtgattcttcaggtc

SEQ ID NO: 3132 - DNA, 20 bp, Artificial Sequence
  chemically synthesized
attcttcaggtctggaatac

SEQ ID NO: 3133 - DNA, 20 bp, Artificial Sequence
  chemically synthesized
tcttcaggtctggaatacta

SEQ ID NO: 3134 - DNA, 20 bp, Artificial Sequence
  chemically synthesized
tcaggtctggaatactagag

SEQ ID NO: 3135 - DNA, 20 bp, Artificial Sequence
  chemically synthesized
ctagagtagcatcccaaatg

SEQ ID NO: 3136 - DNA, 20 bp, Artificial Sequence
  chemically synthesized
tagagtagcatcccaaatga

SEQ ID NO: 3137 - DNA, 20 bp, Artificial Sequence
  chemically synthesized
tatgacaccttcatgccaat

SEQ ID NO: 3138 - DNA, 20 bp, Artificial Sequence
  chemically synthesized
acctcttcacaacccctttc

SEQ ID NO: 3139 - DNA, 20 bp, Artificial Sequence
  chemically synthesized
aacacccatcatactaccca

SEQ ID NO: 3140 - DNA, 20 bp, Artificial Sequence
  chemically synthesized
cccatcatactacccacaga

SEQ ID NO: 3141 - DNA, 20 bp, Artificial Sequence
  chemically synthesized
gatagccatgatgctttttc

SEQ ID NO: 3142 - DNA, 20 bp, Artificial Sequence
  chemically synthesized
atagccatgatgctttttct

SEQ ID NO: 3143 - DNA, 20 bp, Artificial Sequence
  chemically synthesized
ccatgatgctttttctggga

SEQ ID NO: 3144 - DNA, 20 bp, Artificial Sequence
  chemically synthesized
catgatgctttttctgggac

SEQ ID NO: 3145 - DNA, 20 bp, Artificial Sequence
  chemically synthesized
aggtgcctcttccattcgtg

SEQ ID NO: 3146 - DNA, 20 bp, Artificial Sequence
  chemically synthesized
tcttccattcgtgcagtgta

SEQ ID NO: 3147 - DNA, 20 bp, Artificial Sequence
  chemically synthesized
cgtgcagtgtacagccttca

SEQ ID NO: 3148 - DNA, 20 bp, Artificial Sequence
  chemically synthesized
tgtgcaactcacatcacaat

SEQ ID NO: 3149 - DNA, 20 bp, Artificial Sequence
  chemically synthesized
caactcacatcacaatcaga

SEQ ID NO: 3150 - DNA, 20 bp, Artificial Sequence
  chemically synthesized
ctcacatcacaatcagatgg

SEQ ID NO: 3151 - DNA, 20 bp, Artificial Sequence
  chemically synthesized
aatcagatggaagaatcccc

SEQ ID NO: 3152 - DNA, 20 bp, Artificial Sequence
  chemically synthesized
atcagatggaagaatcccca

SEQ ID NO: 3153 - DNA, 20 bp, Artificial Sequence
  chemically synthesized
atggaagaatccccaaggct

SEQ ID NO: 3154 - DNA, 20 bp, Artificial Sequence
  chemically synthesized
gaatccccaaggcttggtga

SEQ ID NO: 3155 - DNA, 20 bp, Artificial Sequence
  chemically synthesized
cccaaggcttggtgacagat

SEQ ID NO: 3156 - DNA, 20 bp, Artificial Sequence
  chemically synthesized
cttggtgacagatgagttac

SEQ ID NO: 3157 - DNA, 20 bp, Artificial Sequence
  chemically synthesized
ttggtgacagatgagttact

SEQ ID NO: 3158 - DNA, 20 bp, Artificial Sequence
  chemically synthesized
agatgagttactgggtaaca

SEQ ID NO: 3159 - DNA, 20 bp, Artificial Sequence
  chemically synthesized
atgagttactgggtaacaca

SEQ ID NO: 3160 - DNA, 20 bp, Artificial Sequence
  chemically synthesized
gagttactgggtaacacaga

SEQ ID NO: 3161 - DNA, 20 bp, Artificial Sequence
  chemically synthesized
gttactgggtaacacagaga

SEQ ID NO: 3162 - DNA, 20 bp, Artificial Sequence
  chemically synthesized
ttactgggtaacacagagag

SEQ ID NO: 3163 - DNA, 20 bp, Artificial Sequence
  chemically synthesized
taacacagagagaggattca

SEQ ID NO: 3164 - DNA, 20 bp, Artificial Sequence
  chemically synthesized
aacacagagagaggattcaa

SEQ ID NO: 3165 - DNA, 20 bp, Artificial Sequence
  chemically synthesized
agagagaggattcaaaggaa

SEQ ID NO: 3166 - DNA, 20 bp, Artificial Sequence
  chemically synthesized
gattcaaaggaaaagttgaa

SEQ ID NO: 3167 - DNA, 20 bp, Artificial Sequence
  chemically synthesized
attcaaaggaaaagttgaac

SEQ ID NO: 3168 - DNA, 20 bp, Artificial Sequence
  chemically synthesized
aaggaaaagttgaacgggtc

SEQ ID NO: 3169 - DNA, 20 bp, Artificial Sequence
  chemically synthesized
gaacgggtccagaaaatgca

SEQ ID NO: 3170 - DNA, 20 bp, Artificial Sequence
  chemically synthesized
tagatacatgtgtaaaaatc

SEQ ID NO: 3171 - DNA, 20 bp, Artificial Sequence
  chemically synthesized
tacatgtgtaaaaatctggt

SEQ ID NO: 3172 - DNA, 20 bp, Artificial Sequence
  chemically synthesized
acatgtgtaaaaatctggta

SEQ ID NO: 3173 - DNA, 20 bp, Artificial Sequence
  chemically synthesized
aaatctggtaaggttatgac

SEQ ID NO: 3174 - DNA, 20 bp, Artificial Sequence
  chemically synthesized
ggttatgactagccacgtcc

SEQ ID NO: 3175 - DNA, 20 bp, Artificial Sequence
  chemically synthesized
gttatgactagccacgtccc

SEQ ID NO: 3176 - DNA, 20 bp, Artificial Sequence
  chemically synthesized
ttatgactagccacgtccca

SEQ ID NO: 3177 - DNA, 20 bp, Artificial Sequence
  chemically synthesized
tagccacgtcccagggttca

SEQ ID NO: 3178 - DNA, 20 bp, Artificial Sequence
  chemically synthesized
ccagggttcaaagcttttct

SEQ ID NO: 3179 - DNA, 20 bp, Artificial Sequence
  chemically synthesized
gatgttaaaatgaatcatgt

SEQ ID NO: 3180 - DNA, 20 bp, Artificial Sequence
  chemically synthesized
catgtaagtcccccaaattt

SEQ ID NO: 3181 - DNA, 20 bp, Artificial Sequence
  chemically synthesized
atgtaagtcccccaaattta

SEQ ID NO: 3182 - DNA, 20 bp, Artificial Sequence
  chemically synthesized
gtaagtcccccaaatttaag

SEQ ID NO: 3183 - DNA, 20 bp, Artificial Sequence
  chemically synthesized
aaggagtcctcttccaaaaa

SEQ ID NO: 3184 - DNA, 20 bp, Artificial Sequence
  chemically synthesized
aggagtcctcttccaaaaat

SEQ ID NO: 3185 - DNA, 20 bp, Artificial Sequence
  chemically synthesized
aaataggaaatgaaatgaca

SEQ ID NO: 3186 - DNA, 20 bp, Artificial Sequence
  chemically synthesized
aataggaaatgaaatgacat

SEQ ID NO: 3187 - DNA, 20 bp, Artificial Sequence
  chemically synthesized
tgacataggtgtatgtctct

SEQ ID NO: 3188 - DNA, 20 bp, Artificial Sequence
  chemically synthesized
gacataggtgtatgtctctg

SEQ ID NO: 3189 - DNA, 20 bp, Artificial Sequence
  chemically synthesized
ggtgtatgtctctgaggtga

SEQ ID NO: 3190 - DNA, 20 bp, Artificial Sequence
  chemically synthesized
tgtatgtctctgaggtgacg

SEQ ID NO: 3191 - DNA, 20 bp, Artificial Sequence
  chemically synthesized
gtatgtctctgaggtgacgg

SEQ ID NO: 3192 - DNA, 20 bp, Artificial Sequence
  chemically synthesized
ctgaggtgacggaggaaatg

SEQ ID NO: 3193 - DNA, 20 bp, Artificial Sequence
  chemically synthesized
tgaggtgacggaggaaatga

SEQ ID NO: 3194 - DNA, 20 bp, Artificial Sequence
  chemically synthesized
ggtgacggaggaaatgaagg

SEQ ID NO: 3195 - DNA, 20 bp, Artificial Sequence
  chemically synthesized
gaggaaatgaaggaagcctc

SEQ ID NO: 3196 - DNA, 20 bp, Artificial Sequence
  chemically synthesized
atgaaggaagcctctagatg

SEQ ID NO: 3197 - DNA, 20 bp, Artificial Sequence
  chemically synthesized
gaagcctctagatgcagctt

SEQ ID NO: 3198 - DNA, 20 bp, Artificial Sequence
  chemically synthesized
aagcctctagatgcagcttg

SEQ ID NO: 3199 - DNA, 20 bp, Artificial Sequence
  chemically synthesized
agatgcagcttgaggttcat

SEQ ID NO: 3200 - DNA, 20 bp, Artificial Sequence
  chemically synthesized
atgcagcttgaggttcatga

SEQ ID NO: 3201 - DNA, 20 bp, Artificial Sequence
  chemically synthesized
agcttgaggttcatgagaga

SEQ ID NO: 3202 - DNA, 20 bp, Artificial Sequence
  chemically synthesized
aggttcatgagagacagttc

SEQ ID NO: 3203 - DNA, 20 bp, Artificial Sequence
  chemically synthesized
ggttcatgagagacagttcc

SEQ ID NO: 3204 - DNA, 20 bp, Artificial Sequence
  chemically synthesized
gttcatgagagacagttcca

SEQ ID NO: 3205 - DNA, 20 bp, Artificial Sequence
  chemically synthesized
ttcatgagagacagttccag

SEQ ID NO: 3206 - DNA, 20 bp, Artificial Sequence
  chemically synthesized
catgagagacagttccaggg

SEQ ID NO: 3207 - DNA, 20 bp, Artificial Sequence
  chemically synthesized
tgagagacagttccagggga

SEQ ID NO: 3208 - DNA, 20 bp, Artificial Sequence
  chemically synthesized
gagagacagttccaggggag

SEQ ID NO: 3209 - DNA, 20 bp, Artificial Sequence
  chemically synthesized
cagttccaggggagaggtca

SEQ ID NO: 3210 - DNA, 20 bp, Artificial Sequence
  chemically synthesized
tccaggggagaggtcacagc

SEQ ID NO: 3211 - DNA, 20 bp, Artificial Sequence
  chemically synthesized
ccaggggagaggtcacagct

SEQ ID NO: 3212 - DNA, 20 bp, Artificial Sequence
  chemically synthesized
caggggagaggtcacagcta

SEQ ID NO: 3213 - DNA, 20 bp, Artificial Sequence
  chemically synthesized
aggtcacagctagggatcac

SEQ ID NO: 3214 - DNA, 20 bp, Artificial Sequence
  chemically synthesized
agctagggatcaccggcatg

SEQ ID NO: 3215 - DNA, 20 bp, Artificial Sequence
  chemically synthesized
gctagggatcaccggcatgc

SEQ ID NO: 3216 - DNA, 20 bp, Artificial Sequence
  chemically synthesized
atcaccggcatgcaggaact

SEQ ID NO: 3217 - DNA, 20 bp, Artificial Sequence
  chemically synthesized
caggaactcagaaacctaaa

SEQ ID NO: 3218 - DNA, 20 bp, Artificial Sequence
  chemically synthesized
aggaactcagaaacctaaat

SEQ ID NO: 3219 - DNA, 20 bp, Artificial Sequence
  chemically synthesized
ggaactcagaaacctaaatg

SEQ ID NO: 3220 - DNA, 20 bp, Artificial Sequence
  chemically synthesized
ctaaatggggaaatcttttt

SEQ ID NO: 3221 - DNA, 20 bp, Artificial Sequence
  chemically synthesized
taaatggggaaatctttttg

SEQ ID NO: 3222 - DNA, 20 bp, Artificial Sequence
  chemically synthesized
aatctttttgaggaaatgaa

SEQ ID NO: 3223 - DNA, 20 bp, Artificial Sequence
  chemically synthesized
tctttttgaggaaatgaaca

SEQ ID NO: 3224 - DNA, 20 bp, Artificial Sequence
  chemically synthesized
ttttgaggaaatgaacagag

SEQ ID NO: 3225 - DNA, 20 bp, Artificial Sequence
  chemically synthesized
tttgaggaaatgaacagaga

SEQ ID NO: 3226 - DNA, 20 bp, Artificial Sequence
  chemically synthesized
gaacagagaaggctaaaatc

SEQ ID NO: 3227 - DNA, 20 bp, Artificial Sequence
  chemically synthesized
aacagagaaggctaaaatca

SEQ ID NO: 3228 - DNA, 20 bp, Artificial Sequence
  chemically synthesized
cagagaaggctaaaatcaag

SEQ ID NO: 3229 - DNA, 20 bp, Artificial Sequence
  chemically synthesized
gctaaaatcaaggagttcgt

SEQ ID NO: 3230 - DNA, 20 bp, Artificial Sequence
  chemically synthesized
ctaaaatcaaggagttcgtc

SEQ ID NO: 3231 - DNA, 20 bp, Artificial Sequence
  chemically synthesized
cgtcaggcaatttctatgtt

SEQ ID NO: 3232 - DNA, 20 bp, Artificial Sequence
  chemically synthesized
gtcaggcaatttctatgttt

SEQ ID NO: 3233 - DNA, 20 bp, Artificial Sequence
  chemically synthesized
caactctctcctgaaacatg

SEQ ID NO: 3234 - DNA, 20 bp, Artificial Sequence
  chemically synthesized
actctctcctgaaacatgaa

SEQ ID NO: 3235 - DNA, 20 bp, Artificial Sequence
  chemically synthesized
cataaatgcactccctcttt

SEQ ID NO: 3236 - DNA, 20 bp, Artificial Sequence
  chemically synthesized
gcactccctctttgagtctc

SEQ ID NO: 3237 - DNA, 20 bp, Artificial Sequence
  chemically synthesized
ctagttttgtctccttccca

SEQ ID NO: 3238 - DNA, 20 bp, Artificial Sequence
  chemically synthesized
ttttgtctccttcccacagt

SEQ ID NO: 3239 - DNA, 20 bp, Artificial Sequence
  chemically synthesized
tccttcccacagtgagtctg

SEQ ID NO: 3240 - DNA, 20 bp, Artificial Sequence
  chemically synthesized
ccttcccacagtgagtctgc

SEQ ID NO: 3241 - DNA, 20 bp, Artificial Sequence
  chemically synthesized
ggctgcgtgtcactcacgtt

SEQ ID NO: 3242 - DNA, 20 bp, Artificial Sequence
  chemically synthesized
cgtgtcactcacgttcagct

SEQ ID NO: 3243 - DNA, 20 bp, Artificial Sequence
  chemically synthesized
actcacgttcagctaagacg

SEQ ID NO: 3244 - DNA, 20 bp, Artificial Sequence
  chemically synthesized
agctaagacgtagtgcccca

SEQ ID NO: 3245 - DNA, 20 bp, Artificial Sequence
  chemically synthesized
gtgccccatggctcctcctg

SEQ ID NO: 3246 - DNA, 20 bp, Artificial Sequence
  chemically synthesized
gccccatggctcctcctgtg

SEQ ID NO: 3247 - DNA, 20 bp, Artificial Sequence
  chemically synthesized
atggctcctcctgtggagac

SEQ ID NO: 3248 - DNA, 20 bp, Artificial Sequence
  chemically synthesized
ggctcctcctgtggagacaa

SEQ ID NO: 3249 - DNA, 20 bp, Artificial Sequence
  chemically synthesized
tcctgtggagacaagagacc

SEQ ID NO: 3250 - DNA, 20 bp, Artificial Sequence
  chemically synthesized
cctgtggagacaagagaccc

SEQ ID NO: 3251 - DNA, 20 bp, Artificial Sequence
  chemically synthesized
tggagacaagagacccagga

SEQ ID NO: 3252 - DNA, 20 bp, Artificial Sequence
  chemically synthesized
gagacaagagacccaggaaa

SEQ ID NO: 3253 - DNA, 20 bp, Artificial Sequence
  chemically synthesized
agacaagagacccaggaaag

SEQ ID NO: 3254 - DNA, 20 bp, Artificial Sequence
  chemically synthesized
ggaaagaggcatcacaaacc

SEQ ID NO: 3255 - DNA, 20 bp, Artificial Sequence
  chemically synthesized
gaaagaggcatcacaaacct

SEQ ID NO: 3256 - DNA, 20 bp, Artificial Sequence
  chemically synthesized
ctcattcacccatctcaatt

SEQ ID NO: 3257 - DNA, 20 bp, Artificial Sequence
  chemically synthesized
cacccatctcaatttagacc

SEQ ID NO: 3258 - DNA, 20 bp, Artificial Sequence
  chemically synthesized
acccatctcaatttagacct

SEQ ID NO: 3259 - DNA, 20 bp, Artificial Sequence
  chemically synthesized
aatttagacctgggcactat

SEQ ID NO: 3260 - DNA, 20 bp, Artificial Sequence
  chemically synthesized
cctgggcactattggatttc

SEQ ID NO: 3261 - DNA, 20 bp, Artificial Sequence
  chemically synthesized
aagaaccattatctctcatc

SEQ ID NO: 3262 - DNA, 20 bp, Artificial Sequence
  chemically synthesized
tctcatctggaaatgcttat

SEQ ID NO: 3263 - DNA, 20 bp, Artificial Sequence
  chemically synthesized
atgcttattggctttctaac

SEQ ID NO: 3264 - DNA, 20 bp, Artificial Sequence
  chemically synthesized
taacaacacattcaccatat

SEQ ID NO: 3265 - DNA, 20 bp, Artificial Sequence
  chemically synthesized
aacaacacattcaccatata

SEQ ID NO: 3266 - DNA, 20 bp, Artificial Sequence
  chemically synthesized
acaacacattcaccatataa

SEQ ID NO: 3267 - DNA, 20 bp, Artificial Sequence
  chemically synthesized
aacacattcaccatataagg

SEQ ID NO: 3268 - DNA, 20 bp, Artificial Sequence
  chemically synthesized
tcaccatataagggagatcg

SEQ ID NO: 3269 - DNA, 20 bp, Artificial Sequence
  chemically synthesized
agatcgtggtcctcctttct

SEQ ID NO: 3270 - DNA, 20 bp, Artificial Sequence
  chemically synthesized
gatcgtggtcctcctttctt

SEQ ID NO: 3271 - DNA, 20 bp, Artificial Sequence
  chemically synthesized
aggatccttcaatgacaccc

SEQ ID NO: 3272 - DNA, 20 bp, Artificial Sequence
  chemically synthesized
atcataacccaatatcccaa

SEQ ID NO: 3273 - DNA, 20 bp, Artificial Sequence
  chemically synthesized
ccaatatcccaaaagaccct

SEQ ID NO: 3274 - DNA, 20 bp, Artificial Sequence
  chemically synthesized
aagacccttggactctgtat

SEQ ID NO: 3275 - DNA, 20 bp, Artificial Sequence
  chemically synthesized
cccttggactctgtatgagc

SEQ ID NO: 3276 - DNA, 20 bp, Artificial Sequence
  chemically synthesized
attctcttttccctacacca

SEQ ID NO: 3277 - DNA, 20 bp, Artificial Sequence
  chemically synthesized
ttccctacaccacagatgtt

SEQ ID NO: 3278 - DNA, 20 bp, Artificial Sequence
  chemically synthesized
tccctacaccacagatgttc

SEQ ID NO: 3279 - DNA, 20 bp, Artificial Sequence
  chemically synthesized
ccctacaccacagatgttca

SEQ ID NO: 3280 - DNA, 20 bp, Artificial Sequence
  chemically synthesized
cctacaccacagatgttcag

SEQ ID NO: 3281 - DNA, 20 bp, Artificial Sequence
  chemically synthesized
ctacaccacagatgttcagg

SEQ ID NO: 3282 - DNA, 20 bp, Artificial Sequence
  chemically synthesized
caccacagatgttcaggggg

SEQ ID NO: 3283 - DNA, 20 bp, Artificial Sequence
  chemically synthesized
agggggtagaaatgcataat

SEQ ID NO: 3284 - DNA, 20 bp, Artificial Sequence
  chemically synthesized
ggtagaaatgcataattggt

SEQ ID NO: 3285 - DNA, 20 bp, Artificial Sequence
  chemically synthesized
aatgcataattggtgagtga

SEQ ID NO: 3286 - DNA, 20 bp, Artificial Sequence
  chemically synthesized
gagtgatagctacgcaaact

SEQ ID NO: 3287 - DNA, 20 bp, Artificial Sequence
  chemically synthesized
agtgatagctacgcaaactc

SEQ ID NO: 3288 - DNA, 20 bp, Artificial Sequence
  chemically synthesized
gtgatagctacgcaaactca

SEQ ID NO: 3289 - DNA, 20 bp, Artificial Sequence
  chemically synthesized
agctacgcaaactcagggtt

SEQ ID NO: 3290 - DNA, 20 bp, Artificial Sequence
  chemically synthesized
gctacgcaaactcagggtta

SEQ ID NO: 3291 - DNA, 20 bp, Artificial Sequence
  chemically synthesized
gcaaactcagggttaaggta

SEQ ID NO: 3292 - DNA, 20 bp, Artificial Sequence
  chemically synthesized
agtaattatttctaatctcc

SEQ ID NO: 3293 - DNA, 20 bp, Artificial Sequence
  chemically synthesized
atgccttatactctcctact

SEQ ID NO: 3294 - DNA, 20 bp, Artificial Sequence
  chemically synthesized
ttatactctcctacttggca

SEQ ID NO: 3295 - DNA, 20 bp, Artificial Sequence
  chemically synthesized
gcatggttgctccgtctgtg

SEQ ID NO: 3296 - DNA, 20 bp, Artificial Sequence
  chemically synthesized
tcatcttcaacctcacctaa

SEQ ID NO: 3297 - DNA, 20 bp, Artificial Sequence
  chemically synthesized
caacctcacctaatggaatc

SEQ ID NO: 3298 - DNA, 20 bp, Artificial Sequence
  chemically synthesized
tggaatccagcttctccttc

SEQ ID NO: 3299 - DNA, 20 bp, Artificial Sequence
  chemically synthesized
ccagcttctccttcaagatc

SEQ ID NO: 3300 - DNA, 20 bp, Artificial Sequence
  chemically synthesized
gcttctccttcaagatccag

SEQ ID NO: 3301 - DNA, 20 bp, Artificial Sequence
  chemically synthesized
cttctccttcaagatccaga

SEQ ID NO: 3302 - DNA, 20 bp, Artificial Sequence
  chemically synthesized
cagaaggctatcttgatccc

SEQ ID NO: 3303 - DNA, 20 bp, Artificial Sequence
  chemically synthesized
attctttcctttgacaccct

SEQ ID NO: 3304 - DNA, 20 bp, Artificial Sequence
  chemically synthesized
catttgcttcctgcctgctt

SEQ ID NO: 3305 - DNA, 20 bp, Artificial Sequence
  chemically synthesized
atttgcttcctgcctgcttt

SEQ ID NO: 3306 - DNA, 20 bp, Artificial Sequence
  chemically synthesized
ctgcctgctttaggacctca

SEQ ID NO: 3307 - DNA, 20 bp, Artificial Sequence
  chemically synthesized
tgcctgctttaggacctcat

SEQ ID NO: 3308 - DNA, 20 bp, Artificial Sequence
  chemically synthesized
gcctgctttaggacctcatg

SEQ ID NO: 3309 - DNA, 20 bp, Artificial Sequence
  chemically synthesized
ctatcaatttcattccctac

SEQ ID NO: 3310 - DNA, 20 bp, Artificial Sequence
  chemically synthesized
atttcattccctaccagatt

SEQ ID NO: 3311 - DNA, 20 bp, Artificial Sequence
  chemically synthesized
tttcattccctaccagattt

SEQ ID NO: 3312 - DNA, 20 bp, Artificial Sequence
  chemically synthesized
ccctaccagatttgggttct

SEQ ID NO: 3313 - DNA, 20 bp, Artificial Sequence
  chemically synthesized
ccagatttgggttctgagaa

SEQ ID NO: 3314 - DNA, 20 bp, Artificial Sequence
  chemically synthesized
ttgggttctgagaatagcca

SEQ ID NO: 3315 - DNA, 20 bp, Artificial Sequence
  chemically synthesized
acagtgacttctcaacctca

SEQ ID NO: 3316 - DNA, 20 bp, Artificial Sequence
  chemically synthesized
agcccctgtactaccttaaa

SEQ ID NO: 3317 - DNA, 20 bp, Artificial Sequence
  chemically synthesized
cttaaacagctcttgcaaaa

SEQ ID NO: 3318 - DNA, 20 bp, Artificial Sequence
  chemically synthesized
aaacagctcttgcaaaatag

SEQ ID NO: 3319 - DNA, 20 bp, Artificial Sequence
  chemically synthesized
aacagctcttgcaaaatagt

SEQ ID NO: 3320 - DNA, 20 bp, Artificial Sequence
  chemically synthesized
gcaaaatagtaggtgctctg

SEQ ID NO: 3321 - DNA, 20 bp, Artificial Sequence
  chemically synthesized
tctgaagatgtttgttgaat

SEQ ID NO: 3322 - DNA, 20 bp, Artificial Sequence
  chemically synthesized
tgaagatgtttgttgaatta

SEQ ID NO: 3323 - DNA, 20 bp, Artificial Sequence
  chemically synthesized
tgaattagagactttcattc

SEQ ID NO: 3324 - DNA, 20 bp, Artificial Sequence
  chemically synthesized
gaattagagactttcattct

SEQ ID NO: 3325 - DNA, 20 bp, Artificial Sequence
  chemically synthesized
aattagagactttcattctg

SEQ ID NO: 3326 - DNA, 20 bp, Artificial Sequence
  chemically synthesized
ttagagactttcattctggg

SEQ ID NO: 3327 - DNA, 20 bp, Artificial Sequence
  chemically synthesized
aaccattattttctgtctcc

SEQ ID NO: 3328 - DNA, 20 bp, Artificial Sequence
  chemically synthesized
accattattttctgtctccc

SEQ ID NO: 3329 - DNA, 20 bp, Artificial Sequence
  chemically synthesized
ccattattttctgtctccca

SEQ ID NO: 3330 - DNA, 20 bp, Artificial Sequence
  chemically synthesized
attattttctgtctcccagg

SEQ ID NO: 3331 - DNA, 20 bp, Artificial Sequence
  chemically synthesized
tctgtctcccagggagctgc

SEQ ID NO: 3332 - DNA, 20 bp, Artificial Sequence
  chemically synthesized
gggagctgctggtgtcccca

SEQ ID NO: 3333 - DNA, 20 bp, Artificial Sequence
  chemically synthesized
tgtccccaaagaatataaat

SEQ ID NO: 3334 - DNA, 20 bp, Artificial Sequence
  chemically synthesized
aatgagaaaaatgcttccca

SEQ ID NO: 3335 - DNA, 20 bp, Artificial Sequence
  chemically synthesized
aaaatgcttcccatggatgc

SEQ ID NO: 3336 - DNA, 20 bp, Artificial Sequence
  chemically synthesized
cccctcttcccactgtgccc

SEQ ID NO: 3337 - DNA, 20 bp, Artificial Sequence
  chemically synthesized
ccctcttcccactgtgccct

SEQ ID NO: 3338 - DNA, 20 bp, Artificial Sequence
  chemically synthesized
cctcttcccactgtgccctg

SEQ ID NO: 3339 - DNA, 20 bp, Artificial Sequence
  chemically synthesized
cttcccactgtgccctgggg

SEQ ID NO: 3340 - DNA, 20 bp, Artificial Sequence
  chemically synthesized
tcccactgtgccctggggca

SEQ ID NO: 3341 - DNA, 20 bp, Artificial Sequence
  chemically synthesized
cccactgtgccctggggcag

SEQ ID NO: 3342 - DNA, 20 bp, Artificial Sequence
  chemically synthesized
tgccctggggcagaggtact

SEQ ID NO: 3343 - DNA, 20 bp, Artificial Sequence
  chemically synthesized
ccctggggcagaggtactaa

SEQ ID NO: 3344 - DNA, 20 bp, Artificial Sequence
  chemically synthesized
tgaacaaaattccaatgaac

SEQ ID NO: 3345 - DNA, 20 bp, Artificial Sequence
  chemically synthesized
gaacaagatgacgacaaaaa

SEQ ID NO: 3346 - DNA, 20 bp, Artificial Sequence
  chemically synthesized
ccactgatgactccaatgac

SEQ ID NO: 3347 - DNA, 20 bp, Artificial Sequence
  chemically synthesized
cactgatgactccaatgact

SEQ ID NO: 3348 - DNA, 20 bp, Artificial Sequence
  chemically synthesized
actgatgactccaatgacta

SEQ ID NO: 3349 - DNA, 20 bp, Artificial Sequence
  chemically synthesized
gactccaatgactagggtgc

SEQ ID NO: 3350 - DNA, 20 bp, Artificial Sequence
  chemically synthesized
ccaatgactagggtgccaga

SEQ ID NO: 3351 - DNA, 20 bp, Artificial Sequence
  chemically synthesized
tgactagggtgccagacggt

SEQ ID NO: 3352 - DNA, 20 bp, Artificial Sequence
  chemically synthesized
gactagggtgccagacggtg

SEQ ID NO: 3353 - DNA, 20 bp, Artificial Sequence
  chemically synthesized
actagggtgccagacggtga

SEQ ID NO: 3354 - DNA, 20 bp, Artificial Sequence
  chemically synthesized
agacggtgagggctctaaaa

SEQ ID NO: 3355 - DNA, 20 bp, Artificial Sequence
  chemically synthesized
tgagggctctaaaacagaaa

SEQ ID NO: 3356 - DNA, 20 bp, Artificial Sequence
  chemically synthesized
ggctctaaaacagaaaaagc

SEQ ID NO: 3357 - DNA, 20 bp, Artificial Sequence
  chemically synthesized
aaaacagaaaaagcaagtta

SEQ ID NO: 3358 - DNA, 20 bp, Artificial Sequence
  chemically synthesized
aagcctttgattgccaccct

SEQ ID NO: 3359 - DNA, 20 bp, Artificial Sequence
  chemically synthesized
cctcagcccaccccctaaca

SEQ ID NO: 3360 - DNA, 20 bp, Artificial Sequence
  chemically synthesized
tcagcccaccccctaacaaa

SEQ ID NO: 3361 - DNA, 20 bp, Artificial Sequence
  chemically synthesized
gcccaccccctaacaaagag

SEQ ID NO: 3362 - DNA, 20 bp, Artificial Sequence
  chemically synthesized
cactgccataattacctcct

SEQ ID NO: 3363 - DNA, 20 bp, Artificial Sequence
  chemically synthesized
actgccataattacctcctc

SEQ ID NO: 3364 - DNA, 20 bp, Artificial Sequence
  chemically synthesized
gcactcctctcaacccccaa

SEQ ID NO: 3365 - DNA, 20 bp, Artificial Sequence
  chemically synthesized
caacccccaatagattttct

SEQ ID NO: 3366 - DNA, 20 bp, Artificial Sequence
  chemically synthesized
caatagattttctcagctcc

SEQ ID NO: 3367 - DNA, 20 bp, Artificial Sequence
  chemically synthesized
tctcagctcctggctctcat

SEQ ID NO: 3368 - DNA, 20 bp, Artificial Sequence
  chemically synthesized
ctctcatcagtcacataccc

SEQ ID NO: 3369 - DNA, 20 bp, Artificial Sequence
  chemically synthesized
cacataccccagatcacaat

SEQ ID NO: 3370 - DNA, 20 bp, Artificial Sequence
  chemically synthesized
acataccccagatcacaatg

SEQ ID NO: 3371 - DNA, 20 bp, Artificial Sequence
  chemically synthesized
cataccccagatcacaatga

SEQ ID NO: 3372 - DNA, 20 bp, Artificial Sequence
  chemically synthesized
ataccccagatcacaatgag

SEQ ID NO: 3373 - DNA, 20 bp, Artificial Sequence
  chemically synthesized
atcacaatgaggggctgatc

SEQ ID NO: 3374 - DNA, 20 bp, Artificial Sequence
  chemically synthesized
tcacaatgaggggctgatcc

SEQ ID NO: 3375 - DNA, 20 bp, Artificial Sequence
  chemically synthesized
atgaggggctgatccaggcc

SEQ ID NO: 3376 - DNA, 20 bp, Artificial Sequence
  chemically synthesized
tgaggggctgatccaggcct

SEQ ID NO: 3377 - DNA, 20 bp, Artificial Sequence
  chemically synthesized
ccaggcctgggtgctccacc

SEQ ID NO: 3378 - DNA, 20 bp, Artificial Sequence
  chemically synthesized
cgtatatctctgctcttccc

SEQ ID NO: 3379 - DNA, 20 bp, Artificial Sequence
  chemically synthesized
gtatatctctgctcttcccc

SEQ ID NO: 3380 - DNA, 20 bp, Artificial Sequence
  chemically synthesized
tatatctctgctcttcccca

SEQ ID NO: 3381 - DNA, 20 bp, Artificial Sequence
  chemically synthesized
atatctctgctcttccccag

SEQ ID NO: 3382 - DNA, 20 bp, Artificial Sequence
  chemically synthesized
tatctctgctcttccccagg

SEQ ID NO: 3383 - DNA, 20 bp, Artificial Sequence
  chemically synthesized
ctgctcttccccagggggta

SEQ ID NO: 3384 - DNA, 20 bp, Artificial Sequence
  chemically synthesized
cttccccagggggtacagcc

SEQ ID NO: 3385 - DNA, 20 bp, Artificial Sequence
  chemically synthesized
ttccccagggggtacagcca

SEQ ID NO: 3386 - DNA, 20 bp, Artificial Sequence
  chemically synthesized
ggggtacagccaaggttatc

SEQ ID NO: 3387 - DNA, 20 bp, Artificial Sequence
  chemically synthesized
cagccaaggttatccagccc

SEQ ID NO: 3388 - DNA, 20 bp, Artificial Sequence
  chemically synthesized
ccaaggttatccagccctgg

SEQ ID NO: 3389 - DNA, 20 bp, Artificial Sequence
  chemically synthesized
caaggttatccagccctggt

SEQ ID NO: 3390 - DNA, 20 bp, Artificial Sequence
  chemically synthesized
ctggtaggtcccatccccat

SEQ ID NO: 3391 - DNA, 20 bp, Artificial Sequence
  chemically synthesized
tggtaggtcccatccccatt

SEQ ID NO: 3392 - DNA, 20 bp, Artificial Sequence
  chemically synthesized
cccattgggcaatacgtctt

SEQ ID NO: 3393 - DNA, 20 bp, Artificial Sequence
  chemically synthesized
ccattgggcaatacgtcttt

SEQ ID NO: 3394 - DNA, 20 bp, Artificial Sequence
  chemically synthesized
gtctttaggttcgaactcct

SEQ ID NO: 3395 - DNA, 20 bp, Artificial Sequence
  chemically synthesized
tcgaactccttggcatccat

SEQ ID NO: 3396 - DNA, 20 bp, Artificial Sequence
  chemically synthesized
tccattggctgcttatcctt

SEQ ID NO: 3397 - DNA, 20 bp, Artificial Sequence
  chemically synthesized
cttatccttcagccacttca

SEQ ID NO: 3398 - DNA, 20 bp, Artificial Sequence
  chemically synthesized
gccacttcatggtgatgttc

SEQ ID NO: 3399 - DNA, 20 bp, Artificial Sequence
  chemically synthesized
ccacttcatggtgatgttct

SEQ ID NO: 3400 - DNA, 20 bp, Artificial Sequence
  chemically synthesized
cacttcatggtgatgttctg

SEQ ID NO: 3401 - DNA, 20 bp, Artificial Sequence
  chemically synthesized
acttcatggtgatgttctgg

SEQ ID NO: 3402 - DNA, 20 bp, Artificial Sequence
  chemically synthesized
tcatggtgatgttctggggg

SEQ ID NO: 3403 - DNA, 20 bp, Artificial Sequence
  chemically synthesized
tggtgatgttctgggggtag

SEQ ID NO: 3404 - DNA, 20 bp, Artificial Sequence
  chemically synthesized
tgttctgggggtagtagttc

SEQ ID NO: 3405 - DNA, 20 bp, Artificial Sequence
  chemically synthesized
gttctgggggtagtagttca

SEQ ID NO: 3406 - DNA, 20 bp, Artificial Sequence
  chemically synthesized
tagttcaaggcccgacaccg

SEQ ID NO: 3407 - DNA, 20 bp, Artificial Sequence
  chemically synthesized
gttcaaggcccgacaccgta

SEQ ID NO: 3408 - DNA, 20 bp, Artificial Sequence
  chemically synthesized
caaggcccgacaccgtagag

SEQ ID NO: 3409 - DNA, 20 bp, Artificial Sequence
  chemically synthesized
acaccgtagagtggtcactg

SEQ ID NO: 3410 - DNA, 20 bp, Artificial Sequence
  chemically synthesized
accgtagagtggtcactgaa

SEQ ID NO: 3411 - DNA, 20 bp, Artificial Sequence
  chemically synthesized
ccgtagagtggtcactgaag

SEQ ID NO: 3412 - DNA, 20 bp, Artificial Sequence
  chemically synthesized
atgatgtgtcaccttcacca

SEQ ID NO: 3413 - DNA, 20 bp, Artificial Sequence
  chemically synthesized
tgatgtgtcaccttcaccaa

SEQ ID NO: 3414 - DNA, 20 bp, Artificial Sequence
  chemically synthesized
atgtgtcaccttcaccaaag

SEQ ID NO: 3415 - DNA, 20 bp, Artificial Sequence
  chemically synthesized
tgtgtcaccttcaccaaagg

SEQ ID NO: 3416 - DNA, 20 bp, Artificial Sequence
  chemically synthesized
tcaccaaaggaggcacttga

SEQ ID NO: 3417 - DNA, 20 bp, Artificial Sequence
  chemically synthesized
caccaaaggaggcacttgac

SEQ ID NO: 3418 - DNA, 20 bp, Artificial Sequence
  chemically synthesized
aaaggaggcacttgacagga

SEQ ID NO: 3419 - DNA, 20 bp, Artificial Sequence
  chemically synthesized
aggaggcacttgacaggaaa

SEQ ID NO: 3420 - DNA, 20 bp, Artificial Sequence
  chemically synthesized
ggaggcacttgacaggaaag

SEQ ID NO: 3421 - DNA, 20 bp, Artificial Sequence
  chemically synthesized
ggcacttgacaggaaagagg

SEQ ID NO: 3422 - DNA, 20 bp, Artificial Sequence
  chemically synthesized
gcacttgacaggaaagagga

SEQ ID NO: 3423 - DNA, 20 bp, Artificial Sequence
  chemically synthesized
tgacaggaaagaggaaggat

SEQ ID NO: 3424 - DNA, 20 bp, Artificial Sequence
  chemically synthesized
gacaggaaagaggaaggatg

SEQ ID NO: 3425 - DNA, 20 bp, Artificial Sequence
  chemically synthesized
caggaaagaggaaggatgag

SEQ ID NO: 3426 - DNA, 20 bp, Artificial Sequence
  chemically synthesized
ggaaagaggaaggatgagga

SEQ ID NO: 3427 - DNA, 20 bp, Artificial Sequence
  chemically synthesized
gaaagaggaaggatgaggag

SEQ ID NO: 3428 - DNA, 20 bp, Artificial Sequence
  chemically synthesized
aaagaggaaggatgaggaga

SEQ ID NO: 3429 - DNA, 20 bp, Artificial Sequence
  chemically synthesized
aagaggaaggatgaggagag

SEQ ID NO: 3430 - DNA, 20 bp, Artificial Sequence
  chemically synthesized
ggggatctgtttacccttgc

SEQ ID NO: 3431 - DNA, 20 bp, Artificial Sequence
  chemically synthesized
gggatctgtttacccttgcc

SEQ ID NO: 3432 - DNA, 20 bp, Artificial Sequence
  chemically synthesized
atctgtttacccttgccagg

SEQ ID NO: 3433 - DNA, 20 bp, Artificial Sequence
  chemically synthesized
tttacccttgccaggaagac

SEQ ID NO: 3434 - DNA, 20 bp, Artificial Sequence
  chemically synthesized
ggaactttcacttccttcta

SEQ ID NO: 3435 - DNA, 20 bp, Artificial Sequence
  chemically synthesized
gaactttcacttccttctat

SEQ ID NO: 3436 - DNA, 20 bp, Artificial Sequence
  chemically synthesized
tttcacttccttctataggt

SEQ ID NO: 3437 - DNA, 20 bp, Artificial Sequence
  chemically synthesized
tcacttccttctataggttg

SEQ ID NO: 3438 - DNA, 20 bp, Artificial Sequence
  chemically synthesized
cacttccttctataggttgg

SEQ ID NO: 3439 - DNA, 20 bp, Artificial Sequence
  chemically synthesized
ttccttctataggttggagg

SEQ ID NO: 3440 - DNA, 20 bp, Artificial Sequence
  chemically synthesized
tccttctataggttggagga

SEQ ID NO: 3441 - DNA, 20 bp, Artificial Sequence
  chemically synthesized
gaggaaggaaataccctttt

SEQ ID NO: 3442 - DNA, 20 bp, Artificial Sequence
  chemically synthesized
tacccttttcagaaaaaaac

SEQ ID NO: 3443 - DNA, 20 bp, Artificial Sequence
  chemically synthesized
tttcagaaaaaaacaagcta

SEQ ID NO: 3444 - DNA, 20 bp, Artificial Sequence
  chemically synthesized
ttcagaaaaaaacaagctac

SEQ ID NO: 3445 - DNA, 20 bp, Artificial Sequence
  chemically synthesized
cagaaaaaaacaagctacag

SEQ ID NO: 3446 - DNA, 20 bp, Artificial Sequence
  chemically synthesized
gaaaaaaacaagctacagga

SEQ ID NO: 3447 - DNA, 20 bp, Artificial Sequence
  chemically synthesized
gagacaccattttgtgtcct

SEQ ID NO: 3448 - DNA, 20 bp, Artificial Sequence
  chemically synthesized
accattttgtgtcctaagat

SEQ ID NO: 3449 - DNA, 20 bp, Artificial Sequence
  chemically synthesized
cctaagattggactctaaca

SEQ ID NO: 3450 - DNA, 20 bp, Artificial Sequence
  chemically synthesized
gactctaacacagtgtcact

SEQ ID NO: 3451 - DNA, 20 bp, Artificial Sequence
  chemically synthesized
ctctaacacagtgtcacttg

SEQ ID NO: 3452 - DNA, 20 bp, Artificial Sequence
  chemically synthesized
ctaacacagtgtcacttgga

SEQ ID NO: 3453 - DNA, 20 bp, Artificial Sequence
  chemically synthesized
acacagtgtcacttggagag

SEQ ID NO: 3454 - DNA, 20 bp, Artificial Sequence
  chemically synthesized
agtgtcacttggagagcagt

SEQ ID NO: 3455 - DNA, 20 bp, Artificial Sequence
  chemically synthesized
cacttggagagcagtcagat

SEQ ID NO: 3456 - DNA, 20 bp, Artificial Sequence
  chemically synthesized
acccatgttctttgttctga

SEQ ID NO: 3457 - DNA, 20 bp, Artificial Sequence
  chemically synthesized
gcattgaaaatgattgaata

SEQ ID NO: 3458 - DNA, 20 bp, Artificial Sequence
  chemically synthesized
tgaaaatgattgaatacaga

SEQ ID NO: 3459 - DNA, 20 bp, Artificial Sequence
  chemically synthesized
aatgattgaatacagatggt

SEQ ID NO: 3460 - DNA, 20 bp, Artificial Sequence
  chemically synthesized
tacagatggtcagtttcacc

SEQ ID NO: 3461 - DNA, 20 bp, Artificial Sequence
  chemically synthesized
acagatggtcagtttcacct

SEQ ID NO: 3462 - DNA, 20 bp, Artificial Sequence
  chemically synthesized
cagtttcacctgggtcaacc

SEQ ID NO: 3463 - DNA, 20 bp, Artificial Sequence
  chemically synthesized
agtttcacctgggtcaacct

SEQ ID NO: 3464 - DNA, 20 bp, Artificial Sequence
  chemically synthesized
tttcacctgggtcaacctag

SEQ ID NO: 3465 - DNA, 20 bp, Artificial Sequence
  chemically synthesized
ttcacctgggtcaacctagg

SEQ ID NO: 3466 - DNA, 20 bp, Artificial Sequence
  chemically synthesized
aacctaggaggcattgttat

SEQ ID NO: 3467 - DNA, 20 bp, Artificial Sequence
  chemically synthesized
ctaggaggcattgttataag

SEQ ID NO: 3468 - DNA, 20 bp, Artificial Sequence
  chemically synthesized
ggaggcattgttataagaag

SEQ ID NO: 3469 - DNA, 20 bp, Artificial Sequence
  chemically synthesized
gttataagaagcggacttgt

SEQ ID NO: 3470 - DNA, 20 bp, Artificial Sequence
  chemically synthesized
taagaagcggacttgtaaga

SEQ ID NO: 3471 - DNA, 20 bp, Artificial Sequence
  chemically synthesized
aagaagcggacttgtaagat

SEQ ID NO: 3472 - DNA, 20 bp, Artificial Sequence
  chemically synthesized
aagcggacttgtaagatagg

SEQ ID NO: 3473 - DNA, 20 bp, Artificial Sequence
  chemically synthesized
acttgtaagataggtagctt

SEQ ID NO: 3474 - DNA, 20 bp, Artificial Sequence
  chemically synthesized
attattgctatgttctatga

SEQ ID NO: 3475 - DNA, 20 bp, Artificial Sequence
  chemically synthesized
tgaaagaaacttttaaccta

SEQ ID NO: 3476 - DNA, 20 bp, Artificial Sequence
  chemically synthesized
gaaagaaacttttaacctaa

SEQ ID NO: 3477 - DNA, 20 bp, Artificial Sequence
  chemically synthesized
aaggattcttctactctgat

SEQ ID NO: 3478 - DNA, 20 bp, Artificial Sequence
  chemically synthesized
gattcttctactctgataag

SEQ ID NO: 3479 - DNA, 20 bp, Artificial Sequence
  chemically synthesized
cctcacttgatattttgtcc

SEQ ID NO: 3480 - DNA, 20 bp, Artificial Sequence
  chemically synthesized
ttgtcctggtattcatatga

SEQ ID NO: 3481 - DNA, 20 bp, Artificial Sequence
  chemically synthesized
ctggtattcatatgatagct

SEQ ID NO: 3482 - DNA, 20 bp, Artificial Sequence
  chemically synthesized
tttttttttttttttttttt

SEQ ID NO: 3483 - DNA, 20 bp, Artificial Sequence
  chemically synthesized
ttttttttttttttttaaga

SEQ ID NO: 3484 - DNA, 20 bp, Artificial Sequence
  chemically synthesized
ttttttttttttttaagatg

SEQ ID NO: 3485 - DNA, 20 bp, Artificial Sequence
  chemically synthesized
tggagtctcactctgctgcc

SEQ ID NO: 3486 - DNA, 20 bp, Artificial Sequence
  chemically synthesized
ggagtctcactctgctgcct

SEQ ID NO: 3487 - DNA, 20 bp, Artificial Sequence
  chemically synthesized
tctcactctgctgcctaggc

SEQ ID NO: 3488 - DNA, 20 bp, Artificial Sequence
  chemically synthesized
tcactctgctgcctaggctg

SEQ ID NO: 3489 - DNA, 20 bp, Artificial Sequence
  chemically synthesized
ctgctgcctaggctggagtg

SEQ ID NO: 3490 - DNA, 20 bp, Artificial Sequence
  chemically synthesized
ctgcctaggctggagtgcag

SEQ ID NO: 3491 - DNA, 20 bp, Artificial Sequence
  chemically synthesized
ggagtgcagtggcgcgatct

SEQ ID NO: 3492 - DNA, 20 bp, Artificial Sequence
  chemically synthesized
gcagtggcgcgatcttggct

SEQ ID NO: 3493 - DNA, 20 bp, Artificial Sequence
  chemically synthesized
tcagtgcaacttccgcttcc

SEQ ID NO: 3494 - DNA, 20 bp, Artificial Sequence
  chemically synthesized
cagtgcaacttccgcttccc

SEQ ID NO: 3495 - DNA, 20 bp, Artificial Sequence
  chemically synthesized
aacttccgcttcccaggttc

SEQ ID NO: 3496 - DNA, 20 bp, Artificial Sequence
  chemically synthesized
ttcaagcgatgctcctgcct

SEQ ID NO: 3497 - DNA, 20 bp, Artificial Sequence
  chemically synthesized
tcctgcctcagccttccaat

SEQ ID NO: 3498 - DNA, 20 bp, Artificial Sequence
  chemically synthesized
gcctcagccttccaattagc

SEQ ID NO: 3499 - DNA, 20 bp, Artificial Sequence
  chemically synthesized
cctcagccttccaattagct

SEQ ID NO: 3500 - DNA, 20 bp, Artificial Sequence
  chemically synthesized
cttccaattagctgggacta

SEQ ID NO: 3501 - DNA, 20 bp, Artificial Sequence
  chemically synthesized
ttccaattagctgggactac

SEQ ID NO: 3502 - DNA, 20 bp, Artificial Sequence
  chemically synthesized
caggtgcgcatgactgtgac

SEQ ID NO: 3503 - DNA, 20 bp, Artificial Sequence
  chemically synthesized
agctaatttttgtatttttt

SEQ ID NO: 3504 - DNA, 20 bp, Artificial Sequence
  chemically synthesized
ctaatttttgtattttttta

SEQ ID NO: 3505 - DNA, 20 bp, Artificial Sequence
  chemically synthesized
tttttgtatttttttagaga

SEQ ID NO: 3506 - DNA, 20 bp, Artificial Sequence
  chemically synthesized
ttttgtatttttttagagac

SEQ ID NO: 3507 - DNA, 20 bp, Artificial Sequence
  chemically synthesized
agagacgggtttcaccatgt

SEQ ID NO: 3508 - DNA, 20 bp, Artificial Sequence
  chemically synthesized
acgggtttcaccatgttggt

SEQ ID NO: 3509 - DNA, 20 bp, Artificial Sequence
  chemically synthesized
cgggtttcaccatgttggtc

SEQ ID NO: 3510 - DNA, 20 bp, Artificial Sequence
  chemically synthesized
tttcaccatgttggtcaggc

SEQ ID NO: 3511 - DNA, 20 bp, Artificial Sequence
  chemically synthesized
gaccttgtgaccacccgcct

SEQ ID NO: 3512 - DNA, 20 bp, Artificial Sequence
  chemically synthesized
ccacccgcctcggcctccca

SEQ ID NO: 3513 - DNA, 20 bp, Artificial Sequence
  chemically synthesized
gcctcggcctcccaaagtgc

SEQ ID NO: 3514 - DNA, 20 bp, Artificial Sequence
  chemically synthesized
cctcggcctcccaaagtgct

SEQ ID NO: 3515 - DNA, 20 bp, Artificial Sequence
  chemically synthesized
ctcccaaagtgctgggatta

SEQ ID NO: 3516 - DNA, 20 bp, Artificial Sequence
  chemically synthesized
tcccaaagtgctgggattac

SEQ ID NO: 3517 - DNA, 20 bp, Artificial Sequence
  chemically synthesized
cccaaagtgctgggattaca

SEQ ID NO: 3518 - DNA, 20 bp, Artificial Sequence
  chemically synthesized
ccaaagtgctgggattacag

SEQ ID NO: 3519 - DNA, 20 bp, Artificial Sequence
  chemically synthesized
agtgctgggattacaggggt

SEQ ID NO: 3520 - DNA, 20 bp, Artificial Sequence
  chemically synthesized
caggggtgagccaccgtgcc

SEQ ID NO: 3521 - DNA, 20 bp, Artificial Sequence
  chemically synthesized
tgacatttctgaatttttaa

SEQ ID NO: 3522 - DNA, 20 bp, Artificial Sequence
  chemically synthesized
gacatttctgaatttttaac

SEQ ID NO: 3523 - DNA, 20 bp, Artificial Sequence
  chemically synthesized
taacaggtataaatatacaa

SEQ ID NO: 3524 - DNA, 20 bp, Artificial Sequence
  chemically synthesized
ataaatatacaaaagattat

SEQ ID NO: 3525 - DNA, 20 bp, Artificial Sequence
  chemically synthesized
aagattattggttaaataaa

SEQ ID NO: 3526 - DNA, 20 bp, Artificial Sequence
  chemically synthesized
ttattggttaaataaaaagc

SEQ ID NO: 3527 - DNA, 20 bp, Artificial Sequence
  chemically synthesized
tattggttaaataaaaagca

SEQ ID NO: 3528 - DNA, 20 bp, Artificial Sequence
  chemically synthesized
attggttaaataaaaagcaa

SEQ ID NO: 3529 - DNA, 20 bp, Artificial Sequence
  chemically synthesized
taaataaaaagcaagggcca

SEQ ID NO: 3530 - DNA, 20 bp, Artificial Sequence
  chemically synthesized
ggccatagacacttcccttt

SEQ ID NO: 3531 - DNA, 20 bp, Artificial Sequence
  chemically synthesized
ttccctttgagccatatgca

SEQ ID NO: 3532 - DNA, 20 bp, Artificial Sequence
  chemically synthesized
ccctttgagccatatgcatg

SEQ ID NO: 3533 - DNA, 20 bp, Artificial Sequence
  chemically synthesized
tgagccatatgcatggagaa

SEQ ID NO: 3534 - DNA, 20 bp, Artificial Sequence
  chemically synthesized
gaaattaaacccatgacttg

SEQ ID NO: 3535 - DNA, 20 bp, Artificial Sequence
  chemically synthesized
gtctcatacatctcaattat

SEQ ID NO: 3536 - DNA, 20 bp, Artificial Sequence
  chemically synthesized
tctcatacatctcaattata

SEQ ID NO: 3537 - DNA, 20 bp, Artificial Sequence
  chemically synthesized
catacatctcaattataagg

SEQ ID NO: 3538 - DNA, 20 bp, Artificial Sequence
  chemically synthesized
tacatctcaattataaggta

SEQ ID NO: 3539 - DNA, 20 bp, Artificial Sequence
  chemically synthesized
caattataaggtagagactc

SEQ ID NO: 3540 - DNA, 20 bp, Artificial Sequence
  chemically synthesized
aattataaggtagagactct

SEQ ID NO: 3541 - DNA, 20 bp, Artificial Sequence
  chemically synthesized
aaggtagagactctaggatt

SEQ ID NO: 3542 - DNA, 20 bp, Artificial Sequence
  chemically synthesized
tagagactctaggattgaga

SEQ ID NO: 3543 - DNA, 20 bp, Artificial Sequence
  chemically synthesized
ggattgagaaagtcccttcc

SEQ ID NO: 3544 - DNA, 20 bp, Artificial Sequence
  chemically synthesized
gaaagtcccttcccagaatt

SEQ ID NO: 3545 - DNA, 20 bp, Artificial Sequence
  chemically synthesized
aagtcccttcccagaatttg

SEQ ID NO: 3546 - DNA, 20 bp, Artificial Sequence
  chemically synthesized
gtcccttcccagaatttgga

SEQ ID NO: 3547 - DNA, 20 bp, Artificial Sequence
  chemically synthesized
tcccttcccagaatttggag

SEQ ID NO: 3548 - DNA, 20 bp, Artificial Sequence
  chemically synthesized
ccagaatttggagaggcaca

SEQ ID NO: 3549 - DNA, 20 bp, Artificial Sequence
  chemically synthesized
tttggagaggcacacagcct

SEQ ID NO: 3550 - DNA, 20 bp, Artificial Sequence
  chemically synthesized
gccacctctgaaactccaac

SEQ ID NO: 3551 - DNA, 20 bp, Artificial Sequence
  chemically synthesized
ccacctctgaaactccaacc

SEQ ID NO: 3552 - DNA, 20 bp, Artificial Sequence
  chemically synthesized
cacctctgaaactccaacca

SEQ ID NO: 3553 - DNA, 20 bp, Artificial Sequence
  chemically synthesized
aacctcctccactctgccac

SEQ ID NO: 3554 - DNA, 20 bp, Artificial Sequence
  chemically synthesized
cctcctccactctgccacta

SEQ ID NO: 3555 - DNA, 20 bp, Artificial Sequence
  chemically synthesized
tccactctgccactagagta

SEQ ID NO: 3556 - DNA, 20 bp, Artificial Sequence
  chemically synthesized
ccactctgccactagagtat

SEQ ID NO: 3557 - DNA, 20 bp, Artificial Sequence
  chemically synthesized
cactctgccactagagtata

SEQ ID NO: 3558 - DNA, 20 bp, Artificial Sequence
  chemically synthesized
actctgccactagagtatag

SEQ ID NO: 3559 - DNA, 20 bp, Artificial Sequence
  chemically synthesized
ctgccactagagtatagggg

SEQ ID NO: 3560 - DNA, 20 bp, Artificial Sequence
  chemically synthesized
ccactagagtataggggcag

SEQ ID NO: 3561 - DNA, 20 bp, Artificial Sequence
  chemically synthesized
gtgtttccaccataccttgt

SEQ ID NO: 3562 - DNA, 20 bp, Artificial Sequence
  chemically synthesized
tggtccaaaacacctctccc

SEQ ID NO: 3563 - DNA, 20 bp, Artificial Sequence
  chemically synthesized
aaaacacctctccccagctc

SEQ ID NO: 3564 - DNA, 20 bp, Artificial Sequence
  chemically synthesized
cccagctccagcaactgctg

SEQ ID NO: 3565 - DNA, 20 bp, Artificial Sequence
  chemically synthesized
cagcaactgctgcagctgtg

SEQ ID NO: 3566 - DNA, 20 bp, Artificial Sequence
  chemically synthesized
agcaactgctgcagctgtgc

SEQ ID NO: 3567 - DNA, 20 bp, Artificial Sequence
  chemically synthesized
gcaactgctgcagctgtgca

SEQ ID NO: 3568 - DNA, 20 bp, Artificial Sequence
  chemically synthesized
actgctgcagctgtgcaggg

SEQ ID NO: 3569 - DNA, 20 bp, Artificial Sequence
  chemically synthesized
tgtgcagggcagtccctctc

SEQ ID NO: 3570 - DNA, 20 bp, Artificial Sequence
  chemically synthesized
gtgcagggcagtccctctcc

SEQ ID NO: 3571 - DNA, 20 bp, Artificial Sequence
  chemically synthesized
cagggcagtccctctccagg

SEQ ID NO: 3572 - DNA, 20 bp, Artificial Sequence
  chemically synthesized
agggcagtccctctccaggt

SEQ ID NO: 3573 - DNA, 20 bp, Artificial Sequence
  chemically synthesized
caggtaggccctgttctgcc

SEQ ID NO: 3574 - DNA, 20 bp, Artificial Sequence
  chemically synthesized
atcttgtgcctttcccactc

SEQ ID NO: 3575 - DNA, 20 bp, Artificial Sequence
  chemically synthesized
gtgcctttcccactccagct

SEQ ID NO: 3576 - DNA, 20 bp, Artificial Sequence
  chemically synthesized
cctttcccactccagcttgg

SEQ ID NO: 3577 - DNA, 20 bp, Artificial Sequence
  chemically synthesized
ctttcccactccagcttggt

SEQ ID NO: 3578 - DNA, 20 bp, Artificial Sequence
  chemically synthesized
cccactccagcttggtgggc

SEQ ID NO: 3579 - DNA, 20 bp, Artificial Sequence
  chemically synthesized
ccactccagcttggtgggcc

SEQ ID NO: 3580 - DNA, 20 bp, Artificial Sequence
  chemically synthesized
cagcttggtgggccaggccc

SEQ ID NO: 3581 - DNA, 20 bp, Artificial Sequence
  chemically synthesized
agcttggtgggccaggccct

SEQ ID NO: 3582 - DNA, 20 bp, Artificial Sequence
  chemically synthesized
ggttctgctgctctccaatc

SEQ ID NO: 3583 - DNA, 20 bp, Artificial Sequence
  chemically synthesized
tgctctccaatccagtgtgt

SEQ ID NO: 3584 - DNA, 20 bp, Artificial Sequence
  chemically synthesized
gctctccaatccagtgtgtc

SEQ ID NO: 3585 - DNA, 20 bp, Artificial Sequence
  chemically synthesized
ctctccaatccagtgtgtca

SEQ ID NO: 3586 - DNA, 20 bp, Artificial Sequence
  chemically synthesized
tccaatccagtgtgtcaggg

SEQ ID NO: 3587 - DNA, 20 bp, Artificial Sequence
  chemically synthesized
agtgtgtcagggcagaattc

SEQ ID NO: 3588 - DNA, 20 bp, Artificial Sequence
  chemically synthesized
gtgtgtcagggcagaattca

SEQ ID NO: 3589 - DNA, 20 bp, Artificial Sequence
  chemically synthesized
tgtcagggcagaattcaagg

SEQ ID NO: 3590 - DNA, 20 bp, Artificial Sequence
  chemically synthesized
gcccatcatacccgtacttc

SEQ ID NO: 3591 - DNA, 20 bp, Artificial Sequence
  chemically synthesized
catcatacccgtacttccag

SEQ ID NO: 3592 - DNA, 20 bp, Artificial Sequence
  chemically synthesized
cccgtacttccagtagccct

SEQ ID NO: 3593 - DNA, 20 bp, Artificial Sequence
  chemically synthesized
tgttgtcttcttgcatttca

SEQ ID NO: 3594 - DNA, 20 bp, Artificial Sequence
  chemically synthesized
tcttcttgcatttcacagcc

SEQ ID NO: 3595 - DNA, 20 bp, Artificial Sequence
  chemically synthesized
cttcttgcatttcacagccc

SEQ ID NO: 3596 - DNA, 20 bp, Artificial Sequence
  chemically synthesized
tcacagcccaggatgacctg

SEQ ID NO: 3597 - DNA, 20 bp, Artificial Sequence
  chemically synthesized
cacagcccaggatgacctgc

SEQ ID NO: 3598 - DNA, 20 bp, Artificial Sequence
  chemically synthesized
acagcccaggatgacctgca

SEQ ID NO: 3599 - DNA, 20 bp, Artificial Sequence
  chemically synthesized
ccaggatgacctgcagggtg

SEQ ID NO: 3600 - DNA, 20 bp, Artificial Sequence
  chemically synthesized
caggatgacctgcagggtgt

SEQ ID NO: 3601 - DNA, 20 bp, Artificial Sequence
  chemically synthesized
acctgcagggtgtgggactc

SEQ ID NO: 3602 - DNA, 20 bp, Artificial Sequence
  chemically synthesized
tgggactctggaaaaatccc

SEQ ID NO: 3603 - DNA, 20 bp, Artificial Sequence
  chemically synthesized
agccttgttaactgcaacca

SEQ ID NO: 3604 - DNA, 20 bp, Artificial Sequence
  chemically synthesized
gccttgttaactgcaaccaa

SEQ ID NO: 3605 - DNA, 20 bp, Artificial Sequence
  chemically synthesized
gttaactgcaaccaaaggaa

SEQ ID NO: 3606 - DNA, 20 bp, Artificial Sequence
  chemically synthesized
ttaactgcaaccaaaggaat

SEQ ID NO: 3607 - DNA, 20 bp, Artificial Sequence
  chemically synthesized
tccctatttccaccatcccc

SEQ ID NO: 3608 - DNA, 20 bp, Artificial Sequence
  chemically synthesized
ccctatttccaccatcccca

SEQ ID NO: 3609 - DNA, 20 bp, Artificial Sequence
  chemically synthesized
ccccaaggaccaaatgatct

SEQ ID NO: 3610 - DNA, 20 bp, Artificial Sequence
  chemically synthesized
cccaaggaccaaatgatctc

SEQ ID NO: 3611 - DNA, 20 bp, Artificial Sequence
  chemically synthesized
aaggaccaaatgatctcagg

SEQ ID NO: 3612 - DNA, 20 bp, Artificial Sequence
  chemically synthesized
tccctcttccctgctcccac

SEQ ID NO: 3613 - DNA, 20 bp, Artificial Sequence
  chemically synthesized
tccctgctcccacaagacct

SEQ ID NO: 3614 - DNA, 20 bp, Artificial Sequence
  chemically synthesized
cccacaagacctcagacttc

SEQ ID NO: 3615 - DNA, 20 bp, Artificial Sequence
  chemically synthesized
gacttccagctgtttccttc

SEQ ID NO: 3616 - DNA, 20 bp, Artificial Sequence
  chemically synthesized
tttccttcaagatgcatgaa

SEQ ID NO: 3617 - DNA, 20 bp, Artificial Sequence
  chemically synthesized
aagatgcatgaaaagatgaa

SEQ ID NO: 3618 - DNA, 20 bp, Artificial Sequence
  chemically synthesized
atgaaaagctctgacaacct

SEQ ID NO: 3619 - DNA, 20 bp, Artificial Sequence
  chemically synthesized
tgaaaagctctgacaacctc

SEQ ID NO: 3620 - DNA, 20 bp, Artificial Sequence
  chemically synthesized
aaagctctgacaacctcagg

SEQ ID NO: 3621 - DNA, 20 bp, Artificial Sequence
  chemically synthesized
aagctctgacaacctcagga

SEQ ID NO: 3622 - DNA, 20 bp, Artificial Sequence
  chemically synthesized
tctgacaacctcaggaaggt

SEQ ID NO: 3623 - DNA, 20 bp, Artificial Sequence
  chemically synthesized
ctgacaacctcaggaaggtg

SEQ ID NO: 3624 - DNA, 20 bp, Artificial Sequence
  chemically synthesized
ctctccacatacccttgctg

SEQ ID NO: 3625 - DNA, 20 bp, Artificial Sequence
  chemically synthesized
gtggttgtgattttccataa

SEQ ID NO: 3626 - DNA, 20 bp, Artificial Sequence
  chemically synthesized
tgtgattttccataatagtc

SEQ ID NO: 3627 - DNA, 20 bp, Artificial Sequence
  chemically synthesized
gattttccataatagtccag

SEQ ID NO: 3628 - DNA, 20 bp, Artificial Sequence
  chemically synthesized
cataatagtccagaagtcaa

SEQ ID NO: 3629 - DNA, 20 bp, Artificial Sequence
  chemically synthesized
aacatgtgatcccacccttt

SEQ ID NO: 3630 - DNA, 20 bp, Artificial Sequence
  chemically synthesized
caccctttcagactctgact

SEQ ID NO: 3631 - DNA, 20 bp, Artificial Sequence
  chemically synthesized
ttcagactctgactcagctg

SEQ ID NO: 3632 - DNA, 20 bp, Artificial Sequence
  chemically synthesized
gactcagctgcagccacatc

SEQ ID NO: 3633 - DNA, 20 bp, Artificial Sequence
  chemically synthesized
catctggcttgaaattctac

SEQ ID NO: 3634 - DNA, 20 bp, Artificial Sequence
  chemically synthesized
gaaattctactggaaaccca

SEQ ID NO: 3635 - DNA, 20 bp, Artificial Sequence
  chemically synthesized
aattctactggaaacccatg

SEQ ID NO: 3636 - DNA, 20 bp, Artificial Sequence
  chemically synthesized
tactggaaacccatggagtt

SEQ ID NO: 3637 - DNA, 20 bp, Artificial Sequence
  chemically synthesized
actggaaacccatggagttc

SEQ ID NO: 3638 - DNA, 20 bp, Artificial Sequence
  chemically synthesized
ctggaaacccatggagttcg

SEQ ID NO: 3639 - DNA, 20 bp, Artificial Sequence
  chemically synthesized
atggagttcggggctccaca

SEQ ID NO: 3640 - DNA, 20 bp, Artificial Sequence
  chemically synthesized
cacggcgactctcatgatca

SEQ ID NO: 3641 - DNA, 20 bp, Artificial Sequence
  chemically synthesized
tcatgatcatagaacacgaa

SEQ ID NO: 3642 - DNA, 20 bp, Artificial Sequence
  chemically synthesized
gatcatagaacacgaacagc

SEQ ID NO: 3643 - DNA, 20 bp, Artificial Sequence
  chemically synthesized
cgaacagctggtcatccacg

SEQ ID NO: 3644 - DNA, 20 bp, Artificial Sequence
  chemically synthesized
ctggtcatccacgtagccca

SEQ ID NO: 3645 - DNA, 20 bp, Artificial Sequence
  chemically synthesized
cgtagcccaaagcttcaaac

SEQ ID NO: 3646 - DNA, 20 bp, Artificial Sequence
  chemically synthesized
gtagcccaaagcttcaaaca

SEQ ID NO: 3647 - DNA, 20 bp, Artificial Sequence
  chemically synthesized
cccaaagcttcaaacaagga

SEQ ID NO: 3648 - DNA, 20 bp, Artificial Sequence
  chemically synthesized
gcttcaaacaaggaaagacc

SEQ ID NO: 3649 - DNA, 20 bp, Artificial Sequence
  chemically synthesized
cttcaaacaaggaaagacca

SEQ ID NO: 3650 - DNA, 20 bp, Artificial Sequence
  chemically synthesized
aaagaccaaggtcctgctct

SEQ ID NO: 3651 - DNA, 20 bp, Artificial Sequence
  chemically synthesized
aagaccaaggtcctgctctg

SEQ ID NO: 3652 - DNA, 20 bp, Artificial Sequence
  chemically synthesized
cctgctctgaggcacccatg

SEQ ID NO: 3653 - DNA, 20 bp, Artificial Sequence
  chemically synthesized
tgctctgaggcacccatgaa

SEQ ID NO: 3654 - DNA, 20 bp, Artificial Sequence
  chemically synthesized
gctctgaggcacccatgaag

SEQ ID NO: 3655 - DNA, 20 bp, Artificial Sequence
  chemically synthesized
ctgaggcacccatgaagagg

SEQ ID NO: 3656 - DNA, 20 bp, Artificial Sequence
  chemically synthesized
gcacccatgaagaggtagtg

SEQ ID NO: 3657 - DNA, 20 bp, Artificial Sequence
  chemically synthesized
acccatgaagaggtagtgca

SEQ ID NO: 3658 - DNA, 20 bp, Artificial Sequence
  chemically synthesized
ccatgaagaggtagtgcaga

SEQ ID NO: 3659 - DNA, 20 bp, Artificial Sequence
  chemically synthesized
tagtgcagagagtgtgaacc

SEQ ID NO: 3660 - DNA, 20 bp, Artificial Sequence
  chemically synthesized
gtgcagagagtgtgaacctg

SEQ ID NO: 3661 - DNA, 20 bp, Artificial Sequence
  chemically synthesized
agagagtgtgaacctggaga

SEQ ID NO: 3662 - DNA, 20 bp, Artificial Sequence
  chemically synthesized
agagtgtgaacctggagaca

SEQ ID NO: 3663 - DNA, 20 bp, Artificial Sequence
  chemically synthesized
tgaacctggagacagagcaa

SEQ ID NO: 3664 - DNA, 20 bp, Artificial Sequence
  chemically synthesized
gaacctggagacagagcaac

SEQ ID NO: 3665 - DNA, 20 bp, Artificial Sequence
  chemically synthesized
caacaggccttaaccatgtg

SEQ ID NO: 3666 - DNA, 20 bp, Artificial Sequence
  chemically synthesized
caggccttaaccatgtgtag

SEQ ID NO: 3667 - DNA, 20 bp, Artificial Sequence
  chemically synthesized
aggccttaaccatgtgtagt

SEQ ID NO: 3668 - DNA, 20 bp, Artificial Sequence
  chemically synthesized
gccttaaccatgtgtagtag

SEQ ID NO: 3669 - DNA, 20 bp, Artificial Sequence
  chemically synthesized
ccttaaccatgtgtagtagg

SEQ ID NO: 3670 - DNA, 20 bp, Artificial Sequence
  chemically synthesized
cttaaccatgtgtagtagga

SEQ ID NO: 3671 - DNA, 20 bp, Artificial Sequence
  chemically synthesized
ttaaccatgtgtagtaggag

SEQ ID NO: 3672 - DNA, 20 bp, Artificial Sequence
  chemically synthesized
aaccatgtgtagtaggaggg

SEQ ID NO: 3673 - DNA, 20 bp, Artificial Sequence
  chemically synthesized
catgtgtagtaggaggggag

SEQ ID NO: 3674 - DNA, 20 bp, Artificial Sequence
  chemically synthesized
atgtgtagtaggaggggagc

SEQ ID NO: 3675 - DNA, 20 bp, Artificial Sequence
  chemically synthesized
taggaggggagcaggatgtt

SEQ ID NO: 3676 - DNA, 20 bp, Artificial Sequence
  chemically synthesized
aggaggggagcaggatgttg

SEQ ID NO: 3677 - DNA, 20 bp, Artificial Sequence
  chemically synthesized
cctgcatcaactcataccat

SEQ ID NO: 3678 - DNA, 20 bp, Artificial Sequence
  chemically synthesized
ctcataccatcagctgtgtc

SEQ ID NO: 3679 - DNA, 20 bp, Artificial Sequence
  chemically synthesized
tgtctggtcctcattttgtg

SEQ ID NO: 3680 - DNA, 20 bp, Artificial Sequence
  chemically synthesized
gtctggtcctcattttgtga

SEQ ID NO: 3681 - DNA, 20 bp, Artificial Sequence
  chemically synthesized
tctggtcctcattttgtgaa

SEQ ID NO: 3682 - DNA, 20 bp, Artificial Sequence
  chemically synthesized
gtcctcattttgtgaagggt

SEQ ID NO: 3683 - DNA, 20 bp, Artificial Sequence
  chemically synthesized
attttgtgaagggtgagttg

SEQ ID NO: 3684 - DNA, 20 bp, Artificial Sequence
  chemically synthesized
cctgtctttcttccatatga

SEQ ID NO: 3685 - DNA, 20 bp, Artificial Sequence
  chemically synthesized
tttcttccatatgacagtcc

SEQ ID NO: 3686 - DNA, 20 bp, Artificial Sequence
  chemically synthesized
ttcttccatatgacagtcct

SEQ ID NO: 3687 - DNA, 20 bp, Artificial Sequence
  chemically synthesized
gtgcttttctctgccacacg

SEQ ID NO: 3688 - DNA, 20 bp, Artificial Sequence
  chemically synthesized
tgccaccccctcactgcccc

SEQ ID NO: 3689 - DNA, 20 bp, Artificial Sequence
  chemically synthesized
cctattccaatactcatgat

SEQ ID NO: 3690 - DNA, 20 bp, Artificial Sequence
  chemically synthesized
ttccaatactcatgattaga

SEQ ID NO: 3691 - DNA, 20 bp, Artificial Sequence
  chemically synthesized
tgattagacagactccacta

SEQ ID NO: 3692 - DNA, 20 bp, Artificial Sequence
  chemically synthesized
tagacagactccactaaagc

SEQ ID NO: 3693 - DNA, 20 bp, Artificial Sequence
  chemically synthesized
acagactccactaaagctgg

SEQ ID NO: 3694 - DNA, 20 bp, Artificial Sequence
  chemically synthesized
ccactaaagctggtggattc

SEQ ID NO: 3695 - DNA, 20 bp, Artificial Sequence
  chemically synthesized
ggtggattctagaaaatgtt

SEQ ID NO: 3696 - DNA, 20 bp, Artificial Sequence
  chemically synthesized
gtggattctagaaaatgtta

SEQ ID NO: 3697 - DNA, 20 bp, Artificial Sequence
  chemically synthesized
agaaaatgttaaggtgtgtc

SEQ ID NO: 3698 - DNA, 20 bp, Artificial Sequence
  chemically synthesized
tgttaaggtgtgtctagcca

SEQ ID NO: 3699 - DNA, 20 bp, Artificial Sequence
  chemically synthesized
taaggtgtgtctagccatgg

SEQ ID NO: 3700 - DNA, 20 bp, Artificial Sequence
  chemically synthesized
ctagccatggtagttgaact

SEQ ID NO: 3701 - DNA, 20 bp, Artificial Sequence
  chemically synthesized
tagccatggtagttgaactc

SEQ ID NO: 3702 - DNA, 20 bp, Artificial Sequence
  chemically synthesized
gccatggtagttgaactcag

SEQ ID NO: 3703 - DNA, 20 bp, Artificial Sequence
  chemically synthesized
tggtagttgaactcaggagt

SEQ ID NO: 3704 - DNA, 20 bp, Artificial Sequence
  chemically synthesized
tgaactcaggagttggtgct

SEQ ID NO: 3705 - DNA, 20 bp, Artificial Sequence
  chemically synthesized
gaactcaggagttggtgctc

SEQ ID NO: 3706 - DNA, 20 bp, Artificial Sequence
  chemically synthesized
aactcaggagttggtgctca

SEQ ID NO: 3707 - DNA, 20 bp, Artificial Sequence
  chemically synthesized
agttggtgctcagggcaaat

SEQ ID NO: 3708 - DNA, 20 bp, Artificial Sequence
  chemically synthesized
gcaaattagacccaaatcct

SEQ ID NO: 3709 - DNA, 20 bp, Artificial Sequence
  chemically synthesized
caaattagacccaaatcctg

SEQ ID NO: 3710 - DNA, 20 bp, Artificial Sequence
  chemically synthesized
atcctgaggaataattcctt

SEQ ID NO: 3711 - DNA, 20 bp, Artificial Sequence
  chemically synthesized
tttttttttttttttttttt

SEQ ID NO: 3712 - DNA, 20 bp, Artificial Sequence
  chemically synthesized
ttttttttttttttttgaga

SEQ ID NO: 3713 - DNA, 20 bp, Artificial Sequence
  chemically synthesized
ttttttttttttttgagaca

SEQ ID NO: 3714 - DNA, 20 bp, Artificial Sequence
  chemically synthesized
cagagtctcactctatcacc

SEQ ID NO: 3715 - DNA, 20 bp, Artificial Sequence
  chemically synthesized
agagtctcactctatcaccc

SEQ ID NO: 3716 - DNA, 20 bp, Artificial Sequence
  chemically synthesized
tctcactctatcacccaggc

SEQ ID NO: 3717 - DNA, 20 bp, Artificial Sequence
  chemically synthesized
tcactctatcacccaggctg

SEQ ID NO: 3718 - DNA, 20 bp, Artificial Sequence
  chemically synthesized
ctatcacccaggctggagtg

SEQ ID NO: 3719 - DNA, 20 bp, Artificial Sequence
  chemically synthesized
tcacccaggctggagtgcag

SEQ ID NO: 3720 - DNA, 20 bp, Artificial Sequence
  chemically synthesized
ggagtgcagtggcacaatct

SEQ ID NO: 3721 - DNA, 20 bp, Artificial Sequence
  chemically synthesized
tcactgcaacctgcacctcc

SEQ ID NO: 3722 - DNA, 20 bp, Artificial Sequence
  chemically synthesized
cactgcaacctgcacctcct

SEQ ID NO: 3723 - DNA, 20 bp, Artificial Sequence
  chemically synthesized
aacctgcacctcctgggttc

SEQ ID NO: 3724 - DNA, 20 bp, Artificial Sequence
  chemically synthesized
acctgcacctcctgggttca

SEQ ID NO: 3725 - DNA, 20 bp, Artificial Sequence
  chemically synthesized
cctgcacctcctgggttcaa

SEQ ID NO: 3726 - DNA, 20 bp, Artificial Sequence
  chemically synthesized
ttcaagggattctcctacct

SEQ ID NO: 3727 - DNA, 20 bp, Artificial Sequence
  chemically synthesized
acctaagcctcctgaaaacc

SEQ ID NO: 3728 - DNA, 20 bp, Artificial Sequence
  chemically synthesized
cctaagcctcctgaaaacct

SEQ ID NO: 3729 - DNA, 20 bp, Artificial Sequence
  chemically synthesized
ctcctgaaaacctgggacta

SEQ ID NO: 3730 - DNA, 20 bp, Artificial Sequence
  chemically synthesized
tcctgaaaacctgggactat

SEQ ID NO: 3731 - DNA, 20 bp, Artificial Sequence
  chemically synthesized
ataggcgtgcgccaccacac

SEQ ID NO: 3732 - DNA, 20 bp, Artificial Sequence
  chemically synthesized
taggcgtgcgccaccacacc

SEQ ID NO: 3733 - DNA, 20 bp, Artificial Sequence
  chemically synthesized
caggctaatttttgtatttt

SEQ ID NO: 3734 - DNA, 20 bp, Artificial Sequence
  chemically synthesized
gctaatttttgtatttttag

SEQ ID NO: 3735 - DNA, 20 bp, Artificial Sequence
  chemically synthesized
ttttgtatttttagtagaca

SEQ ID NO: 3736 - DNA, 20 bp, Artificial Sequence
  chemically synthesized
tttgtatttttagtagacat

SEQ ID NO: 3737 - DNA, 20 bp, Artificial Sequence
  chemically synthesized
ttgtatttttagtagacatg

SEQ ID NO: 3738 - DNA, 20 bp, Artificial Sequence
  chemically synthesized
gacatggggtttcaccatgt

SEQ ID NO: 3739 - DNA, 20 bp, Artificial Sequence
  chemically synthesized
ggggtttcaccatgttggcc

SEQ ID NO: 3740 - DNA, 20 bp, Artificial Sequence
  chemically synthesized
ctcaaatgatctacctgcct

SEQ ID NO: 3741 - DNA, 20 bp, Artificial Sequence
  chemically synthesized
tctacctgcctcagccacca

SEQ ID NO: 3742 - DNA, 20 bp, Artificial Sequence
  chemically synthesized
tgcctcagccaccaaagtgc

SEQ ID NO: 3743 - DNA, 20 bp, Artificial Sequence
  chemically synthesized
gcctcagccaccaaagtgct

SEQ ID NO: 3744 - DNA, 20 bp, Artificial Sequence
  chemically synthesized
ccaccaaagtgctgggatta

SEQ ID NO: 3745 - DNA, 20 bp, Artificial Sequence
  chemically synthesized
ccaaagtgctgggattacag

SEQ ID NO: 3746 - DNA, 20 bp, Artificial Sequence
  chemically synthesized
agtgctgggattacagaagt

SEQ ID NO: 3747 - DNA, 20 bp, Artificial Sequence
  chemically synthesized
cagaagtgagccaccgtgcc

SEQ ID NO: 3748 - DNA, 20 bp, Artificial Sequence
  chemically synthesized
tgagccaccgtgcccagcct

SEQ ID NO: 3749 - DNA, 20 bp, Artificial Sequence
  chemically synthesized
cttacactgaactgcctatg

SEQ ID NO: 3750 - DNA, 20 bp, Artificial Sequence
  chemically synthesized
gcctatgtggcctcaccact

SEQ ID NO: 3751 - DNA, 20 bp, Artificial Sequence
  chemically synthesized
tatgtggcctcaccacttgg

SEQ ID NO: 3752 - DNA, 20 bp, Artificial Sequence
  chemically synthesized
tcaccacttggaagcctgac

SEQ ID NO: 3753 - DNA, 20 bp, Artificial Sequence
  chemically synthesized
aaacttaacatgtccaaatg

SEQ ID NO: 3754 - DNA, 20 bp, Artificial Sequence
  chemically synthesized
ttcctctgccttcaccatct

SEQ ID NO: 3755 - DNA, 20 bp, Artificial Sequence
  chemically synthesized
tgccttcaccatctcagaaa

SEQ ID NO: 3756 - DNA, 20 bp, Artificial Sequence
  chemically synthesized
ttgccaattaccccactgct

SEQ ID NO: 3757 - DNA, 20 bp, Artificial Sequence
  chemically synthesized
tgccaattaccccactgctc

SEQ ID NO: 3758 - DNA, 20 bp, Artificial Sequence
  chemically synthesized
aggccaataaaattaaaata

SEQ ID NO: 3759 - DNA, 20 bp, Artificial Sequence
  chemically synthesized
taaaattaaaataaagaaca

SEQ ID NO: 3760 - DNA, 20 bp, Artificial Sequence
  chemically synthesized
actttaactcttctcttttt

SEQ ID NO: 3761 - DNA, 20 bp, Artificial Sequence
  chemically synthesized
ctttaactcttctctttttc

SEQ ID NO: 3762 - DNA, 20 bp, Artificial Sequence
  chemically synthesized
tttaactcttctctttttca

SEQ ID NO: 3763 - DNA, 20 bp, Artificial Sequence
  chemically synthesized
ttaactcttctctttttcag

SEQ ID NO: 3764 - DNA, 20 bp, Artificial Sequence
  chemically synthesized
taactcttctctttttcagg

SEQ ID NO: 3765 - DNA, 20 bp, Artificial Sequence
  chemically synthesized
tcttctctttttcagggggt

SEQ ID NO: 3766 - DNA, 20 bp, Artificial Sequence
  chemically synthesized
cttctctttttcagggggtc

SEQ ID NO: 3767 - DNA, 20 bp, Artificial Sequence
  chemically synthesized
ttctctttttcagggggtca

SEQ ID NO: 3768 - DNA, 20 bp, Artificial Sequence
  chemically synthesized
tctctttttcagggggtcag

SEQ ID NO: 3769 - DNA, 20 bp, Artificial Sequence
  chemically synthesized
tctttttcagggggtcaggg

SEQ ID NO: 3770 - DNA, 20 bp, Artificial Sequence
  chemically synthesized
tttcagggggtcaggggaga

SEQ ID NO: 3771 - DNA, 20 bp, Artificial Sequence
  chemically synthesized
ttcagggggtcaggggagac

SEQ ID NO: 3772 - DNA, 20 bp, Artificial Sequence
  chemically synthesized
tcagggggtcaggggagaca

SEQ ID NO: 3773 - DNA, 20 bp, Artificial Sequence
  chemically synthesized
cagggtcttgctctgtcacc

SEQ ID NO: 3774 - DNA, 20 bp, Artificial Sequence
  chemically synthesized
agggtcttgctctgtcacct

SEQ ID NO: 3775 - DNA, 20 bp, Artificial Sequence
  chemically synthesized
ttgctctgtcacctaggctg

SEQ ID NO: 3776 - DNA, 20 bp, Artificial Sequence
  chemically synthesized
ctgtcacctaggctgaagta

SEQ ID NO: 3777 - DNA, 20 bp, Artificial Sequence
  chemically synthesized
tcacctaggctgaagtacag

SEQ ID NO: 3778 - DNA, 20 bp, Artificial Sequence
  chemically synthesized
taggctgaagtacagtggca

SEQ ID NO: 3779 - DNA, 20 bp, Artificial Sequence
  chemically synthesized
gaagtacagtggcacagtca

SEQ ID NO: 3780 - DNA, 20 bp, Artificial Sequence
  chemically synthesized
ggcacagtcatggctcactg

SEQ ID NO: 3781 - DNA, 20 bp, Artificial Sequence
  chemically synthesized
tcactgcagcctcaacttcc

SEQ ID NO: 3782 - DNA, 20 bp, Artificial Sequence
  chemically synthesized
cactgcagcctcaacttcct

SEQ ID NO: 3783 - DNA, 20 bp, Artificial Sequence
  chemically synthesized
agcctcaacttcctgggctc

SEQ ID NO: 3784 - DNA, 20 bp, Artificial Sequence
  chemically synthesized
tcaagcaataccctccacct

SEQ ID NO: 3785 - DNA, 20 bp, Artificial Sequence
  chemically synthesized
accctccacctcagcctccc

SEQ ID NO: 3786 - DNA, 20 bp, Artificial Sequence
  chemically synthesized
ctccacctcagcctcccgag

SEQ ID NO: 3787 - DNA, 20 bp, Artificial Sequence
  chemically synthesized
acctcagcctcccgagtagc

SEQ ID NO: 3788 - DNA, 20 bp, Artificial Sequence
  chemically synthesized
cctcagcctcccgagtagct

SEQ ID NO: 3789 - DNA, 20 bp, Artificial Sequence
  chemically synthesized
ctcccgagtagctaggatca

SEQ ID NO: 3790 - DNA, 20 bp, Artificial Sequence
  chemically synthesized
tcccgagtagctaggatcac

SEQ ID NO: 3791 - DNA, 20 bp, Artificial Sequence
  chemically synthesized
caggtgcatgccaccacacc

SEQ ID NO: 3792 - DNA, 20 bp, Artificial Sequence
  chemically synthesized
gctaatttttgtattttttg

SEQ ID NO: 3793 - DNA, 20 bp, Artificial Sequence
  chemically synthesized
taatttttgtattttttgta

SEQ ID NO: 3794 - DNA, 20 bp, Artificial Sequence
  chemically synthesized
tttttgtattttttgtagag

SEQ ID NO: 3795 - DNA, 20 bp, Artificial Sequence
  chemically synthesized
ttttgtattttttgtagaga

SEQ ID NO: 3796 - DNA, 20 bp, Artificial Sequence
  chemically synthesized
tttgtattttttgtagagaa

SEQ ID NO: 3797 - DNA, 20 bp, Artificial Sequence
  chemically synthesized
ttgtattttttgtagagaag

SEQ ID NO: 3798 - DNA, 20 bp, Artificial Sequence
  chemically synthesized
aggggttttgctgtgttgcc

SEQ ID NO: 3799 - DNA, 20 bp, Artificial Sequence
  chemically synthesized
ggggttttgctgtgttgccc

SEQ ID NO: 3800 - DNA, 20 bp, Artificial Sequence
  chemically synthesized
ttttgctgtgttgcccaggc

SEQ ID NO: 3801 - DNA, 20 bp, Artificial Sequence
  chemically synthesized
caggctggtcttgaactcct

SEQ ID NO: 3802 - DNA, 20 bp, Artificial Sequence
  chemically synthesized
tggtcttgaactcctgagct

SEQ ID NO: 3803 - DNA, 20 bp, Artificial Sequence
  chemically synthesized
ggtcttgaactcctgagctc

SEQ ID NO: 3804 - DNA, 20 bp, Artificial Sequence
  chemically synthesized
gctcaggaatctgctctcct

SEQ ID NO: 3805 - DNA, 20 bp, Artificial Sequence
  chemically synthesized
gctctccttggcctcctcct

SEQ ID NO: 3806 - DNA, 20 bp, Artificial Sequence
  chemically synthesized
cttggcctcctccttggcat

SEQ ID NO: 3807 - DNA, 20 bp, Artificial Sequence
  chemically synthesized
ttggcatgagctactacacc

SEQ ID NO: 3808 - DNA, 20 bp, Artificial Sequence
  chemically synthesized
tctctttctctcacacaaca

SEQ ID NO: 3809 - DNA, 20 bp, Artificial Sequence
  chemically synthesized
tcacacaacatagaatcctt

SEQ ID NO: 3810 - DNA, 20 bp, Artificial Sequence
  chemically synthesized
aatccttcagcaacttcctt

SEQ ID NO: 3811 - DNA, 20 bp, Artificial Sequence
  chemically synthesized
aacttccttcagaatatatt

SEQ ID NO: 3812 - DNA, 20 bp, Artificial Sequence
  chemically synthesized
acttccttcagaatatattc

SEQ ID NO: 3813 - DNA, 20 bp, Artificial Sequence
  chemically synthesized
ttccttcagaatatattcag

SEQ ID NO: 3814 - DNA, 20 bp, Artificial Sequence
  chemically synthesized
agaatatattcaggagacaa

SEQ ID NO: 3815 - DNA, 20 bp, Artificial Sequence
  chemically synthesized
ctcccttttctgttcccacc

SEQ ID NO: 3816 - DNA, 20 bp, Artificial Sequence
  chemically synthesized
ccactccactacctcttgcc

SEQ ID NO: 3817 - DNA, 20 bp, Artificial Sequence
  chemically synthesized
ctcttgcctggactgtgtaa

SEQ ID NO: 3818 - DNA, 20 bp, Artificial Sequence
  chemically synthesized
tggactgtgtaacagcttcc

SEQ ID NO: 3819 - DNA, 20 bp, Artificial Sequence
  chemically synthesized
ctgtgtaacagcttcctggc

SEQ ID NO: 3820 - DNA, 20 bp, Artificial Sequence
  chemically synthesized
tgtgtaacagcttcctggct

SEQ ID NO: 3821 - DNA, 20 bp, Artificial Sequence
  chemically synthesized
ccttcattctgctttccaca

SEQ ID NO: 3822 - DNA, 20 bp, Artificial Sequence
  chemically synthesized
tcattctgctttccacatag

SEQ ID NO: 3823 - DNA, 20 bp, Artificial Sequence
  chemically synthesized
tctgctttccacatagcagc

SEQ ID NO: 3824 - DNA, 20 bp, Artificial Sequence
  chemically synthesized
tgctttccacatagcagcca

SEQ ID NO: 3825 - DNA, 20 bp, Artificial Sequence
  chemically synthesized
cagccagagcaatcttttaa

SEQ ID NO: 3826 - DNA, 20 bp, Artificial Sequence
  chemically synthesized
aatcttttaaaagcctgtga

SEQ ID NO: 3827 - DNA, 20 bp, Artificial Sequence
  chemically synthesized
gacagatcactgttactcct

SEQ ID NO: 3828 - DNA, 20 bp, Artificial Sequence
  chemically synthesized
gatcactgttactccttggc

SEQ ID NO: 3829 - DNA, 20 bp, Artificial Sequence
  chemically synthesized
cttggctagaattcacacca

SEQ ID NO: 3830 - DNA, 20 bp, Artificial Sequence
  chemically synthesized
agaattcacaccacagccta

SEQ ID NO: 3831 - DNA, 20 bp, Artificial Sequence
  chemically synthesized
gaattcacaccacagcctac

SEQ ID NO: 3832 - DNA, 20 bp, Artificial Sequence
  chemically synthesized
cgcctgcacaaccttgtttg

SEQ ID NO: 3833 - DNA, 20 bp, Artificial Sequence
  chemically synthesized
ttgtttgtggctcctcttct

SEQ ID NO: 3834 - DNA, 20 bp, Artificial Sequence
  chemically synthesized
tgagcccattacctacttct

SEQ ID NO: 3835 - DNA, 20 bp, Artificial Sequence
  chemically synthesized
acttcttggcctctactccc

SEQ ID NO: 3836 - DNA, 20 bp, Artificial Sequence
  chemically synthesized
ttgtttatttttttcaaccc

SEQ ID NO: 3837 - DNA, 20 bp, Artificial Sequence
  chemically synthesized
ttcaacccgagcttcttaac

SEQ ID NO: 3838 - DNA, 20 bp, Artificial Sequence
  chemically synthesized
tcaacccgagcttcttaacc

SEQ ID NO: 3839 - DNA, 20 bp, Artificial Sequence
  chemically synthesized
aacccgagcttcttaaccag

SEQ ID NO: 3840 - DNA, 20 bp, Artificial Sequence
  chemically synthesized
ttaaccaggagtttgtctac

SEQ ID NO: 3841 - DNA, 20 bp, Artificial Sequence
  chemically synthesized
taaccaggagtttgtctact

SEQ ID NO: 3842 - DNA, 20 bp, Artificial Sequence
  chemically synthesized
tttgtctactaggtgacatg

SEQ ID NO: 3843 - DNA, 20 bp, Artificial Sequence
  chemically synthesized
ctactaggtgacatgtggca

SEQ ID NO: 3844 - DNA, 20 bp, Artificial Sequence
  chemically synthesized
aggtgacatgtggcaaagtt

SEQ ID NO: 3845 - DNA, 20 bp, Artificial Sequence
  chemically synthesized
gtgacatgtggcaaagttta

SEQ ID NO: 3846 - DNA, 20 bp, Artificial Sequence
  chemically synthesized
gcaaagtttagagacatttt

SEQ ID NO: 3847 - DNA, 20 bp, Artificial Sequence
  chemically synthesized
tagagacatttttggttgtc

SEQ ID NO: 3848 - DNA, 20 bp, Artificial Sequence
  chemically synthesized
acatttttggttgtcaagac

SEQ ID NO: 3849 - DNA, 20 bp, Artificial Sequence
  chemically synthesized
catttttggttgtcaagact

SEQ ID NO: 3850 - DNA, 20 bp, Artificial Sequence
  chemically synthesized
atttttggttgtcaagactg

SEQ ID NO: 3851 - DNA, 20 bp, Artificial Sequence
  chemically synthesized
tttttggttgtcaagactgg

SEQ ID NO: 3852 - DNA, 20 bp, Artificial Sequence
  chemically synthesized
tttggttgtcaagactgggg

SEQ ID NO: 3853 - DNA, 20 bp, Artificial Sequence
  chemically synthesized
caagactgggggagtgctcc

SEQ ID NO: 3854 - DNA, 20 bp, Artificial Sequence
  chemically synthesized
gggggagtgctcctagcacc

SEQ ID NO: 3855 - DNA, 20 bp, Artificial Sequence
  chemically synthesized
gagtgctcctagcacctagt

SEQ ID NO: 3856 - DNA, 20 bp, Artificial Sequence
  chemically synthesized
tgctcctagcacctagtgag

SEQ ID NO: 3857 - DNA, 20 bp, Artificial Sequence
  chemically synthesized
gctcctagcacctagtgagt

SEQ ID NO: 3858 - DNA, 20 bp, Artificial Sequence
  chemically synthesized
ctcctagcacctagtgagta

SEQ ID NO: 3859 - DNA, 20 bp, Artificial Sequence
  chemically synthesized
cctagcacctagtgagtagg

SEQ ID NO: 3860 - DNA, 20 bp, Artificial Sequence
  chemically synthesized
ctagcacctagtgagtaggg

SEQ ID NO: 3861 - DNA, 20 bp, Artificial Sequence
  chemically synthesized
cacctagtgagtagggagga

SEQ ID NO: 3862 - DNA, 20 bp, Artificial Sequence
  chemically synthesized
acctagtgagtagggaggac

SEQ ID NO: 3863 - DNA, 20 bp, Artificial Sequence
  chemically synthesized
tagggaggacaggatactgc

SEQ ID NO: 3864 - DNA, 20 bp, Artificial Sequence
  chemically synthesized
actgctagacatcctacatg

SEQ ID NO: 3865 - DNA, 20 bp, Artificial Sequence
  chemically synthesized
ctagacatcctacatgcaga

SEQ ID NO: 3866 - DNA, 20 bp, Artificial Sequence
  chemically synthesized
gacatcctacatgcagatgg

SEQ ID NO: 3867 - DNA, 20 bp, Artificial Sequence
  chemically synthesized
ccccccacacacacacacat

SEQ ID NO: 3868 - DNA, 20 bp, Artificial Sequence
  chemically synthesized
cccacacacacacacatgag

SEQ ID NO: 3869 - DNA, 20 bp, Artificial Sequence
  chemically synthesized
acacacacatgagtagtgct

SEQ ID NO: 3870 - DNA, 20 bp, Artificial Sequence
  chemically synthesized
cgctttttaatccaacttgc

SEQ ID NO: 3871 - DNA, 20 bp, Artificial Sequence
  chemically synthesized
gctttttaatccaacttgcc

SEQ ID NO: 3872 - DNA, 20 bp, Artificial Sequence
  chemically synthesized
tccaacttgccaggcccact

SEQ ID NO: 3873 - DNA, 20 bp, Artificial Sequence
  chemically synthesized
ccaggcccactcagtttgcc

SEQ ID NO: 3874 - DNA, 20 bp, Artificial Sequence
  chemically synthesized
caggcccactcagtttgcct

SEQ ID NO: 3875 - DNA, 20 bp, Artificial Sequence
  chemically synthesized
tgcctgggaaatactgctcc

SEQ ID NO: 3876 - DNA, 20 bp, Artificial Sequence
  chemically synthesized
tttccttcatgtctctgctc

SEQ ID NO: 3877 - DNA, 20 bp, Artificial Sequence
  chemically synthesized
tcatgtctctgctcaagtgt

SEQ ID NO: 3878 - DNA, 20 bp, Artificial Sequence
  chemically synthesized
ctctgctcaagtgtcagccc

SEQ ID NO: 3879 - DNA, 20 bp, Artificial Sequence
  chemically synthesized
ctgctcaagtgtcagcccca

SEQ ID NO: 3880 - DNA, 20 bp, Artificial Sequence
  chemically synthesized
cttattgtcatctctcccac

SEQ ID NO: 3881 - DNA, 20 bp, Artificial Sequence
  chemically synthesized
cactagaatgcaaaatatca

SEQ ID NO: 3882 - DNA, 20 bp, Artificial Sequence
  chemically synthesized
actagaatgcaaaatatcaa

SEQ ID NO: 3883 - DNA, 20 bp, Artificial Sequence
  chemically synthesized
ctagaatgcaaaatatcaaa

SEQ ID NO: 3884 - DNA, 20 bp, Artificial Sequence
  chemically synthesized
atgcaaaatatcaaagggta

SEQ ID NO: 3885 - DNA, 20 bp, Artificial Sequence
  chemically synthesized
tgtttccctgctctctccct

SEQ ID NO: 3886 - DNA, 20 bp, Artificial Sequence
  chemically synthesized
gtttccctgctctctccctt

SEQ ID NO: 3887 - DNA, 20 bp, Artificial Sequence
  chemically synthesized
tttccctgctctctcccttg

SEQ ID NO: 3888 - DNA, 20 bp, Artificial Sequence
  chemically synthesized
tctctcccttggggcttgaa

SEQ ID NO: 3889 - DNA, 20 bp, Artificial Sequence
  chemically synthesized
ggcttgaacagtgcaacaca

SEQ ID NO: 3890 - DNA, 20 bp, Artificial Sequence
  chemically synthesized
tgaacagtgcaacacatggc

SEQ ID NO: 3891 - DNA, 20 bp, Artificial Sequence
  chemically synthesized
gaacagtgcaacacatggct

SEQ ID NO: 3892 - DNA, 20 bp, Artificial Sequence
  chemically synthesized
ttattattcaacctctaatg

SEQ ID NO: 3893 - DNA, 20 bp, Artificial Sequence
  chemically synthesized
tctaatgcagtgtgatgttt

SEQ ID NO: 3894 - DNA, 20 bp, Artificial Sequence
  chemically synthesized
agtgtgatgtttaagaatca

SEQ ID NO: 3895 - DNA, 20 bp, Artificial Sequence
  chemically synthesized
gtttaagaatcatagctatg

SEQ ID NO: 3896 - DNA, 20 bp, Artificial Sequence
  chemically synthesized
taagaatcatagctatgaag

SEQ ID NO: 3897 - DNA, 20 bp, Artificial Sequence
  chemically synthesized
agaatcatagctatgaagtg

SEQ ID NO: 3898 - DNA, 20 bp, Artificial Sequence
  chemically synthesized
tagctatgaagtggagacat

SEQ ID NO: 3899 - DNA, 20 bp, Artificial Sequence
  chemically synthesized
agacatgagctctgccacca

SEQ ID NO: 3900 - DNA, 20 bp, Artificial Sequence
  chemically synthesized
tgagctctgccaccaaagcc

SEQ ID NO: 3901 - DNA, 20 bp, Artificial Sequence
  chemically synthesized
gtaccattgaataaatttgc

SEQ ID NO: 3902 - DNA, 20 bp, Artificial Sequence
  chemically synthesized
taccattgaataaatttgcc

SEQ ID NO: 3903 - DNA, 20 bp, Artificial Sequence
  chemically synthesized
cattgaataaatttgccagg

SEQ ID NO: 3904 - DNA, 20 bp, Artificial Sequence
  chemically synthesized
tgaataaatttgccaggaag

SEQ ID NO: 3905 - DNA, 20 bp, Artificial Sequence
  chemically synthesized
gaataaatttgccaggaagc

SEQ ID NO: 3906 - DNA, 20 bp, Artificial Sequence
  chemically synthesized
ttcttgtcatgtgtaaaatg

SEQ ID NO: 3907 - DNA, 20 bp, Artificial Sequence
  chemically synthesized
gtgtaaaatgtggatacacg

SEQ ID NO: 3908 - DNA, 20 bp, Artificial Sequence
  chemically synthesized
acacgtagtaccaaaactca

SEQ ID NO: 3909 - DNA, 20 bp, Artificial Sequence
  chemically synthesized
aaaactcaaagtgctgtgct

SEQ ID NO: 3910 - DNA, 20 bp, Artificial Sequence
  chemically synthesized
aaactcaaagtgctgtgctg

SEQ ID NO: 3911 - DNA, 20 bp, Artificial Sequence
  chemically synthesized
tcaaagtgctgtgctgaggc

SEQ ID NO: 3912 - DNA, 20 bp, Artificial Sequence
  chemically synthesized
tgaggccggcgtgtgaccca

SEQ ID NO: 3913 - DNA, 20 bp, Artificial Sequence
  chemically synthesized
cagaacactgtgctacacta

SEQ ID NO: 3914 - DNA, 20 bp, Artificial Sequence
  chemically synthesized
agaacactgtgctacactac

SEQ ID NO: 3915 - DNA, 20 bp, Artificial Sequence
  chemically synthesized
gaacactgtgctacactaca

SEQ ID NO: 3916 - DNA, 20 bp, Artificial Sequence
  chemically synthesized
gggcaaaatcactgtcaact

SEQ ID NO: 3917 - DNA, 20 bp, Artificial Sequence
  chemically synthesized
aaatcactgtcaactaagat

SEQ ID NO: 3918 - DNA, 20 bp, Artificial Sequence
  chemically synthesized
tcactgtcaactaagattag

SEQ ID NO: 3919 - DNA, 20 bp, Artificial Sequence
  chemically synthesized
ctgtcaactaagattagaag

SEQ ID NO: 3920 - DNA, 20 bp, Artificial Sequence
  chemically synthesized
actaagattagaagcagctg

SEQ ID NO: 3921 - DNA, 20 bp, Artificial Sequence
  chemically synthesized
tgtagtacttgaaataacat

SEQ ID NO: 3922 - DNA, 20 bp, Artificial Sequence
  chemically synthesized
ttgaaataacatcagaaaac

SEQ ID NO: 3923 - DNA, 20 bp, Artificial Sequence
  chemically synthesized
tatgttctttgtaacctgaa

SEQ ID NO: 3924 - DNA, 20 bp, Artificial Sequence
  chemically synthesized
tgttctttgtaacctgaaaa

SEQ ID NO: 3925 - DNA, 20 bp, Artificial Sequence
  chemically synthesized
gagttatataatctgaattc

SEQ ID NO: 3926 - DNA, 20 bp, Artificial Sequence
  chemically synthesized
tctgaattccagttaacttc

SEQ ID NO: 3927 - DNA, 20 bp, Artificial Sequence
  chemically synthesized
tagtaaaataaacgtattat

SEQ ID NO: 3928 - DNA, 20 bp, Artificial Sequence
  chemically synthesized
agctcctacctccctatgcc

SEQ ID NO: 3929 - DNA, 20 bp, Artificial Sequence
  chemically synthesized
atgcctagtgaaaatcaaat

SEQ ID NO: 3930 - DNA, 20 bp, Artificial Sequence
  chemically synthesized
tagtgaaaatcaaataagat

SEQ ID NO: 3931 - DNA, 20 bp, Artificial Sequence
  chemically synthesized
gatcagatatgaatgtaact

SEQ ID NO: 3932 - DNA, 20 bp, Artificial Sequence
  chemically synthesized
cagatatgaatgtaacttag

SEQ ID NO: 3933 - DNA, 20 bp, Artificial Sequence
  chemically synthesized
tatgaatgtaacttagaagt

SEQ ID NO: 3934 - DNA, 20 bp, Artificial Sequence
  chemically synthesized
attgcttacatgttcattat

SEQ ID NO: 3935 - DNA, 20 bp, Artificial Sequence
  chemically synthesized
tgttcattatcagtactttg

SEQ ID NO: 3936 - DNA, 20 bp, Artificial Sequence
  chemically synthesized
ttcattatcagtactttgta

SEQ ID NO: 3937 - DNA, 20 bp, Artificial Sequence
  chemically synthesized
cattatcagtactttgtaga

SEQ ID NO: 3938 - DNA, 20 bp, Artificial Sequence
  chemically synthesized
attatcagtactttgtagag

SEQ ID NO: 3939 - DNA, 20 bp, Artificial Sequence
  chemically synthesized
agagaggcctcttaattaca

SEQ ID NO: 3940 - DNA, 20 bp, Artificial Sequence
  chemically synthesized
cagcacattgcaaatcaata

SEQ ID NO: 3941 - DNA, 20 bp, Artificial Sequence
  chemically synthesized
cattgcaaatcaataaagcc

SEQ ID NO: 3942 - DNA, 20 bp, Artificial Sequence
  chemically synthesized
atcaataaagcctagccgaa

SEQ ID NO: 3943 - DNA, 20 bp, Artificial Sequence
  chemically synthesized
caataaagcctagccgaaaa

SEQ ID NO: 3944 - DNA, 20 bp, Artificial Sequence
  chemically synthesized
tagccgaaaagagaattgtt

SEQ ID NO: 3945 - DNA, 20 bp, Artificial Sequence
  chemically synthesized
ctaacatatacttaattttc

SEQ ID NO: 3946 - DNA, 20 bp, Artificial Sequence
  chemically synthesized
taacatatacttaattttcc

SEQ ID NO: 3947 - DNA, 20 bp, Artificial Sequence
  chemically synthesized
atacttaattttccaggcaa

SEQ ID NO: 3948 - DNA, 20 bp, Artificial Sequence
  chemically synthesized
caggcaaaagaacaattgcc

SEQ ID NO: 3949 - DNA, 20 bp, Artificial Sequence
  chemically synthesized
ggcaaaagaacaattgccaa

SEQ ID NO: 3950 - DNA, 20 bp, Artificial Sequence
  chemically synthesized
aaaagaacaattgccaagag

SEQ ID NO: 3951 - DNA, 20 bp, Artificial Sequence
  chemically synthesized
aaagaacaattgccaagagt

SEQ ID NO: 3952 - DNA, 20 bp, Artificial Sequence
  chemically synthesized
aagaacaattgccaagagtg

SEQ ID NO: 3953 - DNA, 20 bp, Artificial Sequence
  chemically synthesized
acaattgccaagagtgggga

SEQ ID NO: 3954 - DNA, 20 bp, Artificial Sequence
  chemically synthesized
caattgccaagagtggggaa

SEQ ID NO: 3955 - DNA, 20 bp, Artificial Sequence
  chemically synthesized
ccaagagtggggaaaggccc

SEQ ID NO: 3956 - DNA, 20 bp, Artificial Sequence
  chemically synthesized
caagagtggggaaaggcccg

SEQ ID NO: 3957 - DNA, 20 bp, Artificial Sequence
  chemically synthesized
gagtggggaaaggcccgagg

SEQ ID NO: 3958 - DNA, 20 bp, Artificial Sequence
  chemically synthesized
agtggggaaaggcccgaggt

SEQ ID NO: 3959 - DNA, 20 bp, Artificial Sequence
  chemically synthesized
ggcccgaggtaggcctctct

SEQ ID NO: 3960 - DNA, 20 bp, Artificial Sequence
  chemically synthesized
gcccgaggtaggcctctctc

SEQ ID NO: 3961 - DNA, 20 bp, Artificial Sequence
  chemically synthesized
ccgaggtaggcctctctcag

SEQ ID NO: 3962 - DNA, 20 bp, Artificial Sequence
  chemically synthesized
ctctcaggagcctcccaccc

SEQ ID NO: 3963 - DNA, 20 bp, Artificial Sequence
  chemically synthesized
ctcaggagcctcccacccta

SEQ ID NO: 3964 - DNA, 20 bp, Artificial Sequence
  chemically synthesized
caccctagagacctccaccc

SEQ ID NO: 3965 - DNA, 20 bp, Artificial Sequence
  chemically synthesized
accctagagacctccacccc

SEQ ID NO: 3966 - DNA, 20 bp, Artificial Sequence
  chemically synthesized
tccaccccaggtctcaccaa

SEQ ID NO: 3967 - DNA, 20 bp, Artificial Sequence
  chemically synthesized
accccaggtctcaccaaaag

SEQ ID NO: 3968 - DNA, 20 bp, Artificial Sequence
  chemically synthesized
ccccaggtctcaccaaaagt

SEQ ID NO: 3969 - DNA, 20 bp, Artificial Sequence
  chemically synthesized
caggtctcaccaaaagtggg

SEQ ID NO: 3970 - DNA, 20 bp, Artificial Sequence
  chemically synthesized
ctcaccaaaagtgggtggaa

SEQ ID NO: 3971 - DNA, 20 bp, Artificial Sequence
  chemically synthesized
caaaagtgggtggaatggtg

SEQ ID NO: 3972 - DNA, 20 bp, Artificial Sequence
  chemically synthesized
gggtggaatggtgaagaatt

SEQ ID NO: 3973 - DNA, 20 bp, Artificial Sequence
  chemically synthesized
ccgcccaacgcattcgttct

SEQ ID NO: 3974 - DNA, 20 bp, Artificial Sequence
  chemically synthesized
cgcccaacgcattcgttctg

SEQ ID NO: 3975 - DNA, 20 bp, Artificial Sequence
  chemically synthesized
ccaacgcattcgttctgagg

SEQ ID NO: 3976 - DNA, 20 bp, Artificial Sequence
  chemically synthesized
tctgaggtggaaaccccgtg

SEQ ID NO: 3977 - DNA, 20 bp, Artificial Sequence
  chemically synthesized
accccgtgcggatcctgctg

SEQ ID NO: 3978 - DNA, 20 bp, Artificial Sequence
  chemically synthesized
ccccgtgcggatcctgctgt

SEQ ID NO: 3979 - DNA, 20 bp, Artificial Sequence
  chemically synthesized
gatcctgctgtgggtttgct

SEQ ID NO: 3980 - DNA, 20 bp, Artificial Sequence
  chemically synthesized
gtgggtttgctcagccttct

SEQ ID NO: 3981 - DNA, 20 bp, Artificial Sequence
  chemically synthesized
gtttgctcagccttctcggc

SEQ ID NO: 3982 - DNA, 20 bp, Artificial Sequence
  chemically synthesized
cagccttctcggcaagcact

SEQ ID NO: 3983 - DNA, 20 bp, Artificial Sequence
  chemically synthesized
agccttctcggcaagcactc

SEQ ID NO: 3984 - DNA, 20 bp, Artificial Sequence
  chemically synthesized
gccttctcggcaagcactca

SEQ ID NO: 3985 - DNA, 20 bp, Artificial Sequence
  chemically synthesized
ttctcggcaagcactcaggg

SEQ ID NO: 3986 - DNA, 20 bp, Artificial Sequence
  chemically synthesized
tcagggaagaacttcctgtt

SEQ ID NO: 3987 - DNA, 20 bp, Artificial Sequence
  chemically synthesized
agggaagaacttcctgtttg

SEQ ID NO: 3988 - DNA, 20 bp, Artificial Sequence
  chemically synthesized
acttcctgtttggagatgac

SEQ ID NO: 3989 - DNA, 20 bp, Artificial Sequence
  chemically synthesized
cttcctgtttggagatgact

SEQ ID NO: 3990 - DNA, 20 bp, Artificial Sequence
  chemically synthesized
ttcctgtttggagatgactg

SEQ ID NO: 3991 - DNA, 20 bp, Artificial Sequence
  chemically synthesized
tgactggggaaaaaactgca

SEQ ID NO: 3992 - DNA, 20 bp, Artificial Sequence
  chemically synthesized
aaaaactgcacagctgacat

SEQ ID NO: 3993 - DNA, 20 bp, Artificial Sequence
  chemically synthesized
ctgacattggaaataaaccc

SEQ ID NO: 3994 - DNA, 20 bp, Artificial Sequence
  chemically synthesized
ttggaaataaacccgagttc

SEQ ID NO: 3995 - DNA, 20 bp, Artificial Sequence
  chemically synthesized
tggaaataaacccgagttcc

SEQ ID NO: 3996 - DNA, 20 bp, Artificial Sequence
  chemically synthesized
taaacccgagttccaggttc

SEQ ID NO: 3997 - DNA, 20 bp, Artificial Sequence
  chemically synthesized
aaacccgagttccaggttca

SEQ ID NO: 3998 - DNA, 20 bp, Artificial Sequence
  chemically synthesized
acccgagttccaggttcaag

SEQ ID NO: 3999 - DNA, 20 bp, Artificial Sequence
  chemically synthesized
gttccaggttcaaggagccc

SEQ ID NO: 4000 - DNA, 20 bp, Artificial Sequence
  chemically synthesized
ttccaggttcaaggagcccc

SEQ ID NO: 4001 - DNA, 20 bp, Artificial Sequence
  chemically synthesized
ggttcaaggagccccaggct

SEQ ID NO: 4002 - DNA, 20 bp, Artificial Sequence
  chemically synthesized
aaggagccccaggcttagct

SEQ ID NO: 4003 - DNA, 20 bp, Artificial Sequence
  chemically synthesized
ccccaggcttagctcagctc

SEQ ID NO: 4004 - DNA, 20 bp, Artificial Sequence
  chemically synthesized
aggcttagctcagctcaagt

SEQ ID NO: 4005 - DNA, 20 bp, Artificial Sequence
  chemically synthesized
ggcttagctcagctcaagtg

SEQ ID NO: 4006 - DNA, 20 bp, Artificial Sequence
  chemically synthesized
cagctcaagtgaggaactac

SEQ ID NO: 4007 - DNA, 20 bp, Artificial Sequence
  chemically synthesized
gaactacgagatttatttaa

SEQ ID NO: 4008 - DNA, 20 bp, Artificial Sequence
  chemically synthesized
agatttatttaaaagcattc

SEQ ID NO: 4009 - DNA, 20 bp, Artificial Sequence
  chemically synthesized
ttatttaaaagcattctagt

SEQ ID NO: 4010 - DNA, 20 bp, Artificial Sequence
  chemically synthesized
tatttaaaagcattctagtt

SEQ ID NO: 4011 - DNA, 20 bp, Artificial Sequence
  chemically synthesized
atttaaaagcattctagttg

SEQ ID NO: 4012 - DNA, 20 bp, Artificial Sequence
  chemically synthesized
tttaaaagcattctagttgg

SEQ ID NO: 4013 - DNA, 20 bp, Artificial Sequence
  chemically synthesized
aaaagcattctagttggggg

SEQ ID NO: 4014 - DNA, 20 bp, Artificial Sequence
  chemically synthesized
aaagcattctagttggggga

SEQ ID NO: 4015 - DNA, 20 bp, Artificial Sequence
  chemically synthesized
aagcattctagttgggggaa

SEQ ID NO: 4016 - DNA, 20 bp, Artificial Sequence
  chemically synthesized
gcattctagttgggggaagg

SEQ ID NO: 4017 - DNA, 20 bp, Artificial Sequence
  chemically synthesized
ttctagttgggggaagggag

SEQ ID NO: 4018 - DNA, 20 bp, Artificial Sequence
  chemically synthesized
tctagttgggggaagggagt

SEQ ID NO: 4019 - DNA, 20 bp, Artificial Sequence
  chemically synthesized
agttgggggaagggagtggg

SEQ ID NO: 4020 - DNA, 20 bp, Artificial Sequence
  chemically synthesized
aagggagtgggcggttccaa

SEQ ID NO: 4021 - DNA, 20 bp, Artificial Sequence
  chemically synthesized
cggttccaaaagtcactccg

SEQ ID NO: 4022 - DNA, 20 bp, Artificial Sequence
  chemically synthesized
gttccaaaagtcactccgca

SEQ ID NO: 4023 - DNA, 20 bp, Artificial Sequence
  chemically synthesized
caaaagtcactccgcagagc

SEQ ID NO: 4024 - DNA, 20 bp, Artificial Sequence
  chemically synthesized
aaaagtcactccgcagagcc

SEQ ID NO: 4025 - DNA, 20 bp, Artificial Sequence
  chemically synthesized
gtcactccgcagagccggga

SEQ ID NO: 4026 - DNA, 20 bp, Artificial Sequence
  chemically synthesized
ctccgcagagccgggacagc

SEQ ID NO: 4027 - DNA, 20 bp, Artificial Sequence
  chemically synthesized
tccgcagagccgggacagcc

SEQ ID NO: 4028 - DNA, 20 bp, Artificial Sequence
  chemically synthesized
ccgcagagccgggacagccg

SEQ ID NO: 4029 - DNA, 20 bp, Artificial Sequence
  chemically synthesized
cgcagagccgggacagccgg

SEQ ID NO: 4030 - DNA, 20 bp, Artificial Sequence
  chemically synthesized
cagagccgggacagccgggg

SEQ ID NO: 4031 - DNA, 20 bp, Artificial Sequence
  chemically synthesized
agagccgggacagccggggg

SEQ ID NO: 4032 - DNA, 20 bp, Artificial Sequence
  chemically synthesized
gagccgggacagccggggga

SEQ ID NO: 4033 - DNA, 20 bp, Artificial Sequence
  chemically synthesized
agccgggacagccgggggag

SEQ ID NO: 4034 - DNA, 20 bp, Artificial Sequence
  chemically synthesized
gccgggacagccgggggagg

SEQ ID NO: 4035 - DNA, 20 bp, Artificial Sequence
  chemically synthesized
gggacagccgggggaggggg

SEQ ID NO: 4036 - DNA, 20 bp, Artificial Sequence
  chemically synthesized
ggacagccgggggagggggc

SEQ ID NO: 4037 - DNA, 20 bp, Artificial Sequence
  chemically synthesized
ccgggggagggggcaggtcc

SEQ ID NO: 4038 - DNA, 20 bp, Artificial Sequence
  chemically synthesized
cgggggagggggcaggtcct

SEQ ID NO: 4039 - DNA, 20 bp, Artificial Sequence
  chemically synthesized
gggggagggggcaggtcctg

SEQ ID NO: 4040 - DNA, 20 bp, Artificial Sequence
  chemically synthesized
gagggggcaggtcctggggc

SEQ ID NO: 4041 - DNA, 20 bp, Artificial Sequence
  chemically synthesized
agggggcaggtcctggggcg

SEQ ID NO: 4042 - DNA, 20 bp, Artificial Sequence
  chemically synthesized
gggggcaggtcctggggcga

SEQ ID NO: 4043 - DNA, 20 bp, Artificial Sequence
  chemically synthesized
gggcgagggacccctatctg

SEQ ID NO: 4044 - DNA, 20 bp, Artificial Sequence
  chemically synthesized
agggacccctatctgcagtt

SEQ ID NO: 4045 - DNA, 20 bp, Artificial Sequence
  chemically synthesized
gacccctatctgcagttcag

SEQ ID NO: 4046 - DNA, 20 bp, Artificial Sequence
  chemically synthesized
ccctatctgcagttcagtgg

SEQ ID NO: 4047 - DNA, 20 bp, Artificial Sequence
  chemically synthesized
cctatctgcagttcagtggt

SEQ ID NO: 4048 - DNA, 20 bp, Artificial Sequence
  chemically synthesized
cagtggtaggcactccctca

SEQ ID NO: 4049 - DNA, 20 bp, Artificial Sequence
  chemically synthesized
agtggtaggcactccctcac

SEQ ID NO: 4050 - DNA, 20 bp, Artificial Sequence
  chemically synthesized
gtggtaggcactccctcacg

SEQ ID NO: 4051 - DNA, 20 bp, Artificial Sequence
  chemically synthesized
aggcactccctcacggggtc

SEQ ID NO: 4052 - DNA, 20 bp, Artificial Sequence
  chemically synthesized
tccctcacggggtctggacg

SEQ ID NO: 4053 - DNA, 20 bp, Artificial Sequence
  chemically synthesized
tcacggggtctggacgcaga

SEQ ID NO: 4054 - DNA, 20 bp, Artificial Sequence
  chemically synthesized
cggggtctggacgcagaaag

SEQ ID NO: 4055 - DNA, 20 bp, Artificial Sequence
  chemically synthesized
ggggtctggacgcagaaagt

SEQ ID NO: 4056 - DNA, 20 bp, Artificial Sequence
  chemically synthesized
gggtctggacgcagaaagta

SEQ ID NO: 4057 - DNA, 20 bp, Artificial Sequence
  chemically synthesized
gtctggacgcagaaagtagg

SEQ ID NO: 4058 - DNA, 20 bp, Artificial Sequence
  chemically synthesized
ctggacgcagaaagtaggga

SEQ ID NO: 4059 - DNA, 20 bp, Artificial Sequence
  chemically synthesized
tggacgcagaaagtagggag

SEQ ID NO: 4060 - DNA, 20 bp, Artificial Sequence
  chemically synthesized
ggacgcagaaagtagggaga

SEQ ID NO: 4061 - DNA, 20 bp, Artificial Sequence
  chemically synthesized
gacgcagaaagtagggagag

SEQ ID NO: 4062 - DNA, 20 bp, Artificial Sequence
  chemically synthesized
aaagtagggagaggggcttg

SEQ ID NO: 4063 - DNA, 20 bp, Artificial Sequence
  chemically synthesized
tagggagaggggcttgcgga

SEQ ID NO: 4064 - DNA, 20 bp, Artificial Sequence
  chemically synthesized
agggagaggggcttgcggat

SEQ ID NO: 4065 - DNA, 20 bp, Artificial Sequence
  chemically synthesized
gggagaggggcttgcggata

SEQ ID NO: 4066 - DNA, 20 bp, Artificial Sequence
  chemically synthesized
aggggcttgcggatagggtt

SEQ ID NO: 4067 - DNA, 20 bp, Artificial Sequence
  chemically synthesized
ggcttgcggatagggttgag

SEQ ID NO: 4068 - DNA, 20 bp, Artificial Sequence
  chemically synthesized
gcttgcggatagggttgagc

SEQ ID NO: 4069 - DNA, 20 bp, Artificial Sequence
  chemically synthesized
agggttgagcaggtcctcca

SEQ ID NO: 4070 - DNA, 20 bp, Artificial Sequence
  chemically synthesized
ttgagcaggtcctccaaagt

SEQ ID NO: 4071 - DNA, 20 bp, Artificial Sequence
  chemically synthesized
tccaaagttagcaaactccc

SEQ ID NO: 4072 - DNA, 20 bp, Artificial Sequence
  chemically synthesized
ttagcaaactcccaagcgca

SEQ ID NO: 4073 - DNA, 20 bp, Artificial Sequence
  chemically synthesized
aactcccaagcgcaaagaaa

SEQ ID NO: 4074 - DNA, 20 bp, Artificial Sequence
  chemically synthesized
cccaagcgcaaagaaaaagc

SEQ ID NO: 4075 - DNA, 20 bp, Artificial Sequence
  chemically synthesized
ttccacccccgccgcgcccc

SEQ ID NO: 4076 - DNA, 20 bp, Artificial Sequence
  chemically synthesized
ccgcgcccctagttcgcccg

SEQ ID NO: 4077 - DNA, 20 bp, Artificial Sequence
  chemically synthesized
cctagttcgcccgcagccct

SEQ ID NO: 4078 - DNA, 20 bp, Artificial Sequence
  chemically synthesized
ccgcagccctcggactcacg

SEQ ID NO: 4079 - DNA, 20 bp, Artificial Sequence
  chemically synthesized
agccctcggactcacgcagc

SEQ ID NO: 4080 - DNA, 20 bp, Artificial Sequence
  chemically synthesized
tcacgcagcaagcgcccctg

SEQ ID NO: 4081 - DNA, 20 bp, Artificial Sequence
  chemically synthesized
cacgcagcaagcgcccctgc

SEQ ID NO: 4082 - DNA, 20 bp, Artificial Sequence
  chemically synthesized
caagcgcccctgcaggaccg

SEQ ID NO: 4083 - DNA, 20 bp, Artificial Sequence
  chemically synthesized
tgcaggaccgcggtctgcaa

SEQ ID NO: 4084 - DNA, 20 bp, Artificial Sequence
  chemically synthesized
accgcggtctgcaaaagcat

SEQ ID NO: 4085 - DNA, 20 bp, Artificial Sequence
  chemically synthesized
ccgcggtctgcaaaagcatc

SEQ ID NO: 4086 - DNA, 20 bp, Artificial Sequence
  chemically synthesized
gcggtctgcaaaagcatcag

SEQ ID NO: 4087 - DNA, 20 bp, Artificial Sequence
  chemically synthesized
cggtctgcaaaagcatcagg

SEQ ID NO: 4088 - DNA, 20 bp, Artificial Sequence
  chemically synthesized
gtctgcaaaagcatcaggag

SEQ ID NO: 4089 - DNA, 20 bp, Artificial Sequence
  chemically synthesized
tgcaaaagcatcaggaggag

SEQ ID NO: 4090 - DNA, 20 bp, Artificial Sequence
  chemically synthesized
agcatcaggaggagaagcgc

SEQ ID NO: 4091 - DNA, 20 bp, Artificial Sequence
  chemically synthesized
caggaggagaagcgccggcc

SEQ ID NO: 4092 - DNA, 20 bp, Artificial Sequence
  chemically synthesized
agaagcgccggcctggctcg

SEQ ID NO: 4093 - DNA, 20 bp, Artificial Sequence
  chemically synthesized
gaagcgccggcctggctcgc

SEQ ID NO: 4094 - DNA, 20 bp, Artificial Sequence
  chemically synthesized
ggctcgcgggcccatttccc

SEQ ID NO: 4095 - DNA, 20 bp, Artificial Sequence
  chemically synthesized
cgggcccatttccccagctc

SEQ ID NO: 4096 - DNA, 20 bp, Artificial Sequence
  chemically synthesized
cgttaaatctccgcttcttt

SEQ ID NO: 4097 - DNA, 20 bp, Artificial Sequence
  chemically synthesized
gttaaatctccgcttctttt

SEQ ID NO: 4098 - DNA, 20 bp, Artificial Sequence
  chemically synthesized
ttaaatctccgcttcttttg

SEQ ID NO: 4099 - DNA, 20 bp, Artificial Sequence
  chemically synthesized
taaatctccgcttcttttgg

SEQ ID NO: 4100 - DNA, 20 bp, Artificial Sequence
  chemically synthesized
aaatctccgcttcttttggg

SEQ ID NO: 4101 - DNA, 20 bp, Artificial Sequence
  chemically synthesized
tctccgcttcttttgggggg

SEQ ID NO: 4102 - DNA, 20 bp, Artificial Sequence
  chemically synthesized
ctccgcttcttttggggggc

SEQ ID NO: 4103 - DNA, 20 bp, Artificial Sequence
  chemically synthesized
tccgcttcttttggggggcg

SEQ ID NO: 4104 - DNA, 20 bp, Artificial Sequence
  chemically synthesized
tcttttggggggcggggaaa

SEQ ID NO: 4105 - DNA, 20 bp, Artificial Sequence
  chemically synthesized
cttttggggggcggggaaac

SEQ ID NO: 4106 - DNA, 20 bp, Artificial Sequence
  chemically synthesized
ttttggggggcggggaaacg

SEQ ID NO: 4107 - DNA, 20 bp, Artificial Sequence
  chemically synthesized
ggggggcggggaaacgggga

SEQ ID NO: 4108 - DNA, 20 bp, Artificial Sequence
  chemically synthesized
cggggaaacggggatggctc

SEQ ID NO: 4109 - DNA, 20 bp, Artificial Sequence
  chemically synthesized
ggaaacggggatggctccag

SEQ ID NO: 4110 - DNA, 20 bp, Artificial Sequence
  chemically synthesized
tggctccagaagtcacccta

SEQ ID NO: 4111 - DNA, 20 bp, Artificial Sequence
  chemically synthesized
gtcaccctacagctattgcc

SEQ ID NO: 4112 - DNA, 20 bp, Artificial Sequence
  chemically synthesized
tcaccctacagctattgcct

SEQ ID NO: 4113 - DNA, 20 bp, Artificial Sequence
  chemically synthesized
ctacagctattgcctaggct

SEQ ID NO: 4114 - DNA, 20 bp, Artificial Sequence
  chemically synthesized
tacagctattgcctaggctc

SEQ ID NO: 4115 - DNA, 20 bp, Artificial Sequence
  chemically synthesized
cagctattgcctaggctcag

SEQ ID NO: 4116 - DNA, 20 bp, Artificial Sequence
  chemically synthesized
gcctaggctcaggagatgcc

SEQ ID NO: 4117 - DNA, 20 bp, Artificial Sequence
  chemically synthesized
agatgcccagtaaaacttcc

SEQ ID NO: 4118 - DNA, 20 bp, Artificial Sequence
  chemically synthesized
cagtaaaacttcctggtgaa

SEQ ID NO: 4119 - DNA, 20 bp, Artificial Sequence
  chemically synthesized
aacttcctggtgaaaagcaa

SEQ ID NO: 4120 - DNA, 20 bp, Artificial Sequence
  chemically synthesized
acttcctggtgaaaagcaac

SEQ ID NO: 4121 - DNA, 20 bp, Artificial Sequence
  chemically synthesized
gtgaaaagcaacaggtcttt

SEQ ID NO: 4122 - DNA, 20 bp, Artificial Sequence
  chemically synthesized
caacaggtctttcagaactt

SEQ ID NO: 4123 - DNA, 20 bp, Artificial Sequence
  chemically synthesized
ctttagttctctctctccta

SEQ ID NO: 4124 - DNA, 20 bp, Artificial Sequence
  chemically synthesized
tagttctctctctcctacag

SEQ ID NO: 4125 - DNA, 20 bp, Artificial Sequence
  chemically synthesized
ttctctctctcctacagcag

SEQ ID NO: 4126 - DNA, 20 bp, Artificial Sequence
  chemically synthesized
tctctctctcctacagcaga

SEQ ID NO: 4127 - DNA, 20 bp, Artificial Sequence
  chemically synthesized
ggtacctgcttgtgaaacac

SEQ ID NO: 4128 - DNA, 20 bp, Artificial Sequence
  chemically synthesized
gtacctgcttgtgaaacact

SEQ ID NO: 4129 - DNA, 20 bp, Artificial Sequence
  chemically synthesized
ttgtgaaacactaggtgatc

SEQ ID NO: 4130 - DNA, 20 bp, Artificial Sequence
  chemically synthesized
aggtgatccagtgtccccct

SEQ ID NO: 4131 - DNA, 20 bp, Artificial Sequence
  chemically synthesized
cccttggtttttaaatcctg

SEQ ID NO: 4132 - DNA, 20 bp, Artificial Sequence
  chemically synthesized
ccttggtttttaaatcctga

SEQ ID NO: 4133 - DNA, 20 bp, Artificial Sequence
  chemically synthesized
cttggtttttaaatcctgaa

SEQ ID NO: 4134 - DNA, 20 bp, Artificial Sequence
  chemically synthesized
ttggtttttaaatcctgaag

SEQ ID NO: 4135 - DNA, 20 bp, Artificial Sequence
  chemically synthesized
cctgaaggggtgttgttgat

SEQ ID NO: 4136 - DNA, 20 bp, Artificial Sequence
  chemically synthesized
ctgaaggggtgttgttgatt

SEQ ID NO: 4137 - DNA, 20 bp, Artificial Sequence
  chemically synthesized
tgaaggggtgttgttgattg

SEQ ID NO: 4138 - DNA, 20 bp, Artificial Sequence
  chemically synthesized
ggggtgttgttgattgggga

SEQ ID NO: 4139 - DNA, 20 bp, Artificial Sequence
  chemically synthesized
gtgttgttgattggggaaag

SEQ ID NO: 4140 - DNA, 20 bp, Artificial Sequence
  chemically synthesized
caatgttctgatctgaactt

SEQ ID NO: 4141 - DNA, 20 bp, Artificial Sequence
  chemically synthesized
taaaaattttatctcaacct

SEQ ID NO: 4142 - DNA, 20 bp, Artificial Sequence
  chemically synthesized
aacttatgtcttatttgact

SEQ ID NO: 4143 - DNA, 20 bp, Artificial Sequence
  chemically synthesized
ttatttgacttagaaatata

SEQ ID NO: 4144 - DNA, 20 bp, Artificial Sequence
  chemically synthesized
ttttttgattcaaattaatt

SEQ ID NO: 4145 - DNA, 20 bp, Artificial Sequence
  chemically synthesized
aagtcataacattaaccaat

SEQ ID NO: 4146 - DNA, 20 bp, Artificial Sequence
  chemically synthesized
tcctactgaaacaccttcca

SEQ ID NO: 4147 - DNA, 20 bp, Artificial Sequence
  chemically synthesized
tcataattgaattatctgac

SEQ ID NO: 4148 - DNA, 20 bp, Artificial Sequence
  chemically synthesized
caagtgtttcacaaacttta

SEQ ID NO: 4149 - DNA, 20 bp, Artificial Sequence
  chemically synthesized
tttcacaaactttacagtat

SEQ ID NO: 4150 - DNA, 20 bp, Artificial Sequence
  chemically synthesized
ttcacaaactttacagtatt

SEQ ID NO: 4151 - DNA, 20 bp, Artificial Sequence
  chemically synthesized
tttacagtattgggattatc

SEQ ID NO: 4152 - DNA, 20 bp, Artificial Sequence
  chemically synthesized
tacagtattgggattatctg

SEQ ID NO: 4153 - DNA, 20 bp, Artificial Sequence
  chemically synthesized
ggagaatgattaaacatatt

SEQ ID NO: 4154 - DNA, 20 bp, Artificial Sequence
  chemically synthesized
gagaatgattaaacatattg

SEQ ID NO: 4155 - DNA, 20 bp, Artificial Sequence
  chemically synthesized
ttgaggcctgctcctaaccc

SEQ ID NO: 4156 - DNA, 20 bp, Artificial Sequence
  chemically synthesized
ccccagacacactgatttaa

SEQ ID NO: 4157 - DNA, 20 bp, Artificial Sequence
  chemically synthesized
cccagacacactgatttaat

SEQ ID NO: 4158 - DNA, 20 bp, Artificial Sequence
  chemically synthesized
ctgatttaatgggtaattgt

SEQ ID NO: 4159 - DNA, 20 bp, Artificial Sequence
  chemically synthesized
tgatttaatgggtaattgtt

SEQ ID NO: 4160 - DNA, 20 bp, Artificial Sequence
  chemically synthesized
tttaatgggtaattgttagg

SEQ ID NO: 4161 - DNA, 20 bp, Artificial Sequence
  chemically synthesized
atgggtaattgttaggtagt

SEQ ID NO: 4162 - DNA, 20 bp, Artificial Sequence
  chemically synthesized
attgttaggtagttagacat

SEQ ID NO: 4163 - DNA, 20 bp, Artificial Sequence
  chemically synthesized
gttaggtagttagacattag

SEQ ID NO: 4164 - DNA, 20 bp, Artificial Sequence
  chemically synthesized
ggtagttagacattagcagt

SEQ ID NO: 4165 - DNA, 20 bp, Artificial Sequence
  chemically synthesized
gtagttagacattagcagtt

SEQ ID NO: 4166 - DNA, 20 bp, Artificial Sequence
  chemically synthesized
agttagacattagcagttgg

SEQ ID NO: 4167 - DNA, 20 bp, Artificial Sequence
  chemically synthesized
gttagacattagcagttggg

SEQ ID NO: 4168 - DNA, 20 bp, Artificial Sequence
  chemically synthesized
ttagacattagcagttggga

SEQ ID NO: 4169 - DNA, 20 bp, Artificial Sequence
  chemically synthesized
tagacattagcagttgggag

SEQ ID NO: 4170 - DNA, 20 bp, Artificial Sequence
  chemically synthesized
tagcagttgggaggggatga

SEQ ID NO: 4171 - DNA, 20 bp, Artificial Sequence
  chemically synthesized
cagttgggaggggatgacag

SEQ ID NO: 4172 - DNA, 20 bp, Artificial Sequence
  chemically synthesized
gttgggaggggatgacagaa

SEQ ID NO: 4173 - DNA, 20 bp, Artificial Sequence
  chemically synthesized
tgggaggggatgacagaaga

SEQ ID NO: 4174 - DNA, 20 bp, Artificial Sequence
  chemically synthesized
gaggggatgacagaagagag

SEQ ID NO: 4175 - DNA, 20 bp, Artificial Sequence
  chemically synthesized
ggatgacagaagagagcgga

SEQ ID NO: 4176 - DNA, 20 bp, Artificial Sequence
  chemically synthesized
gatgacagaagagagcggaa

SEQ ID NO: 4177 - DNA, 20 bp, Artificial Sequence
  chemically synthesized
agagcggaaaggctgtcact

SEQ ID NO: 4178 - DNA, 20 bp, Artificial Sequence
  chemically synthesized
cggaaaggctgtcactaaga

SEQ ID NO: 4179 - DNA, 20 bp, Artificial Sequence
  chemically synthesized
gctgtcactaagacagccac

SEQ ID NO: 4180 - DNA, 20 bp, Artificial Sequence
  chemically synthesized
gccactggcccacctaaatt

SEQ ID NO: 4181 - DNA, 20 bp, Artificial Sequence
  chemically synthesized
ccactggcccacctaaattc

SEQ ID NO: 4182 - DNA, 20 bp, Artificial Sequence
  chemically synthesized
gcccacctaaattcaggccc

SEQ ID NO: 4183 - DNA, 20 bp, Artificial Sequence
  chemically synthesized
gactaccctaatgccaccct

SEQ ID NO: 4184 - DNA, 20 bp, Artificial Sequence
  chemically synthesized
actaccctaatgccacccta

SEQ ID NO: 4185 - DNA, 20 bp, Artificial Sequence
  chemically synthesized
ctaccctaatgccaccctaa

SEQ ID NO: 4186 - DNA, 20 bp, Artificial Sequence
  chemically synthesized
cctaatgccaccctaaggga

SEQ ID NO: 4187 - DNA, 20 bp, Artificial Sequence
  chemically synthesized
taatgccaccctaagggatg

SEQ ID NO: 4188 - DNA, 20 bp, Artificial Sequence
  chemically synthesized
aagggatggagtttatgata

SEQ ID NO: 4189 - DNA, 20 bp, Artificial Sequence
  chemically synthesized
ggagtttatgataaagtctg

SEQ ID NO: 4190 - DNA, 20 bp, Artificial Sequence
  chemically synthesized
agtctgtggccaaaatatcc

SEQ ID NO: 4191 - DNA, 20 bp, Artificial Sequence
  chemically synthesized
tctgtggccaaaatatcctg

SEQ ID NO: 4192 - DNA, 20 bp, Artificial Sequence
  chemically synthesized
tggccaaaatatcctggaga

SEQ ID NO: 4193 - DNA, 20 bp, Artificial Sequence
  chemically synthesized
gccaaaatatcctggagaaa

SEQ ID NO: 4194 - DNA, 20 bp, Artificial Sequence
  chemically synthesized
aaatatcctggagaaagaga

SEQ ID NO: 4195 - DNA, 20 bp, Artificial Sequence
  chemically synthesized
aatatcctggagaaagagaa

SEQ ID NO: 4196 - DNA, 20 bp, Artificial Sequence
  chemically synthesized
tatcctggagaaagagaaag

SEQ ID NO: 4197 - DNA, 20 bp, Artificial Sequence
  chemically synthesized
atcctggagaaagagaaagg

SEQ ID NO: 4198 - DNA, 20 bp, Artificial Sequence
  chemically synthesized
tcctggagaaagagaaagga

SEQ ID NO: 4199 - DNA, 20 bp, Artificial Sequence
  chemically synthesized
gagaaagagaaaggagggta

SEQ ID NO: 4200 - DNA, 20 bp, Artificial Sequence
  chemically synthesized
agaaagagaaaggagggtac

SEQ ID NO: 4201 - DNA, 20 bp, Artificial Sequence
  chemically synthesized
aagagaaaggagggtacagg

SEQ ID NO: 4202 - DNA, 20 bp, Artificial Sequence
  chemically synthesized
ggtacaggtggaaattccct

SEQ ID NO: 4203 - DNA, 20 bp, Artificial Sequence
  chemically synthesized
gtacaggtggaaattcccta

SEQ ID NO: 4204 - DNA, 20 bp, Artificial Sequence
  chemically synthesized
caggtggaaattccctaagg

SEQ ID NO: 4205 - DNA, 20 bp, Artificial Sequence
  chemically synthesized
gcacatgcccaacaacacaa

SEQ ID NO: 4206 - DNA, 20 bp, Artificial Sequence
  chemically synthesized
caacacaaaagcctgtcttc

SEQ ID NO: 4207 - DNA, 20 bp, Artificial Sequence
  chemically synthesized
cctgtcttcaagttcacccc

SEQ ID NO: 4208 - DNA, 20 bp, Artificial Sequence
  chemically synthesized
tcatcatgccatcattataa

SEQ ID NO: 4209 - DNA, 20 bp, Artificial Sequence
  chemically synthesized
attataatagaatttacata

SEQ ID NO: 4210 - DNA, 20 bp, Artificial Sequence
  chemically synthesized
cagttttgcccccccatccc

SEQ ID NO: 4211 - DNA, 20 bp, Artificial Sequence
  chemically synthesized
agttttgcccccccatccct

SEQ ID NO: 4212 - DNA, 20 bp, Artificial Sequence
  chemically synthesized
ttttgcccccccatccctgg

SEQ ID NO: 4213 - DNA, 20 bp, Artificial Sequence
  chemically synthesized
tttgcccccccatccctggg

SEQ ID NO: 4214 - DNA, 20 bp, Artificial Sequence
  chemically synthesized
aggcttttcttaacaaatta

SEQ ID NO: 4215 - DNA, 20 bp, Artificial Sequence
  chemically synthesized
ggcttttcttaacaaattat

SEQ ID NO: 4216 - DNA, 20 bp, Artificial Sequence
  chemically synthesized
tttcttaacaaattataggt

SEQ ID NO: 4217 - DNA, 20 bp, Artificial Sequence
  chemically synthesized
attataggtaagaccatgca

SEQ ID NO: 4218 - DNA, 20 bp, Artificial Sequence
  chemically synthesized
gaccatgcacagtttaattt

SEQ ID NO: 4219 - DNA, 20 bp, Artificial Sequence
  chemically synthesized
cagtttaattttagattgta

SEQ ID NO: 4220 - DNA, 20 bp, Artificial Sequence
  chemically synthesized
aataacatcatcctgtcact

SEQ ID NO: 4221 - DNA, 20 bp, Artificial Sequence
  chemically synthesized
atcatcctgtcactcagata

SEQ ID NO: 4222 - DNA, 20 bp, Artificial Sequence
  chemically synthesized
cctccccacaaaccccataa

SEQ ID NO: 4223 - DNA, 20 bp, Artificial Sequence
  chemically synthesized
aaaccccataaaagcacctt

SEQ ID NO: 4224 - DNA, 20 bp, Artificial Sequence
  chemically synthesized
aaagcaccttgagctctgta

SEQ ID NO: 4225 - DNA, 20 bp, Artificial Sequence
  chemically synthesized
gcaccttgagctctgtaaag

SEQ ID NO: 4226 - DNA, 20 bp, Artificial Sequence
  chemically synthesized
gagctctgtaaagaagtgct

SEQ ID NO: 4227 - DNA, 20 bp, Artificial Sequence
  chemically synthesized
gaagtgctgagttcacttcg

SEQ ID NO: 4228 - DNA, 20 bp, Artificial Sequence
  chemically synthesized
tgagttcacttcgcagaaat

SEQ ID NO: 4229 - DNA, 20 bp, Artificial Sequence
  chemically synthesized
gaaataagcccgctgtccct

SEQ ID NO: 4230 - DNA, 20 bp, Artificial Sequence
  chemically synthesized
aataagcccgctgtccctca

SEQ ID NO: 4231 - DNA, 20 bp, Artificial Sequence
  chemically synthesized
gcttcaataaactttgcttt

SEQ ID NO: 4232 - DNA, 20 bp, Artificial Sequence
  chemically synthesized
tttgctttaagcttgcattt

SEQ ID NO: 4233 - DNA, 20 bp, Artificial Sequence
  chemically synthesized
ttaagcttgcattttggtgt

SEQ ID NO: 4234 - DNA, 20 bp, Artificial Sequence
  chemically synthesized
tgcattttggtgttagtttg

SEQ ID NO: 4235 - DNA, 20 bp, Artificial Sequence
  chemically synthesized
agttctttgctcactatcac

SEQ ID NO: 4236 - DNA, 20 bp, Artificial Sequence
  chemically synthesized
tgctcactatcacaagaact

SEQ ID NO: 4237 - DNA, 20 bp, Artificial Sequence
  chemically synthesized
atcacaagaactgagattgc

SEQ ID NO: 4238 - DNA, 20 bp, Artificial Sequence
  chemically synthesized
aagaactgagattgctggtt

SEQ ID NO: 4239 - DNA, 20 bp, Artificial Sequence
  chemically synthesized
gaactgagattgctggttca

SEQ ID NO: 4240 - DNA, 20 bp, Artificial Sequence
  chemically synthesized
agattgctggttcagagctc

SEQ ID NO: 4241 - DNA, 20 bp, Artificial Sequence
  chemically synthesized
tccggctataataatctcct

SEQ ID NO: 4242 - DNA, 20 bp, Artificial Sequence
  chemically synthesized
tataataatctcctcggtta

SEQ ID NO: 4243 - DNA, 20 bp, Artificial Sequence
  chemically synthesized
ataataatctcctcggttaa

SEQ ID NO: 4244 - DNA, 20 bp, Artificial Sequence
  chemically synthesized
ccatcccaatgcataattcc

SEQ ID NO: 4245 - DNA, 20 bp, Artificial Sequence
  chemically synthesized
caatgcataattcccagtaa

SEQ ID NO: 4246 - DNA, 20 bp, Artificial Sequence
  chemically synthesized
cataattcccagtaacagta

SEQ ID NO: 4247 - DNA, 20 bp, Artificial Sequence
  chemically synthesized
ataattcccagtaacagtat

SEQ ID NO: 4248 - DNA, 20 bp, Artificial Sequence
  chemically synthesized
taacagtatgggatgccacc

SEQ ID NO: 4249 - DNA, 20 bp, Artificial Sequence
  chemically synthesized
aacagtatgggatgccacct

SEQ ID NO: 4250 - DNA, 20 bp, Artificial Sequence
  chemically synthesized
atgggatgccacctgggcaa

SEQ ID NO: 4251 - DNA, 20 bp, Artificial Sequence
  chemically synthesized
tgggatgccacctgggcaat

SEQ ID NO: 4252 - DNA, 20 bp, Artificial Sequence
  chemically synthesized
cctgggcaatgggattttaa

SEQ ID NO: 4253 - DNA, 20 bp, Artificial Sequence
  chemically synthesized
gctttccttctccctcaacg

SEQ ID NO: 4254 - DNA, 20 bp, Artificial Sequence
  chemically synthesized
ccttctccctcaacgaagtt

SEQ ID NO: 4255 - DNA, 20 bp, Artificial Sequence
  chemically synthesized
cttctccctcaacgaagttt

SEQ ID NO: 4256 - DNA, 20 bp, Artificial Sequence
  chemically synthesized
aagtttgggaattattgcct

SEQ ID NO: 4257 - DNA, 20 bp, Artificial Sequence
  chemically synthesized
gctccaaacctttacatatc

SEQ ID NO: 4258 - DNA, 20 bp, Artificial Sequence
  chemically synthesized
tacatatctagcaaattcaa

SEQ ID NO: 4259 - DNA, 20 bp, Artificial Sequence
  chemically synthesized
acatatctagcaaattcaac

SEQ ID NO: 4260 - DNA, 20 bp, Artificial Sequence
  chemically synthesized
tcaacaggcattatttttgt

SEQ ID NO: 4261 - DNA, 20 bp, Artificial Sequence
  chemically synthesized
gtaagcatgtatgcaaattt

SEQ ID NO: 4262 - DNA, 20 bp, Artificial Sequence
  chemically synthesized
tatgcaaattttggcaattc

SEQ ID NO: 4263 - DNA, 20 bp, Artificial Sequence
  chemically synthesized
ggcaattcaagaaaatcaaa

SEQ ID NO: 4264 - DNA, 20 bp, Artificial Sequence
  chemically synthesized
gcaattcaagaaaatcaaac

SEQ ID NO: 4265 - DNA, 20 bp, Artificial Sequence
  chemically synthesized
aagaaaatcaaacaggatat

SEQ ID NO: 4266 - DNA, 20 bp, Artificial Sequence
  chemically synthesized
agaaaatcaaacaggatatc

SEQ ID NO: 4267 - DNA, 20 bp, Artificial Sequence
  chemically synthesized
gaaaatcaaacaggatatca

SEQ ID NO: 4268 - DNA, 20 bp, Artificial Sequence
  chemically synthesized
ggatatcagggcctcgactg

SEQ ID NO: 4269 - DNA, 20 bp, Artificial Sequence
  chemically synthesized
gatatcagggcctcgactgt

SEQ ID NO: 4270 - DNA, 20 bp, Artificial Sequence
  chemically synthesized
gggcctcgactgtaggcaaa

SEQ ID NO: 4271 - DNA, 20 bp, Artificial Sequence
  chemically synthesized
gcaaacagatacaataacat

SEQ ID NO: 4272 - DNA, 20 bp, Artificial Sequence
  chemically synthesized
acaataacattggaaacatg

SEQ ID NO: 4273 - DNA, 20 bp, Artificial Sequence
  chemically synthesized
aacatgtagaatattgatga

SEQ ID NO: 4274 - DNA, 20 bp, Artificial Sequence
  chemically synthesized
acatgtagaatattgatgat

SEQ ID NO: 4275 - DNA, 20 bp, Artificial Sequence
  chemically synthesized
aatattgatgatgggcacat

SEQ ID NO: 4276 - DNA, 20 bp, Artificial Sequence
  chemically synthesized
atattgatgatgggcacatt

SEQ ID NO: 4277 - DNA, 20 bp, Artificial Sequence
  chemically synthesized
tattgatgatgggcacattg

SEQ ID NO: 4278 - DNA, 20 bp, Artificial Sequence
  chemically synthesized
gatgggcacattggggctga

SEQ ID NO: 4279 - DNA, 20 bp, Artificial Sequence
  chemically synthesized
tattcctttttttcaatttt

SEQ ID NO: 4280 - DNA, 20 bp, Artificial Sequence
  chemically synthesized
cctttttttcaatttttggt

SEQ ID NO: 4281 - DNA, 20 bp, Artificial Sequence
  chemically synthesized
aatttttggtaagatataat

SEQ ID NO: 4282 - DNA, 20 bp, Artificial Sequence
  chemically synthesized
tctatgtaaaatgcaaaaat

SEQ ID NO: 4283 - DNA, 20 bp, Artificial Sequence
  chemically synthesized
gtaaaatgcaaaaattggcc

SEQ ID NO: 4284 - DNA, 20 bp, Artificial Sequence
  chemically synthesized
atgcaaaaattggcccggct

SEQ ID NO: 4285 - DNA, 20 bp, Artificial Sequence
  chemically synthesized
caaaaattggcccggctcag

SEQ ID NO: 4286 - DNA, 20 bp, Artificial Sequence
  chemically synthesized
gtggctcacgcttgtaatcc

SEQ ID NO: 4287 - DNA, 20 bp, Artificial Sequence
  chemically synthesized
cgcttgtaatcccagcactt

SEQ ID NO: 4288 - DNA, 20 bp, Artificial Sequence
  chemically synthesized
gcttgtaatcccagcacttt

SEQ ID NO: 4289 - DNA, 20 bp, Artificial Sequence
  chemically synthesized
tgtaatcccagcactttggg

SEQ ID NO: 4290 - DNA, 20 bp, Artificial Sequence
  chemically synthesized
tcccagcactttgggcggcc

SEQ ID NO: 4291 - DNA, 20 bp, Artificial Sequence
  chemically synthesized
cccagcactttgggcggccg

SEQ ID NO: 4292 - DNA, 20 bp, Artificial Sequence
  chemically synthesized
agcactttgggcggccgagg

SEQ ID NO: 4293 - DNA, 20 bp, Artificial Sequence
  chemically synthesized
gcactttgggcggccgagga

SEQ ID NO: 4294 - DNA, 20 bp, Artificial Sequence
  chemically synthesized
ctttgggcggccgaggaagg

SEQ ID NO: 4295 - DNA, 20 bp, Artificial Sequence
  chemically synthesized
ccgaggaaggcagatcacct

SEQ ID NO: 4296 - DNA, 20 bp, Artificial Sequence
  chemically synthesized
gaaggcagatcacctgagat

SEQ ID NO: 4297 - DNA, 20 bp, Artificial Sequence
  chemically synthesized
aaggcagatcacctgagatc

SEQ ID NO: 4298 - DNA, 20 bp, Artificial Sequence
  chemically synthesized
aggcagatcacctgagatca

SEQ ID NO: 4299 - DNA, 20 bp, Artificial Sequence
  chemically synthesized
ggcagatcacctgagatcag

SEQ ID NO: 4300 - DNA, 20 bp, Artificial Sequence
  chemically synthesized
tcacctgagatcaggggttc

SEQ ID NO: 4301 - DNA, 20 bp, Artificial Sequence
  chemically synthesized
tgagatcaggggttcgagac

SEQ ID NO: 4302 - DNA, 20 bp, Artificial Sequence
  chemically synthesized
tcaggggttcgagaccagcc

SEQ ID NO: 4303 - DNA, 20 bp, Artificial Sequence
  chemically synthesized
cgagaccagcctggccaaca

SEQ ID NO: 4304 - DNA, 20 bp, Artificial Sequence
  chemically synthesized
tttactaaaaatacaaaaat

SEQ ID NO: 4305 - DNA, 20 bp, Artificial Sequence
  chemically synthesized
ctaaaaatacaaaaattagc

SEQ ID NO: 4306 - DNA, 20 bp, Artificial Sequence
  chemically synthesized
taaaaatacaaaaattagcc

SEQ ID NO: 4307 - DNA, 20 bp, Artificial Sequence
  chemically synthesized
caaaaattagccgggcgtga

SEQ ID NO: 4308 - DNA, 20 bp, Artificial Sequence
  chemically synthesized
aaattagccgggcgtgatag

SEQ ID NO: 4309 - DNA, 20 bp, Artificial Sequence
  chemically synthesized
aattagccgggcgtgatagc

SEQ ID NO: 4310 - DNA, 20 bp, Artificial Sequence
  chemically synthesized
atagcaggcaactgtaatcc

SEQ ID NO: 4311 - DNA, 20 bp, Artificial Sequence
  chemically synthesized
aactgtaatcccagctacat

SEQ ID NO: 4312 - DNA, 20 bp, Artificial Sequence
  chemically synthesized
ctgtaatcccagctacatta

SEQ ID NO: 4313 - DNA, 20 bp, Artificial Sequence
  chemically synthesized
tgtaatcccagctacattag

SEQ ID NO: 4314 - DNA, 20 bp, Artificial Sequence
  chemically synthesized
tcccagctacattagaggct

SEQ ID NO: 4315 - DNA, 20 bp, Artificial Sequence
  chemically synthesized
cccagctacattagaggctg

SEQ ID NO: 4316 - DNA, 20 bp, Artificial Sequence
  chemically synthesized
agctacattagaggctgagg

SEQ ID NO: 4317 - DNA, 20 bp, Artificial Sequence
  chemically synthesized
gctacattagaggctgaggc

SEQ ID NO: 4318 - DNA, 20 bp, Artificial Sequence
  chemically synthesized
tacattagaggctgaggcag

SEQ ID NO: 4319 - DNA, 20 bp, Artificial Sequence
  chemically synthesized
gcaggagaatcgcttgaacc

SEQ ID NO: 4320 - DNA, 20 bp, Artificial Sequence
  chemically synthesized
caggagaatcgcttgaaccc

SEQ ID NO: 4321 - DNA, 20 bp, Artificial Sequence
  chemically synthesized
ggagaatcgcttgaacccgg

SEQ ID NO: 4322 - DNA, 20 bp, Artificial Sequence
  chemically synthesized
gagaatcgcttgaacccggg

SEQ ID NO: 4323 - DNA, 20 bp, Artificial Sequence
  chemically synthesized
tcgcttgaacccgggaggcg

SEQ ID NO: 4324 - DNA, 20 bp, Artificial Sequence
  chemically synthesized
cgcttgaacccgggaggcgt

SEQ ID NO: 4325 - DNA, 20 bp, Artificial Sequence
  chemically synthesized
aacccgggaggcgtaggttg

SEQ ID NO: 4326 - DNA, 20 bp, Artificial Sequence
  chemically synthesized
cgggaggcgtaggttgcagt

SEQ ID NO: 4327 - DNA, 20 bp, Artificial Sequence
  chemically synthesized
ggcgtaggttgcagtgagct

SEQ ID NO: 4328 - DNA, 20 bp, Artificial Sequence
  chemically synthesized
aagatcgtgccatcacactc

SEQ ID NO: 4329 - DNA, 20 bp, Artificial Sequence
  chemically synthesized
cgtgccatcacactccagca

SEQ ID NO: 4330 - DNA, 20 bp, Artificial Sequence
  chemically synthesized
gtgccatcacactccagcat

SEQ ID NO: 4331 - DNA, 20 bp, Artificial Sequence
  chemically synthesized
gccatcacactccagcatgg

SEQ ID NO: 4332 - DNA, 20 bp, Artificial Sequence
  chemically synthesized
cacactccagcatgggagac

SEQ ID NO: 4333 - DNA, 20 bp, Artificial Sequence
  chemically synthesized
cactccagcatgggagacaa

SEQ ID NO: 4334 - DNA, 20 bp, Artificial Sequence
  chemically synthesized
ccagcatgggagacaagagc

SEQ ID NO: 4335 - DNA, 20 bp, Artificial Sequence
  chemically synthesized
tcatctcaaaaaaaaaaaat

SEQ ID NO: 4336 - DNA, 20 bp, Artificial Sequence
  chemically synthesized
ctcaaaaaaaaaaaattagc

SEQ ID NO: 4337 - DNA, 20 bp, Artificial Sequence
  chemically synthesized
tcaaaaaaaaaaaattagct

SEQ ID NO: 4338 - DNA, 20 bp, Artificial Sequence
  chemically synthesized
aaaaaaaaattagctgggtg

SEQ ID NO: 4339 - DNA, 20 bp, Artificial Sequence
  chemically synthesized
aaaaaattagctgggtgtgg

SEQ ID NO: 4340 - DNA, 20 bp, Artificial Sequence
  chemically synthesized
gtggcatgcacctgtaattc

SEQ ID NO: 4341 - DNA, 20 bp, Artificial Sequence
  chemically synthesized
cacctgtaattccagctact

SEQ ID NO: 4342 - DNA, 20 bp, Artificial Sequence
  chemically synthesized
acctgtaattccagctactc

SEQ ID NO: 4343 - DNA, 20 bp, Artificial Sequence
  chemically synthesized
tgtaattccagctactcggg

SEQ ID NO: 4344 - DNA, 20 bp, Artificial Sequence
  chemically synthesized
ttccagctactcgggaagct

SEQ ID NO: 4345 - DNA, 20 bp, Artificial Sequence
  chemically synthesized
agctactcgggaagctgaga

SEQ ID NO: 4346 - DNA, 20 bp, Artificial Sequence
  chemically synthesized
gctactcgggaagctgagac

SEQ ID NO: 4347 - DNA, 20 bp, Artificial Sequence
  chemically synthesized
tactcgggaagctgagacag

SEQ ID NO: 4348 - DNA, 20 bp, Artificial Sequence
  chemically synthesized
acaggagaatcgcttgaacc

SEQ ID NO: 4349 - DNA, 20 bp, Artificial Sequence
  chemically synthesized
caggagaatcgcttgaacct

SEQ ID NO: 4350 - DNA, 20 bp, Artificial Sequence
  chemically synthesized
ggagaatcgcttgaacctgg

SEQ ID NO: 4351 - DNA, 20 bp, Artificial Sequence
  chemically synthesized
gagaatcgcttgaacctggg

SEQ ID NO: 4352 - DNA, 20 bp, Artificial Sequence
  chemically synthesized
aatcgcttgaacctgggagg

SEQ ID NO: 4353 - DNA, 20 bp, Artificial Sequence
  chemically synthesized
tcgcttgaacctgggaggcg

SEQ ID NO: 4354 - DNA, 20 bp, Artificial Sequence
  chemically synthesized
cgcttgaacctgggaggcgg

SEQ ID NO: 4355 - DNA, 20 bp, Artificial Sequence
  chemically synthesized
aacctgggaggcggaggttg

SEQ ID NO: 4356 - DNA, 20 bp, Artificial Sequence
  chemically synthesized
tgggaggcggaggttgtggt

SEQ ID NO: 4357 - DNA, 20 bp, Artificial Sequence
  chemically synthesized
ggcggaggttgtggtgagcc

SEQ ID NO: 4358 - DNA, 20 bp, Artificial Sequence
  chemically synthesized
gagatcatgccattgcactc

SEQ ID NO: 4359 - DNA, 20 bp, Artificial Sequence
  chemically synthesized
catgccattgcactccagcc

SEQ ID NO: 4360 - DNA, 20 bp, Artificial Sequence
  chemically synthesized
atgccattgcactccagcct

SEQ ID NO: 4361 - DNA, 20 bp, Artificial Sequence
  chemically synthesized
tgcactccagcctgggcaac

SEQ ID NO: 4362 - DNA, 20 bp, Artificial Sequence
  chemically synthesized
cactccagcctgggcaacaa

SEQ ID NO: 4363 - DNA, 20 bp, Artificial Sequence
  chemically synthesized
aaataaaatgcaaaaattaa

SEQ ID NO: 4364 - DNA, 20 bp, Artificial Sequence
  chemically synthesized
atgcaaaaattaatggattt

SEQ ID NO: 4365 - DNA, 20 bp, Artificial Sequence
  chemically synthesized
aatggattttagtatattta

SEQ ID NO: 4366 - DNA, 20 bp, Artificial Sequence
  chemically synthesized
tggattttagtatatttaca

SEQ ID NO: 4367 - DNA, 20 bp, Artificial Sequence
  chemically synthesized
tacatttctatctccccaaa

SEQ ID NO: 4368 - DNA, 20 bp, Artificial Sequence
  chemically synthesized
gaaaccatgttcccctaatt

SEQ ID NO: 4369 - DNA, 20 bp, Artificial Sequence
  chemically synthesized
acccttaattcatcgcctcc

SEQ ID NO: 4370 - DNA, 20 bp, Artificial Sequence
  chemically synthesized
ttctcctcctcctcccctcc

SEQ ID NO: 4371 - DNA, 20 bp, Artificial Sequence
  chemically synthesized
tcctcctcccctcccagccc

SEQ ID NO: 4372 - DNA, 20 bp, Artificial Sequence
  chemically synthesized
taatctactttctttctatt

SEQ ID NO: 4373 - DNA, 20 bp, Artificial Sequence
  chemically synthesized
ttctttctatttggaacatt

SEQ ID NO: 4374 - DNA, 20 bp, Artificial Sequence
  chemically synthesized
tttggaacatttagtataca

SEQ ID NO: 4375 - DNA, 20 bp, Artificial Sequence
  chemically synthesized
tggaacatttagtatacata

SEQ ID NO: 4376 - DNA, 20 bp, Artificial Sequence
  chemically synthesized
ggaacatttagtatacatag

SEQ ID NO: 4377 - DNA, 20 bp, Artificial Sequence
  chemically synthesized
atatattgctttgccgtgac

SEQ ID NO: 4378 - DNA, 20 bp, Artificial Sequence
  chemically synthesized
cgtgactggcttctttcatt

SEQ ID NO: 4379 - DNA, 20 bp, Artificial Sequence
  chemically synthesized
gtttttatgtatgtttttca

SEQ ID NO: 4380 - DNA, 20 bp, Artificial Sequence
  chemically synthesized
ggaccaataatatctattat

SEQ ID NO: 4381 - DNA, 20 bp, Artificial Sequence
  chemically synthesized
gaccaataatatctattata

SEQ ID NO: 4382 - DNA, 20 bp, Artificial Sequence
  chemically synthesized
tattttatttattcattcat

SEQ ID NO: 4383 - DNA, 20 bp, Artificial Sequence
  chemically synthesized
tttattcattcatcagccga

SEQ ID NO: 4384 - DNA, 20 bp, Artificial Sequence
  chemically synthesized
attcatcagccgatggacat

SEQ ID NO: 4385 - DNA, 20 bp, Artificial Sequence
  chemically synthesized
attggtttgtttctacttta

SEQ ID NO: 4386 - DNA, 20 bp, Artificial Sequence
  chemically synthesized
tgtttctactttatggctat

SEQ ID NO: 4387 - DNA, 20 bp, Artificial Sequence
  chemically synthesized
gtttctactttatggctatt

SEQ ID NO: 4388 - DNA, 20 bp, Artificial Sequence
  chemically synthesized
tactttatggctattgggaa

SEQ ID NO: 4389 - DNA, 20 bp, Artificial Sequence
  chemically synthesized
tgttataaacatttatgtac

SEQ ID NO: 4390 - DNA, 20 bp, Artificial Sequence
  chemically synthesized
tttatgtacaagtttttttg

SEQ ID NO: 4391 - DNA, 20 bp, Artificial Sequence
  chemically synthesized
acttatgttttgatttcttt

SEQ ID NO: 4392 - DNA, 20 bp, Artificial Sequence
  chemically synthesized
atttcttttggttatatatc

SEQ ID NO: 4393 - DNA, 20 bp, Artificial Sequence
  chemically synthesized
tcttttggttatatatctag

SEQ ID NO: 4394 - DNA, 20 bp, Artificial Sequence
  chemically synthesized
tttggttatatatctagaag

SEQ ID NO: 4395 - DNA, 20 bp, Artificial Sequence
  chemically synthesized
ttggttatatatctagaagt

SEQ ID NO: 4396 - DNA, 20 bp, Artificial Sequence
  chemically synthesized
atatctagaagtgggtttgc

SEQ ID NO: 4397 - DNA, 20 bp, Artificial Sequence
  chemically synthesized
tatctagaagtgggtttgct

SEQ ID NO: 4398 - DNA, 20 bp, Artificial Sequence
  chemically synthesized
agtgggtttgctgggtcata

SEQ ID NO: 4399 - DNA, 20 bp, Artificial Sequence
  chemically synthesized
gtaacactgtttaacctttt

SEQ ID NO: 4400 - DNA, 20 bp, Artificial Sequence
  chemically synthesized
taacactgtttaaccttttg

SEQ ID NO: 4401 - DNA, 20 bp, Artificial Sequence
  chemically synthesized
aattgccacattcttttcca

SEQ ID NO: 4402 - DNA, 20 bp, Artificial Sequence
  chemically synthesized
gccacattcttttccaaagt

SEQ ID NO: 4403 - DNA, 20 bp, Artificial Sequence
  chemically synthesized
taagcattttatcctcctat

SEQ ID NO: 4404 - DNA, 20 bp, Artificial Sequence
  chemically synthesized
gcattttatcctcctatcag

SEQ ID NO: 4405 - DNA, 20 bp, Artificial Sequence
  chemically synthesized
tcctcctatcagcagtgtat

SEQ ID NO: 4406 - DNA, 20 bp, Artificial Sequence
  chemically synthesized
ctcctatcagcagtgtatga

SEQ ID NO: 4407 - DNA, 20 bp, Artificial Sequence
  chemically synthesized
gatttctctccatctttgcc

SEQ ID NO: 4408 - DNA, 20 bp, Artificial Sequence
  chemically synthesized
atttctctccatctttgcct

SEQ ID NO: 4409 - DNA, 20 bp, Artificial Sequence
  chemically synthesized
ctttgcctgggtttttgaat

SEQ ID NO: 4410 - DNA, 20 bp, Artificial Sequence
  chemically synthesized
tttgcctgggtttttgaatc

SEQ ID NO: 4411 - DNA, 20 bp, Artificial Sequence
  chemically synthesized
ttgcctgggtttttgaatca

SEQ ID NO: 4412 - DNA, 20 bp, Artificial Sequence
  chemically synthesized
gggtttttgaatcagggccc

SEQ ID NO: 4413 - DNA, 20 bp, Artificial Sequence
  chemically synthesized
ttttgaatcagggccccaga

SEQ ID NO: 4414 - DNA, 20 bp, Artificial Sequence
  chemically synthesized
ccccagatagaacaaaaatg

SEQ ID NO: 4415 - DNA, 20 bp, Artificial Sequence
  chemically synthesized
agaacaaaaatgtggttatt

SEQ ID NO: 4416 - DNA, 20 bp, Artificial Sequence
  chemically synthesized
ttgttccaccatcacttgtt

SEQ ID NO: 4417 - DNA, 20 bp, Artificial Sequence
  chemically synthesized
ttccaccatcacttgttgag

SEQ ID NO: 4418 - DNA, 20 bp, Artificial Sequence
  chemically synthesized
agaagactcttttttcattg

SEQ ID NO: 4419 - DNA, 20 bp, Artificial Sequence
  chemically synthesized
cttttttcattgaagtgttt

SEQ ID NO: 4420 - DNA, 20 bp, Artificial Sequence
  chemically synthesized
aatcaatctaccataaatgt

SEQ ID NO: 4421 - DNA, 20 bp, Artificial Sequence
  chemically synthesized
tcaatctaccataaatgtga

SEQ ID NO: 4422 - DNA, 20 bp, Artificial Sequence
  chemically synthesized
taaatgtgagagtttatttc

SEQ ID NO: 4423 - DNA, 20 bp, Artificial Sequence
  chemically synthesized
aatgtgagagtttatttctg

SEQ ID NO: 4424 - DNA, 20 bp, Artificial Sequence
  chemically synthesized
ctatctttttttttttttga

SEQ ID NO: 4425 - DNA, 20 bp, Artificial Sequence
  chemically synthesized
atctttttttttttttgaca

SEQ ID NO: 4426 - DNA, 20 bp, Artificial Sequence
  chemically synthesized
cagagcctcactctattgcc

SEQ ID NO: 4427 - DNA, 20 bp, Artificial Sequence
  chemically synthesized
agagcctcactctattgccc

SEQ ID NO: 4428 - DNA, 20 bp, Artificial Sequence
  chemically synthesized
cctcactctattgcccaggt

SEQ ID NO: 4429 - DNA, 20 bp, Artificial Sequence
  chemically synthesized
tcactctattgcccaggttg

SEQ ID NO: 4430 - DNA, 20 bp, Artificial Sequence
  chemically synthesized
ctattgcccaggttggagtg

SEQ ID NO: 4431 - DNA, 20 bp, Artificial Sequence
  chemically synthesized
ttgcccaggttggagtgcag

SEQ ID NO: 4432 - DNA, 20 bp, Artificial Sequence
  chemically synthesized
ggagtgcagtggcccaatcc

SEQ ID NO: 4433 - DNA, 20 bp, Artificial Sequence
  chemically synthesized
agtggcccaatcccggccac

SEQ ID NO: 4434 - DNA, 20 bp, Artificial Sequence
  chemically synthesized
cggccactggctcctcctcc

SEQ ID NO: 4435 - DNA, 20 bp, Artificial Sequence
  chemically synthesized
ggccactggctcctcctccc

SEQ ID NO: 4436 - DNA, 20 bp, Artificial Sequence
  chemically synthesized
tggctcctcctcccaggttc

SEQ ID NO: 4437 - DNA, 20 bp, Artificial Sequence
  chemically synthesized
ttcaagcaattctcctgcct

SEQ ID NO: 4438 - DNA, 20 bp, Artificial Sequence
  chemically synthesized
ttctcctgcctcagcctccc

SEQ ID NO: 4439 - DNA, 20 bp, Artificial Sequence
  chemically synthesized
tcctgcctcagcctcccaag

SEQ ID NO: 4440 - DNA, 20 bp, Artificial Sequence
  chemically synthesized
gcctcagcctcccaagcagc

SEQ ID NO: 4441 - DNA, 20 bp, Artificial Sequence
  chemically synthesized
cctcagcctcccaagcagct

SEQ ID NO: 4442 - DNA, 20 bp, Artificial Sequence
  chemically synthesized
ctcccaagcagctgggatta

SEQ ID NO: 4443 - DNA, 20 bp, Artificial Sequence
  chemically synthesized
tcccaagcagctgggattac

SEQ ID NO: 4444 - DNA, 20 bp, Artificial Sequence
  chemically synthesized
caggtacctgccaccatgcc

SEQ ID NO: 4445 - DNA, 20 bp, Artificial Sequence
  chemically synthesized
ctggttaatttttgtatttt

SEQ ID NO: 4446 - DNA, 20 bp, Artificial Sequence
  chemically synthesized
gttaatttttgtatttttag

SEQ ID NO: 4447 - DNA, 20 bp, Artificial Sequence
  chemically synthesized
taatttttgtatttttagta

SEQ ID NO: 4448 - DNA, 20 bp, Artificial Sequence
  chemically synthesized
ttttgtatttttagtagaga

SEQ ID NO: 4449 - DNA, 20 bp, Artificial Sequence
  chemically synthesized
tttgtatttttagtagagac

SEQ ID NO: 4450 - DNA, 20 bp, Artificial Sequence
  chemically synthesized
ttgtatttttagtagagacg

SEQ ID NO: 4451 - DNA, 20 bp, Artificial Sequence
  chemically synthesized
gagacggggtttcaccatgt

SEQ ID NO: 4452 - DNA, 20 bp, Artificial Sequence
  chemically synthesized
cggggtttcaccatgttggt

SEQ ID NO: 4453 - DNA, 20 bp, Artificial Sequence
  chemically synthesized
ggggtttcaccatgttggtc

SEQ ID NO: 4454 - DNA, 20 bp, Artificial Sequence
  chemically synthesized
tttcaccatgttggtcaggc

SEQ ID NO: 4455 - DNA, 20 bp, Artificial Sequence
  chemically synthesized
ccatgttggtcaggctggtc

SEQ ID NO: 4456 - DNA, 20 bp, Artificial Sequence
  chemically synthesized
tgcttgggaggctgaggcag

SEQ ID NO: 4457 - DNA, 20 bp, Artificial Sequence
  chemically synthesized
tgggaggaggagccagtggc

SEQ ID NO: 4458 - DNA, 20 bp, Artificial Sequence
  chemically synthesized
ctgcactccaacctgggcaa

SEQ ID NO: 4459 - DNA, 20 bp, Artificial Sequence
  chemically synthesized
ctgtcaaaaaaaaaaaaaga

SEQ ID NO: 4460 - DNA, 20 bp, Artificial Sequence
  chemically synthesized
gattatagattatagcataa

SEQ ID NO: 4461 - DNA, 20 bp, Artificial Sequence
  chemically synthesized
atggtagattgatttttgat

SEQ ID NO: 4462 - DNA, 20 bp, Artificial Sequence
  chemically synthesized
ccaaaacacttcaatgaaaa

SEQ ID NO: 4463 - DNA, 20 bp, Artificial Sequence
  chemically synthesized
aacaagtgatggtggaacaa

SEQ ID NO: 4464 - DNA, 20 bp, Artificial Sequence
  chemically synthesized
ctctcatacactgctgatag

SEQ ID NO: 4465 - DNA, 20 bp, Artificial Sequence
  chemically synthesized
ataaaatgcttactttggaa

SEQ ID NO: 4466 - DNA, 20 bp, Artificial Sequence
  chemically synthesized
aaaccaatgtccatcggctg

SEQ ID NO: 4467 - DNA, 20 bp, Artificial Sequence
  chemically synthesized
caatgtccatcggctgatga

SEQ ID NO: 4468 - DNA, 20 bp, Artificial Sequence
  chemically synthesized
ggctgggaggggaggaggag

SEQ ID NO: 4469 - DNA, 20 bp, Artificial Sequence
  chemically synthesized
ggggaggaggaggagaatgg

SEQ ID NO: 4470 - DNA, 20 bp, Artificial Sequence
  chemically synthesized
atggaggaatctgggaggcg

SEQ ID NO: 4471 - DNA, 20 bp, Artificial Sequence
  chemically synthesized
aatctgggaggcgatgaatt

SEQ ID NO: 4472 - DNA, 20 bp, Artificial Sequence
  chemically synthesized
gaggcgatgaattaagggta

SEQ ID NO: 4473 - DNA, 20 bp, Artificial Sequence
  chemically synthesized
tatttattttatttttgaga

SEQ ID NO: 4474 - DNA, 20 bp, Artificial Sequence
  chemically synthesized
ttcgctcttgttgcccaggc

SEQ ID NO: 4475 - DNA, 20 bp, Artificial Sequence
  chemically synthesized
gattctcctgtctcagcttc

SEQ ID NO: 4476 - DNA, 20 bp, Artificial Sequence
  chemically synthesized
gtctcagcttcccgagtagc

SEQ ID NO: 4477 - DNA, 20 bp, Artificial Sequence
  chemically synthesized
cttgctcttgtctcccatgc

SEQ ID NO: 4478 - DNA, 20 bp, Artificial Sequence
  chemically synthesized
ctcactgcaacctacgcctc

SEQ ID NO: 4479 - DNA, 20 bp, Artificial Sequence
  chemically synthesized
gcctcagcctctaatgtagc

SEQ ID NO: 4480 - DNA, 20 bp, Artificial Sequence
  chemically synthesized
ttttgtatttttagtaaaga

SEQ ID NO: 4481 - DNA, 20 bp, Artificial Sequence
  chemically synthesized
tcctcggccgcccaaagtgc

SEQ ID NO: 4482 - DNA, 20 bp, Artificial Sequence
  chemically synthesized
aatttttgcattttacatag

SEQ ID NO: 4483 - DNA, 20 bp, Artificial Sequence
  chemically synthesized
cttaccaaaaattgaaaaaa

SEQ ID NO: 4484 - DNA, 20 bp, Artificial Sequence
  chemically synthesized
tgatatcctgtttgattttc

SEQ ID NO: 4485 - DNA, 20 bp, Artificial Sequence
  chemically synthesized
gcttacaaaaataatgcctg

SEQ ID NO: 4486 - DNA, 20 bp, Artificial Sequence
  chemically synthesized
tggcatcccatactgttact

SEQ ID NO: 4487 - DNA, 20 bp, Artificial Sequence
  chemically synthesized
tgttactgggaattatgcat

SEQ ID NO: 4488 - DNA, 20 bp, Artificial Sequence
  chemically synthesized
actgggaattatgcattggg

SEQ ID NO: 4489 - DNA, 20 bp, Artificial Sequence
  chemically synthesized
cagagctcaaggtgctttta

SEQ ID NO: 4490 - DNA, 20 bp, Artificial Sequence
  chemically synthesized
cttttatggggtttgtgggg

SEQ ID NO: 4491 - DNA, 20 bp, Artificial Sequence
  chemically synthesized
agttgaggtttgggctgtat

SEQ ID NO: 4492 - DNA, 20 bp, Artificial Sequence
  chemically synthesized
tttgggctgtatctgagtga

SEQ ID NO: 4493 - DNA, 20 bp, Artificial Sequence
  chemically synthesized
tttgttaagaaaagcctccc

SEQ ID NO: 4494 - DNA, 20 bp, Artificial Sequence
  chemically synthesized
taatgatggcatgatgaact

SEQ ID NO: 4495 - DNA, 20 bp, Artificial Sequence
  chemically synthesized
gttgggcatgtgccacctta

SEQ ID NO: 4496 - DNA, 20 bp, Artificial Sequence
  chemically synthesized
taccctcctttctctttctc

SEQ ID NO: 4497 - DNA, 20 bp, Artificial Sequence
  chemically synthesized
ttatcataaactccatccct

SEQ ID NO: 4498 - DNA, 20 bp, Artificial Sequence
  chemically synthesized
tccatcccttagggtggcat

SEQ ID NO: 4499 - DNA, 20 bp, Artificial Sequence
  chemically synthesized
gcattagggtagtcttgggc

SEQ ID NO: 4500 - DNA, 20 bp, Artificial Sequence
  chemically synthesized
acccattaaatcagtgtgtc

SEQ ID NO: 4501 - DNA, 20 bp, Artificial Sequence
  chemically synthesized
ggctgtggaaggtgtttcag

SEQ ID NO: 4502 - DNA, 20 bp, Artificial Sequence
  chemically synthesized
aatgttatgacttaattaat

SEQ ID NO: 4503 - DNA, 20 bp, Artificial Sequence
  chemically synthesized
taaaatttttaaatgtatga

SEQ ID NO: 4504 - DNA, 20 bp, Artificial Sequence
  chemically synthesized
cccaatcaacaacacccctt

SEQ ID NO: 4505 - DNA, 20 bp, Artificial Sequence
  chemically synthesized
tttaaaaaccaagggggaca

SEQ ID NO: 4506 - DNA, 20 bp, Artificial Sequence
  chemically synthesized
ctgagcctaggcaatagctg

SEQ ID NO: 4507 - DNA, 20 bp, Artificial Sequence
  chemically synthesized
cctgcaggggcgcttgctgc

SEQ ID NO: 4508 - DNA, 20 bp, Artificial Sequence
  chemically synthesized
gggcgaactaggggcgcggc

SEQ ID NO: 4509 - DNA, 20 bp, Artificial Sequence
  chemically synthesized
ctagctttttctttgcgctt

SEQ ID NO: 4510 - DNA, 20 bp, Artificial Sequence
  chemically synthesized
tctgcgtccagaccccgtga

SEQ ID NO: 4511 - DNA, 20 bp, Artificial Sequence
  chemically synthesized
cctaccactgaactgcagat

SEQ ID NO: 4512 - DNA, 20 bp, Artificial Sequence
  chemically synthesized
ccccggctgtcccggctctg

SEQ ID NO: 4513 - DNA, 20 bp, Artificial Sequence
  chemically synthesized
gcccactcccttcccccaac

SEQ ID NO: 4514 - DNA, 20 bp, Artificial Sequence
  chemically synthesized
gggctccttgaacctggaac

SEQ ID NO: 4515 - DNA, 20 bp, Artificial Sequence
  chemically synthesized
tccaaacaggaagttcttcc

SEQ ID NO: 4516 - DNA, 20 bp, Artificial Sequence
  chemically synthesized
aaggctgagcaaacccacag

SEQ ID NO: 4517 - DNA, 20 bp, Artificial Sequence
  chemically synthesized
aacccacagcaggatccgca

SEQ ID NO: 4518 - DNA, 20 bp, Artificial Sequence
  chemically synthesized
cacggggtttccacctcaga

SEQ ID NO: 4519 - DNA, 20 bp, Artificial Sequence
  chemically synthesized
gttgggcggtgggggcgcga

SEQ ID NO: 4520 - DNA, 20 bp, Artificial Sequence
  chemically synthesized
gggcgcgaaagagtggcgtt

SEQ ID NO: 4521 - DNA, 20 bp, Artificial Sequence
  chemically synthesized
gaaagagtggcgttggggat

SEQ ID NO: 4522 - DNA, 20 bp, Artificial Sequence
  chemically synthesized
cacccacttttggtgagacc

SEQ ID NO: 4523 - DNA, 20 bp, Artificial Sequence
  chemically synthesized
agacctggggtggaggtctc

SEQ ID NO: 4524 - DNA, 20 bp, Artificial Sequence
  chemically synthesized
ttattttactagaagttaac

SEQ ID NO: 4525 - DNA, 20 bp, Artificial Sequence
  chemically synthesized
gtagtgtagcacagtgttct

SEQ ID NO: 4526 - DNA, 20 bp, Artificial Sequence
  chemically synthesized
gccggcctcagcacagcact

SEQ ID NO: 4527 - DNA, 20 bp, Artificial Sequence
  chemically synthesized
atccacattttacacatgac

SEQ ID NO: 4528 - DNA, 20 bp, Artificial Sequence
  chemically synthesized
acatcacactgcattagagg

SEQ ID NO: 4529 - DNA, 20 bp, Artificial Sequence
  chemically synthesized
ttcattgtttacaagtgtaa

SEQ ID NO: 4530 - DNA, 20 bp, Artificial Sequence
  chemically synthesized
atatacaacatcaggaaatc

SEQ ID NO: 4531 - DNA, 20 bp, Artificial Sequence
  chemically synthesized
agcagagacatgaaggaaat

SEQ ID NO: 4532 - DNA, 20 bp, Artificial Sequence
  chemically synthesized
agcagtatttcccaggcaaa

SEQ ID NO: 4533 - DNA, 20 bp, Artificial Sequence
  chemically synthesized
aactgagtgggcctggcaag

SEQ ID NO: 4534 - DNA, 20 bp, Artificial Sequence
  chemically synthesized
ctggcaagttggattaaaaa

SEQ ID NO: 4535 - DNA, 20 bp, Artificial Sequence
  chemically synthesized
gtggggggggggggcggcgt

SEQ ID NO: 4536 - DNA, 20 bp, Artificial Sequence
  chemically synthesized
gggggactaccatctgcatg

SEQ ID NO: 4537 - DNA, 20 bp, Artificial Sequence
  chemically synthesized
caaactcctggttaagaagc

SEQ ID NO: 4538 - DNA, 20 bp, Artificial Sequence
  chemically synthesized
aaaataaacaagtagtgctg

SEQ ID NO: 4539 - DNA, 20 bp, Artificial Sequence
  chemically synthesized
aggcgcctgtaggctgtggt

SEQ ID NO: 4540 - DNA, 20 bp, Artificial Sequence
  chemically synthesized
tgtggtgtgaattctagcca

SEQ ID NO: 4541 - DNA, 20 bp, Artificial Sequence
  chemically synthesized
tctggctgctatgtggaaag

SEQ ID NO: 4542 - DNA, 20 bp, Artificial Sequence
  chemically synthesized
acagtccaggcaagaggtag

SEQ ID NO: 4543 - DNA, 20 bp, Artificial Sequence
  chemically synthesized
gcaagaggtagtggagtggg

SEQ ID NO: 4544 - DNA, 20 bp, Artificial Sequence
  chemically synthesized
ggctgggtgggaacagaaaa

SEQ ID NO: 4545 - DNA, 20 bp, Artificial Sequence
  chemically synthesized
gagtgacaaaccattgtctc

SEQ ID NO: 4546 - DNA, 20 bp, Artificial Sequence
  chemically synthesized
tattctgaaggaagttgctg

SEQ ID NO: 4547 - DNA, 20 bp, Artificial Sequence
  chemically synthesized
atgttgtgtgagagaaagag

SEQ ID NO: 4548 - DNA, 20 bp, Artificial Sequence
  chemically synthesized
gagagaaagagaagaattgg

SEQ ID NO: 4549 - DNA, 20 bp, Artificial Sequence
  chemically synthesized
gagagcagattcctgagctc

SEQ ID NO: 4550 - DNA, 20 bp, Artificial Sequence
  chemically synthesized
acaaaaaatacaaaaattag

SEQ ID NO: 4551 - DNA, 20 bp, Artificial Sequence
  chemically synthesized
ctactcgggaggctgaggtg

SEQ ID NO: 4552 - DNA, 20 bp, Artificial Sequence
  chemically synthesized
cctgaccccctgaaaaagag

SEQ ID NO: 4553 - DNA, 20 bp, Artificial Sequence
  chemically synthesized
aattttattggcctgagcag

SEQ ID NO: 4554 - DNA, 20 bp, Artificial Sequence
  chemically synthesized
aggcagaggaaagagcagtt

SEQ ID NO: 4555 - DNA, 20 bp, Artificial Sequence
  chemically synthesized
agagcagtttggggtaaatc

SEQ ID NO: 4556 - DNA, 20 bp, Artificial Sequence
  chemically synthesized
ccacataggcagttcagtgt

SEQ ID NO: 4557 - DNA, 20 bp, Artificial Sequence
  chemically synthesized
caggtagatcatttgaggtc

SEQ ID NO: 4558 - DNA, 20 bp, Artificial Sequence
  chemically synthesized
ttttcaggaggcttaggtag

SEQ ID NO: 4559 - DNA, 20 bp, Artificial Sequence
  chemically synthesized
ttgtgccactgcactccagc

SEQ ID NO: 4560 - DNA, 20 bp, Artificial Sequence
  chemically synthesized
ctgcactccagcctgggtga

SEQ ID NO: 4561 - DNA, 20 bp, Artificial Sequence
  chemically synthesized
aaaaaaaaaaaaaaaactga

SEQ ID NO: 4562 - DNA, 20 bp, Artificial Sequence
  chemically synthesized
aaactgaaggaattattcct

SEQ ID NO: 4563 - DNA, 20 bp, Artificial Sequence
  chemically synthesized
aaggaattattcctcaggat

SEQ ID NO: 4564 - DNA, 20 bp, Artificial Sequence
  chemically synthesized
tttgccctgagcaccaactc

SEQ ID NO: 4565 - DNA, 20 bp, Artificial Sequence
  chemically synthesized
agacacaccttaacattttc

SEQ ID NO: 4566 - DNA, 20 bp, Artificial Sequence
  chemically synthesized
ctagaatccaccagctttag

SEQ ID NO: 4567 - DNA, 20 bp, Artificial Sequence
  chemically synthesized
ttagtggagtctgtctaatc

SEQ ID NO: 4568 - DNA, 20 bp, Artificial Sequence
  chemically synthesized
gtctgtctaatcatgagtat

SEQ ID NO: 4569 - DNA, 20 bp, Artificial Sequence
  chemically synthesized
tctaatcatgagtattggaa

SEQ ID NO: 4570 - DNA, 20 bp, Artificial Sequence
  chemically synthesized
ataggatctgggggcagtga

SEQ ID NO: 4571 - DNA, 20 bp, Artificial Sequence
  chemically synthesized
gaccagacacagctgatggt

SEQ ID NO: 4572 - DNA, 20 bp, Artificial Sequence
  chemically synthesized
actctctgcactacctcttc

SEQ ID NO: 4573 - DNA, 20 bp, Artificial Sequence
  chemically synthesized
tgtttgaagctttgggctac

SEQ ID NO: 4574 - DNA, 20 bp, Artificial Sequence
  chemically synthesized
tgttcgtgttctatgatcat

SEQ ID NO: 4575 - DNA, 20 bp, Artificial Sequence
  chemically synthesized
cgtgtggagccccgaactcc

SEQ ID NO: 4576 - DNA, 20 bp, Artificial Sequence
  chemically synthesized
cgaactccatgggtttccag

SEQ ID NO: 4577 - DNA, 20 bp, Artificial Sequence
  chemically synthesized
caagccagatgtggctgcag

SEQ ID NO: 4578 - DNA, 20 bp, Artificial Sequence
  chemically synthesized
agatgtggctgcagctgagt

SEQ ID NO: 4579 - DNA, 20 bp, Artificial Sequence
  chemically synthesized
gcagctgagtcagagtctga

SEQ ID NO: 4580 - DNA, 20 bp, Artificial Sequence
  chemically synthesized
tgagtcagagtctgaaaggg

SEQ ID NO: 4581 - DNA, 20 bp, Artificial Sequence
  chemically synthesized
tggaaaatcacaaccacagc

SEQ ID NO: 4582 - DNA, 20 bp, Artificial Sequence
  chemically synthesized
gtgggagcagggaagaggga

SEQ ID NO: 4583 - DNA, 20 bp, Artificial Sequence
  chemically synthesized
cctgagatcatttggtcctt

SEQ ID NO: 4584 - DNA, 20 bp, Artificial Sequence
  chemically synthesized
tggttgcagttaacaaggct

SEQ ID NO: 4585 - DNA, 20 bp, Artificial Sequence
  chemically synthesized
aacaaggctggggatttttc

SEQ ID NO: 4586 - DNA, 20 bp, Artificial Sequence
  chemically synthesized
taccgagggctactggaagt

SEQ ID NO: 4587 - DNA, 20 bp, Artificial Sequence
  chemically synthesized
gtatgatgggcaggaccacc

SEQ ID NO: 4588 - DNA, 20 bp, Artificial Sequence
  chemically synthesized
ttgaattctgccctgacaca

SEQ ID NO: 4589 - DNA, 20 bp, Artificial Sequence
  chemically synthesized
cagggcctggcccaccaagc

SEQ ID NO: 4590 - DNA, 20 bp, Artificial Sequence
  chemically synthesized
ctgcccctatactctagtgg

SEQ ID NO: 4591 - DNA, 20 bp, Artificial Sequence
  chemically synthesized
gtggaggaggttgcagggca

SEQ ID NO: 4592 - DNA, 20 bp, Artificial Sequence
  chemically synthesized
cagggcacggaatccctggt

SEQ ID NO: 4593 - DNA, 20 bp, Artificial Sequence
  chemically synthesized
ggaagggactttctcaatcc

SEQ ID NO: 4594 - DNA, 20 bp, Artificial Sequence
  chemically synthesized
gtatgagacagccacaagtc

SEQ ID NO: 4595 - DNA, 20 bp, Artificial Sequence
  chemically synthesized
cagcactttgggaggccgag

SEQ ID NO: 4596 - DNA, 20 bp, Artificial Sequence
  chemically synthesized
aggcgggtggtcacaaggtc

SEQ ID NO: 4597 - DNA, 20 bp, Artificial Sequence
  chemically synthesized
ctgcactccagcctaggcag

SEQ ID NO: 4598 - DNA, 20 bp, Artificial Sequence
  chemically synthesized
aaaaaaaaaaaaaaaaaaaa

SEQ ID NO: 4599 - DNA, 20 bp, Artificial Sequence
  chemically synthesized
tcagagatctcagctatcat

SEQ ID NO: 4600 - DNA, 20 bp, Artificial Sequence
  chemically synthesized
tatcaagtgaggccacttat

SEQ ID NO: 4601 - DNA, 20 bp, Artificial Sequence
  chemically synthesized
gaggccacttatcagagtag

SEQ ID NO: 4602 - DNA, 20 bp, Artificial Sequence
  chemically synthesized
tatctatcagaacaaagaac

SEQ ID NO: 4603 - DNA, 20 bp, Artificial Sequence
  chemically synthesized
ctctccaagtgacactgtgt

SEQ ID NO: 4604 - DNA, 20 bp, Artificial Sequence
  chemically synthesized
gtagcttgtttttttctgaa

SEQ ID NO: 4605 - DNA, 20 bp, Artificial Sequence
  chemically synthesized
aaagttccagtcttcctggc

SEQ ID NO: 4606 - DNA, 20 bp, Artificial Sequence
  chemically synthesized
acatcaccatgaagtggctg

SEQ ID NO: 4607 - DNA, 20 bp, Artificial Sequence
  chemically synthesized
ggctgaaggataagcagcca

SEQ ID NO: 4608 - DNA, 20 bp, Artificial Sequence
  chemically synthesized
taagcagccaatggatgcca

SEQ ID NO: 4609 - DNA, 20 bp, Artificial Sequence
  chemically synthesized
ctaaagacgtattgcccaat

SEQ ID NO: 4610 - DNA, 20 bp, Artificial Sequence
  chemically synthesized
ggggatgggacctaccaggg

SEQ ID NO: 4611 - DNA, 20 bp, Artificial Sequence
  chemically synthesized
gccaggtggagcacccaggc

SEQ ID NO: 4612 - DNA, 20 bp, Artificial Sequence
  chemically synthesized
atcagcccctcattgtgatc

SEQ ID NO: 4613 - DNA, 20 bp, Artificial Sequence
  chemically synthesized
aggagctgagaaaatctatt

SEQ ID NO: 4614 - DNA, 20 bp, Artificial Sequence
  chemically synthesized
aaaatctattgggggttgag

SEQ ID NO: 4615 - DNA, 20 bp, Artificial Sequence
  chemically synthesized
ggtaattatggcagtgagat

SEQ ID NO: 4616 - DNA, 20 bp, Artificial Sequence
  chemically synthesized
tgaggatctgctctttgtta

SEQ ID NO: 4617 - DNA, 20 bp, Artificial Sequence
  chemically synthesized
tctttgttagggggtgggct

SEQ ID NO: 4618 - DNA, 20 bp, Artificial Sequence
  chemically synthesized
ccgtctggcaccctagtcat

SEQ ID NO: 4619 - DNA, 20 bp, Artificial Sequence
  chemically synthesized
ctagtcattggagtcatcag

SEQ ID NO: 4620 - DNA, 20 bp, Artificial Sequence
  chemically synthesized
tttgtcgtcatcttgttcat

SEQ ID NO: 4621 - DNA, 20 bp, Artificial Sequence
  chemically synthesized
tcataatattaaggaagagg

SEQ ID NO: 4622 - DNA, 20 bp, Artificial Sequence
  chemically synthesized
aaggaagaggcagggttcaa

SEQ ID NO: 4623 - DNA, 20 bp, Artificial Sequence
  chemically synthesized
acagtgggaagaggggcaga

SEQ ID NO: 4624 - DNA, 20 bp, Artificial Sequence
  chemically synthesized
cagaaaataatggttctccc

SEQ ID NO: 4625 - DNA, 20 bp, Artificial Sequence
  chemically synthesized
ctcagaacccaaatctggta

SEQ ID NO: 4626 - DNA, 20 bp, Artificial Sequence
  chemically synthesized
gcaggcaggaagcaaatgct

SEQ ID NO: 4627 - DNA, 20 bp, Artificial Sequence
  chemically synthesized
atgcttagggtgtcaaagga

SEQ ID NO: 4628 - DNA, 20 bp, Artificial Sequence
  chemically synthesized
aagaatgatcacattcagct

SEQ ID NO: 4629 - DNA, 20 bp, Artificial Sequence
  chemically synthesized
ctggggatcaagatagcctt

SEQ ID NO: 4630 - DNA, 20 bp, Artificial Sequence
  chemically synthesized
tctggatcttgaaggagaag

SEQ ID NO: 4631 - DNA, 20 bp, Artificial Sequence
  chemically synthesized
ggagcaaccatgccaagtag

SEQ ID NO: 4632 - DNA, 20 bp, Artificial Sequence
  chemically synthesized
ataattactgtaccttaacc

SEQ ID NO: 4633 - DNA, 20 bp, Artificial Sequence
  chemically synthesized
catctgtggtgtagggaaaa

SEQ ID NO: 4634 - DNA, 20 bp, Artificial Sequence
  chemically synthesized
cagaaagaagccagctcata

SEQ ID NO: 4635 - DNA, 20 bp, Artificial Sequence
  chemically synthesized
agccagctcatacagagtcc

SEQ ID NO: 4636 - DNA, 20 bp, Artificial Sequence
  chemically synthesized
tacagagtccaagggtcttt

SEQ ID NO: 4637 - DNA, 20 bp, Artificial Sequence
  chemically synthesized
tccaagggtcttttgggata

SEQ ID NO: 4638 - DNA, 20 bp, Artificial Sequence
  chemically synthesized
ggatattgggttatgatcac

SEQ ID NO: 4639 - DNA, 20 bp, Artificial Sequence
  chemically synthesized
tgatcactggggtgtcattg

SEQ ID NO: 4640 - DNA, 20 bp, Artificial Sequence
  chemically synthesized
accacgatctcccttatatg

SEQ ID NO: 4641 - DNA, 20 bp, Artificial Sequence
  chemically synthesized
gtgcccaggtctaaattgag

SEQ ID NO: 4642 - DNA, 20 bp, Artificial Sequence
  chemically synthesized
ccaggtctaaattgagatgg

SEQ ID NO: 4643 - DNA, 20 bp, Artificial Sequence
  chemically synthesized
aggtttgtgatgcctctttc

SEQ ID NO: 4644 - DNA, 20 bp, Artificial Sequence
  chemically synthesized
gcactacgtcttagctgaac

SEQ ID NO: 4645 - DNA, 20 bp, Artificial Sequence
  chemically synthesized
caaaactagagactcaaaga

SEQ ID NO: 4646 - DNA, 20 bp, Artificial Sequence
  chemically synthesized
gagctcttcatgtttcagga

SEQ ID NO: 4647 - DNA, 20 bp, Artificial Sequence
  chemically synthesized
agatttccccatttaggttt

SEQ ID NO: 4648 - DNA, 20 bp, Artificial Sequence
  chemically synthesized
ggacccgttcaacttttcct

SEQ ID NO: 4649 - DNA, 20 bp, Artificial Sequence
  chemically synthesized
ctcatctgtcaccaagcctt

SEQ ID NO: 4650 - DNA, 20 bp, Artificial Sequence
  chemically synthesized
ttcttccatctgattgtgat

SEQ ID NO: 4651 - DNA, 20 bp, Artificial Sequence
  chemically synthesized
ctatgaaggctgtacactgc

SEQ ID NO: 4652 - DNA, 20 bp, Artificial Sequence
  chemically synthesized
aaaaagcatcatggctatct

SEQ ID NO: 4653 - DNA, 20 bp, Artificial Sequence
  chemically synthesized
ggctatctgtgggtagtatg

SEQ ID NO: 4654 - DNA, 20 bp, Artificial Sequence
  chemically synthesized
taggaggcaaatatcttgaa

SEQ ID NO: 4655 - DNA, 20 bp, Artificial Sequence
  chemically synthesized
agtttaatggtgccttcatt

SEQ ID NO: 4656 - DNA, 20 bp, Artificial Sequence
  chemically synthesized
actctagtattccagacctg

SEQ ID NO: 4657 - DNA, 20 bp, Artificial Sequence
  chemically synthesized
ctgataatgaaaattatgat

SEQ ID NO: 4658 - DNA, 20 bp, Artificial Sequence
  chemically synthesized
cagcactttgggaggccaaa

SEQ ID NO: 4659 - DNA, 20 bp, Artificial Sequence
  chemically synthesized
actttgggaggccaaagcgg

SEQ ID NO: 4660 - DNA, 20 bp, Artificial Sequence
  chemically synthesized
tactcggaaggctgaggcag

SEQ ID NO: 4661 - DNA, 20 bp, Artificial Sequence
  chemically synthesized
gaggcagagcttgcagtgag

SEQ ID NO: 4662 - DNA, 20 bp, Artificial Sequence
  chemically synthesized
ctgcactccagcctaggtga

SEQ ID NO: 4663 - DNA, 20 bp, Artificial Sequence
  chemically synthesized
aaaaaaaagaaagtgaagta

SEQ ID NO: 4664 - DNA, 20 bp, Artificial Sequence
  chemically synthesized
cattcagtagtttagatgcc

SEQ ID NO: 4665 - DNA, 20 bp, Artificial Sequence
  chemically synthesized
cttgtctcattgtgtttctt

SEQ ID NO: 4666 - DNA, 20 bp, Artificial Sequence
  chemically synthesized
tgtgtttcttctgagtgagc

SEQ ID NO: 4667 - DNA, 20 bp, Artificial Sequence
  chemically synthesized
aagtccctgaaggaaggtcc

SEQ ID NO: 4668 - DNA, 20 bp, Artificial Sequence
  chemically synthesized
cctccctaggccagtgcctc

SEQ ID NO: 4669 - DNA, 20 bp, Artificial Sequence
  chemically synthesized
tggtatttccctcaatgaag

SEQ ID NO: 4670 - DNA, 20 bp, Artificial Sequence
  chemically synthesized
ggaagccaccaagtggctta

SEQ ID NO: 4671 - DNA, 20 bp, Artificial Sequence
  chemically synthesized
aggtccttccatggagccac

SEQ ID NO: 4672 - DNA, 20 bp, Artificial Sequence
  chemically synthesized
aaaatctaaccaggacattc

SEQ ID NO: 4673 - DNA, 20 bp, Artificial Sequence
  chemically synthesized
aatcagttcaccatgttcaa

SEQ ID NO: 4674 - DNA, 20 bp, Artificial Sequence
  chemically synthesized
tgagactctattgcccaggc

SEQ ID NO: 4675 - DNA, 20 bp, Artificial Sequence
  chemically synthesized
gtctcagcctcccaagtagc

SEQ ID NO: 4676 - DNA, 20 bp, Artificial Sequence
  chemically synthesized
ttttgtatttttagtagaga

SEQ ID NO: 4677 - DNA, 20 bp, Artificial Sequence
  chemically synthesized
ccaccctgcccagccgtcaa

SEQ ID NO: 4678 - DNA, 20 bp, Artificial Sequence
  chemically synthesized
gtcttgaagggcaggtgctt

SEQ ID NO: 4679 - DNA, 20 bp, Artificial Sequence
  chemically synthesized
cattgtagaaaagctataaa

SEQ ID NO: 4680 - DNA, 20 bp, Artificial Sequence
  chemically synthesized
tttctttacattttgtctta

SEQ ID NO: 4681 - DNA, 20 bp, Artificial Sequence
  chemically synthesized
ttttcattcaactgtggtag

SEQ ID NO: 4682 - DNA, 20 bp, Artificial Sequence
  chemically synthesized
acttactcttctacctcata

SEQ ID NO: 4683 - DNA, 20 bp, Artificial Sequence
  chemically synthesized
caaaccatggtagtaaagag

SEQ ID NO: 4684 - DNA, 20 bp, Artificial Sequence
  chemically synthesized
gtgaccagagatgcagcgct

SEQ ID NO: 4685 - DNA, 20 bp, Artificial Sequence
  chemically synthesized
gagggttttcctgaaggtaa

SEQ ID NO: 4686 - DNA, 20 bp, Artificial Sequence
  chemically synthesized
ttcctgaaggtaaaggaata

SEQ ID NO: 4687 - DNA, 20 bp, Artificial Sequence
  chemically synthesized
tgaaggtaaaggaataaaga

SEQ ID NO: 4688 - DNA, 20 bp, Artificial Sequence
  chemically synthesized
agaaactacttaccagctat

SEQ ID NO: 4689 - DNA, 20 bp, Artificial Sequence
  chemically synthesized
ttaccagctatttgaattgc

SEQ ID NO: 4690 - DNA, 20 bp, Artificial Sequence
  chemically synthesized
acaaaccactctgataatca

SEQ ID NO: 4691 - DNA, 20 bp, Artificial Sequence
  chemically synthesized
tgtgattctctctgtaggct

SEQ ID NO: 4692 - DNA, 20 bp, Artificial Sequence
  chemically synthesized
aacttctacactctaacatg

SEQ ID NO: 4693 - DNA, 20 bp, Artificial Sequence
  chemically synthesized
gacaattttatttgaaagcc

SEQ ID NO: 4694 - DNA, 20 bp, Artificial Sequence
  chemically synthesized
gtatctcaagcattctattt

SEQ ID NO: 4695 - DNA, 20 bp, Artificial Sequence
  chemically synthesized
gtgtagaagagatagatatg

SEQ ID NO: 4696 - DNA, 20 bp, Artificial Sequence
  chemically synthesized
agagatagatatggtggatt

SEQ ID NO: 4697 - DNA, 20 bp, Artificial Sequence
  chemically synthesized
acttatatattttctatttc

SEQ ID NO: 4698 - DNA, 20 bp, Artificial Sequence
  chemically synthesized
atatattttctatttcttgg

SEQ ID NO: 4699 - DNA, 20 bp, Artificial Sequence
  chemically synthesized
attttctatttcttggatgg

SEQ ID NO: 4700 - DNA, 20 bp, Artificial Sequence
  chemically synthesized
tttcaaaaactttttttttc

SEQ ID NO: 4701 - DNA, 20 bp, Artificial Sequence
  chemically synthesized
aaaaactttttttttccggg

SEQ ID NO: 4702 - DNA, 20 bp, Artificial Sequence
  chemically synthesized
caaaattgtacttgtacccc

SEQ ID NO: 4703 - DNA, 20 bp, Artificial Sequence
  chemically synthesized
actagatattaggctgtgtt

SEQ ID NO: 4704 - DNA, 20 bp, Artificial Sequence
  chemically synthesized
atcttaatttaattcctcca

SEQ ID NO: 4705 - DNA, 20 bp, Artificial Sequence
  chemically synthesized
ttgctgaagaaaatgatgtg

SEQ ID NO: 4706 - DNA, 20 bp, Artificial Sequence
  chemically synthesized
gatttttattctagctattc

SEQ ID NO: 4707 - DNA, 20 bp, Artificial Sequence
  chemically synthesized
aatgtttgctgcagggaaaa

SEQ ID NO: 4708 - DNA, 20 bp, Artificial Sequence
  chemically synthesized
ctgcagggaaaaaggaatct

SEQ ID NO: 4709 - DNA, 20 bp, Artificial Sequence
  chemically synthesized
tcagatgtattttaaaattt

SEQ ID NO: 4710 - DNA, 20 bp, Artificial Sequence
  chemically synthesized
gatattttgttcagttcata

SEQ ID NO: 4711 - DNA, 20 bp, Artificial Sequence
  chemically synthesized
tttttttttttttctcgaga

SEQ ID NO: 4712 - DNA, 20 bp, Artificial Sequence
  chemically synthesized
tctcactctatcacccaggc

SEQ ID NO: 4713 - DNA, 20 bp, Artificial Sequence
  chemically synthesized
ctcactgcaacctctgcctc

SEQ ID NO: 4714 - DNA, 20 bp, Artificial Sequence
  chemically synthesized
ttttgtatttttagtagaga

SEQ ID NO: 4715 - DNA, 20 bp, Artificial Sequence
  chemically synthesized
tttttggcctcccaaagtgc

SEQ ID NO: 4716 - DNA, 20 bp, Artificial Sequence
  chemically synthesized
ttgttttgttgttgttgaga

SEQ ID NO: 4717 - DNA, 20 bp, Artificial Sequence
  chemically synthesized
gatcctcccacctcagccta

SEQ ID NO: 4718 - DNA, 20 bp, Artificial Sequence
  chemically synthesized
tttttctattatttattgaa

SEQ ID NO: 4719 - DNA, 20 bp, Artificial Sequence
  chemically synthesized
ccacccacctcagcgtccga

SEQ ID NO: 4720 - DNA, 20 bp, Artificial Sequence
  chemically synthesized
cagcgtccgaaaggattatc

SEQ ID NO: 4721 - DNA, 20 bp, Artificial Sequence
  chemically synthesized
cccggccaaatttctaactt

SEQ ID NO: 4722 - DNA, 20 bp, Artificial Sequence
  chemically synthesized
tatcattcagggagaaattt

SEQ ID NO: 4723 - DNA, 20 bp, Artificial Sequence
  chemically synthesized
attcagggagaaatttgggg

SEQ ID NO: 4724 - DNA, 20 bp, Artificial Sequence
  chemically synthesized
tttactctgaagattctaaa

SEQ ID NO: 4725 - DNA, 20 bp, Artificial Sequence
  chemically synthesized
gaagattctaaaaagaattt

SEQ ID NO: 4726 - DNA, 20 bp, Artificial Sequence
  chemically synthesized
aattcatacttcaggggcag

SEQ ID NO: 4727 - DNA, 20 bp, Artificial Sequence
  chemically synthesized
cgttagctaactgtagtcta

SEQ ID NO: 4728 - DNA, 20 bp, Artificial Sequence
  chemically synthesized
ccttgatttattccttaaaa

SEQ ID NO: 4729 - DNA, 20 bp, Artificial Sequence
  chemically synthesized
gctcgccctgtctcccaggc

SEQ ID NO: 4730 - DNA, 20 bp, Artificial Sequence
  chemically synthesized
gattctcctgccccagcctc

SEQ ID NO: 4731 - DNA, 20 bp, Artificial Sequence
  chemically synthesized
gtttgtatttttagtagaga

SEQ ID NO: 4732 - DNA, 20 bp, Artificial Sequence
  chemically synthesized
gcctcgacctcccaaagtgc

SEQ ID NO: 4733 - DNA, 20 bp, Artificial Sequence
  chemically synthesized
tcatgagccactgcacccgg

SEQ ID NO: 4734 - DNA, 20 bp, Artificial Sequence
  chemically synthesized
ccaacttcactactgccccc

SEQ ID NO: 4735 - DNA, 20 bp, Artificial Sequence
  chemically synthesized
tgagggcatctgttttaagt

SEQ ID NO: 4736 - DNA, 20 bp, Artificial Sequence
  chemically synthesized
ttaagtatgggtataatgtt

SEQ ID NO: 4737 - DNA, 20 bp, Artificial Sequence
  chemically synthesized
gggtttttctttgtgtaagt

SEQ ID NO: 4738 - DNA, 20 bp, Artificial Sequence
  chemically synthesized
gctattaagaaagtattcaa

SEQ ID NO: 4739 - DNA, 20 bp, Artificial Sequence
  chemically synthesized
tttgaaacaaatgtttaaga

SEQ ID NO: 4740 - DNA, 20 bp, Artificial Sequence
  chemically synthesized
tgggcagatcacttaagccc

SEQ ID NO: 4741 - DNA, 20 bp, Artificial Sequence
  chemically synthesized
cgggcagatcacctgaggtc

SEQ ID NO: 4742 - DNA, 20 bp, Artificial Sequence
  chemically synthesized
tactcgggaggctgaggcag

SEQ ID NO: 4743 - DNA, 20 bp, Artificial Sequence
  chemically synthesized
tacttgggaggctgaggtgg

SEQ ID NO: 4744 - DNA, 20 bp, Artificial Sequence
  chemically synthesized
gatttttttctagaaaagta

SEQ ID NO: 4745 - DNA, 20 bp, Artificial Sequence
  chemically synthesized
acagtttaattcagaaaaaa

SEQ ID NO: 4746 - DNA, 20 bp, Artificial Sequence
  chemically synthesized
agaaaaaaatgaatcagaaa

SEQ ID NO: 4747 - DNA, 20 bp, Artificial Sequence
  chemically synthesized
attttctgattcattttttt

SEQ ID NO: 4748 - DNA, 20 bp, Artificial Sequence
  chemically synthesized
tgtttatttttttcctagac

SEQ ID NO: 4749 - DNA, 20 bp, Artificial Sequence
  chemically synthesized
gtttgttttgttttttgaga

SEQ ID NO: 4750 - DNA, 20 bp, Artificial Sequence
  chemically synthesized
ttcgctcttgttgcccaggc

SEQ ID NO: 4751 - DNA, 20 bp, Artificial Sequence
  chemically synthesized
cccaggctggagtgcaatgg

SEQ ID NO: 4752 - DNA, 20 bp, Artificial Sequence
  chemically synthesized
aattctcctgcctcagcctc

SEQ ID NO: 4753 - DNA, 20 bp, Artificial Sequence
  chemically synthesized
gcctcagcctcccgagtagc

SEQ ID NO: 4754 - DNA, 20 bp, Artificial Sequence
  chemically synthesized
ttttgtatttttagtagaga

SEQ ID NO: 4755 - DNA, 20 bp, Artificial Sequence
  chemically synthesized
gcctcggcctcccaaagtgc

SEQ ID NO: 4756 - DNA, 20 bp, Artificial Sequence
  chemically synthesized
ctgtgttgtccaggctggtc

SEQ ID NO: 4757 - DNA, 20 bp, Artificial Sequence
  chemically synthesized
accttgtcctcccaaaatgc

SEQ ID NO: 4758 - DNA, 20 bp, Artificial Sequence
  chemically synthesized
ttcaaaaattttacaaacat

SEQ ID NO: 4759 - DNA, 20 bp, Artificial Sequence
  chemically synthesized
atttgattttcaaaattccc

SEQ ID NO: 4760 - DNA, 20 bp, Artificial Sequence
  chemically synthesized
tttatgaaagtgccattcag

SEQ ID NO: 4761 - DNA, 20 bp, Artificial Sequence
  chemically synthesized
ggcaggctgatcacgaggtc

SEQ ID NO: 4762 - DNA, 20 bp, Artificial Sequence
  chemically synthesized
tactcaggaggctggggcag

SEQ ID NO: 4763 - DNA, 20 bp, Artificial Sequence
  chemically synthesized
gtcatagtgactcagtttta

SEQ ID NO: 4764 - DNA, 20 bp, Artificial Sequence
  chemically synthesized
tcagttttaaggaataaatc

SEQ ID NO: 4765 - DNA, 20 bp, Artificial Sequence
  chemically synthesized
tgacttgcactgaaagttat

SEQ ID NO: 4766 - DNA, 20 bp, Artificial Sequence
  chemically synthesized
tattcccctgcccctgaagt

SEQ ID NO: 4767 - DNA, 20 bp, Artificial Sequence
  chemically synthesized
aaagactccaaaattctttt

SEQ ID NO: 4768 - DNA, 20 bp, Artificial Sequence
  chemically synthesized
aaaattctttttagaatctt

SEQ ID NO: 4769 - DNA, 20 bp, Artificial Sequence
  chemically synthesized
agaatcttcagagtaaaagc

SEQ ID NO: 4770 - DNA, 20 bp, Artificial Sequence
  chemically synthesized
ctggtgtataaaataacttg

SEQ ID NO: 4771 - DNA, 20 bp, Artificial Sequence
  chemically synthesized
atccatccccaaatttctcc

SEQ ID NO: 4772 - DNA, 20 bp, Artificial Sequence
  chemically synthesized
atttctccctgaatgataaa

SEQ ID NO: 4773 - DNA, 20 bp, Artificial Sequence
  chemically synthesized
ctgaatgataaagagaataa

SEQ ID NO: 4774 - DNA, 20 bp, Artificial Sequence
  chemically synthesized
taatcctttcggacgctgag

SEQ ID NO: 4775 - DNA, 20 bp, Artificial Sequence
  chemically synthesized
cctttcggacgctgaggtgg

SEQ ID NO: 4776 - DNA, 20 bp, Artificial Sequence
  chemically synthesized
tgggtggatcgcatgagctc

SEQ ID NO: 4777 - DNA, 20 bp, Artificial Sequence
  chemically synthesized
tactcagtaggctgaggtgg

SEQ ID NO: 4778 - DNA, 20 bp, Artificial Sequence
  chemically synthesized
actttgggaggccaaaaagg

SEQ ID NO: 4779 - DNA, 20 bp, Artificial Sequence
  chemically synthesized
agggcggatcatttgaggtc

SEQ ID NO: 4780 - DNA, 20 bp, Artificial Sequence
  chemically synthesized
tcatgccactgcattccagc

SEQ ID NO: 4781 - DNA, 20 bp, Artificial Sequence
  chemically synthesized
ctgcattccagcctgggtga

SEQ ID NO: 4782 - DNA, 20 bp, Artificial Sequence
  chemically synthesized
atatttaggaaaaaaattat

SEQ ID NO: 4783 - DNA, 20 bp, Artificial Sequence
  chemically synthesized
ttttccctgcagcaaacatt

SEQ ID NO: 4784 - DNA, 20 bp, Artificial Sequence
  chemically synthesized
aggttgtgtagttgttattc

SEQ ID NO: 4785 - DNA, 20 bp, Artificial Sequence
  chemically synthesized
agttgttattccagaatagc

SEQ ID NO: 4786 - DNA, 20 bp, Artificial Sequence
  chemically synthesized
taacagcaacataagcataa

SEQ ID NO: 4787 - DNA, 20 bp, Artificial Sequence
  chemically synthesized
tacctcataagattctttgg

SEQ ID NO: 4788 - DNA, 20 bp, Artificial Sequence
  chemically synthesized
cttaagattatatatattca

SEQ ID NO: 4789 - DNA, 20 bp, Artificial Sequence
  chemically synthesized
cttaaacaattactcagaaa

SEQ ID NO: 4790 - DNA, 20 bp, Artificial Sequence
  chemically synthesized
aaatagaatgcttgagatac

SEQ ID NO: 4791 - DNA, 20 bp, Artificial Sequence
  chemically synthesized
tatcaagtaataaatgcatg

SEQ ID NO: 4792 - DNA, 20 bp, Artificial Sequence
  chemically synthesized
tgtagtaacattctacatgt

SEQ ID NO: 4793 - DNA, 20 bp, Artificial Sequence
  chemically synthesized
ttatacccaaagcctacaga

SEQ ID NO: 4794 - DNA, 20 bp, Artificial Sequence
  chemically synthesized
gaaaaaaagttagtttaaaa

SEQ ID NO: 4795 - DNA, 20 bp, Artificial Sequence
  chemically synthesized
actgagtttatgaaaaattt

SEQ ID NO: 4796 - DNA, 20 bp, Artificial Sequence
  chemically synthesized
tgttttgtttttaaatgtgt

SEQ ID NO: 4797 - DNA, 20 bp, Artificial Sequence
  chemically synthesized
taaatgtgtgtgagtttgtg

SEQ ID NO: 4798 - DNA, 20 bp, Artificial Sequence
  chemically synthesized
acattattataatacaacat

SEQ ID NO: 4799 - DNA, 20 bp, Artificial Sequence
  chemically synthesized
gtacttgactcaatgattat

SEQ ID NO: 4800 - DNA, 20 bp, Artificial Sequence
  chemically synthesized
tctctttactaccatggttt

SEQ ID NO: 4801 - DNA, 20 bp, Artificial Sequence
  chemically synthesized
tgtgaatggttttgccagag

SEQ ID NO: 4802 - DNA, 20 bp, Artificial Sequence
  chemically synthesized
tggttttgccagaggtgaat

SEQ ID NO: 4803 - DNA, 20 bp, Artificial Sequence
  chemically synthesized
tttcaaatgtagttgacctt

SEQ ID NO: 4804 - DNA, 20 bp, Artificial Sequence
  chemically synthesized
gtagttgaccttaagaattt

SEQ ID NO: 4805 - DNA, 20 bp, Artificial Sequence
  chemically synthesized
aaatgtgttactgtgaagac

SEQ ID NO: 4806 - DNA, 20 bp, Artificial Sequence
  chemically synthesized
acatattccttatgaggtag

SEQ ID NO: 4807 - DNA, 20 bp, Artificial Sequence
  chemically synthesized
aataatttgtcatatgcttt

SEQ ID NO: 4808 - DNA, 20 bp, Artificial Sequence
  chemically synthesized
aacttagacgacaatgtccc

SEQ ID NO: 4809 - DNA, 20 bp, Artificial Sequence
  chemically synthesized
gattaattcggctaccacag

SEQ ID NO: 4810 - DNA, 20 bp, Artificial Sequence
  chemically synthesized
gaagcacctgcccttcaaga

SEQ ID NO: 4811 - DNA, 20 bp, Artificial Sequence
  chemically synthesized
ataaagtaaacacatgccat

SEQ ID NO: 4812 - DNA, 20 bp, Artificial Sequence
  chemically synthesized
agactcttttgacggctggg

SEQ ID NO: 4813 - DNA, 20 bp, Artificial Sequence
  chemically synthesized
actttgggaggccgaggcag

SEQ ID NO: 4814 - DNA, 20 bp, Artificial Sequence
  chemically synthesized
caggcggatcacgaggtcag

SEQ ID NO: 4815 - DNA, 20 bp, Artificial Sequence
  chemically synthesized
tacttgggaggctgagacag

SEQ ID NO: 4816 - DNA, 20 bp, Artificial Sequence
  chemically synthesized
ttgcactccagcctgggcaa

SEQ ID NO: 4817 - DNA, 20 bp, Artificial Sequence
  chemically synthesized
aacatggtgaactgatttcc

SEQ ID NO: 4818 - DNA, 20 bp, Artificial Sequence
  chemically synthesized
ttcccagaatctagcaattc

SEQ ID NO: 4819 - DNA, 20 bp, Artificial Sequence
  chemically synthesized
ttcattgagggaaataccac

SEQ ID NO: 4820 - DNA, 20 bp, Artificial Sequence
  chemically synthesized
caccaattacagtccttgcg

SEQ ID NO: 4821 - DNA, 20 bp, Artificial Sequence
  chemically synthesized
cttgcgtagggtccaaagaa

SEQ ID NO: 4822 - DNA, 20 bp, Artificial Sequence
  chemically synthesized
agagagcaacagaggagcaa

SEQ ID NO: 4823 - DNA, 20 bp, Artificial Sequence
  chemically synthesized
ttaaaggaaacatgacagct

SEQ ID NO: 4824 - DNA, 20 bp, Artificial Sequence
  chemically synthesized
tattctaggcatctaaacta

SEQ ID NO: 4825 - DNA, 20 bp, Artificial Sequence
  chemically synthesized
gtatcaaacggtcagattga

SEQ ID NO: 4826 - DNA, 20 bp, Artificial Sequence
  chemically synthesized
ttatttttatttttttgaga

SEQ ID NO: 4827 - DNA, 20 bp, Artificial Sequence
  chemically synthesized
tctcactctgtcacctaggc

SEQ ID NO: 4828 - DNA, 20 bp, Artificial Sequence
  chemically synthesized
ctcactgcaagctctgcctc

SEQ ID NO: 4829 - DNA, 20 bp, Artificial Sequence
  chemically synthesized
cattctcctgcctcagcctt

SEQ ID NO: 4830 - DNA, 20 bp, Artificial Sequence
  chemically synthesized
ttttgtatttttattagaga

SEQ ID NO: 4831 - DNA, 20 bp, Artificial Sequence
  chemically synthesized
tggggtttcaccatgttagc

SEQ ID NO: 4832 - DNA, 20 bp, Artificial Sequence
  chemically synthesized
gctttggcctcccaaagtgc

SEQ ID NO: 4833 - DNA, 20 bp, Artificial Sequence
  chemically synthesized
tcttcatttaaaaaagaaat

SEQ ID NO: 4834 - DNA, 20 bp, Artificial Sequence
  chemically synthesized
ggataatagtacctatctca

SEQ ID NO: 4835 - DNA, 20 bp, Artificial Sequence
  chemically synthesized
gcatgtaagtaggtgctcag

SEQ ID NO: 4836 - DNA, 20 bp, Artificial Sequence
  chemically synthesized
ttattgtgattcttcaggtc

SEQ ID NO: 4837 - DNA, 20 bp, Artificial Sequence
  chemically synthesized
attcttcaggtctggaatac

SEQ ID NO: 4838 - DNA, 20 bp, Artificial Sequence
  chemically synthesized
ctcacatcacaatcagatgg

SEQ ID NO: 4839 - DNA, 20 bp, Artificial Sequence
  chemically synthesized
tccccaaggcttggtgacag

SEQ ID NO: 4840 - DNA, 20 bp, Artificial Sequence
  chemically synthesized
gcttggtgacagatgagtta

SEQ ID NO: 4841 - DNA, 20 bp, Artificial Sequence
  chemically synthesized
gttactgggtaacacagaga

SEQ ID NO: 4842 - DNA, 20 bp, Artificial Sequence
  chemically synthesized
ggattcaaaggaaaagttga

SEQ ID NO: 4843 - DNA, 20 bp, Artificial Sequence
  chemically synthesized
ggttatgactagccacgtcc

SEQ ID NO: 4844 - DNA, 20 bp, Artificial Sequence
  chemically synthesized
agcttttctcagatgttaaa

SEQ ID NO: 4845 - DNA, 20 bp, Artificial Sequence
  chemically synthesized
atgtaagtcccccaaattta

SEQ ID NO: 4846 - DNA, 20 bp, Artificial Sequence
  chemically synthesized
ccaggggagaggtcacagct

SEQ ID NO: 4847 - DNA, 20 bp, Artificial Sequence
  chemically synthesized
aacagagaaggctaaaatca

SEQ ID NO: 4848 - DNA, 20 bp, Artificial Sequence
  chemically synthesized
ctcataaatgcactccctct

SEQ ID NO: 4849 - DNA, 20 bp, Artificial Sequence
  chemically synthesized
agttttgtctccttcccaca

SEQ ID NO: 4850 - DNA, 20 bp, Artificial Sequence
  chemically synthesized
caatttagacctgggcacta

SEQ ID NO: 4851 - DNA, 20 bp, Artificial Sequence
  chemically synthesized
agatcgtggtcctcctttct

SEQ ID NO: 4852 - DNA, 20 bp, Artificial Sequence
  chemically synthesized
ccctacaccacagatgttca

SEQ ID NO: 4853 - DNA, 20 bp, Artificial Sequence
  chemically synthesized
ggggtagaaatgcataattg

SEQ ID NO: 4854 - DNA, 20 bp, Artificial Sequence
  chemically synthesized
gagtgatagctacgcaaact

SEQ ID NO: 4855 - DNA, 20 bp, Artificial Sequence
  chemically synthesized
tcatcttcaacctcacctaa

SEQ ID NO: 4856 - DNA, 20 bp, Artificial Sequence
  chemically synthesized
aaggctatcttgatccccag

SEQ ID NO: 4857 - DNA, 20 bp, Artificial Sequence
  chemically synthesized
ctgcctgctttaggacctca

SEQ ID NO: 4858 - DNA, 20 bp, Artificial Sequence
  chemically synthesized
aatttcattccctaccagat

SEQ ID NO: 4859 - DNA, 20 bp, Artificial Sequence
  chemically synthesized
ccctaccagatttgggttct

SEQ ID NO: 4860 - DNA, 20 bp, Artificial Sequence
  chemically synthesized
aggtgctctgaagatgtttg

SEQ ID NO: 4861 - DNA, 20 bp, Artificial Sequence
  chemically synthesized
gggagctgctggtgtcccca

SEQ ID NO: 4862 - DNA, 20 bp, Artificial Sequence
  chemically synthesized
aaatgagaaaaatgcttccc

SEQ ID NO: 4863 - DNA, 20 bp, Artificial Sequence
  chemically synthesized
ccactgatgactccaatgac

SEQ ID NO: 4864 - DNA, 20 bp, Artificial Sequence
  chemically synthesized
aatgaggggctgatccaggc

SEQ ID NO: 4865 - DNA, 20 bp, Artificial Sequence
  chemically synthesized
tatatctctgctcttcccca

SEQ ID NO: 4866 - DNA, 20 bp, Artificial Sequence
  chemically synthesized
ccacttcatggtgatgttct

SEQ ID NO: 4867 - DNA, 20 bp, Artificial Sequence
  chemically synthesized
tagttcaaggcccgacaccg

SEQ ID NO: 4868 - DNA, 20 bp, Artificial Sequence
  chemically synthesized
ggcacttgacaggaaagagg

SEQ ID NO: 4869 - DNA, 20 bp, Artificial Sequence
  chemically synthesized
aaagaggaaggatgaggaga

SEQ ID NO: 4870 - DNA, 20 bp, Artificial Sequence
  chemically synthesized
tttatgtgcattgaaaatga

SEQ ID NO: 4871 - DNA, 20 bp, Artificial Sequence
  chemically synthesized
atacagatggtcagtttcac

SEQ ID NO: 4872 - DNA, 20 bp, Artificial Sequence
  chemically synthesized
tgaaagaaacttttaaccta

SEQ ID NO: 4873 - DNA, 20 bp, Artificial Sequence
  chemically synthesized
tcatatgatagctgagatct

SEQ ID NO: 4874 - DNA, 20 bp, Artificial Sequence
  chemically synthesized
ttttttttttttttttaaga

SEQ ID NO: 4875 - DNA, 20 bp, Artificial Sequence
  chemically synthesized
tctcactctgctgcctaggc

SEQ ID NO: 4876 - DNA, 20 bp, Artificial Sequence
  chemically synthesized
atttttgtatttttttagag

SEQ ID NO: 4877 - DNA, 20 bp, Artificial Sequence
  chemically synthesized
gcctcggcctcccaaagtgc

SEQ ID NO: 4878 - DNA, 20 bp, Artificial Sequence
  chemically synthesized
tcccaaagtgctgggattac

SEQ ID NO: 4879 - DNA, 20 bp, Artificial Sequence
  chemically synthesized
cgtgcccggccttgacattt

SEQ ID NO: 4880 - DNA, 20 bp, Artificial Sequence
  chemically synthesized
caattataaggtagagactc

SEQ ID NO: 4881 - DNA, 20 bp, Artificial Sequence
  chemically synthesized
ggattgagaaagtcccttcc

SEQ ID NO: 4882 - DNA, 20 bp, Artificial Sequence
  chemically synthesized
ccacctctgaaactccaacc

SEQ ID NO: 4883 - DNA, 20 bp, Artificial Sequence
  chemically synthesized
aacctcctccactctgccac

SEQ ID NO: 4884 - DNA, 20 bp, Artificial Sequence
  chemically synthesized
taggccctgttctgcctggc

SEQ ID NO: 4885 - DNA, 20 bp, Artificial Sequence
  chemically synthesized
ccagcttggtgggccaggcc

SEQ ID NO: 4886 - DNA, 20 bp, Artificial Sequence
  chemically synthesized
tccaatccagtgtgtcaggg

SEQ ID NO: 4887 - DNA, 20 bp, Artificial Sequence
  chemically synthesized
tcttcttgcatttcacagcc

SEQ ID NO: 4888 - DNA, 20 bp, Artificial Sequence
  chemically synthesized
tcacagcccaggatgacctg

SEQ ID NO: 4889 - DNA, 20 bp, Artificial Sequence
  chemically synthesized
gccttgttaactgcaaccaa

SEQ ID NO: 4890 - DNA, 20 bp, Artificial Sequence
  chemically synthesized
gaaattctactggaaaccca

SEQ ID NO: 4891 - DNA, 20 bp, Artificial Sequence
  chemically synthesized
acccatgaagaggtagtgca

SEQ ID NO: 4892 - DNA, 20 bp, Artificial Sequence
  chemically synthesized
catgtgtagtaggaggggag

SEQ ID NO: 4893 - DNA, 20 bp, Artificial Sequence
  chemically synthesized
tgtctggtcctcattttgtg

SEQ ID NO: 4894 - DNA, 20 bp, Artificial Sequence
  chemically synthesized
tggtcctcattttgtgaagg

SEQ ID NO: 4895 - DNA, 20 bp, Artificial Sequence
  chemically synthesized
ctttcttccatatgacagtc

SEQ ID NO: 4896 - DNA, 20 bp, Artificial Sequence
  chemically synthesized
gacagactccactaaagctg

SEQ ID NO: 4897 - DNA, 20 bp, Artificial Sequence
  chemically synthesized
tagccatggtagttgaactc

SEQ ID NO: 4898 - DNA, 20 bp, Artificial Sequence
  chemically synthesized
caaattagacccaaatcctg

SEQ ID NO: 4899 - DNA, 20 bp, Artificial Sequence
  chemically synthesized
ttttttttttttttttgaga

SEQ ID NO: 4900 - DNA, 20 bp, Artificial Sequence
  chemically synthesized
tctcactctatcacccaggc

SEQ ID NO: 4901 - DNA, 20 bp, Artificial Sequence
  chemically synthesized
ctcactgcaacctgcacctc

SEQ ID NO: 4902 - DNA, 20 bp, Artificial Sequence
  chemically synthesized
acctgcacctcctgggttca

SEQ ID NO: 4903 - DNA, 20 bp, Artificial Sequence
  chemically synthesized
ttttgtatttttagtagaca

SEQ ID NO: 4904 - DNA, 20 bp, Artificial Sequence
  chemically synthesized
tgcctcagccaccaaagtgc

SEQ ID NO: 4905 - DNA, 20 bp, Artificial Sequence
  chemically synthesized
caccgtgcccagccttggtc

SEQ ID NO: 4906 - DNA, 20 bp, Artificial Sequence
  chemically synthesized
tcaccacttggaagcctgac

SEQ ID NO: 4907 - DNA, 20 bp, Artificial Sequence
  chemically synthesized
tttaactcttctctttttca

SEQ ID NO: 4908 - DNA, 20 bp, Artificial Sequence
  chemically synthesized
tttcagggggtcaggggaga

SEQ ID NO: 4909 - DNA, 20 bp, Artificial Sequence
  chemically synthesized
ataccctccacctcagcctc

SEQ ID NO: 4910 - DNA, 20 bp, Artificial Sequence
  chemically synthesized
acctcagcctcccgagtagc

SEQ ID NO: 4911 - DNA, 20 bp, Artificial Sequence
  chemically synthesized
ttttgtattttttgtagaga

SEQ ID NO: 4912 - DNA, 20 bp, Artificial Sequence
  chemically synthesized
ggtcttgaactcctgagctc

SEQ ID NO: 4913 - DNA, 20 bp, Artificial Sequence
  chemically synthesized
tctctttctctcacacaaca

SEQ ID NO: 4914 - DNA, 20 bp, Artificial Sequence
  chemically synthesized
aatccttcagcaacttcctt

SEQ ID NO: 4915 - DNA, 20 bp, Artificial Sequence
  chemically synthesized
gatcactgttactccttggc

SEQ ID NO: 4916 - DNA, 20 bp, Artificial Sequence
  chemically synthesized
tcaacccgagcttcttaacc

SEQ ID NO: 4917 - DNA, 20 bp, Artificial Sequence
  chemically synthesized
tttttggttgtcaagactgg

SEQ ID NO: 4918 - DNA, 20 bp, Artificial Sequence
  chemically synthesized
gggagtgctcctagcaccta

SEQ ID NO: 4919 - DNA, 20 bp, Artificial Sequence
  chemically synthesized
cacctagtgagtagggagga

SEQ ID NO: 4920 - DNA, 20 bp, Artificial Sequence
  chemically synthesized
ccccccccacacacacacac

SEQ ID NO: 4921 - DNA, 20 bp, Artificial Sequence
  chemically synthesized
ctctgctcaagtgtcagccc

SEQ ID NO: 4922 - DNA, 20 bp, Artificial Sequence
  chemically synthesized
cttattgtcatctctcccac

SEQ ID NO: 4923 - DNA, 20 bp, Artificial Sequence
  chemically synthesized
cactagaatgcaaaatatca

SEQ ID NO: 4924 - DNA, 20 bp, Artificial Sequence
  chemically synthesized
ctcatttacacttgtaaaca

SEQ ID NO: 4925 - DNA, 20 bp, Artificial Sequence
  chemically synthesized
tctaatgcagtgtgatgttt

SEQ ID NO: 4926 - DNA, 20 bp, Artificial Sequence
  chemically synthesized
caccaaagcccagtgtacca

SEQ ID NO: 4927 - DNA, 20 bp, Artificial Sequence
  chemically synthesized
attcttgtcatgtgtaaaat

SEQ ID NO: 4928 - DNA, 20 bp, Artificial Sequence
  chemically synthesized
tatgttctttgtaacctgaa

SEQ ID NO: 4929 - DNA, 20 bp, Artificial Sequence
  chemically synthesized
cctgaaaagagttatataat

SEQ ID NO: 4930 - DNA, 20 bp, Artificial Sequence
  chemically synthesized
aaaatcaaataagatcagat

SEQ ID NO: 4931 - DNA, 20 bp, Artificial Sequence
  chemically synthesized
gatatgaatgtaacttagaa

SEQ ID NO: 4932 - DNA, 20 bp, Artificial Sequence
  chemically synthesized
caataaagcctagccgaaaa

SEQ ID NO: 4933 - DNA, 20 bp, Artificial Sequence
  chemically synthesized
caggcaaaagaacaattgcc

SEQ ID NO: 4934 - DNA, 20 bp, Artificial Sequence
  chemically synthesized
caccccaggtctcaccaaaa

SEQ ID NO: 4935 - DNA, 20 bp, Artificial Sequence
  chemically synthesized
caggtctcaccaaaagtggg

SEQ ID NO: 4936 - DNA, 20 bp, Artificial Sequence
  chemically synthesized
caaaagtgggtggaatggtg

SEQ ID NO: 4937 - DNA, 20 bp, Artificial Sequence
  chemically synthesized
ttctgaggtggaaaccccgt

SEQ ID NO: 4938 - DNA, 20 bp, Artificial Sequence
  chemically synthesized
aaccccgtgcggatcctgct

SEQ ID NO: 4939 - DNA, 20 bp, Artificial Sequence
  chemically synthesized
agctgacattggaaataaac

SEQ ID NO: 4940 - DNA, 20 bp, Artificial Sequence
  chemically synthesized
aagcattctagttgggggaa

SEQ ID NO: 4941 - DNA, 20 bp, Artificial Sequence
  chemically synthesized
cagtggtaggcactccctca

SEQ ID NO: 4942 - DNA, 20 bp, Artificial Sequence
  chemically synthesized
gaaagtagggagaggggctt

SEQ ID NO: 4943 - DNA, 20 bp, Artificial Sequence
  chemically synthesized
tagggagaggggcttgcgga

SEQ ID NO: 4944 - DNA, 20 bp, Artificial Sequence
  chemically synthesized
cttttggggggcggggaaac

SEQ ID NO: 4945 - DNA, 20 bp, Artificial Sequence
  chemically synthesized
ccttggtttttaaatcctga

SEQ ID NO: 4946 - DNA, 20 bp, Artificial Sequence
  chemically synthesized
accttccacagccttcataa

SEQ ID NO: 4947 - DNA, 20 bp, Artificial Sequence
  chemically synthesized
tttcacaaactttacagtat

SEQ ID NO: 4948 - DNA, 20 bp, Artificial Sequence
  chemically synthesized
tacagtattgggattatctg

SEQ ID NO: 4949 - DNA, 20 bp, Artificial Sequence
  chemically synthesized
accccagacacactgattta

SEQ ID NO: 4950 - DNA, 20 bp, Artificial Sequence
  chemically synthesized
ttagacattagcagttggga

SEQ ID NO: 4951 - DNA, 20 bp, Artificial Sequence
  chemically synthesized
actaccctaatgccacccta

SEQ ID NO: 4952 - DNA, 20 bp, Artificial Sequence
  chemically synthesized
cctaatgccaccctaaggga

SEQ ID NO: 4953 - DNA, 20 bp, Artificial Sequence
  chemically synthesized
tatcctggagaaagagaaag

SEQ ID NO: 4954 - DNA, 20 bp, Artificial Sequence
  chemically synthesized
tcatcatgccatcattataa

SEQ ID NO: 4955 - DNA, 20 bp, Artificial Sequence
  chemically synthesized
ttgagctctgtaaagaagtg

SEQ ID NO: 4956 - DNA, 20 bp, Artificial Sequence
  chemically synthesized
gaaataagcccgctgtccct

SEQ ID NO: 4957 - DNA, 20 bp, Artificial Sequence
  chemically synthesized
tataataatctcctcggtta

SEQ ID NO: 4958 - DNA, 20 bp, Artificial Sequence
  chemically synthesized
cataattcccagtaacagta

SEQ ID NO: 4959 - DNA, 20 bp, Artificial Sequence
  chemically synthesized
atgggatgccacctgggcaa

SEQ ID NO: 4960 - DNA, 20 bp, Artificial Sequence
  chemically synthesized
cttctccctcaacgaagttt

SEQ ID NO: 4961 - DNA, 20 bp, Artificial Sequence
  chemically synthesized
ggcaattcaagaaaatcaaa

SEQ ID NO: 4962 - DNA, 20 bp, Artificial Sequence
  chemically synthesized
acaataacattggaaacatg

SEQ ID NO: 4963 - DNA, 20 bp, Artificial Sequence
  chemically synthesized
aaggcagatcacctgagatc

SEQ ID NO: 4964 - DNA, 20 bp, Artificial Sequence
  chemically synthesized
tacattagaggctgaggcag

SEQ ID NO: 4965 - DNA, 20 bp, Artificial Sequence
  chemically synthesized
tctcaaaaaaaaaaaattag

SEQ ID NO: 4966 - DNA, 20 bp, Artificial Sequence
  chemically synthesized
tactcgggaagctgagacag

SEQ ID NO: 4967 - DNA, 20 bp, Artificial Sequence
  chemically synthesized
aaaataaaatgcaaaaatta

SEQ ID NO: 4968 - DNA, 20 bp, Artificial Sequence
  chemically synthesized
gtttctactttatggctatt

SEQ ID NO: 4969 - DNA, 20 bp, Artificial Sequence
  chemically synthesized
ttttggttatatatctagaa

SEQ ID NO: 4970 - DNA, 20 bp, Artificial Sequence
  chemically synthesized
tatatctagaagtgggtttg

SEQ ID NO: 4971 - DNA, 20 bp, Artificial Sequence
  chemically synthesized
taacactgtttaaccttttg

SEQ ID NO: 4972 - DNA, 20 bp, Artificial Sequence
  chemically synthesized
tcctcctatcagcagtgtat

SEQ ID NO: 4973 - DNA, 20 bp, Artificial Sequence
  chemically synthesized
tgatttctctccatctttgc

SEQ ID NO: 4974 - DNA, 20 bp, Artificial Sequence
  chemically synthesized
ctccatctttgcctgggttt

SEQ ID NO: 4975 - DNA, 20 bp, Artificial Sequence
  chemically synthesized
aatcaatctaccataaatgt

SEQ ID NO: 4976 - DNA, 20 bp, Artificial Sequence
  chemically synthesized
taaatgtgagagtttatttc

SEQ ID NO: 4977 - DNA, 20 bp, Artificial Sequence
  chemically synthesized
cctcactctattgcccaggt

SEQ ID NO: 4978 - DNA, 20 bp, Artificial Sequence
  chemically synthesized
gcctcagcctcccaagcagc

SEQ ID NO: 4979 - DNA, 20 bp, Artificial Sequence
  chemically synthesized
ttttgtatttttagtagaga

SEQ ID NO: 4980 - DNA, 20 bp, Artificial Sequence
  chemically synthesized
ctgcttgggaggctgaggca

SEQ ID NO: 4981 - DNA, 20 bp, Artificial Sequence
  chemically synthesized
aatgggataaaattgagact

SEQ ID NO: 4982 - DNA, 20 bp, Artificial Sequence
  chemically synthesized
aaaaacccaggcaaagatgg

SEQ ID NO: 4983 - DNA, 20 bp, Artificial Sequence
  chemically synthesized
gataaaatgcttactttgga

SEQ ID NO: 4984 - DNA, 20 bp, Artificial Sequence
  chemically synthesized
cacttctagatatataacca

SEQ ID NO: 4985 - DNA, 20 bp, Artificial Sequence
  chemically synthesized
ctattcccaatagccataaa

SEQ ID NO: 4986 - DNA, 20 bp, Artificial Sequence
  chemically synthesized
atgtatactaaatgttccaa

SEQ ID NO: 4987 - DNA, 20 bp, Artificial Sequence
  chemically synthesized
atactaaatgttccaaatag

SEQ ID NO: 4988 - DNA, 20 bp, Artificial Sequence
  chemically synthesized
gggctgggaggggaggagga

SEQ ID NO: 4989 - DNA, 20 bp, Artificial Sequence
  chemically synthesized
catggtttctttttggggag

SEQ ID NO: 4990 - DNA, 20 bp, Artificial Sequence
  chemically synthesized
tggtcttacctataatttgt

SEQ ID NO: 4991 - DNA, 20 bp, Artificial Sequence
  chemically synthesized
cgcccactcccttcccccaa

SEQ ID NO: 4992 - DNA, 20 bp, Artificial Sequence
  chemically synthesized
tatccacattttacacatga

SEQ ID NO: 4993 - DNA, 20 bp, Artificial Sequence
  chemically synthesized
ataataaaatttcatgttga

SEQ ID NO: 4994 - DNA, 20 bp, Artificial Sequence
  chemically synthesized
agatgacaataagcaaatga

SEQ ID NO: 4995 - DNA, 20 bp, Artificial Sequence
  chemically synthesized
gagcagagacatgaaggaaa

SEQ ID NO: 4996 - DNA, 20 bp, Artificial Sequence
  chemically synthesized
ctctggctgctatgtggaaa

SEQ ID NO: 4997 - DNA, 20 bp, Artificial Sequence
  chemically synthesized
gtggagtgggctgggtggga

SEQ ID NO: 4998 - DNA, 20 bp, Artificial Sequence
  chemically synthesized
gaaggattctatgttgtgtg

SEQ ID NO: 4999 - DNA, 20 bp, Artificial Sequence
  chemically synthesized
tatgttgtgtgagagaaaga

SEQ ID NO: 5000 - DNA, 20 bp, Artificial Sequence
  chemically synthesized
gccacataggcagttcagtg

SEQ ID NO: 5001 - DNA, 20 bp, Artificial Sequence
  chemically synthesized
gttttcaggaggcttaggta

SEQ ID NO: 5002 - DNA, 20 bp, Artificial Sequence
  chemically synthesized
tagacacaccttaacatttt

SEQ ID NO: 5003 - DNA, 20 bp, Artificial Sequence
  chemically synthesized
gggtggcagccacgtgtggc

SEQ ID NO: 5004 - DNA, 20 bp, Artificial Sequence
  chemically synthesized
gcacccaggactgtcatatg

SEQ ID NO: 5005 - DNA, 20 bp, Artificial Sequence
  chemically synthesized
ccgaactccatgggtttcca

SEQ ID NO: 5006 - DNA, 20 bp, Artificial Sequence
  chemically synthesized
tatttatacctgttaaaaat

SEQ ID NO: 5007 - DNA, 20 bp, Artificial Sequence
  chemically synthesized
aaaaaaaaaaaaaaaaaaaa

SEQ ID NO: 5008 - DNA, 20 bp, Artificial Sequence
  chemically synthesized
tgaggccacttatcagagta

SEQ ID NO: 5009 - DNA, 20 bp, Artificial Sequence
  chemically synthesized
gactgatgagagccaggagc

SEQ ID NO: 5010 - DNA, 20 bp, Artificial Sequence
  chemically synthesized
caccagcagctccctgggag

SEQ ID NO: 5011 - DNA, 20 bp, Artificial Sequence
  chemically synthesized
acagaaaataatggttctcc

SEQ ID NO: 5012 - DNA, 20 bp, Artificial Sequence
  chemically synthesized
aatgcttagggtgtcaaagg

SEQ ID NO: 5013 - DNA, 20 bp, Artificial Sequence
  chemically synthesized
gtataaggcatactgggaga

SEQ ID NO: 5014 - DNA, 20 bp, Artificial Sequence
  chemically synthesized
acatctgtggtgtagggaaa

SEQ ID NO: 5015 - DNA, 20 bp, Artificial Sequence
  chemically synthesized
gtggtgtagggaaaagagaa

SEQ ID NO: 5016 - DNA, 20 bp, Artificial Sequence
  chemically synthesized
ggggtgtcattgaaggatcc

SEQ ID NO: 5017 - DNA, 20 bp, Artificial Sequence
  chemically synthesized
atgagaggtgaggagaccag

SEQ ID NO: 5018 - DNA, 20 bp, Artificial Sequence
  chemically synthesized
ggagagagttgaacctaaac

SEQ ID NO: 5019 - DNA, 20 bp, Artificial Sequence
  chemically synthesized
acatgattcattttaacatc

SEQ ID NO: 5020 - DNA, 20 bp, Artificial Sequence
  chemically synthesized
gaatggaagaggcacctgtc

SEQ ID NO: 5021 - DNA, 20 bp, Artificial Sequence
  chemically synthesized
tactctagtattccagacct

SEQ ID NO: 5022 - DNA, 20 bp, Artificial Sequence
  chemically synthesized
tccccatttcttttttaaat

SEQ ID NO: 5023 - DNA, 20 bp, Artificial Sequence
  chemically synthesized
ctactcggaaggctgaggca

SEQ ID NO: 5024 - DNA, 20 bp, Artificial Sequence
  chemically synthesized
aaataaaaaaatgaaaaaaa

SEQ ID NO: 5025 - DNA, 20 bp, Artificial Sequence
  chemically synthesized
tatctcatagtttgtcagtg

SEQ ID NO: 5026 - DNA, 20 bp, Artificial Sequence
  chemically synthesized
acattcagtagtttagatgc

SEQ ID NO: 5027 - DNA, 20 bp, Artificial Sequence
  chemically synthesized
gaatcacatgaaggggaaca

SEQ ID NO: 5028 - DNA, 20 bp, Artificial Sequence
  chemically synthesized
accattttctttttttgtgg

SEQ ID NO: 5029 - DNA, 20 bp, Artificial Sequence
  chemically synthesized
tttgtggttagaaaagttat

SEQ ID NO: 5030 - DNA, 20 bp, Artificial Sequence
  chemically synthesized
aaatgtgatttacgctcatt

SEQ ID NO: 5031 - DNA, 20 bp, Artificial Sequence
  chemically synthesized
tttcacctgggctgagattt

SEQ ID NO: 5032 - DNA, 20 bp, Artificial Sequence
  chemically synthesized
gtggcctgttaattttttta

SEQ ID NO: 5033 - DNA, 20 bp, Artificial Sequence
  chemically synthesized
tttcctgaaggtaaaggaat

SEQ ID NO: 5034 - DNA, 20 bp, Artificial Sequence
  chemically synthesized
gtgcactggaaatcacttgt

SEQ ID NO: 5035 - DNA, 20 bp, Artificial Sequence
  chemically synthesized
gagaaaagcccctgaaaatt

SEQ ID NO: 5036 - DNA, 20 bp, Artificial Sequence
  chemically synthesized
tgaaaatttgagaaaacaaa

SEQ ID NO: 5037 - DNA, 20 bp, Artificial Sequence
  chemically synthesized
taacttctacactctaacat

SEQ ID NO: 5038 - DNA, 20 bp, Artificial Sequence
  chemically synthesized
tacattaaaagttttccatg

SEQ ID NO: 5039 - DNA, 20 bp, Artificial Sequence
  chemically synthesized
cccatgaatatatataatct

SEQ ID NO: 5040 - DNA, 20 bp, Artificial Sequence
  chemically synthesized
aatcttaatttaattcctcc

SEQ ID NO: 5041 - DNA, 20 bp, Artificial Sequence
  chemically synthesized
gagaggttagttaacttgct

SEQ ID NO: 5042 - DNA, 20 bp, Artificial Sequence
  chemically synthesized
gctgcagggaaaaaggaatc

SEQ ID NO: 5043 - DNA, 20 bp, Artificial Sequence
  chemically synthesized
ggatattttgttcagttcat

SEQ ID NO: 5044 - DNA, 20 bp, Artificial Sequence
  chemically synthesized
ttattctctttatcattcag

SEQ ID NO: 5045 - DNA, 20 bp, Artificial Sequence
  chemically synthesized
ttttactctgaagattctaa

SEQ ID NO: 5046 - DNA, 20 bp, Artificial Sequence
  chemically synthesized
ttgtgctttctgtgtgctat

SEQ ID NO: 5047 - DNA, 20 bp, Artificial Sequence
  chemically synthesized
atgtttaagagaggataatg

SEQ ID NO: 5048 - DNA, 20 bp, Artificial Sequence
  chemically synthesized
ttccagaccagcctcaacat

SEQ ID NO: 5049 - DNA, 20 bp, Artificial Sequence
  chemically synthesized
ctactcgggaggctgaggca

SEQ ID NO: 5050 - DNA, 20 bp, Artificial Sequence
  chemically synthesized
aaaattttaaaatcttaaaa

SEQ ID NO: 5051 - DNA, 20 bp, Artificial Sequence
  chemically synthesized
tttaaaatcttaaaaaaaga

SEQ ID NO: 5052 - DNA, 20 bp, Artificial Sequence
  chemically synthesized
caagcctaggaagtgcaagt

SEQ ID NO: 5053 - DNA, 20 bp, Artificial Sequence
  chemically synthesized
tgtgaaataatttaaactga

SEQ ID NO: 5054 - DNA, 20 bp, Artificial Sequence
  chemically synthesized
gaaaaagcagagattttttt

SEQ ID NO: 5055 - DNA, 20 bp, Artificial Sequence
  chemically synthesized
aatggtactgacagtttaat

SEQ ID NO: 5056 - DNA, 20 bp, Artificial Sequence
  chemically synthesized
ttaattcagaaaaaaatgaa

SEQ ID NO: 5057 - DNA, 20 bp, Artificial Sequence
  chemically synthesized
ataagttaggttgctgaaaa

SEQ ID NO: 5058 - DNA, 20 bp, Artificial Sequence
  chemically synthesized
tacctccactccttactttt

SEQ ID NO: 5059 - DNA, 20 bp, Artificial Sequence
  chemically synthesized
ttaaaaataaagatatctgg

SEQ ID NO: 5060 - DNA, 20 bp, Artificial Sequence
  chemically synthesized
gaatactttcttaatagcac

SEQ ID NO: 5061 - DNA, 20 bp, Artificial Sequence
  chemically synthesized
ttgtgaacccaaacttacac

SEQ ID NO: 5062 - DNA, 20 bp, Artificial Sequence
  chemically synthesized
ctactcaggaggctggggca

SEQ ID NO: 5063 - DNA, 20 bp, Artificial Sequence
  chemically synthesized
taaagactccaaaattcttt

SEQ ID NO: 5064 - DNA, 20 bp, Artificial Sequence
  chemically synthesized
tagaatcttcagagtaaaag

SEQ ID NO: 5065 - DNA, 20 bp, Artificial Sequence
  chemically synthesized
aatttctccctgaatgataa

SEQ ID NO: 5066 - DNA, 20 bp, Artificial Sequence
  chemically synthesized
tgaatatgtcaattcaaaag

SEQ ID NO: 5067 - DNA, 20 bp, Artificial Sequence
  chemically synthesized
agaacccgtttcaataaata

SEQ ID NO: 5068 - DNA, 20 bp, Artificial Sequence
  chemically synthesized
ctcaacaacaacaaaacaag

SEQ ID NO: 5069 - DNA, 20 bp, Artificial Sequence
  chemically synthesized
gatagagtgagactccatct

SEQ ID NO: 5070 - DNA, 20 bp, Artificial Sequence
  chemically synthesized
aaggttgtgtagttgttatt

SEQ ID NO: 5071 - DNA, 20 bp, Artificial Sequence
  chemically synthesized
tagttgttattccagaatag

SEQ ID NO: 5072 - DNA, 20 bp, Artificial Sequence
  chemically synthesized
ataacagcaacataagcata

SEQ ID NO: 5073 - DNA, 20 bp, Artificial Sequence
  chemically synthesized
aatgtacaaattcatccatc

SEQ ID NO: 5074 - DNA, 20 bp, Artificial Sequence
  chemically synthesized
caaattcatccatccaagaa

SEQ ID NO: 5075 - DNA, 20 bp, Artificial Sequence
  chemically synthesized
tctacaccttaaacaattac

SEQ ID NO: 5076 - DNA, 20 bp, Artificial Sequence
  chemically synthesized
ccttaaacaattactcagaa

SEQ ID NO: 5077 - DNA, 20 bp, Artificial Sequence
  chemically synthesized
gaaatagaatgcttgagata

SEQ ID NO: 5078 - DNA, 20 bp, Artificial Sequence
  chemically synthesized
attatacccaaagcctacag

SEQ ID NO: 5079 - DNA, 20 bp, Artificial Sequence
  chemically synthesized
gaaaatctttaatttgaaag

SEQ ID NO: 5080 - DNA, 20 bp, Artificial Sequence
  chemically synthesized
ttaaatgtgtgtgagtttgt

SEQ ID NO: 5081 - DNA, 20 bp, Artificial Sequence
  chemically synthesized
gacattattataatacaaca

SEQ ID NO: 5082 - DNA, 20 bp, Artificial Sequence
  chemically synthesized
atggttttgccagaggtgaa

SEQ ID NO: 5083 - DNA, 20 bp, Artificial Sequence
  chemically synthesized
ttttcaaatgtagttgacct

SEQ ID NO: 5084 - DNA, 20 bp, Artificial Sequence
  chemically synthesized
ttaagaatttatgaataaag

SEQ ID NO: 5085 - DNA, 20 bp, Artificial Sequence
  chemically synthesized
attaagcttaaaaaacaccg

SEQ ID NO: 5086 - DNA, 20 bp, Artificial Sequence
  chemically synthesized
cagtatagtaagatattaag

SEQ ID NO: 5087 - DNA, 20 bp, Artificial Sequence
  chemically synthesized
aaataatttgtcatatgctt

SEQ ID NO: 5088 - DNA, 20 bp, Artificial Sequence
  chemically synthesized
gacgacaatgtccctagagt

SEQ ID NO: 5089 - DNA, 20 bp, Artificial Sequence
  chemically synthesized
tattccgtaagacaaaatgt

SEQ ID NO: 5090 - DNA, 20 bp, Artificial Sequence
  chemically synthesized
taacttttctaaccacaaaa

SEQ ID NO: 5091 - DNA, 20 bp, Artificial Sequence
  chemically synthesized
gctaaaatttaatgcctaaa

SEQ ID NO: 5092 - DNA, 20 bp, Artificial Sequence
  chemically synthesized
tgaagcacctgcccttcaag

SEQ ID NO: 5093 - DNA, 20 bp, Artificial Sequence
  chemically synthesized
ctacttgggaggctgagaca

SEQ ID NO: 5094 - DNA, 20 bp, Artificial Sequence
  chemically synthesized
gaacatggtgaactgatttc

SEQ ID NO: 5095 - DNA, 20 bp, Artificial Sequence
  chemically synthesized
acagtccttgcgtagggtcc

SEQ ID NO: 5096 - DNA, 20 bp, Artificial Sequence
  chemically synthesized
atgtgattcaagctcactca

SEQ ID NO: 5097 - DNA, 20 bp, Artificial Sequence
  chemically synthesized
cttcactttcttcatttaaa

SEQ ID NO: 5098 - DNA, 20 bp, Artificial Sequence
  chemically synthesized
gggataatagtacctatctc

SEQ ID NO: 5099 - DNA, 20 bp, Artificial Sequence
  chemically synthesized
tcagaacaaggagagaccag

SEQ ID NO: 5100 - DNA, 20 bp, Artificial Sequence
  chemically synthesized
gtatgacaccttcatgccaa

SEQ ID NO: 5101 - DNA, 20 bp, Artificial Sequence
  chemically synthesized
actcacatcacaatcagatg

SEQ ID NO: 5102 - DNA, 20 bp, Artificial Sequence
  chemically synthesized
aaaggaaaagttgaacgggt

SEQ ID NO: 5103 - DNA, 20 bp, Artificial Sequence
  chemically synthesized
gatcaccggcatgcaggaac

SEQ ID NO: 5104 - DNA, 20 bp, Artificial Sequence
  chemically synthesized
acaccacagatgttcagggg

SEQ ID NO: 5105 - DNA, 20 bp, Artificial Sequence
  chemically synthesized
tccctaccagatttgggttc

SEQ ID NO: 5106 - DNA, 20 bp, Artificial Sequence
  chemically synthesized
agggagctgctggtgtcccc

SEQ ID NO: 5107 - DNA, 20 bp, Artificial Sequence
  chemically synthesized
gtgtccccaaagaatataaa

SEQ ID NO: 5108 - DNA, 20 bp, Artificial Sequence
  chemically synthesized
cagacggtgagggctctaaa

SEQ ID NO: 5109 - DNA, 20 bp, Artificial Sequence
  chemically synthesized
ggaggaaggaaatacccttt

SEQ ID NO: 5110 - DNA, 20 bp, Artificial Sequence
  chemically synthesized
gattattgctatgttctatg

SEQ ID NO: 5111 - DNA, 20 bp, Artificial Sequence
  chemically synthesized
tccctttgagccatatgcat

SEQ ID NO: 5112 - DNA, 20 bp, Artificial Sequence
  chemically synthesized
ttgagccatatgcatggaga

SEQ ID NO: 5113 - DNA, 20 bp, Artificial Sequence
  chemically synthesized
taaggtagagactctaggat

SEQ ID NO: 5114 - DNA, 20 bp, Artificial Sequence
  chemically synthesized
aggattgagaaagtcccttc

SEQ ID NO: 5115 - DNA, 20 bp, Artificial Sequence
  chemically synthesized
ctccaatccagtgtgtcagg

SEQ ID NO: 5116 - DNA, 20 bp, Artificial Sequence
  chemically synthesized
tccactaaagctggtggatt

SEQ ID NO: 5117 - DNA, 20 bp, Artificial Sequence
  chemically synthesized
tttcctctgccttcaccatc

SEQ ID NO: 5118 - DNA, 20 bp, Artificial Sequence
  chemically synthesized
ttctctttctctcacacaac

SEQ ID NO: 5119 - DNA, 20 bp, Artificial Sequence
  chemically synthesized
gaatccttcagcaacttcct

SEQ ID NO: 5120 - DNA, 20 bp, Artificial Sequence
  chemically synthesized
agatcactgttactccttgg

SEQ ID NO: 5121 - DNA, 20 bp, Artificial Sequence
  chemically synthesized
cacacacacatgagtagtgc

SEQ ID NO: 5122 - DNA, 20 bp, Artificial Sequence
  chemically synthesized
gcttattgtcatctctccca

SEQ ID NO: 5123 - DNA, 20 bp, Artificial Sequence
  chemically synthesized
ctctaatgcagtgtgatgtt

SEQ ID NO: 5124 - DNA, 20 bp, Artificial Sequence
  chemically synthesized
ctgtagtacttgaaataaca

SEQ ID NO: 5125 - DNA, 20 bp, Artificial Sequence
  chemically synthesized
tcaataaagcctagccgaaa

SEQ ID NO: 5126 - DNA, 20 bp, Artificial Sequence
  chemically synthesized
ccaaaagtgggtggaatggt

SEQ ID NO: 5127 - DNA, 20 bp, Artificial Sequence
  chemically synthesized
ctccctcacggggtctggac

SEQ ID NO: 5128 - DNA, 20 bp, Artificial Sequence
  chemically synthesized
gttagcaaactcccaagcgc

SEQ ID NO: 5129 - DNA, 20 bp, Artificial Sequence
  chemically synthesized
caacttatgtcttatttgac

SEQ ID NO: 5130 - DNA, 20 bp, Artificial Sequence
  chemically synthesized
ttacagtattgggattatct

SEQ ID NO: 5131 - DNA, 20 bp, Artificial Sequence
  chemically synthesized
gtctgtggccaaaatatcct

SEQ ID NO: 5132 - DNA, 20 bp, Artificial Sequence
  chemically synthesized
ggccaaaatatcctggagaa

SEQ ID NO: 5133 - DNA, 20 bp, Artificial Sequence
  chemically synthesized
ttcatcatgccatcattata

SEQ ID NO: 5134 - DNA, 20 bp, Artificial Sequence
  chemically synthesized
agaagtgctgagttcacttc

SEQ ID NO: 5135 - DNA, 20 bp, Artificial Sequence
  chemically synthesized
gtatgcaaattttggcaatt

SEQ ID NO: 5136 - DNA, 20 bp, Artificial Sequence
  chemically synthesized
tacaataacattggaaacat

SEQ ID NO: 5137 - DNA, 20 bp, Artificial Sequence
  chemically synthesized
ctacattagaggctgaggca

SEQ ID NO: 5138 - DNA, 20 bp, Artificial Sequence
  chemically synthesized
ctactcgggaagctgagaca

SEQ ID NO: 5139 - DNA, 20 bp, Artificial Sequence
  chemically synthesized
ttacatttctatctccccaa

SEQ ID NO: 5140 - DNA, 20 bp, Artificial Sequence
  chemically synthesized
ttgatttttgataagggtgc

SEQ ID NO: 5141 - DNA, 20 bp, Artificial Sequence
  chemically synthesized
tctatctggggccctgattc

SEQ ID NO: 5142 - DNA, 20 bp, Artificial Sequence
  chemically synthesized
gatatataaccaaaagaaat

SEQ ID NO: 5143 - DNA, 20 bp, Artificial Sequence
  chemically synthesized
atcaaaacataagtctacaa

SEQ ID NO: 5144 - DNA, 20 bp, Artificial Sequence
  chemically synthesized
atagatattattggtccatg

SEQ ID NO: 5145 - DNA, 20 bp, Artificial Sequence
  chemically synthesized
ggtccatgaaaaacatacat

SEQ ID NO: 5146 - DNA, 20 bp, Artificial Sequence
  chemically synthesized
gcctcccagggatggggggg

SEQ ID NO: 5147 - DNA, 20 bp, Artificial Sequence
  chemically synthesized
gacttaattaatttgaatca

SEQ ID NO: 5148 - DNA, 20 bp, Artificial Sequence
  chemically synthesized
acaacaccccttcaggattt

SEQ ID NO: 5149 - DNA, 20 bp, Artificial Sequence
  chemically synthesized
gaccagcctgggcaacacag

SEQ ID NO: 5150 - DNA, 20 bp, Artificial Sequence
  chemically synthesized
aaaaaaaaaaaaaaaaaaaa

SEQ ID NO: 5151 - DNA, 20 bp, Artificial Sequence
  chemically synthesized
gactcactgtgggaaggaga

SEQ ID NO: 5152 - DNA, 20 bp, Artificial Sequence
  chemically synthesized
tcacatgaaggggaacagca

SEQ ID NO: 5153 - DNA, 20 bp, Artificial Sequence
  chemically synthesized
tgttatttaattagccagtg

SEQ ID NO: 5154 - DNA, 20 bp, Artificial Sequence
  chemically synthesized
aaattcttattcacctctgg

SEQ ID NO: 5155 - DNA, 20 bp, Artificial Sequence
  chemically synthesized
aaaagcccctgaaaatttga

SEQ ID NO: 5156 - DNA, 20 bp, Artificial Sequence
  chemically synthesized
aactgggaacacaacagaag

SEQ ID NO: 5157 - DNA, 20 bp, Artificial Sequence
  chemically synthesized
ataatactgtcagtatttta

SEQ ID NO: 5158 - DNA, 20 bp, Artificial Sequence
  chemically synthesized
tcacaaactcacacacattt

SEQ ID NO: 5159 - DNA, 20 bp, Artificial Sequence
  chemically synthesized
aactcacacacatttaaaaa

SEQ ID NO: 5160 - DNA, 20 bp, Artificial Sequence
  chemically synthesized
tccatggcagaaatcttttc

SEQ ID NO: 5161 - DNA, 20 bp, Artificial Sequence
  chemically synthesized
aatatccttgatttattcct

SEQ ID NO: 5162 - DNA, 20 bp, Artificial Sequence
  chemically synthesized
ccggctgaatggcactttca

SEQ ID NO: 5163 - DNA, 20 bp, Artificial Sequence
  chemically synthesized
tgggttcacaatttcatcat

SEQ ID NO: 5164 - DNA, 20 bp, Artificial Sequence
  chemically synthesized
aagagcgaaactccatctca

SEQ ID NO: 5165 - DNA, 20 bp, Artificial Sequence
  chemically synthesized
cgaaactccatctcaaaaaa

SEQ ID NO: 5166 - DNA, 20 bp, Artificial Sequence
  chemically synthesized
gcctaggaagtgcaagtcaa

SEQ ID NO: 5167 - DNA, 20 bp, Artificial Sequence
  chemically synthesized
gtaaggagtggaggtaaaaa

SEQ ID NO: 5168 - DNA, 20 bp, Artificial Sequence
  chemically synthesized
gaacccaaacttacacaaag

SEQ ID NO: 5169 - DNA, 20 bp, Artificial Sequence
  chemically synthesized
cgtaacattatacccatact

SEQ ID NO: 5170 - DNA, 20 bp, Artificial Sequence
  chemically synthesized
agatgccctcatatacatag

SEQ ID NO: 5171 - DNA, 20 bp, Artificial Sequence
  chemically synthesized
cgagctccgtctcgaaaaaa

SEQ ID NO: 5172 - DNA, 20 bp, Artificial Sequence
  chemically synthesized
agaccctgtctcaacaacaa

SEQ ID NO: 5173 - DNA, 20 bp, Artificial Sequence
  chemically synthesized
ttaggagtgctgctgttcct

SEQ ID NO: 5174 - DNA, 20 bp, Artificial Sequence
  chemically synthesized
ttgaaaagatttctgccatg

SEQ ID NO: 5175 - DNA, 20 bp, Artificial Sequence
  chemically synthesized
ggtttgaaaaaaagttagtt

SEQ ID NO: 5176 - DNA, 20 bp, Artificial Sequence
  chemically synthesized
ctttattcctttaccttcag

SEQ ID NO: 5177 - DNA, 20 bp, Artificial Sequence
  chemically synthesized
agccagaaaaattaagctta

SEQ ID NO: 5178 - DNA, 20 bp, Artificial Sequence
  chemically synthesized
aaatctcagcccaggtgaaa

SEQ ID NO: 5179 - DNA, 20 bp, Artificial Sequence
  chemically synthesized
caggtgaaataaaaccaata

SEQ ID NO: 5180 - DNA, 20 bp, Artificial Sequence
  chemically synthesized
acaccttcatgccaattaga

SEQ ID NO: 5181 - DNA, 20 bp, Artificial Sequence
  chemically synthesized
atatttgcctcctacctgct

SEQ ID NO: 5182 - DNA, 20 bp, Artificial Sequence
  chemically synthesized
ccaatgaacaagatgacgac

SEQ ID NO: 5183 - DNA, 20 bp, Artificial Sequence
  chemically synthesized
gtgccagacggtgagggctc

SEQ ID NO: 5184 - DNA, 20 bp, Artificial Sequence
  chemically synthesized
aggaaatacccttttcagaa

SEQ ID NO: 5185 - DNA, 20 bp, Artificial Sequence
  chemically synthesized
tccaccataccttgttggtc

SEQ ID NO: 5186 - DNA, 20 bp, Artificial Sequence
  chemically synthesized
ttctcctacctaagcctcct

SEQ ID NO: 5187 - DNA, 20 bp, Artificial Sequence
  chemically synthesized
acacacatgagtagtgctga

SEQ ID NO: 5188 - DNA, 20 bp, Artificial Sequence
  chemically synthesized
aatgtggatacacgtagtac

SEQ ID NO: 5189 - DNA, 20 bp, Artificial Sequence
  chemically synthesized
tagtacttgaaataacatca

SEQ ID NO: 5190 - DNA, 20 bp, Artificial Sequence
  chemically synthesized
aattgttcagttcaaacgtt

SEQ ID NO: 5191 - DNA, 20 bp, Artificial Sequence
  chemically synthesized
tgtttggagatgactgggga

SEQ ID NO: 5192 - DNA, 20 bp, Artificial Sequence
  chemically synthesized
taggctcaggagatgcccag

SEQ ID NO: 5193 - DNA, 20 bp, Artificial Sequence
  chemically synthesized
tggcaggtacctgtaatccc

SEQ ID NO: 5194 - DNA, 20 bp, Artificial Sequence
  chemically synthesized
ttgggaggctgaggcaggag

SEQ ID NO: 5195 - DNA, 20 bp, Artificial Sequence
  chemically synthesized
ctgggaggaggagccagtgg

SEQ ID NO: 5196 - DNA, 20 bp, Artificial Sequence
  chemically synthesized
tctgtcaaaaaaaaaaaaag

SEQ ID NO: 5197 - DNA, 20 bp, Artificial Sequence
  chemically synthesized
aaaaaaaaaaaagataggat

SEQ ID NO: 5198 - DNA, 20 bp, Artificial Sequence
  chemically synthesized
aaataaactctcacatttat

SEQ ID NO: 5199 - DNA, 20 bp, Artificial Sequence
  chemically synthesized
aaactctcacatttatggta

SEQ ID NO: 5200 - DNA, 20 bp, Artificial Sequence
  chemically synthesized
catttttgttctatctgggg

SEQ ID NO: 5201 - DNA, 20 bp, Artificial Sequence
  chemically synthesized
acactgctgataggaggata

SEQ ID NO: 5202 - DNA, 20 bp, Artificial Sequence
  chemically synthesized
ctacaaaaaaacttgtacat

SEQ ID NO: 5203 - DNA, 20 bp, Artificial Sequence
  chemically synthesized
aatgttccaaatagaaagaa

SEQ ID NO: 5204 - DNA, 20 bp, Artificial Sequence
  chemically synthesized
caaatagaaagaaagtagat

SEQ ID NO: 5205 - DNA, 20 bp, Artificial Sequence
  chemically synthesized
agggtactgaattaggggaa

SEQ ID NO: 5206 - DNA, 20 bp, Artificial Sequence
  chemically synthesized
tatttattttatttttgaga

SEQ ID NO: 5207 - DNA, 20 bp, Artificial Sequence
  chemically synthesized
aacctccgcctcccaggttc

SEQ ID NO: 5208 - DNA, 20 bp, Artificial Sequence
  chemically synthesized
ggttcaagcgattctcctgt

SEQ ID NO: 5209 - DNA, 20 bp, Artificial Sequence
  chemically synthesized
aacctacgcctcccgggttc

SEQ ID NO: 5210 - DNA, 20 bp, Artificial Sequence
  chemically synthesized
tgcctcagcctctaatgtag

SEQ ID NO: 5211 - DNA, 20 bp, Artificial Sequence
  chemically synthesized
ttttgtatttttagtaaaga

SEQ ID NO: 5212 - DNA, 20 bp, Artificial Sequence
  chemically synthesized
ttcctcggccgcccaaagtg

SEQ ID NO: 5213 - DNA, 20 bp, Artificial Sequence
  chemically synthesized
gtgcccatcatcaatattct

SEQ ID NO: 5214 - DNA, 20 bp, Artificial Sequence
  chemically synthesized
catgtttccaatgttattgt

SEQ ID NO: 5215 - DNA, 20 bp, Artificial Sequence
  chemically synthesized
ctacagtcgaggccctgata

SEQ ID NO: 5216 - DNA, 20 bp, Artificial Sequence
  chemically synthesized
agtcgaggccctgatatcct

SEQ ID NO: 5217 - DNA, 20 bp, Artificial Sequence
  chemically synthesized
tgaattgccaaaatttgcat

SEQ ID NO: 5218 - DNA, 20 bp, Artificial Sequence
  chemically synthesized
gttgaatttgctagatatgt

SEQ ID NO: 5219 - DNA, 20 bp, Artificial Sequence
  chemically synthesized
aggtgtattaaatttattaa

SEQ ID NO: 5220 - DNA, 20 bp, Artificial Sequence
  chemically synthesized
aaacttcgttgagggagaag

SEQ ID NO: 5221 - DNA, 20 bp, Artificial Sequence
  chemically synthesized
tgggatggatcctttaaccg

SEQ ID NO: 5222 - DNA, 20 bp, Artificial Sequence
  chemically synthesized
ctacaaactaacaccaaaat

SEQ ID NO: 5223 - DNA, 20 bp, Artificial Sequence
  chemically synthesized
accaaaatgcaagcttaaag

SEQ ID NO: 5224 - DNA, 20 bp, Artificial Sequence
  chemically synthesized
ataatacactctgagggaca

SEQ ID NO: 5225 - DNA, 20 bp, Artificial Sequence
  chemically synthesized
gcacttctttacagagctca

SEQ ID NO: 5226 - DNA, 20 bp, Artificial Sequence
  chemically synthesized
cagagctcaaggtgctttta

SEQ ID NO: 5227 - DNA, 20 bp, Artificial Sequence
  chemically synthesized
tggggtttgtggggaggagt

SEQ ID NO: 5228 - DNA, 20 bp, Artificial Sequence
  chemically synthesized
ctgagtgacaggatgatgtt

SEQ ID NO: 5229 - DNA, 20 bp, Artificial Sequence
  chemically synthesized
aacttggggtgaacttgaag

SEQ ID NO: 5230 - DNA, 20 bp, Artificial Sequence
  chemically synthesized
ggggttaggagcaggcctca

SEQ ID NO: 5231 - DNA, 20 bp, Artificial Sequence
  chemically synthesized
tccagataatcccaatactg

SEQ ID NO: 5232 - DNA, 20 bp, Artificial Sequence
  chemically synthesized
tcaattatgaaggctgtgga

SEQ ID NO: 5233 - DNA, 20 bp, Artificial Sequence
  chemically synthesized
tgaatcaaaaaacaaaatga

SEQ ID NO: 5234 - DNA, 20 bp, Artificial Sequence
  chemically synthesized
ttgagataaaatttttaaat

SEQ ID NO: 5235 - DNA, 20 bp, Artificial Sequence
  chemically synthesized
ccccaatcaacaacacccct

SEQ ID NO: 5236 - DNA, 20 bp, Artificial Sequence
  chemically synthesized
aagggggacactggatcacc

SEQ ID NO: 5237 - DNA, 20 bp, Artificial Sequence
  chemically synthesized
aactaaagttctgaaagacc

SEQ ID NO: 5238 - DNA, 20 bp, Artificial Sequence
  chemically synthesized
agacctgttgcttttcacca

SEQ ID NO: 5239 - DNA, 20 bp, Artificial Sequence
  chemically synthesized
agggtgacttctggagccat

SEQ ID NO: 5240 - DNA, 20 bp, Artificial Sequence
  chemically synthesized
tccccgccccccaaaagaag

SEQ ID NO: 5241 - DNA, 20 bp, Artificial Sequence
  chemically synthesized
aatgggcccgcgagccaggc

SEQ ID NO: 5242 - DNA, 20 bp, Artificial Sequence
  chemically synthesized
caggccggcgcttctcctcc

SEQ ID NO: 5243 - DNA, 20 bp, Artificial Sequence
  chemically synthesized
tgcagaccgcggtcctgcag

SEQ ID NO: 5244 - DNA, 20 bp, Artificial Sequence
  chemically synthesized
gcgggggtggaaaaatcgaa

SEQ ID NO: 5245 - DNA, 20 bp, Artificial Sequence
  chemically synthesized
aatcgaaactagctttttct

SEQ ID NO: 5246 - DNA, 20 bp, Artificial Sequence
  chemically synthesized
ctagctttttctttgcgctt

SEQ ID NO: 5247 - DNA, 20 bp, Artificial Sequence
  chemically synthesized
ccactcccttcccccaacta

SEQ ID NO: 5248 - DNA, 20 bp, Artificial Sequence
  chemically synthesized
gggctccttgaacctggaac

SEQ ID NO: 5249 - DNA, 20 bp, Artificial Sequence
  chemically synthesized
tttatttccaatgtcagctg

SEQ ID NO: 5250 - DNA, 20 bp, Artificial Sequence
  chemically synthesized
caaacaggaagttcttccct

SEQ ID NO: 5251 - DNA, 20 bp, Artificial Sequence
  chemically synthesized
aacccacagcaggatccgca

SEQ ID NO: 5252 - DNA, 20 bp, Artificial Sequence
  chemically synthesized
gcctggaaaattaagtatat

SEQ ID NO: 5253 - DNA, 20 bp, Artificial Sequence
  chemically synthesized
attaagtatatgttagtttt

SEQ ID NO: 5254 - DNA, 20 bp, Artificial Sequence
  chemically synthesized
ctgaacaattctcttttcgg

SEQ ID NO: 5255 - DNA, 20 bp, Artificial Sequence
  chemically synthesized
ttctcttttcggctaggctt

SEQ ID NO: 5256 - DNA, 20 bp, Artificial Sequence
  chemically synthesized
ttacattcatatctgatctt

SEQ ID NO: 5257 - DNA, 20 bp, Artificial Sequence
  chemically synthesized
tagggaggtaggagctaata

SEQ ID NO: 5258 - DNA, 20 bp, Artificial Sequence
  chemically synthesized
ttactagaagttaactggaa

SEQ ID NO: 5259 - DNA, 20 bp, Artificial Sequence
  chemically synthesized
gttacaaagaacataaataa

SEQ ID NO: 5260 - DNA, 20 bp, Artificial Sequence
  chemically synthesized
gatgttatttcaagtactac

SEQ ID NO: 5261 - DNA, 20 bp, Artificial Sequence
  chemically synthesized
ctgcttctaatcttagttga

SEQ ID NO: 5262 - DNA, 20 bp, Artificial Sequence
  chemically synthesized
gccggcctcagcacagcact

SEQ ID NO: 5263 - DNA, 20 bp, Artificial Sequence
  chemically synthesized
caagaatgaggcatggcacg

SEQ ID NO: 5264 - DNA, 20 bp, Artificial Sequence
  chemically synthesized
caaatttattcaatggtaca

SEQ ID NO: 5265 - DNA, 20 bp, Artificial Sequence
  chemically synthesized
ctcatgtctccacttcatag

SEQ ID NO: 5266 - DNA, 20 bp, Artificial Sequence
  chemically synthesized
tcatgttgagcagaaatatt

SEQ ID NO: 5267 - DNA, 20 bp, Artificial Sequence
  chemically synthesized
aaactgagtgggcctggcaa

SEQ ID NO: 5268 - DNA, 20 bp, Artificial Sequence
  chemically synthesized
ctggcaagttggattaaaaa

SEQ ID NO: 5269 - DNA, 20 bp, Artificial Sequence
  chemically synthesized
aggagtaacagtgatctgtc

SEQ ID NO: 5270 - DNA, 20 bp, Artificial Sequence
  chemically synthesized
gtgatctgtcacaggctttt

SEQ ID NO: 5271 - DNA, 20 bp, Artificial Sequence
  chemically synthesized
atattctgaaggaagttgct

SEQ ID NO: 5272 - DNA, 20 bp, Artificial Sequence
  chemically synthesized
ccaaggaggaggccaaggag

SEQ ID NO: 5273 - DNA, 20 bp, Artificial Sequence
  chemically synthesized
cgggaggctgaggtggaggg

SEQ ID NO: 5274 - DNA, 20 bp, Artificial Sequence
  chemically synthesized
atggtgaaggcagaggaaag

SEQ ID NO: 5275 - DNA, 20 bp, Artificial Sequence
  chemically synthesized
aggatctgcatttggacatg

SEQ ID NO: 5276 - DNA, 20 bp, Artificial Sequence
  chemically synthesized
tgcatttggacatgttaagt

SEQ ID NO: 5277 - DNA, 20 bp, Artificial Sequence
  chemically synthesized
tgttaagtttgagattccag

SEQ ID NO: 5278 - DNA, 20 bp, Artificial Sequence
  chemically synthesized
caggtagatcatttgaggtc

SEQ ID NO: 5279 - DNA, 20 bp, Artificial Sequence
  chemically synthesized
tttgaggtcaggagtttgag

SEQ ID NO: 5280 - DNA, 20 bp, Artificial Sequence
  chemically synthesized
ggtggcgcacgcctatagtc

SEQ ID NO: 5281 - DNA, 20 bp, Artificial Sequence
  chemically synthesized
cctatagtcccaggttttca

SEQ ID NO: 5282 - DNA, 20 bp, Artificial Sequence
  chemically synthesized
gaggtgcaggttgcagtgag

SEQ ID NO: 5283 - DNA, 20 bp, Artificial Sequence
  chemically synthesized
aaaactgaaggaattattcc

SEQ ID NO: 5284 - DNA, 20 bp, Artificial Sequence
  chemically synthesized
cttaacattttctagaatcc

SEQ ID NO: 5285 - DNA, 20 bp, Artificial Sequence
  chemically synthesized
agagcaggaccttggtcttt

SEQ ID NO: 5286 - DNA, 20 bp, Artificial Sequence
  chemically synthesized
gaccttggtctttccttgtt

SEQ ID NO: 5287 - DNA, 20 bp, Artificial Sequence
  chemically synthesized
cgtgtggagccccgaactcc

SEQ ID NO: 5288 - DNA, 20 bp, Artificial Sequence
  chemically synthesized
cctcaccttcctgaggttgt

SEQ ID NO: 5289 - DNA, 20 bp, Artificial Sequence
  chemically synthesized
gagcagggaagagggaagga

SEQ ID NO: 5290 - DNA, 20 bp, Artificial Sequence
  chemically synthesized
ttggttgcagttaacaaggc

SEQ ID NO: 5291 - DNA, 20 bp, Artificial Sequence
  chemically synthesized
cttgaattctgccctgacac

SEQ ID NO: 5292 - DNA, 20 bp, Artificial Sequence
  chemically synthesized
caagctggagtgggaaaggc

SEQ ID NO: 5293 - DNA, 20 bp, Artificial Sequence
  chemically synthesized
cagttgctggagctggggag

SEQ ID NO: 5294 - DNA, 20 bp, Artificial Sequence
  chemically synthesized
cagggcacggaatccctggt

SEQ ID NO: 5295 - DNA, 20 bp, Artificial Sequence
  chemically synthesized
gtatgagacagccacaagtc

SEQ ID NO: 5296 - DNA, 20 bp, Artificial Sequence
  chemically synthesized
caaagggaagtgtctatggc

SEQ ID NO: 5297 - DNA, 20 bp, Artificial Sequence
  chemically synthesized
aggcgggtggtcacaaggtc

SEQ ID NO: 5298 - DNA, 20 bp, Artificial Sequence
  chemically synthesized
ttggaaggctgaggcaggag

SEQ ID NO: 5299 - DNA, 20 bp, Artificial Sequence
  chemically synthesized
gtagaagaatcctttaggtt

SEQ ID NO: 5300 - DNA, 20 bp, Artificial Sequence
  chemically synthesized
tgaagctacctatcttacaa

SEQ ID NO: 5301 - DNA, 20 bp, Artificial Sequence
  chemically synthesized
acacaaaatggtgtctctcc

SEQ ID NO: 5302 - DNA, 20 bp, Artificial Sequence
  chemically synthesized
aaaatggtgtctctcctgta

SEQ ID NO: 5303 - DNA, 20 bp, Artificial Sequence
  chemically synthesized
gtgggctgagggtggcaatc

SEQ ID NO: 5304 - DNA, 20 bp, Artificial Sequence
  chemically synthesized
ggtggcaatcaaaggcttta

SEQ ID NO: 5305 - DNA, 20 bp, Artificial Sequence
  chemically synthesized
caaaggctttaacttgcttt

SEQ ID NO: 5306 - DNA, 20 bp, Artificial Sequence
  chemically synthesized
attggagtcatcagtggaat

SEQ ID NO: 5307 - DNA, 20 bp, Artificial Sequence
  chemically synthesized
agcacctactattttgcaag

SEQ ID NO: 5308 - DNA, 20 bp, Artificial Sequence
  chemically synthesized
agagctgtttaaggtagtac

SEQ ID NO: 5309 - DNA, 20 bp, Artificial Sequence
  chemically synthesized
tcctaaagcaggcaggaagc

SEQ ID NO: 5310 - DNA, 20 bp, Artificial Sequence
  chemically synthesized
ttctggatcttgaaggagaa

SEQ ID NO: 5311 - DNA, 20 bp, Artificial Sequence
  chemically synthesized
aggagagtataaggcatact

SEQ ID NO: 5312 - DNA, 20 bp, Artificial Sequence
  chemically synthesized
ataattactgtaccttaacc

SEQ ID NO: 5313 - DNA, 20 bp, Artificial Sequence
  chemically synthesized
gagaagaggcaagatggtgc

SEQ ID NO: 5314 - DNA, 20 bp, Artificial Sequence
  chemically synthesized
ggagtgcatttatgagctct

SEQ ID NO: 5315 - DNA, 20 bp, Artificial Sequence
  chemically synthesized
tagaaattgcctgacgaact

SEQ ID NO: 5316 - DNA, 20 bp, Artificial Sequence
  chemically synthesized
cttctctgttcatttcctca

SEQ ID NO: 5317 - DNA, 20 bp, Artificial Sequence
  chemically synthesized
cctcaaaaagatttccccat

SEQ ID NO: 5318 - DNA, 20 bp, Artificial Sequence
  chemically synthesized
atgaacctcaagctgcatct

SEQ ID NO: 5319 - DNA, 20 bp, Artificial Sequence
  chemically synthesized
tccttaaatttgggggactt

SEQ ID NO: 5320 - DNA, 20 bp, Artificial Sequence
  chemically synthesized
gattcattttaacatctgag

SEQ ID NO: 5321 - DNA, 20 bp, Artificial Sequence
  chemically synthesized
acgtggctagtcataacctt

SEQ ID NO: 5322 - DNA, 20 bp, Artificial Sequence
  chemically synthesized
actcatctgtcaccaagcct

SEQ ID NO: 5323 - DNA, 20 bp, Artificial Sequence
  chemically synthesized
caagccttggggattcttcc

SEQ ID NO: 5324 - DNA, 20 bp, Artificial Sequence
  chemically synthesized
ctatctgtgggtagtatgat

SEQ ID NO: 5325 - DNA, 20 bp, Artificial Sequence
  chemically synthesized
tcttgaaaggggttgtgaag

SEQ ID NO: 5326 - DNA, 20 bp, Artificial Sequence
  chemically synthesized
taattggcatgaaggtgtca

SEQ ID NO: 5327 - DNA, 20 bp, Artificial Sequence
  chemically synthesized
gaaggtgtcatacagatttg

SEQ ID NO: 5328 - DNA, 20 bp, Artificial Sequence
  chemically synthesized
aatggcatgaacccaggagg

SEQ ID NO: 5329 - DNA, 20 bp, Artificial Sequence
  chemically synthesized
gaggcagagcttgcagtgag

SEQ ID NO: 5330 - DNA, 20 bp, Artificial Sequence
  chemically synthesized
aagtgaagtatagagtatct

SEQ ID NO: 5331 - DNA, 20 bp, Artificial Sequence
  chemically synthesized
atagtttgtcagtgatagaa

SEQ ID NO: 5332 - DNA, 20 bp, Artificial Sequence
  chemically synthesized
gtttcaaactcagtcaatct

SEQ ID NO: 5333 - DNA, 20 bp, Artificial Sequence
  chemically synthesized
tctcagacaccactacattc

SEQ ID NO: 5334 - DNA, 20 bp, Artificial Sequence
  chemically synthesized
atggctcttctcttgtctca

SEQ ID NO: 5335 - DNA, 20 bp, Artificial Sequence
  chemically synthesized
tctcattgtgtttcttctga

SEQ ID NO: 5336 - DNA, 20 bp, Artificial Sequence
  chemically synthesized
aaccaactgatcctcagctg

SEQ ID NO: 5337 - DNA, 20 bp, Artificial Sequence
  chemically synthesized
ggggacagctagtggccctg

SEQ ID NO: 5338 - DNA, 20 bp, Artificial Sequence
  chemically synthesized
tggtataatggaagccacca

SEQ ID NO: 5339 - DNA, 20 bp, Artificial Sequence
  chemically synthesized
aaccaggacattcaggaatt

SEQ ID NO: 5340 - DNA, 20 bp, Artificial Sequence
  chemically synthesized
aacctctgcctcccaggttc

SEQ ID NO: 5341 - DNA, 20 bp, Artificial Sequence
  chemically synthesized
tgtctcagcctcccaagtag

SEQ ID NO: 5342 - DNA, 20 bp, Artificial Sequence
  chemically synthesized
ttttgtatttttagtagaga

SEQ ID NO: 5343 - DNA, 20 bp, Artificial Sequence
  chemically synthesized
tgcctcggcctcccaaagtg

SEQ ID NO: 5344 - DNA, 20 bp, Artificial Sequence
  chemically synthesized
aatatatatatccagatggc

SEQ ID NO: 5345 - DNA, 20 bp, Artificial Sequence
  chemically synthesized
agcattctgtcttgaagggc

SEQ ID NO: 5346 - DNA, 20 bp, Artificial Sequence
  chemically synthesized
caggataccatatacagctc

SEQ ID NO: 5347 - DNA, 20 bp, Artificial Sequence
  chemically synthesized
agttatgtagaaaaaagtaa

SEQ ID NO: 5348 - DNA, 20 bp, Artificial Sequence
  chemically synthesized
tgtatattgtattgtatact

SEQ ID NO: 5349 - DNA, 20 bp, Artificial Sequence
  chemically synthesized
ttcatcttgtgtatatactt

SEQ ID NO: 5350 - DNA, 20 bp, Artificial Sequence
  chemically synthesized
tgtcattttggagacattta

SEQ ID NO: 5351 - DNA, 20 bp, Artificial Sequence
  chemically synthesized
aactgtggtagccgaattaa

SEQ ID NO: 5352 - DNA, 20 bp, Artificial Sequence
  chemically synthesized
atactgaaagcagactgcta

SEQ ID NO: 5353 - DNA, 20 bp, Artificial Sequence
  chemically synthesized
aattaatttattaggtaagc

SEQ ID NO: 5354 - DNA, 20 bp, Artificial Sequence
  chemically synthesized
taggtaagcatttgttttat

SEQ ID NO: 5355 - DNA, 20 bp, Artificial Sequence
  chemically synthesized
ttggttttatttcacctggg

SEQ ID NO: 5356 - DNA, 20 bp, Artificial Sequence
  chemically synthesized
tttaagtcctcattttcttt

SEQ ID NO: 5357 - DNA, 20 bp, Artificial Sequence
  chemically synthesized
tcattttctttcggtgtttt

SEQ ID NO: 5358 - DNA, 20 bp, Artificial Sequence
  chemically synthesized
tgttttttaagcttaatttt

SEQ ID NO: 5359 - DNA, 20 bp, Artificial Sequence
  chemically synthesized
gtgaccagagatgcagcgct

SEQ ID NO: 5360 - DNA, 20 bp, Artificial Sequence
  chemically synthesized
atcattgagtcaagtacagc

SEQ ID NO: 5361 - DNA, 20 bp, Artificial Sequence
  chemically synthesized
atccccaaatttttcataaa

SEQ ID NO: 5362 - DNA, 20 bp, Artificial Sequence
  chemically synthesized
taactttttttcaaaccaca

SEQ ID NO: 5363 - DNA, 20 bp, Artificial Sequence
  chemically synthesized
aatatttctgactttcaaat

SEQ ID NO: 5364 - DNA, 20 bp, Artificial Sequence
  chemically synthesized
atgcaggctgatatttgtaa

SEQ ID NO: 5365 - DNA, 20 bp, Artificial Sequence
  chemically synthesized
ttgtaattgtgattctctct

SEQ ID NO: 5366 - DNA, 20 bp, Artificial Sequence
  chemically synthesized
gttcttttccttttttgcat

SEQ ID NO: 5367 - DNA, 20 bp, Artificial Sequence
  chemically synthesized
caagcattctatttctgagt

SEQ ID NO: 5368 - DNA, 20 bp, Artificial Sequence
  chemically synthesized
ggtgtagaagagatagatat

SEQ ID NO: 5369 - DNA, 20 bp, Artificial Sequence
  chemically synthesized
gatggatgaatttgtacatt

SEQ ID NO: 5370 - DNA, 20 bp, Artificial Sequence
  chemically synthesized
caaaaactttttttttccgg

SEQ ID NO: 5371 - DNA, 20 bp, Artificial Sequence
  chemically synthesized
tttccgggatggattgaagg

SEQ ID NO: 5372 - DNA, 20 bp, Artificial Sequence
  chemically synthesized
gagctattgctgctattctg

SEQ ID NO: 5373 - DNA, 20 bp, Artificial Sequence
  chemically synthesized
cttgctgaagaaaatgatgt

SEQ ID NO: 5374 - DNA, 20 bp, Artificial Sequence
  chemically synthesized
atacggtgtggcaacagtta

SEQ ID NO: 5375 - DNA, 20 bp, Artificial Sequence
  chemically synthesized
tttaggaacagcagcactcc

SEQ ID NO: 5376 - DNA, 20 bp, Artificial Sequence
  chemically synthesized
ttttgtatttttagtagaga

SEQ ID NO: 5377 - DNA, 20 bp, Artificial Sequence
  chemically synthesized
ctttttggcctcccaaagtg

SEQ ID NO: 5378 - DNA, 20 bp, Artificial Sequence
  chemically synthesized
cgcgcccagccaaatttcta

SEQ ID NO: 5379 - DNA, 20 bp, Artificial Sequence
  chemically synthesized
tccacccacctcagcgtccg

SEQ ID NO: 5380 - DNA, 20 bp, Artificial Sequence
  chemically synthesized
tccaccaagttattttatac

SEQ ID NO: 5381 - DNA, 20 bp, Artificial Sequence
  chemically synthesized
attatttaaaaaaatcaaat

SEQ ID NO: 5382 - DNA, 20 bp, Artificial Sequence
  chemically synthesized
tcaaattctagcttttactc

SEQ ID NO: 5383 - DNA, 20 bp, Artificial Sequence
  chemically synthesized
tagtctattgagttaaatat

SEQ ID NO: 5384 - DNA, 20 bp, Artificial Sequence
  chemically synthesized
gagtcactatgacggcactt

SEQ ID NO: 5385 - DNA, 20 bp, Artificial Sequence
  chemically synthesized
aatctccgcctcccaggttc

SEQ ID NO: 5386 - DNA, 20 bp, Artificial Sequence
  chemically synthesized
cacacaccaccacgcccagc

SEQ ID NO: 5387 - DNA, 20 bp, Artificial Sequence
  chemically synthesized
gtttgtatttttagtagaga

SEQ ID NO: 5388 - DNA, 20 bp, Artificial Sequence
  chemically synthesized
tgcctcgacctcccaaagtg

SEQ ID NO: 5389 - DNA, 20 bp, Artificial Sequence
  chemically synthesized
ccaacttcactactgccccc

SEQ ID NO: 5390 - DNA, 20 bp, Artificial Sequence
  chemically synthesized
tttactatgtatatgagggc

SEQ ID NO: 5391 - DNA, 20 bp, Artificial Sequence
  chemically synthesized
ttaagtatgggtataatgtt

SEQ ID NO: 5392 - DNA, 20 bp, Artificial Sequence
  chemically synthesized
tgttacgggtttttctttgt

SEQ ID NO: 5393 - DNA, 20 bp, Artificial Sequence
  chemically synthesized
taaaacaaatgtaaaatact

SEQ ID NO: 5394 - DNA, 20 bp, Artificial Sequence
  chemically synthesized
aaaatcaaatttaattactc

SEQ ID NO: 5395 - DNA, 20 bp, Artificial Sequence
  chemically synthesized
gtttgtaaaatttttgaaac

SEQ ID NO: 5396 - DNA, 20 bp, Artificial Sequence
  chemically synthesized
tcgggaggctgaggcaggag

SEQ ID NO: 5397 - DNA, 20 bp, Artificial Sequence
  chemically synthesized
aacaaatcgaagtgtattaa

SEQ ID NO: 5398 - DNA, 20 bp, Artificial Sequence
  chemically synthesized
tttaaactgaaaagaaaaag

SEQ ID NO: 5399 - DNA, 20 bp, Artificial Sequence
  chemically synthesized
aaaggtgtgccaatggtact

SEQ ID NO: 5400 - DNA, 20 bp, Artificial Sequence
  chemically synthesized
cttatttaaaaatatccatt

SEQ ID NO: 5401 - DNA, 20 bp, Artificial Sequence
  chemically synthesized
gtagcatacctgtgtctctg

SEQ ID NO: 5402 - DNA, 20 bp, Artificial Sequence
  chemically synthesized
ttacttttctagaaaaaaat

SEQ ID NO: 5403 - DNA, 20 bp, Artificial Sequence
  chemically synthesized
aaaaatctctgctttttctt

SEQ ID NO: 5404 - DNA, 20 bp, Artificial Sequence
  chemically synthesized
tcagtttaaattatttcaca

SEQ ID NO: 5405 - DNA, 20 bp, Artificial Sequence
  chemically synthesized
gttttcttgacttgcacttc

SEQ ID NO: 5406 - DNA, 20 bp, Artificial Sequence
  chemically synthesized
ccataaacactattaataca

SEQ ID NO: 5407 - DNA, 20 bp, Artificial Sequence
  chemically synthesized
agaaaatttcttttcttttt

SEQ ID NO: 5408 - DNA, 20 bp, Artificial Sequence
  chemically synthesized
ttttaagattttaaaatttt

SEQ ID NO: 5409 - DNA, 20 bp, Artificial Sequence
  chemically synthesized
gcacaaccacacctgactaa

SEQ ID NO: 5410 - DNA, 20 bp, Artificial Sequence
  chemically synthesized
acacctgactaattttgttt

SEQ ID NO: 5411 - DNA, 20 bp, Artificial Sequence
  chemically synthesized
ctgactaattttgtttattt

SEQ ID NO: 5412 - DNA, 20 bp, Artificial Sequence
  chemically synthesized
taattttgtttatttgtttg

SEQ ID NO: 5413 - DNA, 20 bp, Artificial Sequence
  chemically synthesized
gtttgttttgttttttgaga

SEQ ID NO: 5414 - DNA, 20 bp, Artificial Sequence
  chemically synthesized
tgcctcagcctcccgagtag

SEQ ID NO: 5415 - DNA, 20 bp, Artificial Sequence
  chemically synthesized
ttttgtatttttagtagaga

SEQ ID NO: 5416 - DNA, 20 bp, Artificial Sequence
  chemically synthesized
cgcctcggcctcccaaagtg

SEQ ID NO: 5417 - DNA, 20 bp, Artificial Sequence
  chemically synthesized
attttgtatattttgtagag

SEQ ID NO: 5418 - DNA, 20 bp, Artificial Sequence
  chemically synthesized
tccaggctggtcttgaattc

SEQ ID NO: 5419 - DNA, 20 bp, Artificial Sequence
  chemically synthesized
caccttgtcctcccaaaatg

SEQ ID NO: 5420 - DNA, 20 bp, Artificial Sequence
  chemically synthesized
aacattatcctctcttaaac

SEQ ID NO: 5421 - DNA, 20 bp, Artificial Sequence
  chemically synthesized
acaaacatgagagtaattaa

SEQ ID NO: 5422 - DNA, 20 bp, Artificial Sequence
  chemically synthesized
gaaagcacaaagtattttac

SEQ ID NO: 5423 - DNA, 20 bp, Artificial Sequence
  chemically synthesized
cagtagtgaagttggttatt

SEQ ID NO: 5424 - DNA, 20 bp, Artificial Sequence
  chemically synthesized
tcaggaggctggggcaggag

SEQ ID NO: 5425 - DNA, 20 bp, Artificial Sequence
  chemically synthesized
aatcgcttgaacctgggagg

SEQ ID NO: 5426 - DNA, 20 bp, Artificial Sequence
  chemically synthesized
aaaaagtgccgtcatagtga

SEQ ID NO: 5427 - DNA, 20 bp, Artificial Sequence
  chemically synthesized
tcttcagagtaaaagctaga

SEQ ID NO: 5428 - DNA, 20 bp, Artificial Sequence
  chemically synthesized
gtataaaataacttggtgga

SEQ ID NO: 5429 - DNA, 20 bp, Artificial Sequence
  chemically synthesized
acctgggcaacatagccaga

SEQ ID NO: 5430 - DNA, 20 bp, Artificial Sequence
  chemically synthesized
ttgggaggctgaggcaggaa

SEQ ID NO: 5431 - DNA, 20 bp, Artificial Sequence
  chemically synthesized
ttatagggatcaggcaaatt

SEQ ID NO: 5432 - DNA, 20 bp, Artificial Sequence
  chemically synthesized
atggtaactgttgccacacc

SEQ ID NO: 5433 - DNA, 20 bp, Artificial Sequence
  chemically synthesized
gttaactaacctctctgtgc

SEQ ID NO: 5434 - DNA, 20 bp, Artificial Sequence
  chemically synthesized
caatagctcctacctacctc

SEQ ID NO: 5435 - DNA, 20 bp, Artificial Sequence
  chemically synthesized
gattctttggaggaattaaa

SEQ ID NO: 5436 - DNA, 20 bp, Artificial Sequence
  chemically synthesized
aattggctaaaaaaattttc

SEQ ID NO: 5437 - DNA, 20 bp, Artificial Sequence
  chemically synthesized
ttcaatccatcccggaaaaa

SEQ ID NO: 5438 - DNA, 20 bp, Artificial Sequence
  chemically synthesized
ccggaaaaaaaaagtttttg

SEQ ID NO: 5439 - DNA, 20 bp, Artificial Sequence
  chemically synthesized
taaacaattactcagaaata

SEQ ID NO: 5440 - DNA, 20 bp, Artificial Sequence
  chemically synthesized
atgcaggatgtcaacgcatc

SEQ ID NO: 5441 - DNA, 20 bp, Artificial Sequence
  chemically synthesized
taaatgatagtcattgttaa

SEQ ID NO: 5442 - DNA, 20 bp, Artificial Sequence
  chemically synthesized
tagtcattgttaaatcagat

SEQ ID NO: 5443 - DNA, 20 bp, Artificial Sequence
  chemically synthesized
agattgtggtttgaaaaaaa

SEQ ID NO: 5444 - DNA, 20 bp, Artificial Sequence
  chemically synthesized
gaaaaaaagttagtttaaaa

SEQ ID NO: 5445 - DNA, 20 bp, Artificial Sequence
  chemically synthesized
aactgagtttatgaaaaatt

SEQ ID NO: 5446 - DNA, 20 bp, Artificial Sequence
  chemically synthesized
aaatttggggattttagaga

SEQ ID NO: 5447 - DNA, 20 bp, Artificial Sequence
  chemically synthesized
tggggattttagagacagtg

SEQ ID NO: 5448 - DNA, 20 bp, Artificial Sequence
  chemically synthesized
tgttttgtttttaaatgtgt

SEQ ID NO: 5449 - DNA, 20 bp, Artificial Sequence
  chemically synthesized
aatgtgtgtgagtttgtgaa

SEQ ID NO: 5450 - DNA, 20 bp, Artificial Sequence
  chemically synthesized
atcacctgctgtacttgact

SEQ ID NO: 5451 - DNA, 20 bp, Artificial Sequence
  chemically synthesized
cttgactcaatgattatcag

SEQ ID NO: 5452 - DNA, 20 bp, Artificial Sequence
  chemically synthesized
actcaatgattatcagagtg

SEQ ID NO: 5453 - DNA, 20 bp, Artificial Sequence
  chemically synthesized
tcaggcagctcagcaatggc

SEQ ID NO: 5454 - DNA, 20 bp, Artificial Sequence
  chemically synthesized
agcaattcaaatagctggta

SEQ ID NO: 5455 - DNA, 20 bp, Artificial Sequence
  chemically synthesized
caaatagctggtaagtagtt

SEQ ID NO: 5456 - DNA, 20 bp, Artificial Sequence
  chemically synthesized
tagctggtaagtagtttctt

SEQ ID NO: 5457 - DNA, 20 bp, Artificial Sequence
  chemically synthesized
gtttgttttctcaaattttc

SEQ ID NO: 5458 - DNA, 20 bp, Artificial Sequence
  chemically synthesized
tttcaggggcttttctctac

SEQ ID NO: 5459 - DNA, 20 bp, Artificial Sequence
  chemically synthesized
gtcacccttctctttactac

SEQ ID NO: 5460 - DNA, 20 bp, Artificial Sequence
  chemically synthesized
ctttactaccatggtttgtg

SEQ ID NO: 5461 - DNA, 20 bp, Artificial Sequence
  chemically synthesized
taagaatttaaaatgcaggt

SEQ ID NO: 5462 - DNA, 20 bp, Artificial Sequence
  chemically synthesized
tatgaataaagccagaaaaa

SEQ ID NO: 5463 - DNA, 20 bp, Artificial Sequence
  chemically synthesized
aattaacaggccacagttgc

SEQ ID NO: 5464 - DNA, 20 bp, Artificial Sequence
  chemically synthesized
atgtgttactgtgaagactg

SEQ ID NO: 5465 - DNA, 20 bp, Artificial Sequence
  chemically synthesized
aaataaaaccaatataaaac

SEQ ID NO: 5466 - DNA, 20 bp, Artificial Sequence
  chemically synthesized
gtaagtgaagccttatagca

SEQ ID NO: 5467 - DNA, 20 bp, Artificial Sequence
  chemically synthesized
taagagagaaataatttgtc

SEQ ID NO: 5468 - DNA, 20 bp, Artificial Sequence
  chemically synthesized
aatttgtcatatgctttcag

SEQ ID NO: 5469 - DNA, 20 bp, Artificial Sequence
  chemically synthesized
aatgtccctagagtgaagaa

SEQ ID NO: 5470 - DNA, 20 bp, Artificial Sequence
  chemically synthesized
taaatgtctccaaaatgaca

SEQ ID NO: 5471 - DNA, 20 bp, Artificial Sequence
  chemically synthesized
caggtaatagacaagttgtt

SEQ ID NO: 5472 - DNA, 20 bp, Artificial Sequence
  chemically synthesized
ttttcactggctaattaaat

SEQ ID NO: 5473 - DNA, 20 bp, Artificial Sequence
  chemically synthesized
agctttaattgtattcattt

SEQ ID NO: 5474 - DNA, 20 bp, Artificial Sequence
  chemically synthesized
ttctaaccacaaaaaaagaa

SEQ ID NO: 5475 - DNA, 20 bp, Artificial Sequence
  chemically synthesized
agcacctgcccttcaagaca

SEQ ID NO: 5476 - DNA, 20 bp, Artificial Sequence
  chemically synthesized
ttgggaggctgagacaggag

SEQ ID NO: 5477 - DNA, 20 bp, Artificial Sequence
  chemically synthesized
agactcttttgaacatggtg

SEQ ID NO: 5478 - DNA, 20 bp, Artificial Sequence
  chemically synthesized
agcaattcctgaatgtcctg

SEQ ID NO: 5479 - DNA, 20 bp, Artificial Sequence
  chemically synthesized
gggcatcctctaagccactt

SEQ ID NO: 5480 - DNA, 20 bp, Artificial Sequence
  chemically synthesized
attataccatctcaaaatga

SEQ ID NO: 5481 - DNA, 20 bp, Artificial Sequence
  chemically synthesized
atgacagctgaggatcagtt

SEQ ID NO: 5482 - DNA, 20 bp, Artificial Sequence
  chemically synthesized
gttttctgctgttccccttc

SEQ ID NO: 5483 - DNA, 20 bp, Artificial Sequence
  chemically synthesized
tgtctgagatgtatcaaacg

SEQ ID NO: 5484 - DNA, 20 bp, Artificial Sequence
  chemically synthesized
gtatcaaacggtcagattga

SEQ ID NO: 5485 - DNA, 20 bp, Artificial Sequence
  chemically synthesized
tcagattgactgagtttgaa

SEQ ID NO: 5486 - DNA, 20 bp, Artificial Sequence
  chemically synthesized
ttttgtatttttattagaga

SEQ ID NO: 5487 - DNA, 20 bp, Artificial Sequence
  chemically synthesized
atctcctgacctcgtgatcc

SEQ ID NO: 5488 - DNA, 20 bp, Artificial Sequence
  chemically synthesized
cgctttggcctcccaaagtg

SEQ ID NO: 5489 - DNA, 20 bp, Artificial Sequence
  chemically synthesized
agaagagtcggacacgaagt

SEQ ID NO: 5490 - DNA, 20 bp, Artificial Sequence
  chemically synthesized
agagaccaggtagaaaatta

SEQ ID NO: 5491 - DNA, 20 bp, Artificial Sequence
  chemically synthesized
atactacccacagatagcca

SEQ ID NO: 5492 - DNA, 20 bp, Artificial Sequence
  chemically synthesized
caatcagatggaagaatccc

SEQ ID NO: 5493 - DNA, 20 bp, Artificial Sequence
  chemically synthesized
agttactgggtaacacagag

SEQ ID NO: 5494 - DNA, 20 bp, Artificial Sequence
  chemically synthesized
actagccacgtcccagggtt

SEQ ID NO: 5495 - DNA, 20 bp, Artificial Sequence
  chemically synthesized
aaatgaaggaagcctctaga

SEQ ID NO: 5496 - DNA, 20 bp, Artificial Sequence
  chemically synthesized
aggagttcgtcaggcaattt

SEQ ID NO: 5497 - DNA, 20 bp, Artificial Sequence
  chemically synthesized
atgcactccctctttgagtc

SEQ ID NO: 5498 - DNA, 20 bp, Artificial Sequence
  chemically synthesized
tcaatttagacctgggcact

SEQ ID NO: 5499 - DNA, 20 bp, Artificial Sequence
  chemically synthesized
aaccattatctctcatctgg

SEQ ID NO: 5500 - DNA, 20 bp, Artificial Sequence
  chemically synthesized
tctctcatctggaaatgctt

SEQ ID NO: 5501 - DNA, 20 bp, Artificial Sequence
  chemically synthesized
gacccttggactctgtatga

SEQ ID NO: 5502 - DNA, 20 bp, Artificial Sequence
  chemically synthesized
ctctgtatgagctggcttct

SEQ ID NO: 5503 - DNA, 20 bp, Artificial Sequence
  chemically synthesized
ttcaacctcacctaatggaa

SEQ ID NO: 5504 - DNA, 20 bp, Artificial Sequence
  chemically synthesized
tttcctttgacaccctaagc

SEQ ID NO: 5505 - DNA, 20 bp, Artificial Sequence
  chemically synthesized
accctaagcatttgcttcct

SEQ ID NO: 5506 - DNA, 20 bp, Artificial Sequence
  chemically synthesized
tgctatcaatttcattccct

SEQ ID NO: 5507 - DNA, 20 bp, Artificial Sequence
  chemically synthesized
caaaatagtaggtgctctga

SEQ ID NO: 5508 - DNA, 20 bp, Artificial Sequence
  chemically synthesized
ccaaagaatataaatgagaa

SEQ ID NO: 5509 - DNA, 20 bp, Artificial Sequence
  chemically synthesized
cagaaaaagcaagttaaagc

SEQ ID NO: 5510 - DNA, 20 bp, Artificial Sequence
  chemically synthesized
aggcactcctctcaaccccc

SEQ ID NO: 5511 - DNA, 20 bp, Artificial Sequence
  chemically synthesized
cgaactccttggcatccatt

SEQ ID NO: 5512 - DNA, 20 bp, Artificial Sequence
  chemically synthesized
aggaaggatgaggagagggg

SEQ ID NO: 5513 - DNA, 20 bp, Artificial Sequence
  chemically synthesized
gagagacaccattttgtgtc

SEQ ID NO: 5514 - DNA, 20 bp, Artificial Sequence
  chemically synthesized
gtcacttggagagcagtcag

SEQ ID NO: 5515 - DNA, 20 bp, Artificial Sequence
  chemically synthesized
ttgccctttatgtgcattga

SEQ ID NO: 5516 - DNA, 20 bp, Artificial Sequence
  chemically synthesized
aaaatgattgaatacagatg

SEQ ID NO: 5517 - DNA, 20 bp, Artificial Sequence
  chemically synthesized
agaagcggacttgtaagata

SEQ ID NO: 5518 - DNA, 20 bp, Artificial Sequence
  chemically synthesized
acttgtaagataggtagctt

SEQ ID NO: 5519 - DNA, 20 bp, Artificial Sequence
  chemically synthesized
atgaaagaaacttttaacct

SEQ ID NO: 5520 - DNA, 20 bp, Artificial Sequence
  chemically synthesized
cgatcttggctcagtgcaac

SEQ ID NO: 5521 - DNA, 20 bp, Artificial Sequence
  chemically synthesized
atttttgtatttttttagag

SEQ ID NO: 5522 - DNA, 20 bp, Artificial Sequence
  chemically synthesized
cgcctcggcctcccaaagtg

SEQ ID NO: 5523 - DNA, 20 bp, Artificial Sequence
  chemically synthesized
tttaacaggtataaatatac

SEQ ID NO: 5524 - DNA, 20 bp, Artificial Sequence
  chemically synthesized
tcaattataaggtagagact

SEQ ID NO: 5525 - DNA, 20 bp, Artificial Sequence
  chemically synthesized
gccacctctgaaactccaac

SEQ ID NO: 5526 - DNA, 20 bp, Artificial Sequence
  chemically synthesized
actagagtataggggcagaa

SEQ ID NO: 5527 - DNA, 20 bp, Artificial Sequence
  chemically synthesized
gaatcttgtgcctttcccac

SEQ ID NO: 5528 - DNA, 20 bp, Artificial Sequence
  chemically synthesized
ccacaagacctcagacttcc

SEQ ID NO: 5529 - DNA, 20 bp, Artificial Sequence
  chemically synthesized
tccacatacccttgctgtgg

SEQ ID NO: 5530 - DNA, 20 bp, Artificial Sequence
  chemically synthesized
ctgactcagctgcagccaca

SEQ ID NO: 5531 - DNA, 20 bp, Artificial Sequence
  chemically synthesized
agctggtcatccacgtagcc

SEQ ID NO: 5532 - DNA, 20 bp, Artificial Sequence
  chemically synthesized
gtcctgggtgctctttcctt

SEQ ID NO: 5533 - DNA, 20 bp, Artificial Sequence
  chemically synthesized
cccagatcctattccaatac

SEQ ID NO: 5534 - DNA, 20 bp, Artificial Sequence
  chemically synthesized
agacagactccactaaagct

SEQ ID NO: 5535 - DNA, 20 bp, Artificial Sequence
  chemically synthesized
aaatcctgaggaataattcc

SEQ ID NO: 5536 - DNA, 20 bp, Artificial Sequence
  chemically synthesized
aacctgcacctcctgggttc

SEQ ID NO: 5537 - DNA, 20 bp, Artificial Sequence
  chemically synthesized
ttttgtatttttagtagaca

SEQ ID NO: 5538 - DNA, 20 bp, Artificial Sequence
  chemically synthesized
atggggtttcaccatgttgg

SEQ ID NO: 5539 - DNA, 20 bp, Artificial Sequence
  chemically synthesized
ctgcctcagccaccaaagtg

SEQ ID NO: 5540 - DNA, 20 bp, Artificial Sequence
  chemically synthesized
taacatgtccaaatgcagat

SEQ ID NO: 5541 - DNA, 20 bp, Artificial Sequence
  chemically synthesized
ttttgtattttttgtagaga

SEQ ID NO: 5542 - DNA, 20 bp, Artificial Sequence
  chemically synthesized
tcagaatatattcaggagac

SEQ ID NO: 5543 - DNA, 20 bp, Artificial Sequence
  chemically synthesized
acctcttgcctggactgtgt

SEQ ID NO: 5544 - DNA, 20 bp, Artificial Sequence
  chemically synthesized
aacagcttcctggctgggct

SEQ ID NO: 5545 - DNA, 20 bp, Artificial Sequence
  chemically synthesized
ttttactgttgctcccttca

SEQ ID NO: 5546 - DNA, 20 bp, Artificial Sequence
  chemically synthesized
gcctacaggcgcctgcacaa

SEQ ID NO: 5547 - DNA, 20 bp, Artificial Sequence
  chemically synthesized
ggcctctactccccagcact

SEQ ID NO: 5548 - DNA, 20 bp, Artificial Sequence
  chemically synthesized
acttgtttatttttttcaac

SEQ ID NO: 5549 - DNA, 20 bp, Artificial Sequence
  chemically synthesized
tcaacccgagcttcttaacc

SEQ ID NO: 5550 - DNA, 20 bp, Artificial Sequence
  chemically synthesized
gtctactaggtgacatgtgg

SEQ ID NO: 5551 - DNA, 20 bp, Artificial Sequence
  chemically synthesized
acatgagtagtgctgagaaa

SEQ ID NO: 5552 - DNA, 20 bp, Artificial Sequence
  chemically synthesized
aatccaacttgccaggccca

SEQ ID NO: 5553 - DNA, 20 bp, Artificial Sequence
  chemically synthesized
agagtgacttgccctgactt

SEQ ID NO: 5554 - DNA, 20 bp, Artificial Sequence
  chemically synthesized
ttctctgcttctcacaacac

SEQ ID NO: 5555 - DNA, 20 bp, Artificial Sequence
  chemically synthesized
tgttgtatatctttctgctc

SEQ ID NO: 5556 - DNA, 20 bp, Artificial Sequence
  chemically synthesized
caaaatatcaaagggtaaag

SEQ ID NO: 5557 - DNA, 20 bp, Artificial Sequence
  chemically synthesized
tgtttccctgctctctccct

SEQ ID NO: 5558 - DNA, 20 bp, Artificial Sequence
  chemically synthesized
attcaacctctaatgcagtg

SEQ ID NO: 5559 - DNA, 20 bp, Artificial Sequence
  chemically synthesized
cagggcaaaatcactgtcaa

SEQ ID NO: 5560 - DNA, 20 bp, Artificial Sequence
  chemically synthesized
acttgaaataacatcagaaa

SEQ ID NO: 5561 - DNA, 20 bp, Artificial Sequence
  chemically synthesized
atgtaacttagaagtgagtg

SEQ ID NO: 5562 - DNA, 20 bp, Artificial Sequence
  chemically synthesized
aaccccgtgcggatcctgct

SEQ ID NO: 5563 - DNA, 20 bp, Artificial Sequence
  chemically synthesized
caagcactcagggaagaact

SEQ ID NO: 5564 - DNA, 20 bp, Artificial Sequence
  chemically synthesized
agttccaggttcaaggagcc

SEQ ID NO: 5565 - DNA, 20 bp, Artificial Sequence
  chemically synthesized
ctcagctcaagtgaggaact

SEQ ID NO: 5566 - DNA, 20 bp, Artificial Sequence
  chemically synthesized
tggacgcagaaagtagggag

SEQ ID NO: 5567 - DNA, 20 bp, Artificial Sequence
  chemically synthesized
ctcccaagcgcaaagaaaaa

SEQ ID NO: 5568 - DNA, 20 bp, Artificial Sequence
  chemically synthesized
aagcgcaaagaaaaagctag

SEQ ID NO: 5569 - DNA, 20 bp, Artificial Sequence
  chemically synthesized
gccgcacgtccccgttaaat

SEQ ID NO: 5570 - DNA, 20 bp, Artificial Sequence
  chemically synthesized
tctctcctacagcagaaggt

SEQ ID NO: 5571 - DNA, 20 bp, Artificial Sequence
  chemically synthesized
ctaggtgatccagtgtcccc

SEQ ID NO: 5572 - DNA, 20 bp, Artificial Sequence
  chemically synthesized
tttaaatcctgaaggggtgt

SEQ ID NO: 5573 - DNA, 20 bp, Artificial Sequence
  chemically synthesized
gggtgttgttgattggggaa

SEQ ID NO: 5574 - DNA, 20 bp, Artificial Sequence
  chemically synthesized
aactttagatatttaaatat

SEQ ID NO: 5575 - DNA, 20 bp, Artificial Sequence
  chemically synthesized
tcttatttgacttagaaata

SEQ ID NO: 5576 - DNA, 20 bp, Artificial Sequence
  chemically synthesized
agaaatataaagctttttca

SEQ ID NO: 5577 - DNA, 20 bp, Artificial Sequence
  chemically synthesized
taaagctttttcattttgtt

SEQ ID NO: 5578 - DNA, 20 bp, Artificial Sequence
  chemically synthesized
tcataattgaattatctgac

SEQ ID NO: 5579 - DNA, 20 bp, Artificial Sequence
  chemically synthesized
gtttcacaaactttacagta

SEQ ID NO: 5580 - DNA, 20 bp, Artificial Sequence
  chemically synthesized
cagtattgggattatctgga

SEQ ID NO: 5581 - DNA, 20 bp, Artificial Sequence
  chemically synthesized
cctgctcctaaccccagaca

SEQ ID NO: 5582 - DNA, 20 bp, Artificial Sequence
  chemically synthesized
cctaatgccaccctaaggga

SEQ ID NO: 5583 - DNA, 20 bp, Artificial Sequence
  chemically synthesized
tcattataatagaatttaca

SEQ ID NO: 5584 - DNA, 20 bp, Artificial Sequence
  chemically synthesized
gttttgcccccccatccctg

SEQ ID NO: 5585 - DNA, 20 bp, Artificial Sequence
  chemically synthesized
aaattataggtaagaccatg

SEQ ID NO: 5586 - DNA, 20 bp, Artificial Sequence
  chemically synthesized
aagaccatgcacagtttaat

SEQ ID NO: 5587 - DNA, 20 bp, Artificial Sequence
  chemically synthesized
ctgtccctcagagtgtatta

SEQ ID NO: 5588 - DNA, 20 bp, Artificial Sequence
  chemically synthesized
tattattgtgcttcaataaa

SEQ ID NO: 5589 - DNA, 20 bp, Artificial Sequence
  chemically synthesized
gtgcttcaataaactttgct

SEQ ID NO: 5590 - DNA, 20 bp, Artificial Sequence
  chemically synthesized
ctttaagcttgcattttggt

SEQ ID NO: 5591 - DNA, 20 bp, Artificial Sequence
  chemically synthesized
tttgctcactatcacaagaa

SEQ ID NO: 5592 - DNA, 20 bp, Artificial Sequence
  chemically synthesized
tatgggatgccacctgggca

SEQ ID NO: 5593 - DNA, 20 bp, Artificial Sequence
  chemically synthesized
cacctgggcaatgggatttt

SEQ ID NO: 5594 - DNA, 20 bp, Artificial Sequence
  chemically synthesized
aagctttccttctccctcaa

SEQ ID NO: 5595 - DNA, 20 bp, Artificial Sequence
  chemically synthesized
aatattaataaatttaatac

SEQ ID NO: 5596 - DNA, 20 bp, Artificial Sequence
  chemically synthesized
aattggcccggctcagtggc

SEQ ID NO: 5597 - DNA, 20 bp, Artificial Sequence
  chemically synthesized
attagaggctgaggcaggag

SEQ ID NO: 5598 - DNA, 20 bp, Artificial Sequence
  chemically synthesized
tcgggaagctgagacaggag

SEQ ID NO: 5599 - DNA, 20 bp, Artificial Sequence
  chemically synthesized
taaaataaaatgcaaaaatt

SEQ ID NO: 5600 - DNA, 20 bp, Artificial Sequence
  chemically synthesized
gtacccttaattcatcgcct

SEQ ID NO: 5601 - DNA, 20 bp, Artificial Sequence
  chemically synthesized
atacatagaggcatataata

SEQ ID NO: 5602 - DNA, 20 bp, Artificial Sequence
  chemically synthesized
taatatattgctttgccgtg

SEQ ID NO: 5603 - DNA, 20 bp, Artificial Sequence
  chemically synthesized
ctggcttctttcatttagca

SEQ ID NO: 5604 - DNA, 20 bp, Artificial Sequence
  chemically synthesized
atttagcataatgtttttat

SEQ ID NO: 5605 - DNA, 20 bp, Artificial Sequence
  chemically synthesized
tcattcatcagccgatggac

SEQ ID NO: 5606 - DNA, 20 bp, Artificial Sequence
  chemically synthesized
tcatcagccgatggacattg

SEQ ID NO: 5607 - DNA, 20 bp, Artificial Sequence
  chemically synthesized
gctgttataaacatttatgt

SEQ ID NO: 5608 - DNA, 20 bp, Artificial Sequence
  chemically synthesized
gtacaagtttttttgtagac

SEQ ID NO: 5609 - DNA, 20 bp, Artificial Sequence
  chemically synthesized
agtttttttgtagacttatg

SEQ ID NO: 5610 - DNA, 20 bp, Artificial Sequence
  chemically synthesized
ttttggttatatatctagaa

SEQ ID NO: 5611 - DNA, 20 bp, Artificial Sequence
  chemically synthesized
tttgctgggtcatatggtaa

SEQ ID NO: 5612 - DNA, 20 bp, Artificial Sequence
  chemically synthesized
ctatcagcagtgtatgagag

SEQ ID NO: 5613 - DNA, 20 bp, Artificial Sequence
  chemically synthesized
tgatttctctccatctttgc

SEQ ID NO: 5614 - DNA, 20 bp, Artificial Sequence
  chemically synthesized
agaagactcttttttcattg

SEQ ID NO: 5615 - DNA, 20 bp, Artificial Sequence
  chemically synthesized
aatcaatctaccataaatgt

SEQ ID NO: 5616 - DNA, 20 bp, Artificial Sequence
  chemically synthesized
tgcctcagcctcccaagcag

SEQ ID NO: 5617 - DNA, 20 bp, Artificial Sequence
  chemically synthesized
ttttgtatttttagtagaga

SEQ ID NO: 5618 - DNA, 22 bp, Artificial Sequence
  chemically synthesized
tgggaggctgaggtgggcagat

SEQ ID NO: 5619 - DNA, 22 bp, Artificial Sequence
  chemically synthesized
gggaggctgaggtgggcagatc

SEQ ID NO: 5620 - DNA, 22 bp, Artificial Sequence
  chemically synthesized
ggaggctgaggtgggcagatca

SEQ ID NO: 5621 - DNA, 22 bp, Artificial Sequence
  chemically synthesized
aggtgggcagatcacctgaggt

SEQ ID NO: 5622 - DNA, 22 bp, Artificial Sequence
  chemically synthesized
aggtcaggagttccagaccagc

SEQ ID NO: 5623 - DNA, 22 bp, Artificial Sequence
  chemically synthesized
cagaccagcctgaccaacatgg

SEQ ID NO: 5624 - DNA, 22 bp, Artificial Sequence
  chemically synthesized
accaacatggtgaaaccccgtc

SEQ ID NO: 5625 - DNA, 22 bp, Artificial Sequence
  chemically synthesized
tactaaaaatacaaaaattaac

SEQ ID NO: 5626 - DNA, 22 bp, Artificial Sequence
  chemically synthesized
ctaaaaatacaaaaattaacca

SEQ ID NO: 5627 - DNA, 22 bp, Artificial Sequence
  chemically synthesized
aaaatacaaaaattaaccaggc

SEQ ID NO: 5628 - DNA, 22 bp, Artificial Sequence
  chemically synthesized
accaggcatggtggcaggtacc

SEQ ID NO: 5629 - DNA, 22 bp, Artificial Sequence
  chemically synthesized
taatcccagctgcttgggaggc

SEQ ID NO: 5630 - DNA, 22 bp, Artificial Sequence
  chemically synthesized
cttgggaggctgaggcaggaga

SEQ ID NO: 5631 - DNA, 22 bp, Artificial Sequence
  chemically synthesized
gggaggctgaggcaggagaatt

SEQ ID NO: 5632 - DNA, 22 bp, Artificial Sequence
  chemically synthesized
ggaggctgaggcaggagaattg

SEQ ID NO: 5633 - DNA, 22 bp, Artificial Sequence
  chemically synthesized
aggcaggagaattgcttgaacc

SEQ ID NO: 5634 - DNA, 22 bp, Artificial Sequence
  chemically synthesized
cttgaacctgggaggaggagcc

SEQ ID NO: 5635 - DNA, 22 bp, Artificial Sequence
  chemically synthesized
gaacctgggaggaggagccagt

SEQ ID NO: 5636 - DNA, 22 bp, Artificial Sequence
  chemically synthesized
aacctgggaggaggagccagtg

SEQ ID NO: 5637 - DNA, 22 bp, Artificial Sequence
  chemically synthesized
ggaggaggagccagtggccggg

SEQ ID NO: 5638 - DNA, 22 bp, Artificial Sequence
  chemically synthesized
ggccactgcactccaacctggg

SEQ ID NO: 5639 - DNA, 22 bp, Artificial Sequence
  chemically synthesized
cactccaacctgggcaatagag

SEQ ID NO: 5640 - DNA, 22 bp, Artificial Sequence
  chemically synthesized
caacctgggcaatagagtgagg

SEQ ID NO: 5641 - DNA, 22 bp, Artificial Sequence
  chemically synthesized
ggcaatagagtgaggctctgtc

SEQ ID NO: 5642 - DNA, 22 bp, Artificial Sequence
  chemically synthesized
tgtcaaaaaaaaaaaaagatag

SEQ ID NO: 5643 - DNA, 22 bp, Artificial Sequence
  chemically synthesized
tcaaaaaaaaaaaaagatagga

SEQ ID NO: 5644 - DNA, 22 bp, Artificial Sequence
  chemically synthesized
tagattatagcataatgggata

SEQ ID NO: 5645 - DNA, 22 bp, Artificial Sequence
  chemically synthesized
tagcataatgggataaaattga

SEQ ID NO: 5646 - DNA, 22 bp, Artificial Sequence
  chemically synthesized
agactccagaaataaactctca

SEQ ID NO: 5647 - DNA, 22 bp, Artificial Sequence
  chemically synthesized
cagaaataaactctcacattta

SEQ ID NO: 5648 - DNA, 22 bp, Artificial Sequence
  chemically synthesized
tcacatttatggtagattgatt

SEQ ID NO: 5649 - DNA, 22 bp, Artificial Sequence
  chemically synthesized
acatttatggtagattgatttt

SEQ ID NO: 5650 - DNA, 22 bp, Artificial Sequence
  chemically synthesized
atggtagattgatttttgataa

SEQ ID NO: 5651 - DNA, 22 bp, Artificial Sequence
  chemically synthesized
tggtagattgatttttgataag

SEQ ID NO: 5652 - DNA, 22 bp, Artificial Sequence
  chemically synthesized
atttttgataagggtgccaaaa

SEQ ID NO: 5653 - DNA, 22 bp, Artificial Sequence
  chemically synthesized
ttgataagggtgccaaaacact

SEQ ID NO: 5654 - DNA, 22 bp, Artificial Sequence
  chemically synthesized
tgataagggtgccaaaacactt

SEQ ID NO: 5655 - DNA, 22 bp, Artificial Sequence
  chemically synthesized
gataagggtgccaaaacacttc

SEQ ID NO: 5656 - DNA, 22 bp, Artificial Sequence
  chemically synthesized
ataagggtgccaaaacacttca

SEQ ID NO: 5657 - DNA, 22 bp, Artificial Sequence
  chemically synthesized
caatgaaaaaagagtcttctca

SEQ ID NO: 5658 - DNA, 22 bp, Artificial Sequence
  chemically synthesized
aatgaaaaaagagtcttctcaa

SEQ ID NO: 5659 - DNA, 22 bp, Artificial Sequence
  chemically synthesized
ctcaacaagtgatggtggaaca

SEQ ID NO: 5660 - DNA, 22 bp, Artificial Sequence
  chemically synthesized
tcaacaagtgatggtggaacaa

SEQ ID NO: 5661 - DNA, 22 bp, Artificial Sequence
  chemically synthesized
aacaagtgatggtggaacaact

SEQ ID NO: 5662 - DNA, 22 bp, Artificial Sequence
  chemically synthesized
aataaccacatttttgttctat

SEQ ID NO: 5663 - DNA, 22 bp, Artificial Sequence
  chemically synthesized
ttgttctatctggggccctgat

SEQ ID NO: 5664 - DNA, 22 bp, Artificial Sequence
  chemically synthesized
tgttctatctggggccctgatt

SEQ ID NO: 5665 - DNA, 22 bp, Artificial Sequence
  chemically synthesized
gttctatctggggccctgattc

SEQ ID NO: 5666 - DNA, 22 bp, Artificial Sequence
  chemically synthesized
ttctatctggggccctgattca

SEQ ID NO: 5667 - DNA, 22 bp, Artificial Sequence
  chemically synthesized
tatctggggccctgattcaaaa

SEQ ID NO: 5668 - DNA, 22 bp, Artificial Sequence
  chemically synthesized
tctggggccctgattcaaaaac

SEQ ID NO: 5669 - DNA, 22 bp, Artificial Sequence
  chemically synthesized
gggccctgattcaaaaacccag

SEQ ID NO: 5670 - DNA, 22 bp, Artificial Sequence
  chemically synthesized
attcaaaaacccaggcaaagat

SEQ ID NO: 5671 - DNA, 22 bp, Artificial Sequence
  chemically synthesized
aaaaacccaggcaaagatggag

SEQ ID NO: 5672 - DNA, 22 bp, Artificial Sequence
  chemically synthesized
tcatacactgctgataggagga

SEQ ID NO: 5673 - DNA, 22 bp, Artificial Sequence
  chemically synthesized
atacactgctgataggaggata

SEQ ID NO: 5674 - DNA, 22 bp, Artificial Sequence
  chemically synthesized
ctgataggaggataaaatgctt

SEQ ID NO: 5675 - DNA, 22 bp, Artificial Sequence
  chemically synthesized
ataggaggataaaatgcttact

SEQ ID NO: 5676 - DNA, 22 bp, Artificial Sequence
  chemically synthesized
actttggaaaagaatgtggcaa

SEQ ID NO: 5677 - DNA, 22 bp, Artificial Sequence
  chemically synthesized
ctttggaaaagaatgtggcaat

SEQ ID NO: 5678 - DNA, 22 bp, Artificial Sequence
  chemically synthesized
tggaaaagaatgtggcaattcc

SEQ ID NO: 5679 - DNA, 22 bp, Artificial Sequence
  chemically synthesized
ggaaaagaatgtggcaattcct

SEQ ID NO: 5680 - DNA, 22 bp, Artificial Sequence
  chemically synthesized
gaaaagaatgtggcaattcctc

SEQ ID NO: 5681 - DNA, 22 bp, Artificial Sequence
  chemically synthesized
ctcaaaaggttaaacagtgtta

SEQ ID NO: 5682 - DNA, 22 bp, Artificial Sequence
  chemically synthesized
aaaaggttaaacagtgttacca

SEQ ID NO: 5683 - DNA, 22 bp, Artificial Sequence
  chemically synthesized
aacagtgttaccatatgaccca

SEQ ID NO: 5684 - DNA, 22 bp, Artificial Sequence
  chemically synthesized
ccatatgacccagcaaacccac

SEQ ID NO: 5685 - DNA, 22 bp, Artificial Sequence
  chemically synthesized
ctagatatataaccaaaagaaa

SEQ ID NO: 5686 - DNA, 22 bp, Artificial Sequence
  chemically synthesized
tagatatataaccaaaagaaat

SEQ ID NO: 5687 - DNA, 22 bp, Artificial Sequence
  chemically synthesized
gatatataaccaaaagaaatca

SEQ ID NO: 5688 - DNA, 22 bp, Artificial Sequence
  chemically synthesized
caaaaaaacttgtacataaatg

SEQ ID NO: 5689 - DNA, 22 bp, Artificial Sequence
  chemically synthesized
gtacataaatgtttataacagc

SEQ ID NO: 5690 - DNA, 22 bp, Artificial Sequence
  chemically synthesized
tacataaatgtttataacagca

SEQ ID NO: 5691 - DNA, 22 bp, Artificial Sequence
  chemically synthesized
ataacagcactattcccaatag

SEQ ID NO: 5692 - DNA, 22 bp, Artificial Sequence
  chemically synthesized
taacagcactattcccaatagc

SEQ ID NO: 5693 - DNA, 22 bp, Artificial Sequence
  chemically synthesized
ttcccaatagccataaagtaga

SEQ ID NO: 5694 - DNA, 22 bp, Artificial Sequence
  chemically synthesized
ccaatagccataaagtagaaac

SEQ ID NO: 5695 - DNA, 22 bp, Artificial Sequence
  chemically synthesized
atgaatgaataaataaaatatg

SEQ ID NO: 5696 - DNA, 22 bp, Artificial Sequence
  chemically synthesized
tggtatgtccttataatagata

SEQ ID NO: 5697 - DNA, 22 bp, Artificial Sequence
  chemically synthesized
ataatagatattattggtccat

SEQ ID NO: 5698 - DNA, 22 bp, Artificial Sequence
  chemically synthesized
taatagatattattggtccatg

SEQ ID NO: 5699 - DNA, 22 bp, Artificial Sequence
  chemically synthesized
ttggtccatgaaaaacatacat

SEQ ID NO: 5700 - DNA, 22 bp, Artificial Sequence
  chemically synthesized
gtccatgaaaaacatacataaa

SEQ ID NO: 5701 - DNA, 22 bp, Artificial Sequence
  chemically synthesized
tgctaaatgaaagaagccagtc

SEQ ID NO: 5702 - DNA, 22 bp, Artificial Sequence
  chemically synthesized
aatgaaagaagccagtcacggc

SEQ ID NO: 5703 - DNA, 22 bp, Artificial Sequence
  chemically synthesized
tatgcctctatgtatactaaat

SEQ ID NO: 5704 - DNA, 22 bp, Artificial Sequence
  chemically synthesized
tatgtatactaaatgttccaaa

SEQ ID NO: 5705 - DNA, 22 bp, Artificial Sequence
  chemically synthesized
tgtatactaaatgttccaaata

SEQ ID NO: 5706 - DNA, 22 bp, Artificial Sequence
  chemically synthesized
aatgttccaaatagaaagaaag

SEQ ID NO: 5707 - DNA, 22 bp, Artificial Sequence
  chemically synthesized
caaatagaaagaaagtagatta

SEQ ID NO: 5708 - DNA, 22 bp, Artificial Sequence
  chemically synthesized
aagattgtctagggctgggagg

SEQ ID NO: 5709 - DNA, 22 bp, Artificial Sequence
  chemically synthesized
tctagggctgggaggggaggag

SEQ ID NO: 5710 - DNA, 22 bp, Artificial Sequence
  chemically synthesized
gggctgggaggggaggaggagg

SEQ ID NO: 5711 - DNA, 22 bp, Artificial Sequence
  chemically synthesized
ggaggggaggaggaggagaatg

SEQ ID NO: 5712 - DNA, 22 bp, Artificial Sequence
  chemically synthesized
ggaggcgatgaattaagggtac

SEQ ID NO: 5713 - DNA, 22 bp, Artificial Sequence
  chemically synthesized
agggtactgaattaggggaaca

SEQ ID NO: 5714 - DNA, 22 bp, Artificial Sequence
  chemically synthesized
aattaggggaacatggtttctt

SEQ ID NO: 5715 - DNA, 22 bp, Artificial Sequence
  chemically synthesized
ggggaacatggtttctttttgg

SEQ ID NO: 5716 - DNA, 22 bp, Artificial Sequence
  chemically synthesized
ctttttggggagatagaaatgt

SEQ ID NO: 5717 - DNA, 22 bp, Artificial Sequence
  chemically synthesized
tttttggggagatagaaatgta

SEQ ID NO: 5718 - DNA, 22 bp, Artificial Sequence
  chemically synthesized
tttggggagatagaaatgtaaa

SEQ ID NO: 5719 - DNA, 22 bp, Artificial Sequence
  chemically synthesized
ttggggagatagaaatgtaaaa

SEQ ID NO: 5720 - DNA, 22 bp, Artificial Sequence
  chemically synthesized
tggggagatagaaatgtaaaat

SEQ ID NO: 5721 - DNA, 22 bp, Artificial Sequence
  chemically synthesized
ggggagatagaaatgtaaaatt

SEQ ID NO: 5722 - DNA, 22 bp, Artificial Sequence
  chemically synthesized
gggagatagaaatgtaaaattt

SEQ ID NO: 5723 - DNA, 22 bp, Artificial Sequence
  chemically synthesized
tggtaatggttgcacatctctg

SEQ ID NO: 5724 - DNA, 22 bp, Artificial Sequence
  chemically synthesized
ggtaatggttgcacatctctgt

SEQ ID NO: 5725 - DNA, 22 bp, Artificial Sequence
  chemically synthesized
gtaatggttgcacatctctgta

SEQ ID NO: 5726 - DNA, 22 bp, Artificial Sequence
  chemically synthesized
cacatctctgtaaatatactaa

SEQ ID NO: 5727 - DNA, 22 bp, Artificial Sequence
  chemically synthesized
tgtaaatatactaaaatccatt

SEQ ID NO: 5728 - DNA, 22 bp, Artificial Sequence
  chemically synthesized
taaatatactaaaatccattaa

SEQ ID NO: 5729 - DNA, 22 bp, Artificial Sequence
  chemically synthesized
aaatccattaatttttgcattt

SEQ ID NO: 5730 - DNA, 22 bp, Artificial Sequence
  chemically synthesized
atttttgcattttattttattt

SEQ ID NO: 5731 - DNA, 22 bp, Artificial Sequence
  chemically synthesized
ttgcattttattttatttattt

SEQ ID NO: 5732 - DNA, 22 bp, Artificial Sequence
  chemically synthesized
tgcattttattttatttatttt

SEQ ID NO: 5733 - DNA, 22 bp, Artificial Sequence
  chemically synthesized
gcattttattttatttatttta

SEQ ID NO: 5734 - DNA, 22 bp, Artificial Sequence
  chemically synthesized
cattttattttatttattttat

SEQ ID NO: 5735 - DNA, 22 bp, Artificial Sequence
  chemically synthesized
tattttatttattttatttttg

SEQ ID NO: 5736 - DNA, 22 bp, Artificial Sequence
  chemically synthesized
attttatttattttatttttga

SEQ ID NO: 5737 - DNA, 22 bp, Artificial Sequence
  chemically synthesized
ttttatttattttatttttgag

SEQ ID NO: 5738 - DNA, 22 bp, Artificial Sequence
  chemically synthesized
tatttattttatttttgagacg

SEQ ID NO: 5739 - DNA, 22 bp, Artificial Sequence
  chemically synthesized
atttattttatttttgagacgg

SEQ ID NO: 5740 - DNA, 22 bp, Artificial Sequence
  chemically synthesized
tttattttatttttgagacgga

SEQ ID NO: 5741 - DNA, 22 bp, Artificial Sequence
  chemically synthesized
attttatttttgagacggagtt

SEQ ID NO: 5742 - DNA, 22 bp, Artificial Sequence
  chemically synthesized
ttttatttttgagacggagttt

SEQ ID NO: 5743 - DNA, 22 bp, Artificial Sequence
  chemically synthesized
tatttttgagacggagtttcgc

SEQ ID NO: 5744 - DNA, 22 bp, Artificial Sequence
  chemically synthesized
atttttgagacggagtttcgct

SEQ ID NO: 5745 - DNA, 22 bp, Artificial Sequence
  chemically synthesized
tttttgagacggagtttcgctc

SEQ ID NO: 5746 - DNA, 22 bp, Artificial Sequence
  chemically synthesized
ttgagacggagtttcgctcttg

SEQ ID NO: 5747 - DNA, 22 bp, Artificial Sequence
  chemically synthesized
tgagacggagtttcgctcttgt

SEQ ID NO: 5748 - DNA, 22 bp, Artificial Sequence
  chemically synthesized
gagacggagtttcgctcttgtt

SEQ ID NO: 5749 - DNA, 22 bp, Artificial Sequence
  chemically synthesized
agacggagtttcgctcttgttg

SEQ ID NO: 5750 - DNA, 22 bp, Artificial Sequence
  chemically synthesized
cgctcttgttgcccaggctgga

SEQ ID NO: 5751 - DNA, 22 bp, Artificial Sequence
  chemically synthesized
gctcttgttgcccaggctggag

SEQ ID NO: 5752 - DNA, 22 bp, Artificial Sequence
  chemically synthesized
ttgttgcccaggctggagtgca

SEQ ID NO: 5753 - DNA, 22 bp, Artificial Sequence
  chemically synthesized
gttgcccaggctggagtgcaat

SEQ ID NO: 5754 - DNA, 22 bp, Artificial Sequence
  chemically synthesized
ttgcccaggctggagtgcaatg

SEQ ID NO: 5755 - DNA, 22 bp, Artificial Sequence
  chemically synthesized
cccaggctggagtgcaatggca

SEQ ID NO: 5756 - DNA, 22 bp, Artificial Sequence
  chemically synthesized
gagtgcaatggcatgatctcgg

SEQ ID NO: 5757 - DNA, 22 bp, Artificial Sequence
  chemically synthesized
ggctcaccacaacctccgcctc

SEQ ID NO: 5758 - DNA, 22 bp, Artificial Sequence
  chemically synthesized
accacaacctccgcctcccagg

SEQ ID NO: 5759 - DNA, 22 bp, Artificial Sequence
  chemically synthesized
cgcctcccaggttcaagcgatt

SEQ ID NO: 5760 - DNA, 22 bp, Artificial Sequence
  chemically synthesized
ccaggttcaagcgattctcctg

SEQ ID NO: 5761 - DNA, 22 bp, Artificial Sequence
  chemically synthesized
aagcgattctcctgtctcagct

SEQ ID NO: 5762 - DNA, 22 bp, Artificial Sequence
  chemically synthesized
tcctgtctcagcttcccgagta

SEQ ID NO: 5763 - DNA, 22 bp, Artificial Sequence
  chemically synthesized
ctgtctcagcttcccgagtagc

SEQ ID NO: 5764 - DNA, 22 bp, Artificial Sequence
  chemically synthesized
tctcagcttcccgagtagctgg

SEQ ID NO: 5765 - DNA, 22 bp, Artificial Sequence
  chemically synthesized
agcttcccgagtagctggaatt

SEQ ID NO: 5766 - DNA, 22 bp, Artificial Sequence
  chemically synthesized
cccgagtagctggaattacagg

SEQ ID NO: 5767 - DNA, 22 bp, Artificial Sequence
  chemically synthesized
ccgagtagctggaattacaggt

SEQ ID NO: 5768 - DNA, 22 bp, Artificial Sequence
  chemically synthesized
gaattacaggtgcatgccacca

SEQ ID NO: 5769 - DNA, 22 bp, Artificial Sequence
  chemically synthesized
caggtgcatgccaccacaccca

SEQ ID NO: 5770 - DNA, 22 bp, Artificial Sequence
  chemically synthesized
attttttttttttgagatgaag

SEQ ID NO: 5771 - DNA, 22 bp, Artificial Sequence
  chemically synthesized
tttttttttgagatgaagtctt

SEQ ID NO: 5772 - DNA, 22 bp, Artificial Sequence
  chemically synthesized
ttttttttgagatgaagtcttg

SEQ ID NO: 5773 - DNA, 22 bp, Artificial Sequence
  chemically synthesized
tttttttgagatgaagtcttgc

SEQ ID NO: 5774 - DNA, 22 bp, Artificial Sequence
  chemically synthesized
ttttttgagatgaagtcttgct

SEQ ID NO: 5775 - DNA, 22 bp, Artificial Sequence
  chemically synthesized
tttttgagatgaagtcttgctc

SEQ ID NO: 5776 - DNA, 22 bp, Artificial Sequence
  chemically synthesized
ttttgagatgaagtcttgctct

SEQ ID NO: 5777 - DNA, 22 bp, Artificial Sequence
  chemically synthesized
tttgagatgaagtcttgctctt

SEQ ID NO: 5778 - DNA, 22 bp, Artificial Sequence
  chemically synthesized
ttgagatgaagtcttgctcttg

SEQ ID NO: 5779 - DNA, 22 bp, Artificial Sequence
  chemically synthesized
tgagatgaagtcttgctcttgt

SEQ ID NO: 5780 - DNA, 22 bp, Artificial Sequence
  chemically synthesized
gagatgaagtcttgctcttgtc

SEQ ID NO: 5781 - DNA, 22 bp, Artificial Sequence
  chemically synthesized
agatgaagtcttgctcttgtct

SEQ ID NO: 5782 - DNA, 22 bp, Artificial Sequence
  chemically synthesized
gctcttgtctcccatgctggag

SEQ ID NO: 5783 - DNA, 22 bp, Artificial Sequence
  chemically synthesized
ctcttgtctcccatgctggagt

SEQ ID NO: 5784 - DNA, 22 bp, Artificial Sequence
  chemically synthesized
ttgtctcccatgctggagtgtg

SEQ ID NO: 5785 - DNA, 22 bp, Artificial Sequence
  chemically synthesized
gtctcccatgctggagtgtgat

SEQ ID NO: 5786 - DNA, 22 bp, Artificial Sequence
  chemically synthesized
tctcccatgctggagtgtgatg

SEQ ID NO: 5787 - DNA, 22 bp, Artificial Sequence
  chemically synthesized
ccatgctggagtgtgatggcac

SEQ ID NO: 5788 - DNA, 22 bp, Artificial Sequence
  chemically synthesized
gagtgtgatggcacgatcttag

SEQ ID NO: 5789 - DNA, 22 bp, Artificial Sequence
  chemically synthesized
agctcactgcaacctacgcctc

SEQ ID NO: 5790 - DNA, 22 bp, Artificial Sequence
  chemically synthesized
gctcactgcaacctacgcctcc

SEQ ID NO: 5791 - DNA, 22 bp, Artificial Sequence
  chemically synthesized
actgcaacctacgcctcccggg

SEQ ID NO: 5792 - DNA, 22 bp, Artificial Sequence
  chemically synthesized
caacctacgcctcccgggttca

SEQ ID NO: 5793 - DNA, 22 bp, Artificial Sequence
  chemically synthesized
cgcctcccgggttcaagcgatt

SEQ ID NO: 5794 - DNA, 22 bp, Artificial Sequence
  chemically synthesized
ccgggttcaagcgattctcctg

SEQ ID NO: 5795 - DNA, 22 bp, Artificial Sequence
  chemically synthesized
aagcgattctcctgcctcagcc

SEQ ID NO: 5796 - DNA, 22 bp, Artificial Sequence
  chemically synthesized
tcctgcctcagcctctaatgta

SEQ ID NO: 5797 - DNA, 22 bp, Artificial Sequence
  chemically synthesized
ctgcctcagcctctaatgtagc

SEQ ID NO: 5798 - DNA, 22 bp, Artificial Sequence
  chemically synthesized
cctcagcctctaatgtagctgg

SEQ ID NO: 5799 - DNA, 22 bp, Artificial Sequence
  chemically synthesized
agcctctaatgtagctgggatt

SEQ ID NO: 5800 - DNA, 22 bp, Artificial Sequence
  chemically synthesized
taatgtagctgggattacagtt

SEQ ID NO: 5801 - DNA, 22 bp, Artificial Sequence
  chemically synthesized
atgtagctgggattacagttgc

SEQ ID NO: 5802 - DNA, 22 bp, Artificial Sequence
  chemically synthesized
ggattacagttgcctgctatca

SEQ ID NO: 5803 - DNA, 22 bp, Artificial Sequence
  chemically synthesized
cagttgcctgctatcacgcccg

SEQ ID NO: 5804 - DNA, 22 bp, Artificial Sequence
  chemically synthesized
cctgctatcacgcccggctaat

SEQ ID NO: 5805 - DNA, 22 bp, Artificial Sequence
  chemically synthesized
ctatcacgcccggctaattttt

SEQ ID NO: 5806 - DNA, 22 bp, Artificial Sequence
  chemically synthesized
tcacgcccggctaatttttgta

SEQ ID NO: 5807 - DNA, 22 bp, Artificial Sequence
  chemically synthesized
atttttgtatttttagtaaaga

SEQ ID NO: 5808 - DNA, 22 bp, Artificial Sequence
  chemically synthesized
ttgtatttttagtaaagacggg

SEQ ID NO: 5809 - DNA, 22 bp, Artificial Sequence
  chemically synthesized
tgtatttttagtaaagacgggg

SEQ ID NO: 5810 - DNA, 22 bp, Artificial Sequence
  chemically synthesized
gtatttttagtaaagacggggt

SEQ ID NO: 5811 - DNA, 22 bp, Artificial Sequence
  chemically synthesized
tatttttagtaaagacggggtt

SEQ ID NO: 5812 - DNA, 22 bp, Artificial Sequence
  chemically synthesized
ttagtaaagacggggtttcacc

SEQ ID NO: 5813 - DNA, 22 bp, Artificial Sequence
  chemically synthesized
tagtaaagacggggtttcacca

SEQ ID NO: 5814 - DNA, 22 bp, Artificial Sequence
  chemically synthesized
agtaaagacggggtttcaccat

SEQ ID NO: 5815 - DNA, 22 bp, Artificial Sequence
  chemically synthesized
gtaaagacggggtttcaccatg

SEQ ID NO: 5816 - DNA, 22 bp, Artificial Sequence
  chemically synthesized
caccatgttggccaggctggtc

SEQ ID NO: 5817 - DNA, 22 bp, Artificial Sequence
  chemically synthesized
accatgttggccaggctggtct

SEQ ID NO: 5818 - DNA, 22 bp, Artificial Sequence
  chemically synthesized
gccaggctggtctcgaacccct

SEQ ID NO: 5819 - DNA, 22 bp, Artificial Sequence
  chemically synthesized
gtctcgaacccctgatctcagg

SEQ ID NO: 5820 - DNA, 22 bp, Artificial Sequence
  chemically synthesized
gaacccctgatctcaggtgatc

SEQ ID NO: 5821 - DNA, 22 bp, Artificial Sequence
  chemically synthesized
atctcaggtgatctgccttcct

SEQ ID NO: 5822 - DNA, 22 bp, Artificial Sequence
  chemically synthesized
aggtgatctgccttcctcggcc

SEQ ID NO: 5823 - DNA, 22 bp, Artificial Sequence
  chemically synthesized
ccttcctcggccgcccaaagtg

SEQ ID NO: 5824 - DNA, 22 bp, Artificial Sequence
  chemically synthesized
cctcggccgcccaaagtgctgg

SEQ ID NO: 5825 - DNA, 22 bp, Artificial Sequence
  chemically synthesized
ctcggccgcccaaagtgctggg

SEQ ID NO: 5826 - DNA, 22 bp, Artificial Sequence
  chemically synthesized
ggccgcccaaagtgctgggatt

SEQ ID NO: 5827 - DNA, 22 bp, Artificial Sequence
  chemically synthesized
ggattacaagcgtgagccactg

SEQ ID NO: 5828 - DNA, 22 bp, Artificial Sequence
  chemically synthesized
caagcgtgagccactgagccgg

SEQ ID NO: 5829 - DNA, 22 bp, Artificial Sequence
  chemically synthesized
agccgggccaatttttgcattt

SEQ ID NO: 5830 - DNA, 22 bp, Artificial Sequence
  chemically synthesized
ttgcattttacatagatgaatt

SEQ ID NO: 5831 - DNA, 22 bp, Artificial Sequence
  chemically synthesized
tgcattttacatagatgaatta

SEQ ID NO: 5832 - DNA, 22 bp, Artificial Sequence
  chemically synthesized
gcattttacatagatgaattat

SEQ ID NO: 5833 - DNA, 22 bp, Artificial Sequence
  chemically synthesized
cattttacatagatgaattata

SEQ ID NO: 5834 - DNA, 22 bp, Artificial Sequence
  chemically synthesized
tacatagatgaattatatggta

SEQ ID NO: 5835 - DNA, 22 bp, Artificial Sequence
  chemically synthesized
acatagatgaattatatggtat

SEQ ID NO: 5836 - DNA, 22 bp, Artificial Sequence
  chemically synthesized
catagatgaattatatggtatg

SEQ ID NO: 5837 - DNA, 22 bp, Artificial Sequence
  chemically synthesized
tatggtatgctaattatatctt

SEQ ID NO: 5838 - DNA, 22 bp, Artificial Sequence
  chemically synthesized
attatatcttaccaaaaattga

SEQ ID NO: 5839 - DNA, 22 bp, Artificial Sequence
  chemically synthesized
tatcttaccaaaaattgaaaaa

SEQ ID NO: 5840 - DNA, 22 bp, Artificial Sequence
  chemically synthesized
accaaaaattgaaaaaaaggaa

SEQ ID NO: 5841 - DNA, 22 bp, Artificial Sequence
  chemically synthesized
ccaaaaattgaaaaaaaggaat

SEQ ID NO: 5842 - DNA, 22 bp, Artificial Sequence
  chemically synthesized
aaaaaaaggaatagtactatca

SEQ ID NO: 5843 - DNA, 22 bp, Artificial Sequence
  chemically synthesized
tcagccccaatgtgcccatcat

SEQ ID NO: 5844 - DNA, 22 bp, Artificial Sequence
  chemically synthesized
tacatgtttccaatgttattgt

SEQ ID NO: 5845 - DNA, 22 bp, Artificial Sequence
  chemically synthesized
catgtttccaatgttattgtat

SEQ ID NO: 5846 - DNA, 22 bp, Artificial Sequence
  chemically synthesized
ccaatgttattgtatctgtttg

SEQ ID NO: 5847 - DNA, 22 bp, Artificial Sequence
  chemically synthesized
caatgttattgtatctgtttgc

SEQ ID NO: 5848 - DNA, 22 bp, Artificial Sequence
  chemically synthesized
ttgtatctgtttgcctacagtc

SEQ ID NO: 5849 - DNA, 22 bp, Artificial Sequence
  chemically synthesized
tatctgtttgcctacagtcgag

SEQ ID NO: 5850 - DNA, 22 bp, Artificial Sequence
  chemically synthesized
tttgcctacagtcgaggccctg

SEQ ID NO: 5851 - DNA, 22 bp, Artificial Sequence
  chemically synthesized
gcctacagtcgaggccctgata

SEQ ID NO: 5852 - DNA, 22 bp, Artificial Sequence
  chemically synthesized
cctacagtcgaggccctgatat

SEQ ID NO: 5853 - DNA, 22 bp, Artificial Sequence
  chemically synthesized
cagtcgaggccctgatatcctg

SEQ ID NO: 5854 - DNA, 22 bp, Artificial Sequence
  chemically synthesized
atatcctgtttgattttcttga

SEQ ID NO: 5855 - DNA, 22 bp, Artificial Sequence
  chemically synthesized
tttgattttcttgaattgccaa

SEQ ID NO: 5856 - DNA, 22 bp, Artificial Sequence
  chemically synthesized
gattttcttgaattgccaaaat

SEQ ID NO: 5857 - DNA, 22 bp, Artificial Sequence
  chemically synthesized
attttcttgaattgccaaaatt

SEQ ID NO: 5858 - DNA, 22 bp, Artificial Sequence
  chemically synthesized
tcttgaattgccaaaatttgca

SEQ ID NO: 5859 - DNA, 22 bp, Artificial Sequence
  chemically synthesized
cttgaattgccaaaatttgcat

SEQ ID NO: 5860 - DNA, 22 bp, Artificial Sequence
  chemically synthesized
ttgaattgccaaaatttgcata

SEQ ID NO: 5861 - DNA, 22 bp, Artificial Sequence
  chemically synthesized
gaattgccaaaatttgcataca

SEQ ID NO: 5862 - DNA, 22 bp, Artificial Sequence
  chemically synthesized
aattgccaaaatttgcatacat

SEQ ID NO: 5863 - DNA, 22 bp, Artificial Sequence
  chemically synthesized
ccaaaatttgcatacatgctta

SEQ ID NO: 5864 - DNA, 22 bp, Artificial Sequence
  chemically synthesized
gcatacatgcttacaaaaataa

SEQ ID NO: 5865 - DNA, 22 bp, Artificial Sequence
  chemically synthesized
catacatgcttacaaaaataat

SEQ ID NO: 5866 - DNA, 22 bp, Artificial Sequence
  chemically synthesized
acaaaaataatgcctgttgaat

SEQ ID NO: 5867 - DNA, 22 bp, Artificial Sequence
  chemically synthesized
caaaaataatgcctgttgaatt

SEQ ID NO: 5868 - DNA, 22 bp, Artificial Sequence
  chemically synthesized
ttgaatttgctagatatgtaaa

SEQ ID NO: 5869 - DNA, 22 bp, Artificial Sequence
  chemically synthesized
aatttgctagatatgtaaaggt

SEQ ID NO: 5870 - DNA, 22 bp, Artificial Sequence
  chemically synthesized
gctagatatgtaaaggtttgga

SEQ ID NO: 5871 - DNA, 22 bp, Artificial Sequence
  chemically synthesized
ctagatatgtaaaggtttggag

SEQ ID NO: 5872 - DNA, 22 bp, Artificial Sequence
  chemically synthesized
gatatgtaaaggtttggagcaa

SEQ ID NO: 5873 - DNA, 22 bp, Artificial Sequence
  chemically synthesized
ggagcaaatcaggtgtattaaa

SEQ ID NO: 5874 - DNA, 22 bp, Artificial Sequence
  chemically synthesized
gagcaaatcaggtgtattaaat

SEQ ID NO: 5875 - DNA, 22 bp, Artificial Sequence
  chemically synthesized
aatttattaatattgtttgaaa

SEQ ID NO: 5876 - DNA, 22 bp, Artificial Sequence
  chemically synthesized
attaatattgtttgaaatgtct

SEQ ID NO: 5877 - DNA, 22 bp, Artificial Sequence
  chemically synthesized
ttaatattgtttgaaatgtcta

SEQ ID NO: 5878 - DNA, 22 bp, Artificial Sequence
  chemically synthesized
atattgtttgaaatgtctaagg

SEQ ID NO: 5879 - DNA, 22 bp, Artificial Sequence
  chemically synthesized
tttgaaatgtctaaggcaataa

SEQ ID NO: 5880 - DNA, 22 bp, Artificial Sequence
  chemically synthesized
gaaatgtctaaggcaataattc

SEQ ID NO: 5881 - DNA, 22 bp, Artificial Sequence
  chemically synthesized
aaatgtctaaggcaataattcc

SEQ ID NO: 5882 - DNA, 22 bp, Artificial Sequence
  chemically synthesized
aggcaataattcccaaacttcg

SEQ ID NO: 5883 - DNA, 22 bp, Artificial Sequence
  chemically synthesized
ccaaacttcgttgagggagaag

SEQ ID NO: 5884 - DNA, 22 bp, Artificial Sequence
  chemically synthesized
cgttgagggagaaggaaagctt

SEQ ID NO: 5885 - DNA, 22 bp, Artificial Sequence
  chemically synthesized
gttgagggagaaggaaagcttt

SEQ ID NO: 5886 - DNA, 22 bp, Artificial Sequence
  chemically synthesized
agggagaaggaaagcttttaaa

SEQ ID NO: 5887 - DNA, 22 bp, Artificial Sequence
  chemically synthesized
ttaaaatcccattgcccaggtg

SEQ ID NO: 5888 - DNA, 22 bp, Artificial Sequence
  chemically synthesized
taaaatcccattgcccaggtgg

SEQ ID NO: 5889 - DNA, 22 bp, Artificial Sequence
  chemically synthesized
aaaatcccattgcccaggtggc

SEQ ID NO: 5890 - DNA, 22 bp, Artificial Sequence
  chemically synthesized
aaatcccattgcccaggtggca

SEQ ID NO: 5891 - DNA, 22 bp, Artificial Sequence
  chemically synthesized
cccaggtggcatcccatactgt

SEQ ID NO: 5892 - DNA, 22 bp, Artificial Sequence
  chemically synthesized
ttactgggaattatgcattggg

SEQ ID NO: 5893 - DNA, 22 bp, Artificial Sequence
  chemically synthesized
ctgggaattatgcattgggatg

SEQ ID NO: 5894 - DNA, 22 bp, Artificial Sequence
  chemically synthesized
ggaattatgcattgggatggat

SEQ ID NO: 5895 - DNA, 22 bp, Artificial Sequence
  chemically synthesized
tgcattgggatggatcctttaa

SEQ ID NO: 5896 - DNA, 22 bp, Artificial Sequence
  chemically synthesized
ggatggatcctttaaccgagga

SEQ ID NO: 5897 - DNA, 22 bp, Artificial Sequence
  chemically synthesized
taaccgaggagattattatagc

SEQ ID NO: 5898 - DNA, 22 bp, Artificial Sequence
  chemically synthesized
aaccgaggagattattatagcc

SEQ ID NO: 5899 - DNA, 22 bp, Artificial Sequence
  chemically synthesized
accgaggagattattatagccg

SEQ ID NO: 5900 - DNA, 22 bp, Artificial Sequence
  chemically synthesized
ttatagccggagctctgaacca

SEQ ID NO: 5901 - DNA, 22 bp, Artificial Sequence
  chemically synthesized
tagccggagctctgaaccagca

SEQ ID NO: 5902 - DNA, 22 bp, Artificial Sequence
  chemically synthesized
tgaaccagcaatctcagttctt

SEQ ID NO: 5903 - DNA, 22 bp, Artificial Sequence
  chemically synthesized
aaccagcaatctcagttcttgt

SEQ ID NO: 5904 - DNA, 22 bp, Artificial Sequence
  chemically synthesized
agttcttgtgatagtgagcaaa

SEQ ID NO: 5905 - DNA, 22 bp, Artificial Sequence
  chemically synthesized
ttgtgatagtgagcaaagaact

SEQ ID NO: 5906 - DNA, 22 bp, Artificial Sequence
  chemically synthesized
gtgatagtgagcaaagaactac

SEQ ID NO: 5907 - DNA, 22 bp, Artificial Sequence
  chemically synthesized
tgatagtgagcaaagaactaca

SEQ ID NO: 5908 - DNA, 22 bp, Artificial Sequence
  chemically synthesized
caaactaacaccaaaatgcaag

SEQ ID NO: 5909 - DNA, 22 bp, Artificial Sequence
  chemically synthesized
acaccaaaatgcaagcttaaag

SEQ ID NO: 5910 - DNA, 22 bp, Artificial Sequence
  chemically synthesized
aaagcaaagtttattgaagcac

SEQ ID NO: 5911 - DNA, 22 bp, Artificial Sequence
  chemically synthesized
aagcaaagtttattgaagcaca

SEQ ID NO: 5912 - DNA, 22 bp, Artificial Sequence
  chemically synthesized
attgaagcacaataatacactc

SEQ ID NO: 5913 - DNA, 22 bp, Artificial Sequence
  chemically synthesized
ttgaagcacaataatacactct

SEQ ID NO: 5914 - DNA, 22 bp, Artificial Sequence
  chemically synthesized
aagcacaataatacactctgag

SEQ ID NO: 5915 - DNA, 22 bp, Artificial Sequence
  chemically synthesized
tgagggacagcgggcttatttc

SEQ ID NO: 5916 - DNA, 22 bp, Artificial Sequence
  chemically synthesized
agggacagcgggcttatttctg

SEQ ID NO: 5917 - DNA, 22 bp, Artificial Sequence
  chemically synthesized
atttctgcgaagtgaactcagc

SEQ ID NO: 5918 - DNA, 22 bp, Artificial Sequence
  chemically synthesized
tttctgcgaagtgaactcagca

SEQ ID NO: 5919 - DNA, 22 bp, Artificial Sequence
  chemically synthesized
ctgcgaagtgaactcagcactt

SEQ ID NO: 5920 - DNA, 22 bp, Artificial Sequence
  chemically synthesized
tgcgaagtgaactcagcacttc

SEQ ID NO: 5921 - DNA, 22 bp, Artificial Sequence
  chemically synthesized
cgaagtgaactcagcacttctt

SEQ ID NO: 5922 - DNA, 22 bp, Artificial Sequence
  chemically synthesized
agcacttctttacagagctcaa

SEQ ID NO: 5923 - DNA, 22 bp, Artificial Sequence
  chemically synthesized
ctttacagagctcaaggtgctt

SEQ ID NO: 5924 - DNA, 22 bp, Artificial Sequence
  chemically synthesized
tttacagagctcaaggtgcttt

SEQ ID NO: 5925 - DNA, 22 bp, Artificial Sequence
  chemically synthesized
tacagagctcaaggtgctttta

SEQ ID NO: 5926 - DNA, 22 bp, Artificial Sequence
  chemically synthesized
acagagctcaaggtgcttttat

SEQ ID NO: 5927 - DNA, 22 bp, Artificial Sequence
  chemically synthesized
cagagctcaaggtgcttttatg

SEQ ID NO: 5928 - DNA, 22 bp, Artificial Sequence
  chemically synthesized
aaggtgcttttatggggtttgt

SEQ ID NO: 5929 - DNA, 22 bp, Artificial Sequence
  chemically synthesized
ttatggggtttgtggggaggag

SEQ ID NO: 5930 - DNA, 22 bp, Artificial Sequence
  chemically synthesized
tatggggtttgtggggaggagt

SEQ ID NO: 5931 - DNA, 22 bp, Artificial Sequence
  chemically synthesized
atggggtttgtggggaggagtt

SEQ ID NO: 5932 - DNA, 22 bp, Artificial Sequence
  chemically synthesized
tggggtttgtggggaggagttg

SEQ ID NO: 5933 - DNA, 22 bp, Artificial Sequence
  chemically synthesized
gtggggaggagttgaggtttgg

SEQ ID NO: 5934 - DNA, 22 bp, Artificial Sequence
  chemically synthesized
tggggaggagttgaggtttggg

SEQ ID NO: 5935 - DNA, 22 bp, Artificial Sequence
  chemically synthesized
aggtttgggctgtatctgagtg

SEQ ID NO: 5936 - DNA, 22 bp, Artificial Sequence
  chemically synthesized
gggctgtatctgagtgacagga

SEQ ID NO: 5937 - DNA, 22 bp, Artificial Sequence
  chemically synthesized
ggctgtatctgagtgacaggat

SEQ ID NO: 5938 - DNA, 22 bp, Artificial Sequence
  chemically synthesized
tatctgagtgacaggatgatgt

SEQ ID NO: 5939 - DNA, 22 bp, Artificial Sequence
  chemically synthesized
agtgacaggatgatgttatttg

SEQ ID NO: 5940 - DNA, 22 bp, Artificial Sequence
  chemically synthesized
tttgattgaagtgtatagctat

SEQ ID NO: 5941 - DNA, 22 bp, Artificial Sequence
  chemically synthesized
gattgaagtgtatagctataca

SEQ ID NO: 5942 - DNA, 22 bp, Artificial Sequence
  chemically synthesized
attgaagtgtatagctatacaa

SEQ ID NO: 5943 - DNA, 22 bp, Artificial Sequence
  chemically synthesized
aagtgtatagctatacaatcta

SEQ ID NO: 5944 - DNA, 22 bp, Artificial Sequence
  chemically synthesized
tacaatctaaaattaaactgtg

SEQ ID NO: 5945 - DNA, 22 bp, Artificial Sequence
  chemically synthesized
aaattaaactgtgcatggtctt

SEQ ID NO: 5946 - DNA, 22 bp, Artificial Sequence
  chemically synthesized
aactgtgcatggtcttacctat

SEQ ID NO: 5947 - DNA, 22 bp, Artificial Sequence
  chemically synthesized
tgcatggtcttacctataattt

SEQ ID NO: 5948 - DNA, 22 bp, Artificial Sequence
  chemically synthesized
acctataatttgttaagaaaag

SEQ ID NO: 5949 - DNA, 22 bp, Artificial Sequence
  chemically synthesized
cctataatttgttaagaaaagc

SEQ ID NO: 5950 - DNA, 22 bp, Artificial Sequence
  chemically synthesized
taatttgttaagaaaagcctcc

SEQ ID NO: 5951 - DNA, 22 bp, Artificial Sequence
  chemically synthesized
gttaagaaaagcctcccaggga

SEQ ID NO: 5952 - DNA, 22 bp, Artificial Sequence
  chemically synthesized
ttaagaaaagcctcccagggat

SEQ ID NO: 5953 - DNA, 22 bp, Artificial Sequence
  chemically synthesized
agaaaagcctcccagggatggg

SEQ ID NO: 5954 - DNA, 22 bp, Artificial Sequence
  chemically synthesized
ccagggatgggggggcaaaact

SEQ ID NO: 5955 - DNA, 22 bp, Artificial Sequence
  chemically synthesized
tatgtaaattctattataatga

SEQ ID NO: 5956 - DNA, 22 bp, Artificial Sequence
  chemically synthesized
tattataatgatggcatgatga

SEQ ID NO: 5957 - DNA, 22 bp, Artificial Sequence
  chemically synthesized
ttataatgatggcatgatgaac

SEQ ID NO: 5958 - DNA, 22 bp, Artificial Sequence
  chemically synthesized
taatgatggcatgatgaacttg

SEQ ID NO: 5959 - DNA, 22 bp, Artificial Sequence
  chemically synthesized
ggggtgaacttgaagacaggct

SEQ ID NO: 5960 - DNA, 22 bp, Artificial Sequence
  chemically synthesized
gggtgaacttgaagacaggctt

SEQ ID NO: 5961 - DNA, 22 bp, Artificial Sequence
  chemically synthesized
gaagacaggcttttgtgttgtt

SEQ ID NO: 5962 - DNA, 22 bp, Artificial Sequence
  chemically synthesized
aagacaggcttttgtgttgttg

SEQ ID NO: 5963 - DNA, 22 bp, Artificial Sequence
  chemically synthesized
ttgtgttgttgggcatgtgcca

SEQ ID NO: 5964 - DNA, 22 bp, Artificial Sequence
  chemically synthesized
tgtgttgttgggcatgtgccac

SEQ ID NO: 5965 - DNA, 22 bp, Artificial Sequence
  chemically synthesized
gtgttgttgggcatgtgccacc

SEQ ID NO: 5966 - DNA, 22 bp, Artificial Sequence
  chemically synthesized
tgttgttgggcatgtgccacct

SEQ ID NO: 5967 - DNA, 22 bp, Artificial Sequence
  chemically synthesized
ttgggcatgtgccaccttaggg

SEQ ID NO: 5968 - DNA, 22 bp, Artificial Sequence
  chemically synthesized
ggcatgtgccaccttagggaat

SEQ ID NO: 5969 - DNA, 22 bp, Artificial Sequence
  chemically synthesized
agggaatttccacctgtaccct

SEQ ID NO: 5970 - DNA, 22 bp, Artificial Sequence
  chemically synthesized
gggaatttccacctgtaccctc

SEQ ID NO: 5971 - DNA, 22 bp, Artificial Sequence
  chemically synthesized
ccacctgtaccctcctttctct

SEQ ID NO: 5972 - DNA, 22 bp, Artificial Sequence
  chemically synthesized
cacctgtaccctcctttctctt

SEQ ID NO: 5973 - DNA, 22 bp, Artificial Sequence
  chemically synthesized
taccctcctttctctttctcca

SEQ ID NO: 5974 - DNA, 22 bp, Artificial Sequence
  chemically synthesized
ctttctctttctccaggatatt

SEQ ID NO: 5975 - DNA, 22 bp, Artificial Sequence
  chemically synthesized
tctctttctccaggatattttg

SEQ ID NO: 5976 - DNA, 22 bp, Artificial Sequence
  chemically synthesized
ctctttctccaggatattttgg

SEQ ID NO: 5977 - DNA, 22 bp, Artificial Sequence
  chemically synthesized
tctttctccaggatattttggc

SEQ ID NO: 5978 - DNA, 22 bp, Artificial Sequence
  chemically synthesized
tttctccaggatattttggcca

SEQ ID NO: 5979 - DNA, 22 bp, Artificial Sequence
  chemically synthesized
tctccaggatattttggccaca

SEQ ID NO: 5980 - DNA, 22 bp, Artificial Sequence
  chemically synthesized
ctccaggatattttggccacag

SEQ ID NO: 5981 - DNA, 22 bp, Artificial Sequence
  chemically synthesized
tccaggatattttggccacaga

SEQ ID NO: 5982 - DNA, 22 bp, Artificial Sequence
  chemically synthesized
caggatattttggccacagact

SEQ ID NO: 5983 - DNA, 22 bp, Artificial Sequence
  chemically synthesized
tggccacagactttatcataaa

SEQ ID NO: 5984 - DNA, 22 bp, Artificial Sequence
  chemically synthesized
ggccacagactttatcataaac

SEQ ID NO: 5985 - DNA, 22 bp, Artificial Sequence
  chemically synthesized
gccacagactttatcataaact

SEQ ID NO: 5986 - DNA, 22 bp, Artificial Sequence
  chemically synthesized
tatcataaactccatcccttag

SEQ ID NO: 5987 - DNA, 22 bp, Artificial Sequence
  chemically synthesized
atcataaactccatcccttagg

SEQ ID NO: 5988 - DNA, 22 bp, Artificial Sequence
  chemically synthesized
tcataaactccatcccttaggg

SEQ ID NO: 5989 - DNA, 22 bp, Artificial Sequence
  chemically synthesized
catcccttagggtggcattagg

SEQ ID NO: 5990 - DNA, 22 bp, Artificial Sequence
  chemically synthesized
agggtggcattagggtagtctt

SEQ ID NO: 5991 - DNA, 22 bp, Artificial Sequence
  chemically synthesized
gggtggcattagggtagtcttg

SEQ ID NO: 5992 - DNA, 22 bp, Artificial Sequence
  chemically synthesized
gggtagtcttgggcctgaattt

SEQ ID NO: 5993 - DNA, 22 bp, Artificial Sequence
  chemically synthesized
gggcctgaatttaggtgggcca

SEQ ID NO: 5994 - DNA, 22 bp, Artificial Sequence
  chemically synthesized
ggcctgaatttaggtgggccag

SEQ ID NO: 5995 - DNA, 22 bp, Artificial Sequence
  chemically synthesized
aatttaggtgggccagtggctg

SEQ ID NO: 5996 - DNA, 22 bp, Artificial Sequence
  chemically synthesized
aggtgggccagtggctgtctta

SEQ ID NO: 5997 - DNA, 22 bp, Artificial Sequence
  chemically synthesized
ggtgggccagtggctgtcttag

SEQ ID NO: 5998 - DNA, 22 bp, Artificial Sequence
  chemically synthesized
tcttagtgacagcctttccgct

SEQ ID NO: 5999 - DNA, 22 bp, Artificial Sequence
  chemically synthesized
agtgacagcctttccgctctct

SEQ ID NO: 6000 - DNA, 22 bp, Artificial Sequence
  chemically synthesized
gtgacagcctttccgctctctt

SEQ ID NO: 6001 - DNA, 22 bp, Artificial Sequence
  chemically synthesized
tccgctctcttctgtcatcccc

SEQ ID NO: 6002 - DNA, 22 bp, Artificial Sequence
  chemically synthesized
ccgctctcttctgtcatcccct

SEQ ID NO: 6003 - DNA, 22 bp, Artificial Sequence
  chemically synthesized
cgctctcttctgtcatcccctc

SEQ ID NO: 6004 - DNA, 22 bp, Artificial Sequence
  chemically synthesized
tcttctgtcatcccctcccaac

SEQ ID NO: 6005 - DNA, 22 bp, Artificial Sequence
  chemically synthesized
ttctgtcatcccctcccaactg

SEQ ID NO: 6006 - DNA, 22 bp, Artificial Sequence
  chemically synthesized
ctgtcatcccctcccaactgct

SEQ ID NO: 6007 - DNA, 22 bp, Artificial Sequence
  chemically synthesized
tgtcatcccctcccaactgcta

SEQ ID NO: 6008 - DNA, 22 bp, Artificial Sequence
  chemically synthesized
tcatcccctcccaactgctaat

SEQ ID NO: 6009 - DNA, 22 bp, Artificial Sequence
  chemically synthesized
ccaactgctaatgtctaactac

SEQ ID NO: 6010 - DNA, 22 bp, Artificial Sequence
  chemically synthesized
ctaatgtctaactacctaacaa

SEQ ID NO: 6011 - DNA, 22 bp, Artificial Sequence
  chemically synthesized
atgtctaactacctaacaatta

SEQ ID NO: 6012 - DNA, 22 bp, Artificial Sequence
  chemically synthesized
actacctaacaattacccatta

SEQ ID NO: 6013 - DNA, 22 bp, Artificial Sequence
  chemically synthesized
cctaacaattacccattaaatc

SEQ ID NO: 6014 - DNA, 22 bp, Artificial Sequence
  chemically synthesized
acaattacccattaaatcagtg

SEQ ID NO: 6015 - DNA, 22 bp, Artificial Sequence
  chemically synthesized
cccattaaatcagtgtgtctgg

SEQ ID NO: 6016 - DNA, 22 bp, Artificial Sequence
  chemically synthesized
aatcagtgtgtctggggttagg

SEQ ID NO: 6017 - DNA, 22 bp, Artificial Sequence
  chemically synthesized
gggttaggagcaggcctcaata

SEQ ID NO: 6018 - DNA, 22 bp, Artificial Sequence
  chemically synthesized
ggagcaggcctcaatatgttta

SEQ ID NO: 6019 - DNA, 22 bp, Artificial Sequence
  chemically synthesized
aatatgtttaatcattctccag

SEQ ID NO: 6020 - DNA, 22 bp, Artificial Sequence
  chemically synthesized
aatcattctccagataatccca

SEQ ID NO: 6021 - DNA, 22 bp, Artificial Sequence
  chemically synthesized
atcattctccagataatcccaa

SEQ ID NO: 6022 - DNA, 22 bp, Artificial Sequence
  chemically synthesized
tccagataatcccaatactgta

SEQ ID NO: 6023 - DNA, 22 bp, Artificial Sequence
  chemically synthesized
cagataatcccaatactgtaaa

SEQ ID NO: 6024 - DNA, 22 bp, Artificial Sequence
  chemically synthesized
taaagtttgtgaaacacttgtc

SEQ ID NO: 6025 - DNA, 22 bp, Artificial Sequence
  chemically synthesized
gtgaaacacttgtcagataatt

SEQ ID NO: 6026 - DNA, 22 bp, Artificial Sequence
  chemically synthesized
tgaaacacttgtcagataattc

SEQ ID NO: 6027 - DNA, 22 bp, Artificial Sequence
  chemically synthesized
gtcagataattcaattatgaag

SEQ ID NO: 6028 - DNA, 22 bp, Artificial Sequence
  chemically synthesized
tcagataattcaattatgaagg

SEQ ID NO: 6029 - DNA, 22 bp, Artificial Sequence
  chemically synthesized
aattatgaaggctgtggaaggt

SEQ ID NO: 6030 - DNA, 22 bp, Artificial Sequence
  chemically synthesized
tgaaggctgtggaaggtgtttc

SEQ ID NO: 6031 - DNA, 22 bp, Artificial Sequence
  chemically synthesized
tggaaggtgtttcagtaggatc

SEQ ID NO: 6032 - DNA, 22 bp, Artificial Sequence
  chemically synthesized
cagtaggatctaattggttaat

SEQ ID NO: 6033 - DNA, 22 bp, Artificial Sequence
  chemically synthesized
agtaggatctaattggttaatg

SEQ ID NO: 6034 - DNA, 22 bp, Artificial Sequence
  chemically synthesized
attggttaatgttatgacttaa

SEQ ID NO: 6035 - DNA, 22 bp, Artificial Sequence
  chemically synthesized
gttaatgttatgacttaattaa

SEQ ID NO: 6036 - DNA, 22 bp, Artificial Sequence
  chemically synthesized
atgttatgacttaattaatttg

SEQ ID NO: 6037 - DNA, 22 bp, Artificial Sequence
  chemically synthesized
tgacttaattaatttgaatcaa

SEQ ID NO: 6038 - DNA, 22 bp, Artificial Sequence
  chemically synthesized
aattaatttgaatcaaaaaaca

SEQ ID NO: 6039 - DNA, 22 bp, Artificial Sequence
  chemically synthesized
attaatttgaatcaaaaaacaa

SEQ ID NO: 6040 - DNA, 22 bp, Artificial Sequence
  chemically synthesized
atttgaatcaaaaaacaaaatg

SEQ ID NO: 6041 - DNA, 22 bp, Artificial Sequence
  chemically synthesized
gaatcaaaaaacaaaatgaaaa

SEQ ID NO: 6042 - DNA, 22 bp, Artificial Sequence
  chemically synthesized
aatcaaaaaacaaaatgaaaaa

SEQ ID NO: 6043 - DNA, 22 bp, Artificial Sequence
  chemically synthesized
tatatttctaagtcaaataaga

SEQ ID NO: 6044 - DNA, 22 bp, Artificial Sequence
  chemically synthesized
atatttctaagtcaaataagac

SEQ ID NO: 6045 - DNA, 22 bp, Artificial Sequence
  chemically synthesized
tatttctaagtcaaataagaca

SEQ ID NO: 6046 - DNA, 22 bp, Artificial Sequence
  chemically synthesized
ctaagtcaaataagacataagt

SEQ ID NO: 6047 - DNA, 22 bp, Artificial Sequence
  chemically synthesized
taagtcaaataagacataagtt

SEQ ID NO: 6048 - DNA, 22 bp, Artificial Sequence
  chemically synthesized
agtcaaataagacataagttgg

SEQ ID NO: 6049 - DNA, 22 bp, Artificial Sequence
  chemically synthesized
gtctaaggttgagataaaattt

SEQ ID NO: 6050 - DNA, 22 bp, Artificial Sequence
  chemically synthesized
aggttgagataaaatttttaaa

SEQ ID NO: 6051 - DNA, 22 bp, Artificial Sequence
  chemically synthesized
agataaaatttttaaatgtatg

SEQ ID NO: 6052 - DNA, 22 bp, Artificial Sequence
  chemically synthesized
ttaaatgtatgattgaattttg

SEQ ID NO: 6053 - DNA, 22 bp, Artificial Sequence
  chemically synthesized
taaatgtatgattgaattttga

SEQ ID NO: 6054 - DNA, 22 bp, Artificial Sequence
  chemically synthesized
aaatgtatgattgaattttgaa

SEQ ID NO: 6055 - DNA, 22 bp, Artificial Sequence
  chemically synthesized
aatgtatgattgaattttgaaa

SEQ ID NO: 6056 - DNA, 22 bp, Artificial Sequence
  chemically synthesized
aattttgaaaatcataaatatt

SEQ ID NO: 6057 - DNA, 22 bp, Artificial Sequence
  chemically synthesized
tgaaaatcataaatatttaaat

SEQ ID NO: 6058 - DNA, 22 bp, Artificial Sequence
  chemically synthesized
gaaaatcataaatatttaaata

SEQ ID NO: 6059 - DNA, 22 bp, Artificial Sequence
  chemically synthesized
aaaatcataaatatttaaatat

SEQ ID NO: 6060 - DNA, 22 bp, Artificial Sequence
  chemically synthesized
aaatatctaaagttcagatcag

SEQ ID NO: 6061 - DNA, 22 bp, Artificial Sequence
  chemically synthesized
aatatctaaagttcagatcaga

SEQ ID NO: 6062 - DNA, 22 bp, Artificial Sequence
  chemically synthesized
aagttcagatcagaacattgcg

SEQ ID NO: 6063 - DNA, 22 bp, Artificial Sequence
  chemically synthesized
agatcagaacattgcgaagcta

SEQ ID NO: 6064 - DNA, 22 bp, Artificial Sequence
  chemically synthesized
cgaagctactttccccaatcaa

SEQ ID NO: 6065 - DNA, 22 bp, Artificial Sequence
  chemically synthesized
ctttccccaatcaacaacaccc

SEQ ID NO: 6066 - DNA, 22 bp, Artificial Sequence
  chemically synthesized
tccccaatcaacaacacccctt

SEQ ID NO: 6067 - DNA, 22 bp, Artificial Sequence
  chemically synthesized
ccccaatcaacaacaccccttc

SEQ ID NO: 6068 - DNA, 22 bp, Artificial Sequence
  chemically synthesized
cccaatcaacaacaccccttca

SEQ ID NO: 6069 - DNA, 22 bp, Artificial Sequence
  chemically synthesized
caggatttaaaaaccaaggggg

SEQ ID NO: 6070 - DNA, 22 bp, Artificial Sequence
  chemically synthesized
aggatttaaaaaccaaggggga

SEQ ID NO: 6071 - DNA, 22 bp, Artificial Sequence
  chemically synthesized
aaaaaccaagggggacactgga

SEQ ID NO: 6072 - DNA, 22 bp, Artificial Sequence
  chemically synthesized
aaaaccaagggggacactggat

SEQ ID NO: 6073 - DNA, 22 bp, Artificial Sequence
  chemically synthesized
gatcacctagtgtttcacaagc

SEQ ID NO: 6074 - DNA, 22 bp, Artificial Sequence
  chemically synthesized
gtgtttcacaagcaggtacctt

SEQ ID NO: 6075 - DNA, 22 bp, Artificial Sequence
  chemically synthesized
cacaagcaggtaccttctgctg

SEQ ID NO: 6076 - DNA, 22 bp, Artificial Sequence
  chemically synthesized
acaagcaggtaccttctgctgt

SEQ ID NO: 6077 - DNA, 22 bp, Artificial Sequence
  chemically synthesized
ctgctgtaggagagagagaact

SEQ ID NO: 6078 - DNA, 22 bp, Artificial Sequence
  chemically synthesized
tgctgtaggagagagagaacta

SEQ ID NO: 6079 - DNA, 22 bp, Artificial Sequence
  chemically synthesized
ctgtaggagagagagaactaaa

SEQ ID NO: 6080 - DNA, 22 bp, Artificial Sequence
  chemically synthesized
taggagagagagaactaaagtt

SEQ ID NO: 6081 - DNA, 22 bp, Artificial Sequence
  chemically synthesized
aagttctgaaagacctgttgct

SEQ ID NO: 6082 - DNA, 22 bp, Artificial Sequence
  chemically synthesized
tgaaagacctgttgcttttcac

SEQ ID NO: 6083 - DNA, 22 bp, Artificial Sequence
  chemically synthesized
aaagacctgttgcttttcacca

SEQ ID NO: 6084 - DNA, 22 bp, Artificial Sequence
  chemically synthesized
ttgcttttcaccaggaagtttt

SEQ ID NO: 6085 - DNA, 22 bp, Artificial Sequence
  chemically synthesized
cttttcaccaggaagttttact

SEQ ID NO: 6086 - DNA, 22 bp, Artificial Sequence
  chemically synthesized
ttcaccaggaagttttactggg

SEQ ID NO: 6087 - DNA, 22 bp, Artificial Sequence
  chemically synthesized
tcaccaggaagttttactgggc

SEQ ID NO: 6088 - DNA, 22 bp, Artificial Sequence
  chemically synthesized
caccaggaagttttactgggca

SEQ ID NO: 6089 - DNA, 22 bp, Artificial Sequence
  chemically synthesized
accaggaagttttactgggcat

SEQ ID NO: 6090 - DNA, 22 bp, Artificial Sequence
  chemically synthesized
tactgggcatctcctgagccta

SEQ ID NO: 6091 - DNA, 22 bp, Artificial Sequence
  chemically synthesized
actgggcatctcctgagcctag

SEQ ID NO: 6092 - DNA, 22 bp, Artificial Sequence
  chemically synthesized
ctgggcatctcctgagcctagg

SEQ ID NO: 6093 - DNA, 22 bp, Artificial Sequence
  chemically synthesized
ggcatctcctgagcctaggcaa

SEQ ID NO: 6094 - DNA, 22 bp, Artificial Sequence
  chemically synthesized
ctgagcctaggcaatagctgta

SEQ ID NO: 6095 - DNA, 22 bp, Artificial Sequence
  chemically synthesized
agcctaggcaatagctgtaggg

SEQ ID NO: 6096 - DNA, 22 bp, Artificial Sequence
  chemically synthesized
ggcaatagctgtagggtgactt

SEQ ID NO: 6097 - DNA, 22 bp, Artificial Sequence
  chemically synthesized
tagggtgacttctggagccatc

SEQ ID NO: 6098 - DNA, 22 bp, Artificial Sequence
  chemically synthesized
ctggagccatccccgtttcccc

SEQ ID NO: 6099 - DNA, 22 bp, Artificial Sequence
  chemically synthesized
tggagccatccccgtttccccg

SEQ ID NO: 6100 - DNA, 22 bp, Artificial Sequence
  chemically synthesized
gagccatccccgtttccccgcc

SEQ ID NO: 6101 - DNA, 22 bp, Artificial Sequence
  chemically synthesized
ccccgccccccaaaagaagcgg

SEQ ID NO: 6102 - DNA, 22 bp, Artificial Sequence
  chemically synthesized
cccgccccccaaaagaagcgga

SEQ ID NO: 6103 - DNA, 22 bp, Artificial Sequence
  chemically synthesized
aacggggacgtgcggccagagc

SEQ ID NO: 6104 - DNA, 22 bp, Artificial Sequence
  chemically synthesized
acggggacgtgcggccagagct

SEQ ID NO: 6105 - DNA, 22 bp, Artificial Sequence
  chemically synthesized
gggaaatgggcccgcgagccag

SEQ ID NO: 6106 - DNA, 22 bp, Artificial Sequence
  chemically synthesized
ctcctcctgatgcttttgcaga

SEQ ID NO: 6107 - DNA, 22 bp, Artificial Sequence
  chemically synthesized
tcctcctgatgcttttgcagac

SEQ ID NO: 6108 - DNA, 22 bp, Artificial Sequence
  chemically synthesized
ctcctgatgcttttgcagaccg

SEQ ID NO: 6109 - DNA, 22 bp, Artificial Sequence
  chemically synthesized
ctgatgcttttgcagaccgcgg

SEQ ID NO: 6110 - DNA, 22 bp, Artificial Sequence
  chemically synthesized
atgcttttgcagaccgcggtcc

SEQ ID NO: 6111 - DNA, 22 bp, Artificial Sequence
  chemically synthesized
ttgcagaccgcggtcctgcagg

SEQ ID NO: 6112 - DNA, 22 bp, Artificial Sequence
  chemically synthesized
tgcagaccgcggtcctgcaggg

SEQ ID NO: 6113 - DNA, 22 bp, Artificial Sequence
  chemically synthesized
gcagaccgcggtcctgcagggg

SEQ ID NO: 6114 - DNA, 22 bp, Artificial Sequence
  chemically synthesized
cagaccgcggtcctgcaggggc

SEQ ID NO: 6115 - DNA, 22 bp, Artificial Sequence
  chemically synthesized
caggggcgcttgctgcgtgagt

SEQ ID NO: 6116 - DNA, 22 bp, Artificial Sequence
  chemically synthesized
gctgcgtgagtccgagggctgc

SEQ ID NO: 6117 - DNA, 22 bp, Artificial Sequence
  chemically synthesized
ctgcgtgagtccgagggctgcg

SEQ ID NO: 6118 - DNA, 22 bp, Artificial Sequence
  chemically synthesized
cgtgagtccgagggctgcgggc

SEQ ID NO: 6119 - DNA, 22 bp, Artificial Sequence
  chemically synthesized
cgggcgaactaggggcgcggcg

SEQ ID NO: 6120 - DNA, 22 bp, Artificial Sequence
  chemically synthesized
ggggcgcggcgggggtggaaaa

SEQ ID NO: 6121 - DNA, 22 bp, Artificial Sequence
  chemically synthesized
gctttttctttgcgcttgggag

SEQ ID NO: 6122 - DNA, 22 bp, Artificial Sequence
  chemically synthesized
tttctttgcgcttgggagtttg

SEQ ID NO: 6123 - DNA, 22 bp, Artificial Sequence
  chemically synthesized
ttctttgcgcttgggagtttgc

SEQ ID NO: 6124 - DNA, 22 bp, Artificial Sequence
  chemically synthesized
tctttgcgcttgggagtttgct

SEQ ID NO: 6125 - DNA, 22 bp, Artificial Sequence
  chemically synthesized
ctttgcgcttgggagtttgcta

SEQ ID NO: 6126 - DNA, 22 bp, Artificial Sequence
  chemically synthesized
tttgcgcttgggagtttgctaa

SEQ ID NO: 6127 - DNA, 22 bp, Artificial Sequence
  chemically synthesized
tgcgcttgggagtttgctaact

SEQ ID NO: 6128 - DNA, 22 bp, Artificial Sequence
  chemically synthesized
gcgcttgggagtttgctaactt

SEQ ID NO: 6129 - DNA, 22 bp, Artificial Sequence
  chemically synthesized
cgcttgggagtttgctaacttt

SEQ ID NO: 6130 - DNA, 22 bp, Artificial Sequence
  chemically synthesized
gggagtttgctaactttggagg

SEQ ID NO: 6131 - DNA, 22 bp, Artificial Sequence
  chemically synthesized
ggagtttgctaactttggagga

SEQ ID NO: 6132 - DNA, 22 bp, Artificial Sequence
  chemically synthesized
gctaactttggaggacctgctc

SEQ ID NO: 6133 - DNA, 22 bp, Artificial Sequence
  chemically synthesized
ctaactttggaggacctgctca

SEQ ID NO: 6134 - DNA, 22 bp, Artificial Sequence
  chemically synthesized
actttggaggacctgctcaacc

SEQ ID NO: 6135 - DNA, 22 bp, Artificial Sequence
  chemically synthesized
tggaggacctgctcaaccctat

SEQ ID NO: 6136 - DNA, 22 bp, Artificial Sequence
  chemically synthesized
ggaggacctgctcaaccctatc

SEQ ID NO: 6137 - DNA, 22 bp, Artificial Sequence
  chemically synthesized
gaggacctgctcaaccctatcc

SEQ ID NO: 6138 - DNA, 22 bp, Artificial Sequence
  chemically synthesized
ctcaaccctatccgcaagcccc

SEQ ID NO: 6139 - DNA, 22 bp, Artificial Sequence
  chemically synthesized
aaccctatccgcaagcccctct

SEQ ID NO: 6140 - DNA, 22 bp, Artificial Sequence
  chemically synthesized
tccgcaagcccctctccctact

SEQ ID NO: 6141 - DNA, 22 bp, Artificial Sequence
  chemically synthesized
tccctactttctgcgtccagac

SEQ ID NO: 6142 - DNA, 22 bp, Artificial Sequence
  chemically synthesized
cctactttctgcgtccagaccc

SEQ ID NO: 6143 - DNA, 22 bp, Artificial Sequence
  chemically synthesized
ctttctgcgtccagaccccgtg

SEQ ID NO: 6144 - DNA, 22 bp, Artificial Sequence
  chemically synthesized
tctgcgtccagaccccgtgagg

SEQ ID NO: 6145 - DNA, 22 bp, Artificial Sequence
  chemically synthesized
ctgcgtccagaccccgtgaggg

SEQ ID NO: 6146 - DNA, 22 bp, Artificial Sequence
  chemically synthesized
tgcgtccagaccccgtgaggga

SEQ ID NO: 6147 - DNA, 22 bp, Artificial Sequence
  chemically synthesized
cgtccagaccccgtgagggagt

SEQ ID NO: 6148 - DNA, 22 bp, Artificial Sequence
  chemically synthesized
ccactgaactgcagataggggt

SEQ ID NO: 6149 - DNA, 22 bp, Artificial Sequence
  chemically synthesized
aactgcagataggggtccctcg

SEQ ID NO: 6150 - DNA, 22 bp, Artificial Sequence
  chemically synthesized
cagataggggtccctcgcccca

SEQ ID NO: 6151 - DNA, 22 bp, Artificial Sequence
  chemically synthesized
gccccaggacctgccccctccc

SEQ ID NO: 6152 - DNA, 22 bp, Artificial Sequence
  chemically synthesized
ccccctcccccggctgtcccgg

SEQ ID NO: 6153 - DNA, 22 bp, Artificial Sequence
  chemically synthesized
ccccggctgtcccggctctgcg

SEQ ID NO: 6154 - DNA, 22 bp, Artificial Sequence
  chemically synthesized
tcccggctctgcggagtgactt

SEQ ID NO: 6155 - DNA, 22 bp, Artificial Sequence
  chemically synthesized
tgcggagtgacttttggaaccg

SEQ ID NO: 6156 - DNA, 22 bp, Artificial Sequence
  chemically synthesized
cggagtgacttttggaaccgcc

SEQ ID NO: 6157 - DNA, 22 bp, Artificial Sequence
  chemically synthesized
ttggaaccgcccactcccttcc

SEQ ID NO: 6158 - DNA, 22 bp, Artificial Sequence
  chemically synthesized
tggaaccgcccactcccttccc

SEQ ID NO: 6159 - DNA, 22 bp, Artificial Sequence
  chemically synthesized
ggaaccgcccactcccttcccc

SEQ ID NO: 6160 - DNA, 22 bp, Artificial Sequence
  chemically synthesized
gaaccgcccactcccttccccc

SEQ ID NO: 6161 - DNA, 22 bp, Artificial Sequence
  chemically synthesized
ccttcccccaactagaatgctt

SEQ ID NO: 6162 - DNA, 22 bp, Artificial Sequence
  chemically synthesized
cccccaactagaatgcttttaa

SEQ ID NO: 6163 - DNA, 22 bp, Artificial Sequence
  chemically synthesized
ccccaactagaatgcttttaaa

SEQ ID NO: 6164 - DNA, 22 bp, Artificial Sequence
  chemically synthesized
gaatgcttttaaataaatctcg

SEQ ID NO: 6165 - DNA, 22 bp, Artificial Sequence
  chemically synthesized
ttaaataaatctcgtagttcct

SEQ ID NO: 6166 - DNA, 22 bp, Artificial Sequence
  chemically synthesized
taaataaatctcgtagttcctc

SEQ ID NO: 6167 - DNA, 22 bp, Artificial Sequence
  chemically synthesized
aaataaatctcgtagttcctca

SEQ ID NO: 6168 - DNA, 22 bp, Artificial Sequence
  chemically synthesized
aataaatctcgtagttcctcac

SEQ ID NO: 6169 - DNA, 22 bp, Artificial Sequence
  chemically synthesized
gtagttcctcacttgagctgag

SEQ ID NO: 6170 - DNA, 22 bp, Artificial Sequence
  chemically synthesized
ctcacttgagctgagctaagcc

SEQ ID NO: 6171 - DNA, 22 bp, Artificial Sequence
  chemically synthesized
acttgagctgagctaagcctgg

SEQ ID NO: 6172 - DNA, 22 bp, Artificial Sequence
  chemically synthesized
gagctgagctaagcctggggct

SEQ ID NO: 6173 - DNA, 22 bp, Artificial Sequence
  chemically synthesized
agctgagctaagcctggggctc

SEQ ID NO: 6174 - DNA, 22 bp, Artificial Sequence
  chemically synthesized
agctaagcctggggctccttga

SEQ ID NO: 6175 - DNA, 22 bp, Artificial Sequence
  chemically synthesized
agcctggggctccttgaacctg

SEQ ID NO: 6176 - DNA, 22 bp, Artificial Sequence
  chemically synthesized
gggctccttgaacctggaactc

SEQ ID NO: 6177 - DNA, 22 bp, Artificial Sequence
  chemically synthesized
cttgaacctggaactcgggttt

SEQ ID NO: 6178 - DNA, 22 bp, Artificial Sequence
  chemically synthesized
gaacctggaactcgggtttatt

SEQ ID NO: 6179 - DNA, 22 bp, Artificial Sequence
  chemically synthesized
aacctggaactcgggtttattt

SEQ ID NO: 6180 - DNA, 22 bp, Artificial Sequence
  chemically synthesized
gaactcgggtttatttccaatg

SEQ ID NO: 6181 - DNA, 22 bp, Artificial Sequence
  chemically synthesized
gggtttatttccaatgtcagct

SEQ ID NO: 6182 - DNA, 22 bp, Artificial Sequence
  chemically synthesized
atttccaatgtcagctgtgcag

SEQ ID NO: 6183 - DNA, 22 bp, Artificial Sequence
  chemically synthesized
tttccaatgtcagctgtgcagt

SEQ ID NO: 6184 - DNA, 22 bp, Artificial Sequence
  chemically synthesized
ccaatgtcagctgtgcagtttt

SEQ ID NO: 6185 - DNA, 22 bp, Artificial Sequence
  chemically synthesized
caatgtcagctgtgcagttttt

SEQ ID NO: 6186 - DNA, 22 bp, Artificial Sequence
  chemically synthesized
tgcagttttttccccagtcatc

SEQ ID NO: 6187 - DNA, 22 bp, Artificial Sequence
  chemically synthesized
tttccccagtcatctccaaaca

SEQ ID NO: 6188 - DNA, 22 bp, Artificial Sequence
  chemically synthesized
ttccccagtcatctccaaacag

SEQ ID NO: 6189 - DNA, 22 bp, Artificial Sequence
  chemically synthesized
tccccagtcatctccaaacagg

SEQ ID NO: 6190 - DNA, 22 bp, Artificial Sequence
  chemically synthesized
ccccagtcatctccaaacagga

SEQ ID NO: 6191 - DNA, 22 bp, Artificial Sequence
  chemically synthesized
cccagtcatctccaaacaggaa

SEQ ID NO: 6192 - DNA, 22 bp, Artificial Sequence
  chemically synthesized
caaacaggaagttcttccctga

SEQ ID NO: 6193 - DNA, 22 bp, Artificial Sequence
  chemically synthesized
ttccctgagtgcttgccgagaa

SEQ ID NO: 6194 - DNA, 22 bp, Artificial Sequence
  chemically synthesized
ccctgagtgcttgccgagaagg

SEQ ID NO: 6195 - DNA, 22 bp, Artificial Sequence
  chemically synthesized
cctgagtgcttgccgagaaggc

SEQ ID NO: 6196 - DNA, 22 bp, Artificial Sequence
  chemically synthesized
agtgcttgccgagaaggctgag

SEQ ID NO: 6197 - DNA, 22 bp, Artificial Sequence
  chemically synthesized
gccgagaaggctgagcaaaccc

SEQ ID NO: 6198 - DNA, 22 bp, Artificial Sequence
  chemically synthesized
ccgagaaggctgagcaaaccca

SEQ ID NO: 6199 - DNA, 22 bp, Artificial Sequence
  chemically synthesized
agcaaacccacagcaggatccg

SEQ ID NO: 6200 - DNA, 22 bp, Artificial Sequence
  chemically synthesized
ccacctcagaacgaatgcgttg

SEQ ID NO: 6201 - DNA, 22 bp, Artificial Sequence
  chemically synthesized
cacctcagaacgaatgcgttgg

SEQ ID NO: 6202 - DNA, 22 bp, Artificial Sequence
  chemically synthesized
agaacgaatgcgttgggcggtg

SEQ ID NO: 6203 - DNA, 22 bp, Artificial Sequence
  chemically synthesized
ggcggtgggggcgcgaaagagt

SEQ ID NO: 6204 - DNA, 22 bp, Artificial Sequence
  chemically synthesized
gggatctgaattcttcaccatt

SEQ ID NO: 6205 - DNA, 22 bp, Artificial Sequence
  chemically synthesized
aattcttcaccattccacccac

SEQ ID NO: 6206 - DNA, 22 bp, Artificial Sequence
  chemically synthesized
ttcaccattccacccacttttg

SEQ ID NO: 6207 - DNA, 22 bp, Artificial Sequence
  chemically synthesized
caccattccacccacttttggt

SEQ ID NO: 6208 - DNA, 22 bp, Artificial Sequence
  chemically synthesized
accattccacccacttttggtg

SEQ ID NO: 6209 - DNA, 22 bp, Artificial Sequence
  chemically synthesized
cacccacttttggtgagacctg

SEQ ID NO: 6210 - DNA, 22 bp, Artificial Sequence
  chemically synthesized
ttggtgagacctggggtggagg

SEQ ID NO: 6211 - DNA, 22 bp, Artificial Sequence
  chemically synthesized
tggtgagacctggggtggaggt

SEQ ID NO: 6212 - DNA, 22 bp, Artificial Sequence
  chemically synthesized
ggtgagacctggggtggaggtc

SEQ ID NO: 6213 - DNA, 22 bp, Artificial Sequence
  chemically synthesized
gtgagacctggggtggaggtct

SEQ ID NO: 6214 - DNA, 22 bp, Artificial Sequence
  chemically synthesized
gggtggaggtctctagggtggg

SEQ ID NO: 6215 - DNA, 22 bp, Artificial Sequence
  chemically synthesized
tagggtgggaggctcctgagag

SEQ ID NO: 6216 - DNA, 22 bp, Artificial Sequence
  chemically synthesized
gggtgggaggctcctgagagag

SEQ ID NO: 6217 - DNA, 22 bp, Artificial Sequence
  chemically synthesized
ctgagagaggcctacctcgggc

SEQ ID NO: 6218 - DNA, 22 bp, Artificial Sequence
  chemically synthesized
agagaggcctacctcgggcctt

SEQ ID NO: 6219 - DNA, 22 bp, Artificial Sequence
  chemically synthesized
cctcgggcctttccccactctt

SEQ ID NO: 6220 - DNA, 22 bp, Artificial Sequence
  chemically synthesized
gggcctttccccactcttggca

SEQ ID NO: 6221 - DNA, 22 bp, Artificial Sequence
  chemically synthesized
tccccactcttggcaattgttc

SEQ ID NO: 6222 - DNA, 22 bp, Artificial Sequence
  chemically synthesized
ccccactcttggcaattgttct

SEQ ID NO: 6223 - DNA, 22 bp, Artificial Sequence
  chemically synthesized
cccactcttggcaattgttctt

SEQ ID NO: 6224 - DNA, 22 bp, Artificial Sequence
  chemically synthesized
ttggcaattgttcttttgcctg

SEQ ID NO: 6225 - DNA, 22 bp, Artificial Sequence
  chemically synthesized
ggcaattgttcttttgcctgga

SEQ ID NO: 6226 - DNA, 22 bp, Artificial Sequence
  chemically synthesized
gcaattgttcttttgcctggaa

SEQ ID NO: 6227 - DNA, 22 bp, Artificial Sequence
  chemically synthesized
ttcttttgcctggaaaattaag

SEQ ID NO: 6228 - DNA, 22 bp, Artificial Sequence
  chemically synthesized
ttttgcctggaaaattaagtat

SEQ ID NO: 6229 - DNA, 22 bp, Artificial Sequence
  chemically synthesized
ttgcctggaaaattaagtatat

SEQ ID NO: 6230 - DNA, 22 bp, Artificial Sequence
  chemically synthesized
tgcctggaaaattaagtatatg

SEQ ID NO: 6231 - DNA, 22 bp, Artificial Sequence
  chemically synthesized
gcctggaaaattaagtatatgt

SEQ ID NO: 6232 - DNA, 22 bp, Artificial Sequence
  chemically synthesized
cctggaaaattaagtatatgtt

SEQ ID NO: 6233 - DNA, 22 bp, Artificial Sequence
  chemically synthesized
gaaaattaagtatatgttagtt

SEQ ID NO: 6234 - DNA, 22 bp, Artificial Sequence
  chemically synthesized
agtatatgttagttttgaacgt

SEQ ID NO: 6235 - DNA, 22 bp, Artificial Sequence
  chemically synthesized
gttttgaacgtttgaactgaac

SEQ ID NO: 6236 - DNA, 22 bp, Artificial Sequence
  chemically synthesized
tgaacgtttgaactgaacaatt

SEQ ID NO: 6237 - DNA, 22 bp, Artificial Sequence
  chemically synthesized
gaacgtttgaactgaacaattc

SEQ ID NO: 6238 - DNA, 22 bp, Artificial Sequence
  chemically synthesized
aacgtttgaactgaacaattct

SEQ ID NO: 6239 - DNA, 22 bp, Artificial Sequence
  chemically synthesized
gaactgaacaattctcttttcg

SEQ ID NO: 6240 - DNA, 22 bp, Artificial Sequence
  chemically synthesized
aactgaacaattctcttttcgg

SEQ ID NO: 6241 - DNA, 22 bp, Artificial Sequence
  chemically synthesized
aacaattctcttttcggctagg

SEQ ID NO: 6242 - DNA, 22 bp, Artificial Sequence
  chemically synthesized
tcttttcggctaggctttattg

SEQ ID NO: 6243 - DNA, 22 bp, Artificial Sequence
  chemically synthesized
ttttcggctaggctttattgat

SEQ ID NO: 6244 - DNA, 22 bp, Artificial Sequence
  chemically synthesized
ttcggctaggctttattgattt

SEQ ID NO: 6245 - DNA, 22 bp, Artificial Sequence
  chemically synthesized
tcggctaggctttattgatttg

SEQ ID NO: 6246 - DNA, 22 bp, Artificial Sequence
  chemically synthesized
cggctaggctttattgatttgc

SEQ ID NO: 6247 - DNA, 22 bp, Artificial Sequence
  chemically synthesized
ggctaggctttattgatttgca

SEQ ID NO: 6248 - DNA, 22 bp, Artificial Sequence
  chemically synthesized
ggctttattgatttgcaatgtg

SEQ ID NO: 6249 - DNA, 22 bp, Artificial Sequence
  chemically synthesized
tattgatttgcaatgtgctgtg

SEQ ID NO: 6250 - DNA, 22 bp, Artificial Sequence
  chemically synthesized
attgatttgcaatgtgctgtgt

SEQ ID NO: 6251 - DNA, 22 bp, Artificial Sequence
  chemically synthesized
ttgatttgcaatgtgctgtgta

SEQ ID NO: 6252 - DNA, 22 bp, Artificial Sequence
  chemically synthesized
atttgcaatgtgctgtgtaatt

SEQ ID NO: 6253 - DNA, 22 bp, Artificial Sequence
  chemically synthesized
gcaatgtgctgtgtaattaaga

SEQ ID NO: 6254 - DNA, 22 bp, Artificial Sequence
  chemically synthesized
caatgtgctgtgtaattaagag

SEQ ID NO: 6255 - DNA, 22 bp, Artificial Sequence
  chemically synthesized
tgtaattaagaggcctctctac

SEQ ID NO: 6256 - DNA, 22 bp, Artificial Sequence
  chemically synthesized
agaggcctctctacaaagtact

SEQ ID NO: 6257 - DNA, 22 bp, Artificial Sequence
  chemically synthesized
tctacaaagtactgataatgaa

SEQ ID NO: 6258 - DNA, 22 bp, Artificial Sequence
  chemically synthesized
tacaaagtactgataatgaaca

SEQ ID NO: 6259 - DNA, 22 bp, Artificial Sequence
  chemically synthesized
caaagtactgataatgaacatg

SEQ ID NO: 6260 - DNA, 22 bp, Artificial Sequence
  chemically synthesized
ataatgaacatgtaagcaatgc

SEQ ID NO: 6261 - DNA, 22 bp, Artificial Sequence
  chemically synthesized
acttctaagttacattcatatc

SEQ ID NO: 6262 - DNA, 22 bp, Artificial Sequence
  chemically synthesized
ctaagttacattcatatctgat

SEQ ID NO: 6263 - DNA, 22 bp, Artificial Sequence
  chemically synthesized
taagttacattcatatctgatc

SEQ ID NO: 6264 - DNA, 22 bp, Artificial Sequence
  chemically synthesized
agttacattcatatctgatctt

SEQ ID NO: 6265 - DNA, 22 bp, Artificial Sequence
  chemically synthesized
cattcatatctgatcttatttg

SEQ ID NO: 6266 - DNA, 22 bp, Artificial Sequence
  chemically synthesized
atatctgatcttatttgatttt

SEQ ID NO: 6267 - DNA, 22 bp, Artificial Sequence
  chemically synthesized
atcttatttgattttcactagg

SEQ ID NO: 6268 - DNA, 22 bp, Artificial Sequence
  chemically synthesized
atttgattttcactaggcatag

SEQ ID NO: 6269 - DNA, 22 bp, Artificial Sequence
  chemically synthesized
tttgattttcactaggcatagg

SEQ ID NO: 6270 - DNA, 22 bp, Artificial Sequence
  chemically synthesized
gattttcactaggcatagggag

SEQ ID NO: 6271 - DNA, 22 bp, Artificial Sequence
  chemically synthesized
attttcactaggcatagggagg

SEQ ID NO: 6272 - DNA, 22 bp, Artificial Sequence
  chemically synthesized
tcactaggcatagggaggtagg

SEQ ID NO: 6273 - DNA, 22 bp, Artificial Sequence
  chemically synthesized
cactaggcatagggaggtagga

SEQ ID NO: 6274 - DNA, 22 bp, Artificial Sequence
  chemically synthesized
actaggcatagggaggtaggag

SEQ ID NO: 6275 - DNA, 22 bp, Artificial Sequence
  chemically synthesized
ggcatagggaggtaggagctaa

SEQ ID NO: 6276 - DNA, 22 bp, Artificial Sequence
  chemically synthesized
ataatacgtttattttactaga

SEQ ID NO: 6277 - DNA, 22 bp, Artificial Sequence
  chemically synthesized
attttactagaagttaactgga

SEQ ID NO: 6278 - DNA, 22 bp, Artificial Sequence
  chemically synthesized
ttttactagaagttaactggaa

SEQ ID NO: 6279 - DNA, 22 bp, Artificial Sequence
  chemically synthesized
tactagaagttaactggaattc

SEQ ID NO: 6280 - DNA, 22 bp, Artificial Sequence
  chemically synthesized
actagaagttaactggaattca

SEQ ID NO: 6281 - DNA, 22 bp, Artificial Sequence
  chemically synthesized
ctagaagttaactggaattcag

SEQ ID NO: 6282 - DNA, 22 bp, Artificial Sequence
  chemically synthesized
gaagttaactggaattcagatt

SEQ ID NO: 6283 - DNA, 22 bp, Artificial Sequence
  chemically synthesized
actggaattcagattatataac

SEQ ID NO: 6284 - DNA, 22 bp, Artificial Sequence
  chemically synthesized
gaattcagattatataactctt

SEQ ID NO: 6285 - DNA, 22 bp, Artificial Sequence
  chemically synthesized
agattatataactcttttcagg

SEQ ID NO: 6286 - DNA, 22 bp, Artificial Sequence
  chemically synthesized
tataactcttttcaggttacaa

SEQ ID NO: 6287 - DNA, 22 bp, Artificial Sequence
  chemically synthesized
ttttcaggttacaaagaacata

SEQ ID NO: 6288 - DNA, 22 bp, Artificial Sequence
  chemically synthesized
ttcaggttacaaagaacataaa

SEQ ID NO: 6289 - DNA, 22 bp, Artificial Sequence
  chemically synthesized
tcaggttacaaagaacataaat

SEQ ID NO: 6290 - DNA, 22 bp, Artificial Sequence
  chemically synthesized
caggttacaaagaacataaata

SEQ ID NO: 6291 - DNA, 22 bp, Artificial Sequence
  chemically synthesized
aggttacaaagaacataaataa

SEQ ID NO: 6292 - DNA, 22 bp, Artificial Sequence
  chemically synthesized
caaagaacataaataatctggt

SEQ ID NO: 6293 - DNA, 22 bp, Artificial Sequence
  chemically synthesized
gttttctgatgttatttcaagt

SEQ ID NO: 6294 - DNA, 22 bp, Artificial Sequence
  chemically synthesized
tctgatgttatttcaagtacta

SEQ ID NO: 6295 - DNA, 22 bp, Artificial Sequence
  chemically synthesized
ctgatgttatttcaagtactac

SEQ ID NO: 6296 - DNA, 22 bp, Artificial Sequence
  chemically synthesized
tgatgttatttcaagtactaca

SEQ ID NO: 6297 - DNA, 22 bp, Artificial Sequence
  chemically synthesized
atgttatttcaagtactacagc

SEQ ID NO: 6298 - DNA, 22 bp, Artificial Sequence
  chemically synthesized
tttcaagtactacagctgcttc

SEQ ID NO: 6299 - DNA, 22 bp, Artificial Sequence
  chemically synthesized
caagtactacagctgcttctaa

SEQ ID NO: 6300 - DNA, 22 bp, Artificial Sequence
  chemically synthesized
aagtactacagctgcttctaat

SEQ ID NO: 6301 - DNA, 22 bp, Artificial Sequence
  chemically synthesized
cagctgcttctaatcttagttg

SEQ ID NO: 6302 - DNA, 22 bp, Artificial Sequence
  chemically synthesized
cttctaatcttagttgacagtg

SEQ ID NO: 6303 - DNA, 22 bp, Artificial Sequence
  chemically synthesized
ctaatcttagttgacagtgatt

SEQ ID NO: 6304 - DNA, 22 bp, Artificial Sequence
  chemically synthesized
taatcttagttgacagtgattt

SEQ ID NO: 6305 - DNA, 22 bp, Artificial Sequence
  chemically synthesized
atcttagttgacagtgattttg

SEQ ID NO: 6306 - DNA, 22 bp, Artificial Sequence
  chemically synthesized
agttgacagtgattttgccctg

SEQ ID NO: 6307 - DNA, 22 bp, Artificial Sequence
  chemically synthesized
gttgacagtgattttgccctgt

SEQ ID NO: 6308 - DNA, 22 bp, Artificial Sequence
  chemically synthesized
acagtgattttgccctgtagtg

SEQ ID NO: 6309 - DNA, 22 bp, Artificial Sequence
  chemically synthesized
tgccctgtagtgtagcacagtg

SEQ ID NO: 6310 - DNA, 22 bp, Artificial Sequence
  chemically synthesized
gccctgtagtgtagcacagtgt

SEQ ID NO: 6311 - DNA, 22 bp, Artificial Sequence
  chemically synthesized
ccctgtagtgtagcacagtgtt

SEQ ID NO: 6312 - DNA, 22 bp, Artificial Sequence
  chemically synthesized
tagtgtagcacagtgttctgtg

SEQ ID NO: 6313 - DNA, 22 bp, Artificial Sequence
  chemically synthesized
tgtgggtcacacgccggcctca

SEQ ID NO: 6314 - DNA, 22 bp, Artificial Sequence
  chemically synthesized
tgggtcacacgccggcctcagc

SEQ ID NO: 6315 - DNA, 22 bp, Artificial Sequence
  chemically synthesized
agcacagcactttgagttttgg

SEQ ID NO: 6316 - DNA, 22 bp, Artificial Sequence
  chemically synthesized
tgagttttggtactacgtgtat

SEQ ID NO: 6317 - DNA, 22 bp, Artificial Sequence
  chemically synthesized
gagttttggtactacgtgtatc

SEQ ID NO: 6318 - DNA, 22 bp, Artificial Sequence
  chemically synthesized
agttttggtactacgtgtatcc

SEQ ID NO: 6319 - DNA, 22 bp, Artificial Sequence
  chemically synthesized
tggtactacgtgtatccacatt

SEQ ID NO: 6320 - DNA, 22 bp, Artificial Sequence
  chemically synthesized
ggtactacgtgtatccacattt

SEQ ID NO: 6321 - DNA, 22 bp, Artificial Sequence
  chemically synthesized
gtactacgtgtatccacatttt

SEQ ID NO: 6322 - DNA, 22 bp, Artificial Sequence
  chemically synthesized
cgtgtatccacattttacacat

SEQ ID NO: 6323 - DNA, 22 bp, Artificial Sequence
  chemically synthesized
tacacatgacaagaatgaggca

SEQ ID NO: 6324 - DNA, 22 bp, Artificial Sequence
  chemically synthesized
acacatgacaagaatgaggcat

SEQ ID NO: 6325 - DNA, 22 bp, Artificial Sequence
  chemically synthesized
cacatgacaagaatgaggcatg

SEQ ID NO: 6326 - DNA, 22 bp, Artificial Sequence
  chemically synthesized
cttcctggcaaatttattcaat

SEQ ID NO: 6327 - DNA, 22 bp, Artificial Sequence
  chemically synthesized
cctggcaaatttattcaatggt

SEQ ID NO: 6328 - DNA, 22 bp, Artificial Sequence
  chemically synthesized
ctggcaaatttattcaatggta

SEQ ID NO: 6329 - DNA, 22 bp, Artificial Sequence
  chemically synthesized
gcaaatttattcaatggtacac

SEQ ID NO: 6330 - DNA, 22 bp, Artificial Sequence
  chemically synthesized
attcaatggtacactgggcttt

SEQ ID NO: 6331 - DNA, 22 bp, Artificial Sequence
  chemically synthesized
ttcaatggtacactgggctttg

SEQ ID NO: 6332 - DNA, 22 bp, Artificial Sequence
  chemically synthesized
aatggtacactgggctttggtg

SEQ ID NO: 6333 - DNA, 22 bp, Artificial Sequence
  chemically synthesized
ggctttggtggcagagctcatg

SEQ ID NO: 6334 - DNA, 22 bp, Artificial Sequence
  chemically synthesized
tggtggcagagctcatgtctcc

SEQ ID NO: 6335 - DNA, 22 bp, Artificial Sequence
  chemically synthesized
ggtggcagagctcatgtctcca

SEQ ID NO: 6336 - DNA, 22 bp, Artificial Sequence
  chemically synthesized
gtggcagagctcatgtctccac

SEQ ID NO: 6337 - DNA, 22 bp, Artificial Sequence
  chemically synthesized
atgtctccacttcatagctatg

SEQ ID NO: 6338 - DNA, 22 bp, Artificial Sequence
  chemically synthesized
cacttcatagctatgattctta

SEQ ID NO: 6339 - DNA, 22 bp, Artificial Sequence
  chemically synthesized
catagctatgattcttaaacat

SEQ ID NO: 6340 - DNA, 22 bp, Artificial Sequence
  chemically synthesized
atagctatgattcttaaacatc

SEQ ID NO: 6341 - DNA, 22 bp, Artificial Sequence
  chemically synthesized
tgattcttaaacatcacactgc

SEQ ID NO: 6342 - DNA, 22 bp, Artificial Sequence
  chemically synthesized
ttaaacatcacactgcattaga

SEQ ID NO: 6343 - DNA, 22 bp, Artificial Sequence
  chemically synthesized
aaacatcacactgcattagagg

SEQ ID NO: 6344 - DNA, 22 bp, Artificial Sequence
  chemically synthesized
aacatcacactgcattagaggt

SEQ ID NO: 6345 - DNA, 22 bp, Artificial Sequence
  chemically synthesized
cattagaggttgaataataaaa

SEQ ID NO: 6346 - DNA, 22 bp, Artificial Sequence
  chemically synthesized
gaggttgaataataaaatttca

SEQ ID NO: 6347 - DNA, 22 bp, Artificial Sequence
  chemically synthesized
aataataaaatttcatgttgag

SEQ ID NO: 6348 - DNA, 22 bp, Artificial Sequence
  chemically synthesized
catgttgagcagaaatattcat

SEQ ID NO: 6349 - DNA, 22 bp, Artificial Sequence
  chemically synthesized
atgttgagcagaaatattcatt

SEQ ID NO: 6350 - DNA, 22 bp, Artificial Sequence
  chemically synthesized
agcagaaatattcattgtttac

SEQ ID NO: 6351 - DNA, 22 bp, Artificial Sequence
  chemically synthesized
attgtttacaagtgtaaatgag

SEQ ID NO: 6352 - DNA, 22 bp, Artificial Sequence
  chemically synthesized
tttacaagtgtaaatgagtccc

SEQ ID NO: 6353 - DNA, 22 bp, Artificial Sequence
  chemically synthesized
acaagtgtaaatgagtcccagc

SEQ ID NO: 6354 - DNA, 22 bp, Artificial Sequence
  chemically synthesized
caagtgtaaatgagtcccagcc

SEQ ID NO: 6355 - DNA, 22 bp, Artificial Sequence
  chemically synthesized
cactgttcaagccccaagggag

SEQ ID NO: 6356 - DNA, 22 bp, Artificial Sequence
  chemically synthesized
ttcaagccccaagggagagagc

SEQ ID NO: 6357 - DNA, 22 bp, Artificial Sequence
  chemically synthesized
aagccccaagggagagagcagg

SEQ ID NO: 6358 - DNA, 22 bp, Artificial Sequence
  chemically synthesized
taccctttgatattttgcattc

SEQ ID NO: 6359 - DNA, 22 bp, Artificial Sequence
  chemically synthesized
accctttgatattttgcattct

SEQ ID NO: 6360 - DNA, 22 bp, Artificial Sequence
  chemically synthesized
ccctttgatattttgcattcta

SEQ ID NO: 6361 - DNA, 22 bp, Artificial Sequence
  chemically synthesized
tgatattttgcattctagtggg

SEQ ID NO: 6362 - DNA, 22 bp, Artificial Sequence
  chemically synthesized
gatattttgcattctagtggga

SEQ ID NO: 6363 - DNA, 22 bp, Artificial Sequence
  chemically synthesized
atattttgcattctagtgggag

SEQ ID NO: 6364 - DNA, 22 bp, Artificial Sequence
  chemically synthesized
tgcattctagtgggagagatga

SEQ ID NO: 6365 - DNA, 22 bp, Artificial Sequence
  chemically synthesized
gcattctagtgggagagatgac

SEQ ID NO: 6366 - DNA, 22 bp, Artificial Sequence
  chemically synthesized
cattctagtgggagagatgaca

SEQ ID NO: 6367 - DNA, 22 bp, Artificial Sequence
  chemically synthesized
tagtgggagagatgacaataag

SEQ ID NO: 6368 - DNA, 22 bp, Artificial Sequence
  chemically synthesized
gtgggagagatgacaataagca

SEQ ID NO: 6369 - DNA, 22 bp, Artificial Sequence
  chemically synthesized
tgagaagcagagaagtcagggc

SEQ ID NO: 6370 - DNA, 22 bp, Artificial Sequence
  chemically synthesized
tggggctgacacttgagcagag

SEQ ID NO: 6371 - DNA, 22 bp, Artificial Sequence
  chemically synthesized
gggctgacacttgagcagagac

SEQ ID NO: 6372 - DNA, 22 bp, Artificial Sequence
  chemically synthesized
acacttgagcagagacatgaag

SEQ ID NO: 6373 - DNA, 22 bp, Artificial Sequence
  chemically synthesized
gagcagagacatgaaggaaata

SEQ ID NO: 6374 - DNA, 22 bp, Artificial Sequence
  chemically synthesized
agcagagacatgaaggaaataa

SEQ ID NO: 6375 - DNA, 22 bp, Artificial Sequence
  chemically synthesized
actgggagcagtatttcccagg

SEQ ID NO: 6376 - DNA, 22 bp, Artificial Sequence
  chemically synthesized
ggagcagtatttcccaggcaaa

SEQ ID NO: 6377 - DNA, 22 bp, Artificial Sequence
  chemically synthesized
cccaggcaaactgagtgggcct

SEQ ID NO: 6378 - DNA, 22 bp, Artificial Sequence
  chemically synthesized
ccaggcaaactgagtgggcctg

SEQ ID NO: 6379 - DNA, 22 bp, Artificial Sequence
  chemically synthesized
agtgggcctggcaagttggatt

SEQ ID NO: 6380 - DNA, 22 bp, Artificial Sequence
  chemically synthesized
gcaagttggattaaaaagcggg

SEQ ID NO: 6381 - DNA, 22 bp, Artificial Sequence
  chemically synthesized
gattaaaaagcgggttttctca

SEQ ID NO: 6382 - DNA, 22 bp, Artificial Sequence
  chemically synthesized
aaaagcgggttttctcagcact

SEQ ID NO: 6383 - DNA, 22 bp, Artificial Sequence
  chemically synthesized
tctcagcactactcatgtgtgt

SEQ ID NO: 6384 - DNA, 22 bp, Artificial Sequence
  chemically synthesized
ctcagcactactcatgtgtgtg

SEQ ID NO: 6385 - DNA, 22 bp, Artificial Sequence
  chemically synthesized
tcagcactactcatgtgtgtgt

SEQ ID NO: 6386 - DNA, 22 bp, Artificial Sequence
  chemically synthesized
agcactactcatgtgtgtgtgt

SEQ ID NO: 6387 - DNA, 22 bp, Artificial Sequence
  chemically synthesized
ctcatgtgtgtgtgtgtggggg

SEQ ID NO: 6388 - DNA, 22 bp, Artificial Sequence
  chemically synthesized
atgtgtgtgtgtgtgggggggg

SEQ ID NO: 6389 - DNA, 22 bp, Artificial Sequence
  chemically synthesized
ccatctgcatgtaggatgtcta

SEQ ID NO: 6390 - DNA, 22 bp, Artificial Sequence
  chemically synthesized
catgtaggatgtctagcagtat

SEQ ID NO: 6391 - DNA, 22 bp, Artificial Sequence
  chemically synthesized
gcagtatcctgtcctccctact

SEQ ID NO: 6392 - DNA, 22 bp, Artificial Sequence
  chemically synthesized
tcctccctactcactaggtgct

SEQ ID NO: 6393 - DNA, 22 bp, Artificial Sequence
  chemically synthesized
cctactcactaggtgctaggag

SEQ ID NO: 6394 - DNA, 22 bp, Artificial Sequence
  chemically synthesized
ctcactaggtgctaggagcact

SEQ ID NO: 6395 - DNA, 22 bp, Artificial Sequence
  chemically synthesized
actaggtgctaggagcactccc

SEQ ID NO: 6396 - DNA, 22 bp, Artificial Sequence
  chemically synthesized
ggtgctaggagcactcccccag

SEQ ID NO: 6397 - DNA, 22 bp, Artificial Sequence
  chemically synthesized
ggagcactcccccagtcttgac

SEQ ID NO: 6398 - DNA, 22 bp, Artificial Sequence
  chemically synthesized
ccccagtcttgacaaccaaaaa

SEQ ID NO: 6399 - DNA, 22 bp, Artificial Sequence
  chemically synthesized
gacaaccaaaaatgtctctaaa

SEQ ID NO: 6400 - DNA, 22 bp, Artificial Sequence
  chemically synthesized
acaaccaaaaatgtctctaaac

SEQ ID NO: 6401 - DNA, 22 bp, Artificial Sequence
  chemically synthesized
taaactttgccacatgtcacct

SEQ ID NO: 6402 - DNA, 22 bp, Artificial Sequence
  chemically synthesized
aactttgccacatgtcacctag

SEQ ID NO: 6403 - DNA, 22 bp, Artificial Sequence
  chemically synthesized
tgccacatgtcacctagtagac

SEQ ID NO: 6404 - DNA, 22 bp, Artificial Sequence
  chemically synthesized
gccacatgtcacctagtagaca

SEQ ID NO: 6405 - DNA, 22 bp, Artificial Sequence
  chemically synthesized
ccacatgtcacctagtagacaa

SEQ ID NO: 6406 - DNA, 22 bp, Artificial Sequence
  chemically synthesized
gtagacaaactcctggttaaga

SEQ ID NO: 6407 - DNA, 22 bp, Artificial Sequence
  chemically synthesized
ctggttaagaagctcgggttga

SEQ ID NO: 6408 - DNA, 22 bp, Artificial Sequence
  chemically synthesized
gttaagaagctcgggttgaaaa

SEQ ID NO: 6409 - DNA, 22 bp, Artificial Sequence
  chemically synthesized
agaagctcgggttgaaaaaaat

SEQ ID NO: 6410 - DNA, 22 bp, Artificial Sequence
  chemically synthesized
gggttgaaaaaaataaacaagt

SEQ ID NO: 6411 - DNA, 22 bp, Artificial Sequence
  chemically synthesized
aaaaaaataaacaagtagtgct

SEQ ID NO: 6412 - DNA, 22 bp, Artificial Sequence
  chemically synthesized
gggagtagaggccaagaagtag

SEQ ID NO: 6413 - DNA, 22 bp, Artificial Sequence
  chemically synthesized
agaagaggagccacaaacaagg

SEQ ID NO: 6414 - DNA, 22 bp, Artificial Sequence
  chemically synthesized
tgcaggcgcctgtaggctgtgg

SEQ ID NO: 6415 - DNA, 22 bp, Artificial Sequence
  chemically synthesized
taggctgtggtgtgaattctag

SEQ ID NO: 6416 - DNA, 22 bp, Artificial Sequence
  chemically synthesized
tggtgtgaattctagccaagga

SEQ ID NO: 6417 - DNA, 22 bp, Artificial Sequence
  chemically synthesized
tagccaaggagtaacagtgatc

SEQ ID NO: 6418 - DNA, 22 bp, Artificial Sequence
  chemically synthesized
gccaaggagtaacagtgatctg

SEQ ID NO: 6419 - DNA, 22 bp, Artificial Sequence
  chemically synthesized
tcacaggcttttaaaagattgc

SEQ ID NO: 6420 - DNA, 22 bp, Artificial Sequence
  chemically synthesized
ttaaaagattgctctggctgct

SEQ ID NO: 6421 - DNA, 22 bp, Artificial Sequence
  chemically synthesized
taaaagattgctctggctgcta

SEQ ID NO: 6422 - DNA, 22 bp, Artificial Sequence
  chemically synthesized
aaaagattgctctggctgctat

SEQ ID NO: 6423 - DNA, 22 bp, Artificial Sequence
  chemically synthesized
aaagattgctctggctgctatg

SEQ ID NO: 6424 - DNA, 22 bp, Artificial Sequence
  chemically synthesized
ctctggctgctatgtggaaagc

SEQ ID NO: 6425 - DNA, 22 bp, Artificial Sequence
  chemically synthesized
tggctgctatgtggaaagcaga

SEQ ID NO: 6426 - DNA, 22 bp, Artificial Sequence
  chemically synthesized
gctgctatgtggaaagcagaat

SEQ ID NO: 6427 - DNA, 22 bp, Artificial Sequence
  chemically synthesized
ctatgtggaaagcagaatgaag

SEQ ID NO: 6428 - DNA, 22 bp, Artificial Sequence
  chemically synthesized
tgtggaaagcagaatgaaggga

SEQ ID NO: 6429 - DNA, 22 bp, Artificial Sequence
  chemically synthesized
ttacacagtccaggcaagaggt

SEQ ID NO: 6430 - DNA, 22 bp, Artificial Sequence
  chemically synthesized
cacagtccaggcaagaggtagt

SEQ ID NO: 6431 - DNA, 22 bp, Artificial Sequence
  chemically synthesized
ggtgggaacagaaaagggagtg

SEQ ID NO: 6432 - DNA, 22 bp, Artificial Sequence
  chemically synthesized
tctcctgaatatattctgaagg

SEQ ID NO: 6433 - DNA, 22 bp, Artificial Sequence
  chemically synthesized
ctgaatatattctgaaggaagt

SEQ ID NO: 6434 - DNA, 22 bp, Artificial Sequence
  chemically synthesized
aatatattctgaaggaagttgc

SEQ ID NO: 6435 - DNA, 22 bp, Artificial Sequence
  chemically synthesized
tgaaggaagttgctgaaggatt

SEQ ID NO: 6436 - DNA, 22 bp, Artificial Sequence
  chemically synthesized
aaggaagttgctgaaggattct

SEQ ID NO: 6437 - DNA, 22 bp, Artificial Sequence
  chemically synthesized
ctgaaggattctatgttgtgtg

SEQ ID NO: 6438 - DNA, 22 bp, Artificial Sequence
  chemically synthesized
aaggattctatgttgtgtgaga

SEQ ID NO: 6439 - DNA, 22 bp, Artificial Sequence
  chemically synthesized
tatgttgtgtgagagaaagaga

SEQ ID NO: 6440 - DNA, 22 bp, Artificial Sequence
  chemically synthesized
tgttgtgtgagagaaagagaag

SEQ ID NO: 6441 - DNA, 22 bp, Artificial Sequence
  chemically synthesized
tgtgagagaaagagaagaattg

SEQ ID NO: 6442 - DNA, 22 bp, Artificial Sequence
  chemically synthesized
gctgggtgtagtagctcatgcc

SEQ ID NO: 6443 - DNA, 22 bp, Artificial Sequence
  chemically synthesized
ggtgtagtagctcatgccaagg

SEQ ID NO: 6444 - DNA, 22 bp, Artificial Sequence
  chemically synthesized
atgccaaggaggaggccaagga

SEQ ID NO: 6445 - DNA, 22 bp, Artificial Sequence
  chemically synthesized
ctgagctcaggagttcaagacc

SEQ ID NO: 6446 - DNA, 22 bp, Artificial Sequence
  chemically synthesized
agctcaggagttcaagaccagc

SEQ ID NO: 6447 - DNA, 22 bp, Artificial Sequence
  chemically synthesized
aggagttcaagaccagcctggg

SEQ ID NO: 6448 - DNA, 22 bp, Artificial Sequence
  chemically synthesized
aagaccagcctgggcaacacag

SEQ ID NO: 6449 - DNA, 22 bp, Artificial Sequence
  chemically synthesized
ggcaacacagcaaaaccccttc

SEQ ID NO: 6450 - DNA, 22 bp, Artificial Sequence
  chemically synthesized
ctctacaaaaaatacaaaaatt

SEQ ID NO: 6451 - DNA, 22 bp, Artificial Sequence
  chemically synthesized
tctacaaaaaatacaaaaatta

SEQ ID NO: 6452 - DNA, 22 bp, Artificial Sequence
  chemically synthesized
tacaaaaaatacaaaaattagc

SEQ ID NO: 6453 - DNA, 22 bp, Artificial Sequence
  chemically synthesized
caaaaaatacaaaaattagctg

SEQ ID NO: 6454 - DNA, 22 bp, Artificial Sequence
  chemically synthesized
gctgggtgtggtggcatgcacc

SEQ ID NO: 6455 - DNA, 22 bp, Artificial Sequence
  chemically synthesized
ggtgtggtggcatgcacctgtg

SEQ ID NO: 6456 - DNA, 22 bp, Artificial Sequence
  chemically synthesized
tgatcctagctactcgggaggc

SEQ ID NO: 6457 - DNA, 22 bp, Artificial Sequence
  chemically synthesized
gctactcgggaggctgaggtgg

SEQ ID NO: 6458 - DNA, 22 bp, Artificial Sequence
  chemically synthesized
ctcgggaggctgaggtggaggg

SEQ ID NO: 6459 - DNA, 22 bp, Artificial Sequence
  chemically synthesized
gggaggctgaggtggagggtat

SEQ ID NO: 6460 - DNA, 22 bp, Artificial Sequence
  chemically synthesized
aggtggagggtattgcttgagc

SEQ ID NO: 6461 - DNA, 22 bp, Artificial Sequence
  chemically synthesized
cttgagcccaggaagttgaggc

SEQ ID NO: 6462 - DNA, 22 bp, Artificial Sequence
  chemically synthesized
gagcccaggaagttgaggctgc

SEQ ID NO: 6463 - DNA, 22 bp, Artificial Sequence
  chemically synthesized
agcccaggaagttgaggctgca

SEQ ID NO: 6464 - DNA, 22 bp, Artificial Sequence
  chemically synthesized
aggctgcagtgagccatgactg

SEQ ID NO: 6465 - DNA, 22 bp, Artificial Sequence
  chemically synthesized
cagtgagccatgactgtgccac

SEQ ID NO: 6466 - DNA, 22 bp, Artificial Sequence
  chemically synthesized
tgccactgtacttcagcctagg

SEQ ID NO: 6467 - DNA, 22 bp, Artificial Sequence
  chemically synthesized
tacttcagcctaggtgacagag

SEQ ID NO: 6468 - DNA, 22 bp, Artificial Sequence
  chemically synthesized
cagcctaggtgacagagcaaga

SEQ ID NO: 6469 - DNA, 22 bp, Artificial Sequence
  chemically synthesized
agcctaggtgacagagcaagac

SEQ ID NO: 6470 - DNA, 22 bp, Artificial Sequence
  chemically synthesized
ggtgacagagcaagaccctgtc

SEQ ID NO: 6471 - DNA, 22 bp, Artificial Sequence
  chemically synthesized
tctcccctgaccccctgaaaaa

SEQ ID NO: 6472 - DNA, 22 bp, Artificial Sequence
  chemically synthesized
ccctgaccccctgaaaaagaga

SEQ ID NO: 6473 - DNA, 22 bp, Artificial Sequence
  chemically synthesized
accccctgaaaaagagaagagt

SEQ ID NO: 6474 - DNA, 22 bp, Artificial Sequence
  chemically synthesized
aaaaagagaagagttaaagttg

SEQ ID NO: 6475 - DNA, 22 bp, Artificial Sequence
  chemically synthesized
aagttgactttgttctttattt

SEQ ID NO: 6476 - DNA, 22 bp, Artificial Sequence
  chemically synthesized
actttgttctttattttaattt

SEQ ID NO: 6477 - DNA, 22 bp, Artificial Sequence
  chemically synthesized
tgttctttattttaattttatt

SEQ ID NO: 6478 - DNA, 22 bp, Artificial Sequence
  chemically synthesized
gttctttattttaattttattg

SEQ ID NO: 6479 - DNA, 22 bp, Artificial Sequence
  chemically synthesized
ttctttattttaattttattgg

SEQ ID NO: 6480 - DNA, 22 bp, Artificial Sequence
  chemically synthesized
tttattttaattttattggcct

SEQ ID NO: 6481 - DNA, 22 bp, Artificial Sequence
  chemically synthesized
tattttaattttattggcctga

SEQ ID NO: 6482 - DNA, 22 bp, Artificial Sequence
  chemically synthesized
attttaattttattggcctgag

SEQ ID NO: 6483 - DNA, 22 bp, Artificial Sequence
  chemically synthesized
ttttaattttattggcctgagc

SEQ ID NO: 6484 - DNA, 22 bp, Artificial Sequence
  chemically synthesized
taattttattggcctgagcagt

SEQ ID NO: 6485 - DNA, 22 bp, Artificial Sequence
  chemically synthesized
aattttattggcctgagcagtg

SEQ ID NO: 6486 - DNA, 22 bp, Artificial Sequence
  chemically synthesized
attttattggcctgagcagtgg

SEQ ID NO: 6487 - DNA, 22 bp, Artificial Sequence
  chemically synthesized
tattggcctgagcagtggggta

SEQ ID NO: 6488 - DNA, 22 bp, Artificial Sequence
  chemically synthesized
attggcctgagcagtggggtaa

SEQ ID NO: 6489 - DNA, 22 bp, Artificial Sequence
  chemically synthesized
ttggcctgagcagtggggtaat

SEQ ID NO: 6490 - DNA, 22 bp, Artificial Sequence
  chemically synthesized
gcctgagcagtggggtaattgg

SEQ ID NO: 6491 - DNA, 22 bp, Artificial Sequence
  chemically synthesized
agcagtggggtaattggcaatg

SEQ ID NO: 6492 - DNA, 22 bp, Artificial Sequence
  chemically synthesized
gcaatgccatttctgagatggt

SEQ ID NO: 6493 - DNA, 22 bp, Artificial Sequence
  chemically synthesized
ctgagatggtgaaggcagagga

SEQ ID NO: 6494 - DNA, 22 bp, Artificial Sequence
  chemically synthesized
tgagatggtgaaggcagaggaa

SEQ ID NO: 6495 - DNA, 22 bp, Artificial Sequence
  chemically synthesized
agatggtgaaggcagaggaaag

SEQ ID NO: 6496 - DNA, 22 bp, Artificial Sequence
  chemically synthesized
ggggtaaatcaaggatctgcat

SEQ ID NO: 6497 - DNA, 22 bp, Artificial Sequence
  chemically synthesized
gggtaaatcaaggatctgcatt

SEQ ID NO: 6498 - DNA, 22 bp, Artificial Sequence
  chemically synthesized
catttggacatgttaagtttga

SEQ ID NO: 6499 - DNA, 22 bp, Artificial Sequence
  chemically synthesized
ggacatgttaagtttgagattc

SEQ ID NO: 6500 - DNA, 22 bp, Artificial Sequence
  chemically synthesized
gacatgttaagtttgagattcc

SEQ ID NO: 6501 - DNA, 22 bp, Artificial Sequence
  chemically synthesized
agtttgagattccagtcaggct

SEQ ID NO: 6502 - DNA, 22 bp, Artificial Sequence
  chemically synthesized
gagattccagtcaggcttccaa

SEQ ID NO: 6503 - DNA, 22 bp, Artificial Sequence
  chemically synthesized
agattccagtcaggcttccaag

SEQ ID NO: 6504 - DNA, 22 bp, Artificial Sequence
  chemically synthesized
cagtcaggcttccaagtggtga

SEQ ID NO: 6505 - DNA, 22 bp, Artificial Sequence
  chemically synthesized
ccaagtggtgaggccacatagg

SEQ ID NO: 6506 - DNA, 22 bp, Artificial Sequence
  chemically synthesized
caagtggtgaggccacataggc

SEQ ID NO: 6507 - DNA, 22 bp, Artificial Sequence
  chemically synthesized
agtgtaagaattcaggaccaag

SEQ ID NO: 6508 - DNA, 22 bp, Artificial Sequence
  chemically synthesized
aggaccaaggctgggcacggtg

SEQ ID NO: 6509 - DNA, 22 bp, Artificial Sequence
  chemically synthesized
ggcacggtggctcacttctgta

SEQ ID NO: 6510 - DNA, 22 bp, Artificial Sequence
  chemically synthesized
acttctgtaatcccagcacttt

SEQ ID NO: 6511 - DNA, 22 bp, Artificial Sequence
  chemically synthesized
ctgtaatcccagcactttggtg

SEQ ID NO: 6512 - DNA, 22 bp, Artificial Sequence
  chemically synthesized
tgtaatcccagcactttggtgg

SEQ ID NO: 6513 - DNA, 22 bp, Artificial Sequence
  chemically synthesized
taatcccagcactttggtggct

SEQ ID NO: 6514 - DNA, 22 bp, Artificial Sequence
  chemically synthesized
tggtggctgaggcaggtagatc

SEQ ID NO: 6515 - DNA, 22 bp, Artificial Sequence
  chemically synthesized
ggtggctgaggcaggtagatca

SEQ ID NO: 6516 - DNA, 22 bp, Artificial Sequence
  chemically synthesized
gtggctgaggcaggtagatcat

SEQ ID NO: 6517 - DNA, 22 bp, Artificial Sequence
  chemically synthesized
aggcaggtagatcatttgaggt

SEQ ID NO: 6518 - DNA, 22 bp, Artificial Sequence
  chemically synthesized
gaggtcaggagtttgagacaag

SEQ ID NO: 6519 - DNA, 22 bp, Artificial Sequence
  chemically synthesized
aggtcaggagtttgagacaagc

SEQ ID NO: 6520 - DNA, 22 bp, Artificial Sequence
  chemically synthesized
gagacaagcttggccaacatgg

SEQ ID NO: 6521 - DNA, 22 bp, Artificial Sequence
  chemically synthesized
agacaagcttggccaacatggt

SEQ ID NO: 6522 - DNA, 22 bp, Artificial Sequence
  chemically synthesized
ggccaacatggtgaaaccccat

SEQ ID NO: 6523 - DNA, 22 bp, Artificial Sequence
  chemically synthesized
gccaacatggtgaaaccccatg

SEQ ID NO: 6524 - DNA, 22 bp, Artificial Sequence
  chemically synthesized
ctaaaaatacaaaaattagcct

SEQ ID NO: 6525 - DNA, 22 bp, Artificial Sequence
  chemically synthesized
aaaatacaaaaattagcctggt

SEQ ID NO: 6526 - DNA, 22 bp, Artificial Sequence
  chemically synthesized
gcctggtgtggtggcgcacgcc

SEQ ID NO: 6527 - DNA, 22 bp, Artificial Sequence
  chemically synthesized
gtgtggtggcgcacgcctatag

SEQ ID NO: 6528 - DNA, 22 bp, Artificial Sequence
  chemically synthesized
tagtcccaggttttcaggaggc

SEQ ID NO: 6529 - DNA, 22 bp, Artificial Sequence
  chemically synthesized
tcaggaggcttaggtaggagaa

SEQ ID NO: 6530 - DNA, 22 bp, Artificial Sequence
  chemically synthesized
caggaggcttaggtaggagaat

SEQ ID NO: 6531 - DNA, 22 bp, Artificial Sequence
  chemically synthesized
aggaggcttaggtaggagaatc

SEQ ID NO: 6532 - DNA, 22 bp, Artificial Sequence
  chemically synthesized
aggtaggagaatcccttgaacc

SEQ ID NO: 6533 - DNA, 22 bp, Artificial Sequence
  chemically synthesized
ggtaggagaatcccttgaaccc

SEQ ID NO: 6534 - DNA, 22 bp, Artificial Sequence
  chemically synthesized
gaacccaggaggtgcaggttgc

SEQ ID NO: 6535 - DNA, 22 bp, Artificial Sequence
  chemically synthesized
aacccaggaggtgcaggttgca

SEQ ID NO: 6536 - DNA, 22 bp, Artificial Sequence
  chemically synthesized
cagtgagctgagattgtgccac

SEQ ID NO: 6537 - DNA, 22 bp, Artificial Sequence
  chemically synthesized
agattgtgccactgcactccag

SEQ ID NO: 6538 - DNA, 22 bp, Artificial Sequence
  chemically synthesized
tgccactgcactccagcctggg

SEQ ID NO: 6539 - DNA, 22 bp, Artificial Sequence
  chemically synthesized
cactccagcctgggtgatagag

SEQ ID NO: 6540 - DNA, 22 bp, Artificial Sequence
  chemically synthesized
cagcctgggtgatagagtgaga

SEQ ID NO: 6541 - DNA, 22 bp, Artificial Sequence
  chemically synthesized
ggtgatagagtgagactctgtc

SEQ ID NO: 6542 - DNA, 22 bp, Artificial Sequence
  chemically synthesized
tgtctcaaaaaaaaaaaaaaaa

SEQ ID NO: 6543 - DNA, 22 bp, Artificial Sequence
  chemically synthesized
tctcaaaaaaaaaaaaaaaaaa

SEQ ID NO: 6544 - DNA, 22 bp, Artificial Sequence
  chemically synthesized
aaaaaaaaaaaaaaaaaaaaaa

SEQ ID NO: 6545 - DNA, 22 bp, Artificial Sequence
  chemically synthesized
aaggaattattcctcaggattt

SEQ ID NO: 6546 - DNA, 22 bp, Artificial Sequence
  chemically synthesized
ttcctcaggatttgggtctaat

SEQ ID NO: 6547 - DNA, 22 bp, Artificial Sequence
  chemically synthesized
ctcaggatttgggtctaatttg

SEQ ID NO: 6548 - DNA, 22 bp, Artificial Sequence
  chemically synthesized
aggatttgggtctaatttgccc

SEQ ID NO: 6549 - DNA, 22 bp, Artificial Sequence
  chemically synthesized
gggtctaatttgccctgagcac

SEQ ID NO: 6550 - DNA, 22 bp, Artificial Sequence
  chemically synthesized
ggtctaatttgccctgagcacc

SEQ ID NO: 6551 - DNA, 22 bp, Artificial Sequence
  chemically synthesized
atttgccctgagcaccaactcc

SEQ ID NO: 6552 - DNA, 22 bp, Artificial Sequence
  chemically synthesized
gccctgagcaccaactcctgag

SEQ ID NO: 6553 - DNA, 22 bp, Artificial Sequence
  chemically synthesized
ccctgagcaccaactcctgagt

SEQ ID NO: 6554 - DNA, 22 bp, Artificial Sequence
  chemically synthesized
agcaccaactcctgagttcaac

SEQ ID NO: 6555 - DNA, 22 bp, Artificial Sequence
  chemically synthesized
ctgagttcaactaccatggcta

SEQ ID NO: 6556 - DNA, 22 bp, Artificial Sequence
  chemically synthesized
agttcaactaccatggctagac

SEQ ID NO: 6557 - DNA, 22 bp, Artificial Sequence
  chemically synthesized
aactaccatggctagacacacc

SEQ ID NO: 6558 - DNA, 22 bp, Artificial Sequence
  chemically synthesized
ccatggctagacacaccttaac

SEQ ID NO: 6559 - DNA, 22 bp, Artificial Sequence
  chemically synthesized
gacacaccttaacattttctag

SEQ ID NO: 6560 - DNA, 22 bp, Artificial Sequence
  chemically synthesized
aacattttctagaatccaccag

SEQ ID NO: 6561 - DNA, 22 bp, Artificial Sequence
  chemically synthesized
acattttctagaatccaccagc

SEQ ID NO: 6562 - DNA, 22 bp, Artificial Sequence
  chemically synthesized
tctagaatccaccagctttagt

SEQ ID NO: 6563 - DNA, 22 bp, Artificial Sequence
  chemically synthesized
ctagaatccaccagctttagtg

SEQ ID NO: 6564 - DNA, 22 bp, Artificial Sequence
  chemically synthesized
tagaatccaccagctttagtgg

SEQ ID NO: 6565 - DNA, 22 bp, Artificial Sequence
  chemically synthesized
gaatccaccagctttagtggag

SEQ ID NO: 6566 - DNA, 22 bp, Artificial Sequence
  chemically synthesized
tagtggagtctgtctaatcatg

SEQ ID NO: 6567 - DNA, 22 bp, Artificial Sequence
  chemically synthesized
agtggagtctgtctaatcatga

SEQ ID NO: 6568 - DNA, 22 bp, Artificial Sequence
  chemically synthesized
gtggagtctgtctaatcatgag

SEQ ID NO: 6569 - DNA, 22 bp, Artificial Sequence
  chemically synthesized
tctaatcatgagtattggaata

SEQ ID NO: 6570 - DNA, 22 bp, Artificial Sequence
  chemically synthesized
atcatgagtattggaataggat

SEQ ID NO: 6571 - DNA, 22 bp, Artificial Sequence
  chemically synthesized
gaataggatctgggggcagtga

SEQ ID NO: 6572 - DNA, 22 bp, Artificial Sequence
  chemically synthesized
ggggcagtgagggggtggcagc

SEQ ID NO: 6573 - DNA, 22 bp, Artificial Sequence
  chemically synthesized
tcatatggaagaaagacaggac

SEQ ID NO: 6574 - DNA, 22 bp, Artificial Sequence
  chemically synthesized
caactcacccttcacaaaatga

SEQ ID NO: 6575 - DNA, 22 bp, Artificial Sequence
  chemically synthesized
acccttcacaaaatgaggacca

SEQ ID NO: 6576 - DNA, 22 bp, Artificial Sequence
  chemically synthesized
cacaaaatgaggaccagacaca

SEQ ID NO: 6577 - DNA, 22 bp, Artificial Sequence
  chemically synthesized
acaaaatgaggaccagacacag

SEQ ID NO: 6578 - DNA, 22 bp, Artificial Sequence
  chemically synthesized
atggtatgagttgatgcaggtg

SEQ ID NO: 6579 - DNA, 22 bp, Artificial Sequence
  chemically synthesized
atgcaggtgtgtggagcctcaa

SEQ ID NO: 6580 - DNA, 22 bp, Artificial Sequence
  chemically synthesized
aacatcctgctcccctcctact

SEQ ID NO: 6581 - DNA, 22 bp, Artificial Sequence
  chemically synthesized
ctcccctcctactacacatggt

SEQ ID NO: 6582 - DNA, 22 bp, Artificial Sequence
  chemically synthesized
ccctcctactacacatggttaa

SEQ ID NO: 6583 - DNA, 22 bp, Artificial Sequence
  chemically synthesized
ctactacacatggttaaggcct

SEQ ID NO: 6584 - DNA, 22 bp, Artificial Sequence
  chemically synthesized
ctacacatggttaaggcctgtt

SEQ ID NO: 6585 - DNA, 22 bp, Artificial Sequence
  chemically synthesized
cacatggttaaggcctgttgct

SEQ ID NO: 6586 - DNA, 22 bp, Artificial Sequence
  chemically synthesized
aggcctgttgctctgtctccag

SEQ ID NO: 6587 - DNA, 22 bp, Artificial Sequence
  chemically synthesized
ttgctctgtctccaggttcaca

SEQ ID NO: 6588 - DNA, 22 bp, Artificial Sequence
  chemically synthesized
ctctgtctccaggttcacactc

SEQ ID NO: 6589 - DNA, 22 bp, Artificial Sequence
  chemically synthesized
tgtctccaggttcacactctct

SEQ ID NO: 6590 - DNA, 22 bp, Artificial Sequence
  chemically synthesized
tctccaggttcacactctctgc

SEQ ID NO: 6591 - DNA, 22 bp, Artificial Sequence
  chemically synthesized
caggttcacactctctgcacta

SEQ ID NO: 6592 - DNA, 22 bp, Artificial Sequence
  chemically synthesized
acactctctgcactacctcttc

SEQ ID NO: 6593 - DNA, 22 bp, Artificial Sequence
  chemically synthesized
tctgcactacctcttcatgggt

SEQ ID NO: 6594 - DNA, 22 bp, Artificial Sequence
  chemically synthesized
tgcactacctcttcatgggtgc

SEQ ID NO: 6595 - DNA, 22 bp, Artificial Sequence
  chemically synthesized
cactacctcttcatgggtgcct

SEQ ID NO: 6596 - DNA, 22 bp, Artificial Sequence
  chemically synthesized
cctcttcatgggtgcctcagag

SEQ ID NO: 6597 - DNA, 22 bp, Artificial Sequence
  chemically synthesized
ttcatgggtgcctcagagcagg

SEQ ID NO: 6598 - DNA, 22 bp, Artificial Sequence
  chemically synthesized
catgggtgcctcagagcaggac

SEQ ID NO: 6599 - DNA, 22 bp, Artificial Sequence
  chemically synthesized
atgggtgcctcagagcaggacc

SEQ ID NO: 6600 - DNA, 22 bp, Artificial Sequence
  chemically synthesized
agagcaggaccttggtctttcc

SEQ ID NO: 6601 - DNA, 22 bp, Artificial Sequence
  chemically synthesized
ggtctttccttgtttgaagctt

SEQ ID NO: 6602 - DNA, 22 bp, Artificial Sequence
  chemically synthesized
gtctttccttgtttgaagcttt

SEQ ID NO: 6603 - DNA, 22 bp, Artificial Sequence
  chemically synthesized
tccttgtttgaagctttgggct

SEQ ID NO: 6604 - DNA, 22 bp, Artificial Sequence
  chemically synthesized
ccttgtttgaagctttgggcta

SEQ ID NO: 6605 - DNA, 22 bp, Artificial Sequence
  chemically synthesized
cttgtttgaagctttgggctac

SEQ ID NO: 6606 - DNA, 22 bp, Artificial Sequence
  chemically synthesized
gtttgaagctttgggctacgtg

SEQ ID NO: 6607 - DNA, 22 bp, Artificial Sequence
  chemically synthesized
tttgaagctttgggctacgtgg

SEQ ID NO: 6608 - DNA, 22 bp, Artificial Sequence
  chemically synthesized
gaagctttgggctacgtggatg

SEQ ID NO: 6609 - DNA, 22 bp, Artificial Sequence
  chemically synthesized
aagctttgggctacgtggatga

SEQ ID NO: 6610 - DNA, 22 bp, Artificial Sequence
  chemically synthesized
tgggctacgtggatgaccagct

SEQ ID NO: 6611 - DNA, 22 bp, Artificial Sequence
  chemically synthesized
gggctacgtggatgaccagctg

SEQ ID NO: 6612 - DNA, 22 bp, Artificial Sequence
  chemically synthesized
ggctacgtggatgaccagctgt

SEQ ID NO: 6613 - DNA, 22 bp, Artificial Sequence
  chemically synthesized
cgtggatgaccagctgttcgtg

SEQ ID NO: 6614 - DNA, 22 bp, Artificial Sequence
  chemically synthesized
ttcgtgttctatgatcatgaga

SEQ ID NO: 6615 - DNA, 22 bp, Artificial Sequence
  chemically synthesized
gtgttctatgatcatgagagtc

SEQ ID NO: 6616 - DNA, 22 bp, Artificial Sequence
  chemically synthesized
tatgatcatgagagtcgccgtg

SEQ ID NO: 6617 - DNA, 22 bp, Artificial Sequence
  chemically synthesized
tgatcatgagagtcgccgtgtg

SEQ ID NO: 6618 - DNA, 22 bp, Artificial Sequence
  chemically synthesized
catgggtttccagtagaatttc

SEQ ID NO: 6619 - DNA, 22 bp, Artificial Sequence
  chemically synthesized
ccagtagaatttcaagccagat

SEQ ID NO: 6620 - DNA, 22 bp, Artificial Sequence
  chemically synthesized
cagtagaatttcaagccagatg

SEQ ID NO: 6621 - DNA, 22 bp, Artificial Sequence
  chemically synthesized
caagccagatgtggctgcagct

SEQ ID NO: 6622 - DNA, 22 bp, Artificial Sequence
  chemically synthesized
aagccagatgtggctgcagctg

SEQ ID NO: 6623 - DNA, 22 bp, Artificial Sequence
  chemically synthesized
cagctgagtcagagtctgaaag

SEQ ID NO: 6624 - DNA, 22 bp, Artificial Sequence
  chemically synthesized
agtcagagtctgaaagggtggg

SEQ ID NO: 6625 - DNA, 22 bp, Artificial Sequence
  chemically synthesized
aaagggtgggatcacatgttca

SEQ ID NO: 6626 - DNA, 22 bp, Artificial Sequence
  chemically synthesized
actgttgacttctggactatta

SEQ ID NO: 6627 - DNA, 22 bp, Artificial Sequence
  chemically synthesized
ttgacttctggactattatgga

SEQ ID NO: 6628 - DNA, 22 bp, Artificial Sequence
  chemically synthesized
acttctggactattatggaaaa

SEQ ID NO: 6629 - DNA, 22 bp, Artificial Sequence
  chemically synthesized
ctggactattatggaaaatcac

SEQ ID NO: 6630 - DNA, 22 bp, Artificial Sequence
  chemically synthesized
tggactattatggaaaatcaca

SEQ ID NO: 6631 - DNA, 22 bp, Artificial Sequence
  chemically synthesized
gactattatggaaaatcacaac

SEQ ID NO: 6632 - DNA, 22 bp, Artificial Sequence
  chemically synthesized
ttatggaaaatcacaaccacag

SEQ ID NO: 6633 - DNA, 22 bp, Artificial Sequence
  chemically synthesized
tggaaaatcacaaccacagcaa

SEQ ID NO: 6634 - DNA, 22 bp, Artificial Sequence
  chemically synthesized
accttcctgaggttgtcagagc

SEQ ID NO: 6635 - DNA, 22 bp, Artificial Sequence
  chemically synthesized
cctgaggttgtcagagcttttc

SEQ ID NO: 6636 - DNA, 22 bp, Artificial Sequence
  chemically synthesized
ctgaggttgtcagagcttttca

SEQ ID NO: 6637 - DNA, 22 bp, Artificial Sequence
  chemically synthesized
aggttgtcagagcttttcatct

SEQ ID NO: 6638 - DNA, 22 bp, Artificial Sequence
  chemically synthesized
tcagagcttttcatcttttcat

SEQ ID NO: 6639 - DNA, 22 bp, Artificial Sequence
  chemically synthesized
ttcatcttttcatgcatcttga

SEQ ID NO: 6640 - DNA, 22 bp, Artificial Sequence
  chemically synthesized
tcatcttttcatgcatcttgaa

SEQ ID NO: 6641 - DNA, 22 bp, Artificial Sequence
  chemically synthesized
catcttttcatgcatcttgaag

SEQ ID NO: 6642 - DNA, 22 bp, Artificial Sequence
  chemically synthesized
atcttttcatgcatcttgaagg

SEQ ID NO: 6643 - DNA, 22 bp, Artificial Sequence
  chemically synthesized
ttcatgcatcttgaaggaaaca

SEQ ID NO: 6644 - DNA, 22 bp, Artificial Sequence
  chemically synthesized
tcatgcatcttgaaggaaacag

SEQ ID NO: 6645 - DNA, 22 bp, Artificial Sequence
  chemically synthesized
catgcatcttgaaggaaacagc

SEQ ID NO: 6646 - DNA, 22 bp, Artificial Sequence
  chemically synthesized
atgcatcttgaaggaaacagct

SEQ ID NO: 6647 - DNA, 22 bp, Artificial Sequence
  chemically synthesized
gaaggaaacagctggaagtctg

SEQ ID NO: 6648 - DNA, 22 bp, Artificial Sequence
  chemically synthesized
aaggaaacagctggaagtctga

SEQ ID NO: 6649 - DNA, 22 bp, Artificial Sequence
  chemically synthesized
gaagtctgaggtcttgtgggag

SEQ ID NO: 6650 - DNA, 22 bp, Artificial Sequence
  chemically synthesized
aggtcttgtgggagcagggaag

SEQ ID NO: 6651 - DNA, 22 bp, Artificial Sequence
  chemically synthesized
gtgggagcagggaagagggaag

SEQ ID NO: 6652 - DNA, 22 bp, Artificial Sequence
  chemically synthesized
tgggagcagggaagagggaagg

SEQ ID NO: 6653 - DNA, 22 bp, Artificial Sequence
  chemically synthesized
gcttcctgagatcatttggtcc

SEQ ID NO: 6654 - DNA, 22 bp, Artificial Sequence
  chemically synthesized
cttcctgagatcatttggtcct

SEQ ID NO: 6655 - DNA, 22 bp, Artificial Sequence
  chemically synthesized
cctgagatcatttggtccttgg

SEQ ID NO: 6656 - DNA, 22 bp, Artificial Sequence
  chemically synthesized
ctgagatcatttggtccttggg

SEQ ID NO: 6657 - DNA, 22 bp, Artificial Sequence
  chemically synthesized
agatcatttggtccttggggat

SEQ ID NO: 6658 - DNA, 22 bp, Artificial Sequence
  chemically synthesized
ggtccttggggatggtggaaat

SEQ ID NO: 6659 - DNA, 22 bp, Artificial Sequence
  chemically synthesized
gtccttggggatggtggaaata

SEQ ID NO: 6660 - DNA, 22 bp, Artificial Sequence
  chemically synthesized
ggggatggtggaaatagggacc

SEQ ID NO: 6661 - DNA, 22 bp, Artificial Sequence
  chemically synthesized
gggatggtggaaatagggacct

SEQ ID NO: 6662 - DNA, 22 bp, Artificial Sequence
  chemically synthesized
ttcctttggttgcagttaacaa

SEQ ID NO: 6663 - DNA, 22 bp, Artificial Sequence
  chemically synthesized
ctttggttgcagttaacaaggc

SEQ ID NO: 6664 - DNA, 22 bp, Artificial Sequence
  chemically synthesized
tggttgcagttaacaaggctgg

SEQ ID NO: 6665 - DNA, 22 bp, Artificial Sequence
  chemically synthesized
ggttgcagttaacaaggctggg

SEQ ID NO: 6666 - DNA, 22 bp, Artificial Sequence
  chemically synthesized
gttgcagttaacaaggctgggg

SEQ ID NO: 6667 - DNA, 22 bp, Artificial Sequence
  chemically synthesized
cagttaacaaggctggggattt

SEQ ID NO: 6668 - DNA, 22 bp, Artificial Sequence
  chemically synthesized
acaaggctggggatttttccag

SEQ ID NO: 6669 - DNA, 22 bp, Artificial Sequence
  chemically synthesized
gggatttttccagagtcccaca

SEQ ID NO: 6670 - DNA, 22 bp, Artificial Sequence
  chemically synthesized
ttccagagtcccacaccctgca

SEQ ID NO: 6671 - DNA, 22 bp, Artificial Sequence
  chemically synthesized
tccagagtcccacaccctgcag

SEQ ID NO: 6672 - DNA, 22 bp, Artificial Sequence
  chemically synthesized
ccagagtcccacaccctgcagg

SEQ ID NO: 6673 - DNA, 22 bp, Artificial Sequence
  chemically synthesized
cagagtcccacaccctgcaggt

SEQ ID NO: 6674 - DNA, 22 bp, Artificial Sequence
  chemically synthesized
caggtcatcctgggctgtgaaa

SEQ ID NO: 6675 - DNA, 22 bp, Artificial Sequence
  chemically synthesized
ggctgtgaaatgcaagaagaca

SEQ ID NO: 6676 - DNA, 22 bp, Artificial Sequence
  chemically synthesized
tgaaatgcaagaagacaacagt

SEQ ID NO: 6677 - DNA, 22 bp, Artificial Sequence
  chemically synthesized
ctggaagtacgggtatgatggg

SEQ ID NO: 6678 - DNA, 22 bp, Artificial Sequence
  chemically synthesized
gaagtacgggtatgatgggcag

SEQ ID NO: 6679 - DNA, 22 bp, Artificial Sequence
  chemically synthesized
gaattctgccctgacacactgg

SEQ ID NO: 6680 - DNA, 22 bp, Artificial Sequence
  chemically synthesized
aattctgccctgacacactgga

SEQ ID NO: 6681 - DNA, 22 bp, Artificial Sequence
  chemically synthesized
tgccctgacacactggattgga

SEQ ID NO: 6682 - DNA, 22 bp, Artificial Sequence
  chemically synthesized
ccctgacacactggattggaga

SEQ ID NO: 6683 - DNA, 22 bp, Artificial Sequence
  chemically synthesized
acacactggattggagagcagc

SEQ ID NO: 6684 - DNA, 22 bp, Artificial Sequence
  chemically synthesized
gattggagagcagcagaaccca

SEQ ID NO: 6685 - DNA, 22 bp, Artificial Sequence
  chemically synthesized
gagagcagcagaacccagggcc

SEQ ID NO: 6686 - DNA, 22 bp, Artificial Sequence
  chemically synthesized
gcccaccaagctggagtgggaa

SEQ ID NO: 6687 - DNA, 22 bp, Artificial Sequence
  chemically synthesized
gagtgggaaaggcacaagattc

SEQ ID NO: 6688 - DNA, 22 bp, Artificial Sequence
  chemically synthesized
gggccaggcagaacagggccta

SEQ ID NO: 6689 - DNA, 22 bp, Artificial Sequence
  chemically synthesized
cctggagagggactgccctgca

SEQ ID NO: 6690 - DNA, 22 bp, Artificial Sequence
  chemically synthesized
gagagggactgccctgcacagc

SEQ ID NO: 6691 - DNA, 22 bp, Artificial Sequence
  chemically synthesized
ccctgcacagctgcagcagttg

SEQ ID NO: 6692 - DNA, 22 bp, Artificial Sequence
  chemically synthesized
cacagctgcagcagttgctgga

SEQ ID NO: 6693 - DNA, 22 bp, Artificial Sequence
  chemically synthesized
cagcagttgctggagctgggga

SEQ ID NO: 6694 - DNA, 22 bp, Artificial Sequence
  chemically synthesized
ctggagctggggagaggtgttt

SEQ ID NO: 6695 - DNA, 22 bp, Artificial Sequence
  chemically synthesized
gagctggggagaggtgttttgg

SEQ ID NO: 6696 - DNA, 22 bp, Artificial Sequence
  chemically synthesized
gggagaggtgttttggaccaac

SEQ ID NO: 6697 - DNA, 22 bp, Artificial Sequence
  chemically synthesized
tggaccaacaaggtatggtgga

SEQ ID NO: 6698 - DNA, 22 bp, Artificial Sequence
  chemically synthesized
ggaccaacaaggtatggtggaa

SEQ ID NO: 6699 - DNA, 22 bp, Artificial Sequence
  chemically synthesized
gaccaacaaggtatggtggaaa

SEQ ID NO: 6700 - DNA, 22 bp, Artificial Sequence
  chemically synthesized
ctgcccctatactctagtggca

SEQ ID NO: 6701 - DNA, 22 bp, Artificial Sequence
  chemically synthesized
tgcccctatactctagtggcag

SEQ ID NO: 6702 - DNA, 22 bp, Artificial Sequence
  chemically synthesized
cccctatactctagtggcagag

SEQ ID NO: 6703 - DNA, 22 bp, Artificial Sequence
  chemically synthesized
tactctagtggcagagtggagg

SEQ ID NO: 6704 - DNA, 22 bp, Artificial Sequence
  chemically synthesized
tagtggcagagtggaggaggtt

SEQ ID NO: 6705 - DNA, 22 bp, Artificial Sequence
  chemically synthesized
gtggcagagtggaggaggttgc

SEQ ID NO: 6706 - DNA, 22 bp, Artificial Sequence
  chemically synthesized
cagggcacggaatccctggttg

SEQ ID NO: 6707 - DNA, 22 bp, Artificial Sequence
  chemically synthesized
gttggagtttcagaggtggctg

SEQ ID NO: 6708 - DNA, 22 bp, Artificial Sequence
  chemically synthesized
gagtttcagaggtggctgaggc

SEQ ID NO: 6709 - DNA, 22 bp, Artificial Sequence
  chemically synthesized
cagaggtggctgaggctgtgtg

SEQ ID NO: 6710 - DNA, 22 bp, Artificial Sequence
  chemically synthesized
agaggtggctgaggctgtgtgc

SEQ ID NO: 6711 - DNA, 22 bp, Artificial Sequence
  chemically synthesized
aggctgtgtgcctctccaaatt

SEQ ID NO: 6712 - DNA, 22 bp, Artificial Sequence
  chemically synthesized
tgtgcctctccaaattctggga

SEQ ID NO: 6713 - DNA, 22 bp, Artificial Sequence
  chemically synthesized
tccaaattctgggaagggactt

SEQ ID NO: 6714 - DNA, 22 bp, Artificial Sequence
  chemically synthesized
caaattctgggaagggactttc

SEQ ID NO: 6715 - DNA, 22 bp, Artificial Sequence
  chemically synthesized
tgggaagggactttctcaatcc

SEQ ID NO: 6716 - DNA, 22 bp, Artificial Sequence
  chemically synthesized
ggaagggactttctcaatccta

SEQ ID NO: 6717 - DNA, 22 bp, Artificial Sequence
  chemically synthesized
tctcaatcctagagtctctacc

SEQ ID NO: 6718 - DNA, 22 bp, Artificial Sequence
  chemically synthesized
ctcaatcctagagtctctacct

SEQ ID NO: 6719 - DNA, 22 bp, Artificial Sequence
  chemically synthesized
tcaatcctagagtctctacctt

SEQ ID NO: 6720 - DNA, 22 bp, Artificial Sequence
  chemically synthesized
aatcctagagtctctaccttat

SEQ ID NO: 6721 - DNA, 22 bp, Artificial Sequence
  chemically synthesized
gagtctctaccttataattgag

SEQ ID NO: 6722 - DNA, 22 bp, Artificial Sequence
  chemically synthesized
taccttataattgagatgtatg

SEQ ID NO: 6723 - DNA, 22 bp, Artificial Sequence
  chemically synthesized
ccttataattgagatgtatgag

SEQ ID NO: 6724 - DNA, 22 bp, Artificial Sequence
  chemically synthesized
ataattgagatgtatgagacag

SEQ ID NO: 6725 - DNA, 22 bp, Artificial Sequence
  chemically synthesized
taattgagatgtatgagacagc

SEQ ID NO: 6726 - DNA, 22 bp, Artificial Sequence
  chemically synthesized
agatgtatgagacagccacaag

SEQ ID NO: 6727 - DNA, 22 bp, Artificial Sequence
  chemically synthesized
aatttcttttctccatgcatat

SEQ ID NO: 6728 - DNA, 22 bp, Artificial Sequence
  chemically synthesized
atttcttttctccatgcatatg

SEQ ID NO: 6729 - DNA, 22 bp, Artificial Sequence
  chemically synthesized
cttttctccatgcatatggctc

SEQ ID NO: 6730 - DNA, 22 bp, Artificial Sequence
  chemically synthesized
ttttctccatgcatatggctca

SEQ ID NO: 6731 - DNA, 22 bp, Artificial Sequence
  chemically synthesized
ttctccatgcatatggctcaaa

SEQ ID NO: 6732 - DNA, 22 bp, Artificial Sequence
  chemically synthesized
tctccatgcatatggctcaaag

SEQ ID NO: 6733 - DNA, 22 bp, Artificial Sequence
  chemically synthesized
ctccatgcatatggctcaaagg

SEQ ID NO: 6734 - DNA, 22 bp, Artificial Sequence
  chemically synthesized
tccatgcatatggctcaaaggg

SEQ ID NO: 6735 - DNA, 22 bp, Artificial Sequence
  chemically synthesized
catgcatatggctcaaagggaa

SEQ ID NO: 6736 - DNA, 22 bp, Artificial Sequence
  chemically synthesized
aaagggaagtgtctatggccct

SEQ ID NO: 6737 - DNA, 22 bp, Artificial Sequence
  chemically synthesized
tggcccttgctttttatttaac

SEQ ID NO: 6738 - DNA, 22 bp, Artificial Sequence
  chemically synthesized
gctttttatttaaccaataatc

SEQ ID NO: 6739 - DNA, 22 bp, Artificial Sequence
  chemically synthesized
ctttttatttaaccaataatct

SEQ ID NO: 6740 - DNA, 22 bp, Artificial Sequence
  chemically synthesized
tttatttaaccaataatctttt

SEQ ID NO: 6741 - DNA, 22 bp, Artificial Sequence
  chemically synthesized
ttatttaaccaataatcttttg

SEQ ID NO: 6742 - DNA, 22 bp, Artificial Sequence
  chemically synthesized
tatttaaccaataatcttttgt

SEQ ID NO: 6743 - DNA, 22 bp, Artificial Sequence
  chemically synthesized
atttaaccaataatcttttgta

SEQ ID NO: 6744 - DNA, 22 bp, Artificial Sequence
  chemically synthesized
tttaaccaataatcttttgtat

SEQ ID NO: 6745 - DNA, 22 bp, Artificial Sequence
  chemically synthesized
aaccaataatcttttgtatatt

SEQ ID NO: 6746 - DNA, 22 bp, Artificial Sequence
  chemically synthesized
accaataatcttttgtatattt

SEQ ID NO: 6747 - DNA, 22 bp, Artificial Sequence
  chemically synthesized
ttgtatatttatacctgttaaa

SEQ ID NO: 6748 - DNA, 22 bp, Artificial Sequence
  chemically synthesized
tgtatatttatacctgttaaaa

SEQ ID NO: 6749 - DNA, 22 bp, Artificial Sequence
  chemically synthesized
gtatatttatacctgttaaaaa

SEQ ID NO: 6750 - DNA, 22 bp, Artificial Sequence
  chemically synthesized
tatatttatacctgttaaaaat

SEQ ID NO: 6751 - DNA, 22 bp, Artificial Sequence
  chemically synthesized
atacctgttaaaaattcagaaa

SEQ ID NO: 6752 - DNA, 22 bp, Artificial Sequence
  chemically synthesized
tacctgttaaaaattcagaaat

SEQ ID NO: 6753 - DNA, 22 bp, Artificial Sequence
  chemically synthesized
ttaaaaattcagaaatgtcaag

SEQ ID NO: 6754 - DNA, 22 bp, Artificial Sequence
  chemically synthesized
aaaattcagaaatgtcaaggcc

SEQ ID NO: 6755 - DNA, 22 bp, Artificial Sequence
  chemically synthesized
agaaatgtcaaggccgggcacg

SEQ ID NO: 6756 - DNA, 22 bp, Artificial Sequence
  chemically synthesized
acccctgtaatcccagcacttt

SEQ ID NO: 6757 - DNA, 22 bp, Artificial Sequence
  chemically synthesized
taatcccagcactttgggaggc

SEQ ID NO: 6758 - DNA, 22 bp, Artificial Sequence
  chemically synthesized
tgggaggccgaggcgggtggtc

SEQ ID NO: 6759 - DNA, 22 bp, Artificial Sequence
  chemically synthesized
gggaggccgaggcgggtggtca

SEQ ID NO: 6760 - DNA, 22 bp, Artificial Sequence
  chemically synthesized
ggaggccgaggcgggtggtcac

SEQ ID NO: 6761 - DNA, 22 bp, Artificial Sequence
  chemically synthesized
gagaccagcctgaccaacatgg

SEQ ID NO: 6762 - DNA, 22 bp, Artificial Sequence
  chemically synthesized
agaccagcctgaccaacatggt

SEQ ID NO: 6763 - DNA, 22 bp, Artificial Sequence
  chemically synthesized
accaacatggtgaaacccgtct

SEQ ID NO: 6764 - DNA, 22 bp, Artificial Sequence
  chemically synthesized
taaaaaaatacaaaaattagct

SEQ ID NO: 6765 - DNA, 22 bp, Artificial Sequence
  chemically synthesized
aaaaaatacaaaaattagctgg

SEQ ID NO: 6766 - DNA, 22 bp, Artificial Sequence
  chemically synthesized
gctggtcacagtcatgcgcacc

SEQ ID NO: 6767 - DNA, 22 bp, Artificial Sequence
  chemically synthesized
gtcacagtcatgcgcacctgta

SEQ ID NO: 6768 - DNA, 22 bp, Artificial Sequence
  chemically synthesized
tagtcccagctaattggaaggc

SEQ ID NO: 6769 - DNA, 22 bp, Artificial Sequence
  chemically synthesized
attggaaggctgaggcaggagc

SEQ ID NO: 6770 - DNA, 22 bp, Artificial Sequence
  chemically synthesized
gaaggctgaggcaggagcatcg

SEQ ID NO: 6771 - DNA, 22 bp, Artificial Sequence
  chemically synthesized
aggcaggagcatcgcttgaacc

SEQ ID NO: 6772 - DNA, 22 bp, Artificial Sequence
  chemically synthesized
gaacctgggaagcggaagttgc

SEQ ID NO: 6773 - DNA, 22 bp, Artificial Sequence
  chemically synthesized
aacctgggaagcggaagttgca

SEQ ID NO: 6774 - DNA, 22 bp, Artificial Sequence
  chemically synthesized
ggaagcggaagttgcactgagc

SEQ ID NO: 6775 - DNA, 22 bp, Artificial Sequence
  chemically synthesized
cactgagccaagatcgcgccac

SEQ ID NO: 6776 - DNA, 22 bp, Artificial Sequence
  chemically synthesized
agccaagatcgcgccactgcac

SEQ ID NO: 6777 - DNA, 22 bp, Artificial Sequence
  chemically synthesized
cactccagcctaggcagcagag

SEQ ID NO: 6778 - DNA, 22 bp, Artificial Sequence
  chemically synthesized
cagcctaggcagcagagtgaga

SEQ ID NO: 6779 - DNA, 22 bp, Artificial Sequence
  chemically synthesized
ggcagcagagtgagactccatc

SEQ ID NO: 6780 - DNA, 22 bp, Artificial Sequence
  chemically synthesized
catcttaaaaaaaaaaaaaaaa

SEQ ID NO: 6781 - DNA, 22 bp, Artificial Sequence
  chemically synthesized
aaaaaaaaaaaaaaaaaaaaaa

SEQ ID NO: 6782 - DNA, 22 bp, Artificial Sequence
  chemically synthesized
aaaaaaaaaaaaaaaaaaaaaa

SEQ ID NO: 6783 - DNA, 22 bp, Artificial Sequence
  chemically synthesized
agagatctcagctatcatatga

SEQ ID NO: 6784 - DNA, 22 bp, Artificial Sequence
  chemically synthesized
agctatcatatgaataccagga

SEQ ID NO: 6785 - DNA, 22 bp, Artificial Sequence
  chemically synthesized
tcatatgaataccaggacaaaa

SEQ ID NO: 6786 - DNA, 22 bp, Artificial Sequence
  chemically synthesized
atcagagtagaagaatccttta

SEQ ID NO: 6787 - DNA, 22 bp, Artificial Sequence
  chemically synthesized
tcagagtagaagaatcctttag

SEQ ID NO: 6788 - DNA, 22 bp, Artificial Sequence
  chemically synthesized
taggttaaaagtttctttcata

SEQ ID NO: 6789 - DNA, 22 bp, Artificial Sequence
  chemically synthesized
aggttaaaagtttctttcatag

SEQ ID NO: 6790 - DNA, 22 bp, Artificial Sequence
  chemically synthesized
ggttaaaagtttctttcataga

SEQ ID NO: 6791 - DNA, 22 bp, Artificial Sequence
  chemically synthesized
aaagtttctttcatagaacata

SEQ ID NO: 6792 - DNA, 22 bp, Artificial Sequence
  chemically synthesized
ctttcatagaacatagcaataa

SEQ ID NO: 6793 - DNA, 22 bp, Artificial Sequence
  chemically synthesized
tttcatagaacatagcaataat

SEQ ID NO: 6794 - DNA, 22 bp, Artificial Sequence
  chemically synthesized
tcatagaacatagcaataatca

SEQ ID NO: 6795 - DNA, 22 bp, Artificial Sequence
  chemically synthesized
catagaacatagcaataatcac

SEQ ID NO: 6796 - DNA, 22 bp, Artificial Sequence
  chemically synthesized
atagaacatagcaataatcact

SEQ ID NO: 6797 - DNA, 22 bp, Artificial Sequence
  chemically synthesized
aagctacctatcttacaagtcc

SEQ ID NO: 6798 - DNA, 22 bp, Artificial Sequence
  chemically synthesized
cctatcttacaagtccgcttct

SEQ ID NO: 6799 - DNA, 22 bp, Artificial Sequence
  chemically synthesized
tcttacaagtccgcttcttata

SEQ ID NO: 6800 - DNA, 22 bp, Artificial Sequence
  chemically synthesized
acaagtccgcttcttataacaa

SEQ ID NO: 6801 - DNA, 22 bp, Artificial Sequence
  chemically synthesized
caagtccgcttcttataacaat

SEQ ID NO: 6802 - DNA, 22 bp, Artificial Sequence
  chemically synthesized
cttataacaatgcctcctaggt

SEQ ID NO: 6803 - DNA, 22 bp, Artificial Sequence
  chemically synthesized
ttataacaatgcctcctaggtt

SEQ ID NO: 6804 - DNA, 22 bp, Artificial Sequence
  chemically synthesized
ataacaatgcctcctaggttga

SEQ ID NO: 6805 - DNA, 22 bp, Artificial Sequence
  chemically synthesized
taacaatgcctcctaggttgac

SEQ ID NO: 6806 - DNA, 22 bp, Artificial Sequence
  chemically synthesized
ctaggttgacccaggtgaaact

SEQ ID NO: 6807 - DNA, 22 bp, Artificial Sequence
  chemically synthesized
ggttgacccaggtgaaactgac

SEQ ID NO: 6808 - DNA, 22 bp, Artificial Sequence
  chemically synthesized
acccaggtgaaactgaccatct

SEQ ID NO: 6809 - DNA, 22 bp, Artificial Sequence
  chemically synthesized
accatctgtattcaatcatttt

SEQ ID NO: 6810 - DNA, 22 bp, Artificial Sequence
  chemically synthesized
tattcaatcattttcaatgcac

SEQ ID NO: 6811 - DNA, 22 bp, Artificial Sequence
  chemically synthesized
aatcattttcaatgcacataaa

SEQ ID NO: 6812 - DNA, 22 bp, Artificial Sequence
  chemically synthesized
tcaatgcacataaagggcaatt

SEQ ID NO: 6813 - DNA, 22 bp, Artificial Sequence
  chemically synthesized
caatgcacataaagggcaattt

SEQ ID NO: 6814 - DNA, 22 bp, Artificial Sequence
  chemically synthesized
aatgcacataaagggcaatttt

SEQ ID NO: 6815 - DNA, 22 bp, Artificial Sequence
  chemically synthesized
tatctatcagaacaaagaacat

SEQ ID NO: 6816 - DNA, 22 bp, Artificial Sequence
  chemically synthesized
atctatcagaacaaagaacatg

SEQ ID NO: 6817 - DNA, 22 bp, Artificial Sequence
  chemically synthesized
tctatcagaacaaagaacatgg

SEQ ID NO: 6818 - DNA, 22 bp, Artificial Sequence
  chemically synthesized
tcagaacaaagaacatgggtaa

SEQ ID NO: 6819 - DNA, 22 bp, Artificial Sequence
  chemically synthesized
acatgtgaggagaacaagctga

SEQ ID NO: 6820 - DNA, 22 bp, Artificial Sequence
  chemically synthesized
catgtgaggagaacaagctgat

SEQ ID NO: 6821 - DNA, 22 bp, Artificial Sequence
  chemically synthesized
atctgactgctctccaagtgac

SEQ ID NO: 6822 - DNA, 22 bp, Artificial Sequence
  chemically synthesized
actgctctccaagtgacactgt

SEQ ID NO: 6823 - DNA, 22 bp, Artificial Sequence
  chemically synthesized
ctctccaagtgacactgtgtta

SEQ ID NO: 6824 - DNA, 22 bp, Artificial Sequence
  chemically synthesized
tccaagtgacactgtgttagag

SEQ ID NO: 6825 - DNA, 22 bp, Artificial Sequence
  chemically synthesized
caagtgacactgtgttagagtc

SEQ ID NO: 6826 - DNA, 22 bp, Artificial Sequence
  chemically synthesized
tgttagagtccaatcttaggac

SEQ ID NO: 6827 - DNA, 22 bp, Artificial Sequence
  chemically synthesized
gagtccaatcttaggacacaaa

SEQ ID NO: 6828 - DNA, 22 bp, Artificial Sequence
  chemically synthesized
aggacacaaaatggtgtctctc

SEQ ID NO: 6829 - DNA, 22 bp, Artificial Sequence
  chemically synthesized
ggacacaaaatggtgtctctcc

SEQ ID NO: 6830 - DNA, 22 bp, Artificial Sequence
  chemically synthesized
tcctgtagcttgtttttttctg

SEQ ID NO: 6831 - DNA, 22 bp, Artificial Sequence
  chemically synthesized
ctgtagcttgtttttttctgaa

SEQ ID NO: 6832 - DNA, 22 bp, Artificial Sequence
  chemically synthesized
tagcttgtttttttctgaaaag

SEQ ID NO: 6833 - DNA, 22 bp, Artificial Sequence
  chemically synthesized
gtttttttctgaaaagggtatt

SEQ ID NO: 6834 - DNA, 22 bp, Artificial Sequence
  chemically synthesized
tttttttctgaaaagggtattt

SEQ ID NO: 6835 - DNA, 22 bp, Artificial Sequence
  chemically synthesized
ttttctgaaaagggtatttcct

SEQ ID NO: 6836 - DNA, 22 bp, Artificial Sequence
  chemically synthesized
tttctgaaaagggtatttcctt

SEQ ID NO: 6837 - DNA, 22 bp, Artificial Sequence
  chemically synthesized
ttctgaaaagggtatttccttc

SEQ ID NO: 6838 - DNA, 22 bp, Artificial Sequence
  chemically synthesized
tctgaaaagggtatttccttcc

SEQ ID NO: 6839 - DNA, 22 bp, Artificial Sequence
  chemically synthesized
ctgaaaagggtatttccttcct

SEQ ID NO: 6840 - DNA, 22 bp, Artificial Sequence
  chemically synthesized
tgaaaagggtatttccttcctc

SEQ ID NO: 6841 - DNA, 22 bp, Artificial Sequence
  chemically synthesized
aaaagggtatttccttcctcca

SEQ ID NO: 6842 - DNA, 22 bp, Artificial Sequence
  chemically synthesized
ccttcctccaacctatagaagg

SEQ ID NO: 6843 - DNA, 22 bp, Artificial Sequence
  chemically synthesized
cttcctccaacctatagaagga

SEQ ID NO: 6844 - DNA, 22 bp, Artificial Sequence
  chemically synthesized
cctccaacctatagaaggaagt

SEQ ID NO: 6845 - DNA, 22 bp, Artificial Sequence
  chemically synthesized
ctccaacctatagaaggaagtg

SEQ ID NO: 6846 - DNA, 22 bp, Artificial Sequence
  chemically synthesized
caacctatagaaggaagtgaaa

SEQ ID NO: 6847 - DNA, 22 bp, Artificial Sequence
  chemically synthesized
tagaaggaagtgaaagttccag

SEQ ID NO: 6848 - DNA, 22 bp, Artificial Sequence
  chemically synthesized
cagtcttcctggcaagggtaaa

SEQ ID NO: 6849 - DNA, 22 bp, Artificial Sequence
  chemically synthesized
cctggcaagggtaaacagatcc

SEQ ID NO: 6850 - DNA, 22 bp, Artificial Sequence
  chemically synthesized
ctggcaagggtaaacagatccc

SEQ ID NO: 6851 - DNA, 22 bp, Artificial Sequence
  chemically synthesized
gcaagggtaaacagatcccctc

SEQ ID NO: 6852 - DNA, 22 bp, Artificial Sequence
  chemically synthesized
tcctcatccttcctctttcctg

SEQ ID NO: 6853 - DNA, 22 bp, Artificial Sequence
  chemically synthesized
ctcatccttcctctttcctgtc

SEQ ID NO: 6854 - DNA, 22 bp, Artificial Sequence
  chemically synthesized
atccttcctctttcctgtcaag

SEQ ID NO: 6855 - DNA, 22 bp, Artificial Sequence
  chemically synthesized
cctctttcctgtcaagtgcctc

SEQ ID NO: 6856 - DNA, 22 bp, Artificial Sequence
  chemically synthesized
ctctttcctgtcaagtgcctcc

SEQ ID NO: 6857 - DNA, 22 bp, Artificial Sequence
  chemically synthesized
tttcctgtcaagtgcctccttt

SEQ ID NO: 6858 - DNA, 22 bp, Artificial Sequence
  chemically synthesized
tcctgtcaagtgcctcctttgg

SEQ ID NO: 6859 - DNA, 22 bp, Artificial Sequence
  chemically synthesized
cctgtcaagtgcctcctttggt

SEQ ID NO: 6860 - DNA, 22 bp, Artificial Sequence
  chemically synthesized
ctgtcaagtgcctcctttggtg

SEQ ID NO: 6861 - DNA, 22 bp, Artificial Sequence
  chemically synthesized
tcaagtgcctcctttggtgaag

SEQ ID NO: 6862 - DNA, 22 bp, Artificial Sequence
  chemically synthesized
ctttggtgaaggtgacacatca

SEQ ID NO: 6863 - DNA, 22 bp, Artificial Sequence
  chemically synthesized
tggtgaaggtgacacatcatgt

SEQ ID NO: 6864 - DNA, 22 bp, Artificial Sequence
  chemically synthesized
ggtgaaggtgacacatcatgtg

SEQ ID NO: 6865 - DNA, 22 bp, Artificial Sequence
  chemically synthesized
gtgaaggtgacacatcatgtga

SEQ ID NO: 6866 - DNA, 22 bp, Artificial Sequence
  chemically synthesized
ttcagtgaccactctacggtgt

SEQ ID NO: 6867 - DNA, 22 bp, Artificial Sequence
  chemically synthesized
cagtgaccactctacggtgtcg

SEQ ID NO: 6868 - DNA, 22 bp, Artificial Sequence
  chemically synthesized
agtgaccactctacggtgtcgg

SEQ ID NO: 6869 - DNA, 22 bp, Artificial Sequence
  chemically synthesized
tacggtgtcgggccttgaacta

SEQ ID NO: 6870 - DNA, 22 bp, Artificial Sequence
  chemically synthesized
cggtgtcgggccttgaactact

SEQ ID NO: 6871 - DNA, 22 bp, Artificial Sequence
  chemically synthesized
gaactactacccccagaacatc

SEQ ID NO: 6872 - DNA, 22 bp, Artificial Sequence
  chemically synthesized
aactactacccccagaacatca

SEQ ID NO: 6873 - DNA, 22 bp, Artificial Sequence
  chemically synthesized
ctacccccagaacatcaccatg

SEQ ID NO: 6874 - DNA, 22 bp, Artificial Sequence
  chemically synthesized
cccccagaacatcaccatgaag

SEQ ID NO: 6875 - DNA, 22 bp, Artificial Sequence
  chemically synthesized
aaggataagcagccaatggatg

SEQ ID NO: 6876 - DNA, 22 bp, Artificial Sequence
  chemically synthesized
gaacctaaagacgtattgccca

SEQ ID NO: 6877 - DNA, 22 bp, Artificial Sequence
  chemically synthesized
aagacgtattgcccaatgggga

SEQ ID NO: 6878 - DNA, 22 bp, Artificial Sequence
  chemically synthesized
cccaatggggatgggacctacc

SEQ ID NO: 6879 - DNA, 22 bp, Artificial Sequence
  chemically synthesized
ccagggctggataaccttggct

SEQ ID NO: 6880 - DNA, 22 bp, Artificial Sequence
  chemically synthesized
gataaccttggctgtaccccct

SEQ ID NO: 6881 - DNA, 22 bp, Artificial Sequence
  chemically synthesized
ggctgtaccccctggggaagag

SEQ ID NO: 6882 - DNA, 22 bp, Artificial Sequence
  chemically synthesized
gctgtaccccctggggaagagc

SEQ ID NO: 6883 - DNA, 22 bp, Artificial Sequence
  chemically synthesized
taccccctggggaagagcagag

SEQ ID NO: 6884 - DNA, 22 bp, Artificial Sequence
  chemically synthesized
gggaagagcagagatatacgtg

SEQ ID NO: 6885 - DNA, 22 bp, Artificial Sequence
  chemically synthesized
gatcagcccctcattgtgatct

SEQ ID NO: 6886 - DNA, 22 bp, Artificial Sequence
  chemically synthesized
attgtgatctggggtatgtgac

SEQ ID NO: 6887 - DNA, 22 bp, Artificial Sequence
  chemically synthesized
tgatctggggtatgtgactgat

SEQ ID NO: 6888 - DNA, 22 bp, Artificial Sequence
  chemically synthesized
gggtatgtgactgatgagagcc

SEQ ID NO: 6889 - DNA, 22 bp, Artificial Sequence
  chemically synthesized
atgagagccaggagctgagaaa

SEQ ID NO: 6890 - DNA, 22 bp, Artificial Sequence
  chemically synthesized
agaaaatctattgggggttgag

SEQ ID NO: 6891 - DNA, 22 bp, Artificial Sequence
  chemically synthesized
ttgggggttgagaggagtgcct

SEQ ID NO: 6892 - DNA, 22 bp, Artificial Sequence
  chemically synthesized
ggggttgagaggagtgcctgag

SEQ ID NO: 6893 - DNA, 22 bp, Artificial Sequence
  chemically synthesized
agaggagtgcctgaggaggtaa

SEQ ID NO: 6894 - DNA, 22 bp, Artificial Sequence
  chemically synthesized
aggaggtaattatggcagtgag

SEQ ID NO: 6895 - DNA, 22 bp, Artificial Sequence
  chemically synthesized
tggcagtgagatgaggatctgc

SEQ ID NO: 6896 - DNA, 22 bp, Artificial Sequence
  chemically synthesized
ctctttgttagggggtgggctg

SEQ ID NO: 6897 - DNA, 22 bp, Artificial Sequence
  chemically synthesized
tttgttagggggtgggctgagg

SEQ ID NO: 6898 - DNA, 22 bp, Artificial Sequence
  chemically synthesized
tgttagggggtgggctgagggt

SEQ ID NO: 6899 - DNA, 22 bp, Artificial Sequence
  chemically synthesized
gttagggggtgggctgagggtg

SEQ ID NO: 6900 - DNA, 22 bp, Artificial Sequence
  chemically synthesized
ttagggggtgggctgagggtgg

SEQ ID NO: 6901 - DNA, 22 bp, Artificial Sequence
  chemically synthesized
gggggtgggctgagggtggcaa

SEQ ID NO: 6902 - DNA, 22 bp, Artificial Sequence
  chemically synthesized
agggtggcaatcaaaggcttta

SEQ ID NO: 6903 - DNA, 22 bp, Artificial Sequence
  chemically synthesized
taacttgctttttctgttttag

SEQ ID NO: 6904 - DNA, 22 bp, Artificial Sequence
  chemically synthesized
aacttgctttttctgttttaga

SEQ ID NO: 6905 - DNA, 22 bp, Artificial Sequence
  chemically synthesized
acttgctttttctgttttagag

SEQ ID NO: 6906 - DNA, 22 bp, Artificial Sequence
  chemically synthesized
gctttttctgttttagagccct

SEQ ID NO: 6907 - DNA, 22 bp, Artificial Sequence
  chemically synthesized
ctttttctgttttagagccctc

SEQ ID NO: 6908 - DNA, 22 bp, Artificial Sequence
  chemically synthesized
tttctgttttagagccctcacc

SEQ ID NO: 6909 - DNA, 22 bp, Artificial Sequence
  chemically synthesized
ttctgttttagagccctcaccg

SEQ ID NO: 6910 - DNA, 22 bp, Artificial Sequence
  chemically synthesized
tctgttttagagccctcaccgt

SEQ ID NO: 6911 - DNA, 22 bp, Artificial Sequence
  chemically synthesized
ctgttttagagccctcaccgtc

SEQ ID NO: 6912 - DNA, 22 bp, Artificial Sequence
  chemically synthesized
tgttttagagccctcaccgtct

SEQ ID NO: 6913 - DNA, 22 bp, Artificial Sequence
  chemically synthesized
ttttagagccctcaccgtctgg

SEQ ID NO: 6914 - DNA, 22 bp, Artificial Sequence
  chemically synthesized
tagagccctcaccgtctggcac

SEQ ID NO: 6915 - DNA, 22 bp, Artificial Sequence
  chemically synthesized
agagccctcaccgtctggcacc

SEQ ID NO: 6916 - DNA, 22 bp, Artificial Sequence
  chemically synthesized
gagccctcaccgtctggcaccc

SEQ ID NO: 6917 - DNA, 22 bp, Artificial Sequence
  chemically synthesized
accgtctggcaccctagtcatt

SEQ ID NO: 6918 - DNA, 22 bp, Artificial Sequence
  chemically synthesized
gcaccctagtcattggagtcat

SEQ ID NO: 6919 - DNA, 22 bp, Artificial Sequence
  chemically synthesized
gtcattggagtcatcagtggaa

SEQ ID NO: 6920 - DNA, 22 bp, Artificial Sequence
  chemically synthesized
gagtcatcagtggaattgctgt

SEQ ID NO: 6921 - DNA, 22 bp, Artificial Sequence
  chemically synthesized
ctgtttttgtcgtcatcttgtt

SEQ ID NO: 6922 - DNA, 22 bp, Artificial Sequence
  chemically synthesized
tttttgtcgtcatcttgttcat

SEQ ID NO: 6923 - DNA, 22 bp, Artificial Sequence
  chemically synthesized
ttgtcgtcatcttgttcattgg

SEQ ID NO: 6924 - DNA, 22 bp, Artificial Sequence
  chemically synthesized
tgtcgtcatcttgttcattgga

SEQ ID NO: 6925 - DNA, 22 bp, Artificial Sequence
  chemically synthesized
gtcgtcatcttgttcattggaa

SEQ ID NO: 6926 - DNA, 22 bp, Artificial Sequence
  chemically synthesized
tcgtcatcttgttcattggaat

SEQ ID NO: 6927 - DNA, 22 bp, Artificial Sequence
  chemically synthesized
gttcattggaattttgttcata

SEQ ID NO: 6928 - DNA, 22 bp, Artificial Sequence
  chemically synthesized
ttcattggaattttgttcataa

SEQ ID NO: 6929 - DNA, 22 bp, Artificial Sequence
  chemically synthesized
attggaattttgttcataatat

SEQ ID NO: 6930 - DNA, 22 bp, Artificial Sequence
  chemically synthesized
gaattttgttcataatattaag

SEQ ID NO: 6931 - DNA, 22 bp, Artificial Sequence
  chemically synthesized
tgttcataatattaaggaagag

SEQ ID NO: 6932 - DNA, 22 bp, Artificial Sequence
  chemically synthesized
gttcataatattaaggaagagg

SEQ ID NO: 6933 - DNA, 22 bp, Artificial Sequence
  chemically synthesized
ttcataatattaaggaagaggc

SEQ ID NO: 6934 - DNA, 22 bp, Artificial Sequence
  chemically synthesized
ataatattaaggaagaggcagg

SEQ ID NO: 6935 - DNA, 22 bp, Artificial Sequence
  chemically synthesized
aggaagaggcagggttcaagtg

SEQ ID NO: 6936 - DNA, 22 bp, Artificial Sequence
  chemically synthesized
aagtgagtaggaacaaggggga

SEQ ID NO: 6937 - DNA, 22 bp, Artificial Sequence
  chemically synthesized
ttagtacctctgccccagggca

SEQ ID NO: 6938 - DNA, 22 bp, Artificial Sequence
  chemically synthesized
agtacctctgccccagggcaca

SEQ ID NO: 6939 - DNA, 22 bp, Artificial Sequence
  chemically synthesized
gtacctctgccccagggcacag

SEQ ID NO: 6940 - DNA, 22 bp, Artificial Sequence
  chemically synthesized
tgccccagggcacagtgggaag

SEQ ID NO: 6941 - DNA, 22 bp, Artificial Sequence
  chemically synthesized
ccccagggcacagtgggaagag

SEQ ID NO: 6942 - DNA, 22 bp, Artificial Sequence
  chemically synthesized
gcatccatgggaagcatttttc

SEQ ID NO: 6943 - DNA, 22 bp, Artificial Sequence
  chemically synthesized
ttctcatttatattctttgggg

SEQ ID NO: 6944 - DNA, 22 bp, Artificial Sequence
  chemically synthesized
tctcatttatattctttgggga

SEQ ID NO: 6945 - DNA, 22 bp, Artificial Sequence
  chemically synthesized
ctcatttatattctttggggac

SEQ ID NO: 6946 - DNA, 22 bp, Artificial Sequence
  chemically synthesized
tcatttatattctttggggaca

SEQ ID NO: 6947 - DNA, 22 bp, Artificial Sequence
  chemically synthesized
atttatattctttggggacacc

SEQ ID NO: 6948 - DNA, 22 bp, Artificial Sequence
  chemically synthesized
atattctttggggacaccagca

SEQ ID NO: 6949 - DNA, 22 bp, Artificial Sequence
  chemically synthesized
tattctttggggacaccagcag

SEQ ID NO: 6950 - DNA, 22 bp, Artificial Sequence
  chemically synthesized
tttggggacaccagcagctccc

SEQ ID NO: 6951 - DNA, 22 bp, Artificial Sequence
  chemically synthesized
tggggacaccagcagctccctg

SEQ ID NO: 6952 - DNA, 22 bp, Artificial Sequence
  chemically synthesized
ggggacaccagcagctccctgg

SEQ ID NO: 6953 - DNA, 22 bp, Artificial Sequence
  chemically synthesized
gggacaccagcagctccctggg

SEQ ID NO: 6954 - DNA, 22 bp, Artificial Sequence
  chemically synthesized
cctgggagacagaaaataatgg

SEQ ID NO: 6955 - DNA, 22 bp, Artificial Sequence
  chemically synthesized
ggagacagaaaataatggttct

SEQ ID NO: 6956 - DNA, 22 bp, Artificial Sequence
  chemically synthesized
tccccagaatgaaagtctctaa

SEQ ID NO: 6957 - DNA, 22 bp, Artificial Sequence
  chemically synthesized
cccagaatgaaagtctctaatt

SEQ ID NO: 6958 - DNA, 22 bp, Artificial Sequence
  chemically synthesized
taattcaacaaacatcttcaga

SEQ ID NO: 6959 - DNA, 22 bp, Artificial Sequence
  chemically synthesized
attcaacaaacatcttcagagc

SEQ ID NO: 6960 - DNA, 22 bp, Artificial Sequence
  chemically synthesized
aacaaacatcttcagagcacct

SEQ ID NO: 6961 - DNA, 22 bp, Artificial Sequence
  chemically synthesized
cagagcacctactattttgcaa

SEQ ID NO: 6962 - DNA, 22 bp, Artificial Sequence
  chemically synthesized
agagcacctactattttgcaag

SEQ ID NO: 6963 - DNA, 22 bp, Artificial Sequence
  chemically synthesized
ctattttgcaagagctgtttaa

SEQ ID NO: 6964 - DNA, 22 bp, Artificial Sequence
  chemically synthesized
ttttgcaagagctgtttaaggt

SEQ ID NO: 6965 - DNA, 22 bp, Artificial Sequence
  chemically synthesized
tgcaagagctgtttaaggtagt

SEQ ID NO: 6966 - DNA, 22 bp, Artificial Sequence
  chemically synthesized
gcaagagctgtttaaggtagta

SEQ ID NO: 6967 - DNA, 22 bp, Artificial Sequence
  chemically synthesized
caagagctgtttaaggtagtac

SEQ ID NO: 6968 - DNA, 22 bp, Artificial Sequence
  chemically synthesized
tttaaggtagtacaggggcttt

SEQ ID NO: 6969 - DNA, 22 bp, Artificial Sequence
  chemically synthesized
aaggtagtacaggggctttgag

SEQ ID NO: 6970 - DNA, 22 bp, Artificial Sequence
  chemically synthesized
aggtagtacaggggctttgagg

SEQ ID NO: 6971 - DNA, 22 bp, Artificial Sequence
  chemically synthesized
tgaggttgagaagtcactgtgg

SEQ ID NO: 6972 - DNA, 22 bp, Artificial Sequence
  chemically synthesized
gaggttgagaagtcactgtggc

SEQ ID NO: 6973 - DNA, 22 bp, Artificial Sequence
  chemically synthesized
aggttgagaagtcactgtggct

SEQ ID NO: 6974 - DNA, 22 bp, Artificial Sequence
  chemically synthesized
agaagtcactgtggctattctc

SEQ ID NO: 6975 - DNA, 22 bp, Artificial Sequence
  chemically synthesized
tggctattctcagaacccaaat

SEQ ID NO: 6976 - DNA, 22 bp, Artificial Sequence
  chemically synthesized
ttctcagaacccaaatctggta

SEQ ID NO: 6977 - DNA, 22 bp, Artificial Sequence
  chemically synthesized
tcagaacccaaatctggtaggg

SEQ ID NO: 6978 - DNA, 22 bp, Artificial Sequence
  chemically synthesized
agaacccaaatctggtagggaa

SEQ ID NO: 6979 - DNA, 22 bp, Artificial Sequence
  chemically synthesized
gtagggaatgaaattgatagca

SEQ ID NO: 6980 - DNA, 22 bp, Artificial Sequence
  chemically synthesized
atagcaagtaaatgtagttaaa

SEQ ID NO: 6981 - DNA, 22 bp, Artificial Sequence
  chemically synthesized
aagaagaccccatgaggtccta

SEQ ID NO: 6982 - DNA, 22 bp, Artificial Sequence
  chemically synthesized
aagcaggcaggaagcaaatgct

SEQ ID NO: 6983 - DNA, 22 bp, Artificial Sequence
  chemically synthesized
agggtgtcaaaggaaagaatga

SEQ ID NO: 6984 - DNA, 22 bp, Artificial Sequence
  chemically synthesized
gggtgtcaaaggaaagaatgat

SEQ ID NO: 6985 - DNA, 22 bp, Artificial Sequence
  chemically synthesized
agctggggatcaagatagcctt

SEQ ID NO: 6986 - DNA, 22 bp, Artificial Sequence
  chemically synthesized
gggatcaagatagccttctgga

SEQ ID NO: 6987 - DNA, 22 bp, Artificial Sequence
  chemically synthesized
ctggatcttgaaggagaagctg

SEQ ID NO: 6988 - DNA, 22 bp, Artificial Sequence
  chemically synthesized
tggatcttgaaggagaagctgg

SEQ ID NO: 6989 - DNA, 22 bp, Artificial Sequence
  chemically synthesized
gatcttgaaggagaagctggat

SEQ ID NO: 6990 - DNA, 22 bp, Artificial Sequence
  chemically synthesized
gaaggagaagctggattccatt

SEQ ID NO: 6991 - DNA, 22 bp, Artificial Sequence
  chemically synthesized
aaggagaagctggattccatta

SEQ ID NO: 6992 - DNA, 22 bp, Artificial Sequence
  chemically synthesized
gattccattaggtgaggttgaa

SEQ ID NO: 6993 - DNA, 22 bp, Artificial Sequence
  chemically synthesized
cattaggtgaggttgaagatga

SEQ ID NO: 6994 - DNA, 22 bp, Artificial Sequence
  chemically synthesized
ggtgaggttgaagatgatggga

SEQ ID NO: 6995 - DNA, 22 bp, Artificial Sequence
  chemically synthesized
aagatgatgggaggtctacaca

SEQ ID NO: 6996 - DNA, 22 bp, Artificial Sequence
  chemically synthesized
cacagacggagcaaccatgcca

SEQ ID NO: 6997 - DNA, 22 bp, Artificial Sequence
  chemically synthesized
ggagattagaaataattactgt

SEQ ID NO: 6998 - DNA, 22 bp, Artificial Sequence
  chemically synthesized
gaaataattactgtaccttaac

SEQ ID NO: 6999 - DNA, 22 bp, Artificial Sequence
  chemically synthesized
ctgtaccttaaccctgagtttg

SEQ ID NO: 7000 - DNA, 22 bp, Artificial Sequence
  chemically synthesized
taccttaaccctgagtttgcgt

SEQ ID NO: 7001 - DNA, 22 bp, Artificial Sequence
  chemically synthesized
aaccctgagtttgcgtagctat

SEQ ID NO: 7002 - DNA, 22 bp, Artificial Sequence
  chemically synthesized
accctgagtttgcgtagctatc

SEQ ID NO: 7003 - DNA, 22 bp, Artificial Sequence
  chemically synthesized
agtttgcgtagctatcactcac

SEQ ID NO: 7004 - DNA, 22 bp, Artificial Sequence
  chemically synthesized
gcgtagctatcactcaccaatt

SEQ ID NO: 7005 - DNA, 22 bp, Artificial Sequence
  chemically synthesized
cgtagctatcactcaccaatta

SEQ ID NO: 7006 - DNA, 22 bp, Artificial Sequence
  chemically synthesized
tcactcaccaattatgcatttc

SEQ ID NO: 7007 - DNA, 22 bp, Artificial Sequence
  chemically synthesized
accaattatgcatttctacccc

SEQ ID NO: 7008 - DNA, 22 bp, Artificial Sequence
  chemically synthesized
tgcatttctaccccctgaacat

SEQ ID NO: 7009 - DNA, 22 bp, Artificial Sequence
  chemically synthesized
ctaccccctgaacatctgtggt

SEQ ID NO: 7010 - DNA, 22 bp, Artificial Sequence
  chemically synthesized
taccccctgaacatctgtggtg

SEQ ID NO: 7011 - DNA, 22 bp, Artificial Sequence
  chemically synthesized
ccccctgaacatctgtggtgta

SEQ ID NO: 7012 - DNA, 22 bp, Artificial Sequence
  chemically synthesized
aacatctgtggtgtagggaaaa

SEQ ID NO: 7013 - DNA, 22 bp, Artificial Sequence
  chemically synthesized
tggtgtagggaaaagagaatca

SEQ ID NO: 7014 - DNA, 22 bp, Artificial Sequence
  chemically synthesized
atacagagtccaagggtctttt

SEQ ID NO: 7015 - DNA, 22 bp, Artificial Sequence
  chemically synthesized
ttgggatattgggttatgatca

SEQ ID NO: 7016 - DNA, 22 bp, Artificial Sequence
  chemically synthesized
tgggatattgggttatgatcac

SEQ ID NO: 7017 - DNA, 22 bp, Artificial Sequence
  chemically synthesized
gggatattgggttatgatcact

SEQ ID NO: 7018 - DNA, 22 bp, Artificial Sequence
  chemically synthesized
ggatattgggttatgatcactg

SEQ ID NO: 7019 - DNA, 22 bp, Artificial Sequence
  chemically synthesized
ggttatgatcactggggtgtca

SEQ ID NO: 7020 - DNA, 22 bp, Artificial Sequence
  chemically synthesized
tgatcactggggtgtcattgaa

SEQ ID NO: 7021 - DNA, 22 bp, Artificial Sequence
  chemically synthesized
gggtgtcattgaaggatcctaa

SEQ ID NO: 7022 - DNA, 22 bp, Artificial Sequence
  chemically synthesized
aaggatcctaagaaaggaggac

SEQ ID NO: 7023 - DNA, 22 bp, Artificial Sequence
  chemically synthesized
agaaaggaggaccacgatctcc

SEQ ID NO: 7024 - DNA, 22 bp, Artificial Sequence
  chemically synthesized
ccttatatggtgaatgtgttgt

SEQ ID NO: 7025 - DNA, 22 bp, Artificial Sequence
  chemically synthesized
atatggtgaatgtgttgttaag

SEQ ID NO: 7026 - DNA, 22 bp, Artificial Sequence
  chemically synthesized
tatggtgaatgtgttgttaaga

SEQ ID NO: 7027 - DNA, 22 bp, Artificial Sequence
  chemically synthesized
ttaagaagttagatgagaggtg

SEQ ID NO: 7028 - DNA, 22 bp, Artificial Sequence
  chemically synthesized
agaagttagatgagaggtgagg

SEQ ID NO: 7029 - DNA, 22 bp, Artificial Sequence
  chemically synthesized
gatgagaggtgaggagaccagt

SEQ ID NO: 7030 - DNA, 22 bp, Artificial Sequence
  chemically synthesized
gaaagccaataagcatttccag

SEQ ID NO: 7031 - DNA, 22 bp, Artificial Sequence
  chemically synthesized
ccagatgagagataatggttct

SEQ ID NO: 7032 - DNA, 22 bp, Artificial Sequence
  chemically synthesized
cagatgagagataatggttctt

SEQ ID NO: 7033 - DNA, 22 bp, Artificial Sequence
  chemically synthesized
ttgaaatccaatagtgcccagg

SEQ ID NO: 7034 - DNA, 22 bp, Artificial Sequence
  chemically synthesized
gaaatccaatagtgcccaggtc

SEQ ID NO: 7035 - DNA, 22 bp, Artificial Sequence
  chemically synthesized
aaatccaatagtgcccaggtct

SEQ ID NO: 7036 - DNA, 22 bp, Artificial Sequence
  chemically synthesized
aattgagatgggtgaatgagga

SEQ ID NO: 7037 - DNA, 22 bp, Artificial Sequence
  chemically synthesized
agatgggtgaatgaggaaaata

SEQ ID NO: 7038 - DNA, 22 bp, Artificial Sequence
  chemically synthesized
ggtttgtgatgcctctttcctg

SEQ ID NO: 7039 - DNA, 22 bp, Artificial Sequence
  chemically synthesized
gtgatgcctctttcctgggtct

SEQ ID NO: 7040 - DNA, 22 bp, Artificial Sequence
  chemically synthesized
tgatgcctctttcctgggtctc

SEQ ID NO: 7041 - DNA, 22 bp, Artificial Sequence
  chemically synthesized
tttcctgggtctcttgtctcca

SEQ ID NO: 7042 - DNA, 22 bp, Artificial Sequence
  chemically synthesized
tcctgggtctcttgtctccaca

SEQ ID NO: 7043 - DNA, 22 bp, Artificial Sequence
  chemically synthesized
cctgggtctcttgtctccacag

SEQ ID NO: 7044 - DNA, 22 bp, Artificial Sequence
  chemically synthesized
ctgggtctcttgtctccacagg

SEQ ID NO: 7045 - DNA, 22 bp, Artificial Sequence
  chemically synthesized
ggtctcttgtctccacaggagg

SEQ ID NO: 7046 - DNA, 22 bp, Artificial Sequence
  chemically synthesized
ttgtctccacaggaggagccat

SEQ ID NO: 7047 - DNA, 22 bp, Artificial Sequence
  chemically synthesized
gtctccacaggaggagccatgg

SEQ ID NO: 7048 - DNA, 22 bp, Artificial Sequence
  chemically synthesized
tctccacaggaggagccatggg

SEQ ID NO: 7049 - DNA, 22 bp, Artificial Sequence
  chemically synthesized
cacaggaggagccatggggcac

SEQ ID NO: 7050 - DNA, 22 bp, Artificial Sequence
  chemically synthesized
cgtcttagctgaacgtgagtga

SEQ ID NO: 7051 - DNA, 22 bp, Artificial Sequence
  chemically synthesized
agctgaacgtgagtgacacgca

SEQ ID NO: 7052 - DNA, 22 bp, Artificial Sequence
  chemically synthesized
gctgaacgtgagtgacacgcag

SEQ ID NO: 7053 - DNA, 22 bp, Artificial Sequence
  chemically synthesized
aacgtgagtgacacgcagcctg

SEQ ID NO: 7054 - DNA, 22 bp, Artificial Sequence
  chemically synthesized
cagactcactgtgggaaggaga

SEQ ID NO: 7055 - DNA, 22 bp, Artificial Sequence
  chemically synthesized
actgtgggaaggagacaaaact

SEQ ID NO: 7056 - DNA, 22 bp, Artificial Sequence
  chemically synthesized
tgggaaggagacaaaactagag

SEQ ID NO: 7057 - DNA, 22 bp, Artificial Sequence
  chemically synthesized
gagactcaaagagggagtgcat

SEQ ID NO: 7058 - DNA, 22 bp, Artificial Sequence
  chemically synthesized
aaagagggagtgcatttatgag

SEQ ID NO: 7059 - DNA, 22 bp, Artificial Sequence
  chemically synthesized
atgagctcttcatgtttcagga

SEQ ID NO: 7060 - DNA, 22 bp, Artificial Sequence
  chemically synthesized
tgagctcttcatgtttcaggag

SEQ ID NO: 7061 - DNA, 22 bp, Artificial Sequence
  chemically synthesized
ttcatgtttcaggagagagttg

SEQ ID NO: 7062 - DNA, 22 bp, Artificial Sequence
  chemically synthesized
catgtttcaggagagagttgaa

SEQ ID NO: 7063 - DNA, 22 bp, Artificial Sequence
  chemically synthesized
atgtttcaggagagagttgaac

SEQ ID NO: 7064 - DNA, 22 bp, Artificial Sequence
  chemically synthesized
caggagagagttgaacctaaac

SEQ ID NO: 7065 - DNA, 22 bp, Artificial Sequence
  chemically synthesized
aggagagagttgaacctaaaca

SEQ ID NO: 7066 - DNA, 22 bp, Artificial Sequence
  chemically synthesized
aacctaaacatagaaattgcct

SEQ ID NO: 7067 - DNA, 22 bp, Artificial Sequence
  chemically synthesized
aacatagaaattgcctgacgaa

SEQ ID NO: 7068 - DNA, 22 bp, Artificial Sequence
  chemically synthesized
cctgacgaactccttgatttta

SEQ ID NO: 7069 - DNA, 22 bp, Artificial Sequence
  chemically synthesized
acgaactccttgattttagcct

SEQ ID NO: 7070 - DNA, 22 bp, Artificial Sequence
  chemically synthesized
cttgattttagccttctctgtt

SEQ ID NO: 7071 - DNA, 22 bp, Artificial Sequence
  chemically synthesized
gattttagccttctctgttcat

SEQ ID NO: 7072 - DNA, 22 bp, Artificial Sequence
  chemically synthesized
attttagccttctctgttcatt

SEQ ID NO: 7073 - DNA, 22 bp, Artificial Sequence
  chemically synthesized
tagccttctctgttcatttcct

SEQ ID NO: 7074 - DNA, 22 bp, Artificial Sequence
  chemically synthesized
agccttctctgttcatttcctc

SEQ ID NO: 7075 - DNA, 22 bp, Artificial Sequence
  chemically synthesized
gccttctctgttcatttcctca

SEQ ID NO: 7076 - DNA, 22 bp, Artificial Sequence
  chemically synthesized
ctctgttcatttcctcaaaaag

SEQ ID NO: 7077 - DNA, 22 bp, Artificial Sequence
  chemically synthesized
tctgttcatttcctcaaaaaga

SEQ ID NO: 7078 - DNA, 22 bp, Artificial Sequence
  chemically synthesized
tgttcatttcctcaaaaagatt

SEQ ID NO: 7079 - DNA, 22 bp, Artificial Sequence
  chemically synthesized
ttcatttcctcaaaaagatttc

SEQ ID NO: 7080 - DNA, 22 bp, Artificial Sequence
  chemically synthesized
atttcctcaaaaagatttcccc

SEQ ID NO: 7081 - DNA, 22 bp, Artificial Sequence
  chemically synthesized
cctcaaaaagatttccccattt

SEQ ID NO: 7082 - DNA, 22 bp, Artificial Sequence
  chemically synthesized
ctcaaaaagatttccccattta

SEQ ID NO: 7083 - DNA, 22 bp, Artificial Sequence
  chemically synthesized
aaaaagatttccccatttaggt

SEQ ID NO: 7084 - DNA, 22 bp, Artificial Sequence
  chemically synthesized
ccccatttaggtttctgagttc

SEQ ID NO: 7085 - DNA, 22 bp, Artificial Sequence
  chemically synthesized
cccatttaggtttctgagttcc

SEQ ID NO: 7086 - DNA, 22 bp, Artificial Sequence
  chemically synthesized
aggtttctgagttcctgcatgc

SEQ ID NO: 7087 - DNA, 22 bp, Artificial Sequence
  chemically synthesized
ggtttctgagttcctgcatgcc

SEQ ID NO: 7088 - DNA, 22 bp, Artificial Sequence
  chemically synthesized
ctgagttcctgcatgccggtga

SEQ ID NO: 7089 - DNA, 22 bp, Artificial Sequence
  chemically synthesized
tgagttcctgcatgccggtgat

SEQ ID NO: 7090 - DNA, 22 bp, Artificial Sequence
  chemically synthesized
agttcctgcatgccggtgatcc

SEQ ID NO: 7091 - DNA, 22 bp, Artificial Sequence
  chemically synthesized
ctgcatgccggtgatccctagc

SEQ ID NO: 7092 - DNA, 22 bp, Artificial Sequence
  chemically synthesized
catgccggtgatccctagctgt

SEQ ID NO: 7093 - DNA, 22 bp, Artificial Sequence
  chemically synthesized
gctgtgacctctcccctggaac

SEQ ID NO: 7094 - DNA, 22 bp, Artificial Sequence
  chemically synthesized
tgacctctcccctggaactgtc

SEQ ID NO: 7095 - DNA, 22 bp, Artificial Sequence
  chemically synthesized
tcccctggaactgtctctcatg

SEQ ID NO: 7096 - DNA, 22 bp, Artificial Sequence
  chemically synthesized
ccctggaactgtctctcatgaa

SEQ ID NO: 7097 - DNA, 22 bp, Artificial Sequence
  chemically synthesized
gaactgtctctcatgaacctca

SEQ ID NO: 7098 - DNA, 22 bp, Artificial Sequence
  chemically synthesized
tctctcatgaacctcaagctgc

SEQ ID NO: 7099 - DNA, 22 bp, Artificial Sequence
  chemically synthesized
tcatgaacctcaagctgcatct

SEQ ID NO: 7100 - DNA, 22 bp, Artificial Sequence
  chemically synthesized
atgaacctcaagctgcatctag

SEQ ID NO: 7101 - DNA, 22 bp, Artificial Sequence
  chemically synthesized
aagctgcatctagaggcttcct

SEQ ID NO: 7102 - DNA, 22 bp, Artificial Sequence
  chemically synthesized
catctagaggcttccttcattt

SEQ ID NO: 7103 - DNA, 22 bp, Artificial Sequence
  chemically synthesized
gaggcttccttcatttcctccg

SEQ ID NO: 7104 - DNA, 22 bp, Artificial Sequence
  chemically synthesized
ccttcatttcctccgtcacctc

SEQ ID NO: 7105 - DNA, 22 bp, Artificial Sequence
  chemically synthesized
cttcatttcctccgtcacctca

SEQ ID NO: 7106 - DNA, 22 bp, Artificial Sequence
  chemically synthesized
catttcctccgtcacctcagag

SEQ ID NO: 7107 - DNA, 22 bp, Artificial Sequence
  chemically synthesized
atttcctccgtcacctcagaga

SEQ ID NO: 7108 - DNA, 22 bp, Artificial Sequence
  chemically synthesized
cctccgtcacctcagagacata

SEQ ID NO: 7109 - DNA, 22 bp, Artificial Sequence
  chemically synthesized
ctccgtcacctcagagacatac

SEQ ID NO: 7110 - DNA, 22 bp, Artificial Sequence
  chemically synthesized
cgtcacctcagagacatacacc

SEQ ID NO: 7111 - DNA, 22 bp, Artificial Sequence
  chemically synthesized
agagacatacacctatgtcatt

SEQ ID NO: 7112 - DNA, 22 bp, Artificial Sequence
  chemically synthesized
tgtcatttcatttcctattttt

SEQ ID NO: 7113 - DNA, 22 bp, Artificial Sequence
  chemically synthesized
catttcctatttttggaagagg

SEQ ID NO: 7114 - DNA, 22 bp, Artificial Sequence
  chemically synthesized
atttcctatttttggaagagga

SEQ ID NO: 7115 - DNA, 22 bp, Artificial Sequence
  chemically synthesized
cctatttttggaagaggactcc

SEQ ID NO: 7116 - DNA, 22 bp, Artificial Sequence
  chemically synthesized
ctatttttggaagaggactcct

SEQ ID NO: 7117 - DNA, 22 bp, Artificial Sequence
  chemically synthesized
tttttggaagaggactccttaa

SEQ ID NO: 7118 - DNA, 22 bp, Artificial Sequence
  chemically synthesized
ttggaagaggactccttaaatt

SEQ ID NO: 7119 - DNA, 22 bp, Artificial Sequence
  chemically synthesized
tggaagaggactccttaaattt

SEQ ID NO: 7120 - DNA, 22 bp, Artificial Sequence
  chemically synthesized
ggaagaggactccttaaatttg

SEQ ID NO: 7121 - DNA, 22 bp, Artificial Sequence
  chemically synthesized
gaagaggactccttaaatttgg

SEQ ID NO: 7122 - DNA, 22 bp, Artificial Sequence
  chemically synthesized
cttaaatttgggggacttacat

SEQ ID NO: 7123 - DNA, 22 bp, Artificial Sequence
  chemically synthesized
aaatttgggggacttacatgat

SEQ ID NO: 7124 - DNA, 22 bp, Artificial Sequence
  chemically synthesized
aatttgggggacttacatgatt

SEQ ID NO: 7125 - DNA, 22 bp, Artificial Sequence
  chemically synthesized
gggggacttacatgattcattt

SEQ ID NO: 7126 - DNA, 22 bp, Artificial Sequence
  chemically synthesized
ggggacttacatgattcatttt

SEQ ID NO: 7127 - DNA, 22 bp, Artificial Sequence
  chemically synthesized
acatgattcattttaacatctg

SEQ ID NO: 7128 - DNA, 22 bp, Artificial Sequence
  chemically synthesized
catgattcattttaacatctga

SEQ ID NO: 7129 - DNA, 22 bp, Artificial Sequence
  chemically synthesized
attttaacatctgagaaaagct

SEQ ID NO: 7130 - DNA, 22 bp, Artificial Sequence
  chemically synthesized
taacatctgagaaaagctttga

SEQ ID NO: 7131 - DNA, 22 bp, Artificial Sequence
  chemically synthesized
aacatctgagaaaagctttgaa

SEQ ID NO: 7132 - DNA, 22 bp, Artificial Sequence
  chemically synthesized
acatctgagaaaagctttgaac

SEQ ID NO: 7133 - DNA, 22 bp, Artificial Sequence
  chemically synthesized
agaaaagctttgaaccctggga

SEQ ID NO: 7134 - DNA, 22 bp, Artificial Sequence
  chemically synthesized
tgaaccctgggacgtggctagt

SEQ ID NO: 7135 - DNA, 22 bp, Artificial Sequence
  chemically synthesized
gaaccctgggacgtggctagtc

SEQ ID NO: 7136 - DNA, 22 bp, Artificial Sequence
  chemically synthesized
aaccctgggacgtggctagtca

SEQ ID NO: 7137 - DNA, 22 bp, Artificial Sequence
  chemically synthesized
ggacgtggctagtcataacctt

SEQ ID NO: 7138 - DNA, 22 bp, Artificial Sequence
  chemically synthesized
gtcataaccttaccagattttt

SEQ ID NO: 7139 - DNA, 22 bp, Artificial Sequence
  chemically synthesized
accagatttttacacatgtatc

SEQ ID NO: 7140 - DNA, 22 bp, Artificial Sequence
  chemically synthesized
ccagatttttacacatgtatct

SEQ ID NO: 7141 - DNA, 22 bp, Artificial Sequence
  chemically synthesized
ttacacatgtatctatgcattt

SEQ ID NO: 7142 - DNA, 22 bp, Artificial Sequence
  chemically synthesized
tacacatgtatctatgcatttt

SEQ ID NO: 7143 - DNA, 22 bp, Artificial Sequence
  chemically synthesized
acacatgtatctatgcattttc

SEQ ID NO: 7144 - DNA, 22 bp, Artificial Sequence
  chemically synthesized
cacatgtatctatgcattttct

SEQ ID NO: 7145 - DNA, 22 bp, Artificial Sequence
  chemically synthesized
tgcattttctggacccgttcaa

SEQ ID NO: 7146 - DNA, 22 bp, Artificial Sequence
  chemically synthesized
tctggacccgttcaacttttcc

SEQ ID NO: 7147 - DNA, 22 bp, Artificial Sequence
  chemically synthesized
ctggacccgttcaacttttcct

SEQ ID NO: 7148 - DNA, 22 bp, Artificial Sequence
  chemically synthesized
tggacccgttcaacttttcctt

SEQ ID NO: 7149 - DNA, 22 bp, Artificial Sequence
  chemically synthesized
gacccgttcaacttttcctttg

SEQ ID NO: 7150 - DNA, 22 bp, Artificial Sequence
  chemically synthesized
aacttttcctttgaatcctctc

SEQ ID NO: 7151 - DNA, 22 bp, Artificial Sequence
  chemically synthesized
ttcctttgaatcctctctctgt

SEQ ID NO: 7152 - DNA, 22 bp, Artificial Sequence
  chemically synthesized
tcctttgaatcctctctctgtg

SEQ ID NO: 7153 - DNA, 22 bp, Artificial Sequence
  chemically synthesized
cctttgaatcctctctctgtgt

SEQ ID NO: 7154 - DNA, 22 bp, Artificial Sequence
  chemically synthesized
ctttgaatcctctctctgtgtt

SEQ ID NO: 7155 - DNA, 22 bp, Artificial Sequence
  chemically synthesized
tgaatcctctctctgtgttacc

SEQ ID NO: 7156 - DNA, 22 bp, Artificial Sequence
  chemically synthesized
gaatcctctctctgtgttaccc

SEQ ID NO: 7157 - DNA, 22 bp, Artificial Sequence
  chemically synthesized
aatcctctctctgtgttaccca

SEQ ID NO: 7158 - DNA, 22 bp, Artificial Sequence
  chemically synthesized
tctctgtgttacccagtaactc

SEQ ID NO: 7159 - DNA, 22 bp, Artificial Sequence
  chemically synthesized
tctgtgttacccagtaactcat

SEQ ID NO: 7160 - DNA, 22 bp, Artificial Sequence
  chemically synthesized
tgtgttacccagtaactcatct

SEQ ID NO: 7161 - DNA, 22 bp, Artificial Sequence
  chemically synthesized
tgttacccagtaactcatctgt

SEQ ID NO: 7162 - DNA, 22 bp, Artificial Sequence
  chemically synthesized
cccagtaactcatctgtcacca

SEQ ID NO: 7163 - DNA, 22 bp, Artificial Sequence
  chemically synthesized
atctgtcaccaagccttgggga

SEQ ID NO: 7164 - DNA, 22 bp, Artificial Sequence
  chemically synthesized
tcaccaagccttggggattctt

SEQ ID NO: 7165 - DNA, 22 bp, Artificial Sequence
  chemically synthesized
ggggattcttccatctgattgt

SEQ ID NO: 7166 - DNA, 22 bp, Artificial Sequence
  chemically synthesized
gggattcttccatctgattgtg

SEQ ID NO: 7167 - DNA, 22 bp, Artificial Sequence
  chemically synthesized
ttccatctgattgtgatgtgag

SEQ ID NO: 7168 - DNA, 22 bp, Artificial Sequence
  chemically synthesized
ccatctgattgtgatgtgagtt

SEQ ID NO: 7169 - DNA, 22 bp, Artificial Sequence
  chemically synthesized
catctgattgtgatgtgagttg

SEQ ID NO: 7170 - DNA, 22 bp, Artificial Sequence
  chemically synthesized
attgtgatgtgagttgcacagc

SEQ ID NO: 7171 - DNA, 22 bp, Artificial Sequence
  chemically synthesized
tgatgtgagttgcacagctatg

SEQ ID NO: 7172 - DNA, 22 bp, Artificial Sequence
  chemically synthesized
cacagctatgaaggctgtacac

SEQ ID NO: 7173 - DNA, 22 bp, Artificial Sequence
  chemically synthesized
tgaaggctgtacactgcacgaa

SEQ ID NO: 7174 - DNA, 22 bp, Artificial Sequence
  chemically synthesized
tacactgcacgaatggaagagg

SEQ ID NO: 7175 - DNA, 22 bp, Artificial Sequence
  chemically synthesized
cacgaatggaagaggcacctgt

SEQ ID NO: 7176 - DNA, 22 bp, Artificial Sequence
  chemically synthesized
tcccagaaaaagcatcatggct

SEQ ID NO: 7177 - DNA, 22 bp, Artificial Sequence
  chemically synthesized
tctgtgggtagtatgatgggtg

SEQ ID NO: 7178 - DNA, 22 bp, Artificial Sequence
  chemically synthesized
tgggtagtatgatgggtgtttt

SEQ ID NO: 7179 - DNA, 22 bp, Artificial Sequence
  chemically synthesized
ttagcaggtaggaggcaaatat

SEQ ID NO: 7180 - DNA, 22 bp, Artificial Sequence
  chemically synthesized
tagcaggtaggaggcaaatatc

SEQ ID NO: 7181 - DNA, 22 bp, Artificial Sequence
  chemically synthesized
agcaggtaggaggcaaatatct

SEQ ID NO: 7182 - DNA, 22 bp, Artificial Sequence
  chemically synthesized
gcaggtaggaggcaaatatctt

SEQ ID NO: 7183 - DNA, 22 bp, Artificial Sequence
  chemically synthesized
gaaaggggttgtgaagaggtgt

SEQ ID NO: 7184 - DNA, 22 bp, Artificial Sequence
  chemically synthesized
aaaggggttgtgaagaggtgtt

SEQ ID NO: 7185 - DNA, 22 bp, Artificial Sequence
  chemically synthesized
tgaagaggtgttttttctaatt

SEQ ID NO: 7186 - DNA, 22 bp, Artificial Sequence
  chemically synthesized
tttctaattggcatgaaggtgt

SEQ ID NO: 7187 - DNA, 22 bp, Artificial Sequence
  chemically synthesized
ttctaattggcatgaaggtgtc

SEQ ID NO: 7188 - DNA, 22 bp, Artificial Sequence
  chemically synthesized
tctaattggcatgaaggtgtca

SEQ ID NO: 7189 - DNA, 22 bp, Artificial Sequence
  chemically synthesized
ctaattggcatgaaggtgtcat

SEQ ID NO: 7190 - DNA, 22 bp, Artificial Sequence
  chemically synthesized
taattggcatgaaggtgtcata

SEQ ID NO: 7191 - DNA, 22 bp, Artificial Sequence
  chemically synthesized
attggcatgaaggtgtcataca

SEQ ID NO: 7192 - DNA, 22 bp, Artificial Sequence
  chemically synthesized
gcatgaaggtgtcatacagatt

SEQ ID NO: 7193 - DNA, 22 bp, Artificial Sequence
  chemically synthesized
gcaaagtttaatggtgccttca

SEQ ID NO: 7194 - DNA, 22 bp, Artificial Sequence
  chemically synthesized
caaagtttaatggtgccttcat

SEQ ID NO: 7195 - DNA, 22 bp, Artificial Sequence
  chemically synthesized
aatggtgccttcatttgggatg

SEQ ID NO: 7196 - DNA, 22 bp, Artificial Sequence
  chemically synthesized
atggtgccttcatttgggatgc

SEQ ID NO: 7197 - DNA, 22 bp, Artificial Sequence
  chemically synthesized
catttgggatgctactctagta

SEQ ID NO: 7198 - DNA, 22 bp, Artificial Sequence
  chemically synthesized
atttgggatgctactctagtat

SEQ ID NO: 7199 - DNA, 22 bp, Artificial Sequence
  chemically synthesized
gggatgctactctagtattcca

SEQ ID NO: 7200 - DNA, 22 bp, Artificial Sequence
  chemically synthesized
ggatgctactctagtattccag

SEQ ID NO: 7201 - DNA, 22 bp, Artificial Sequence
  chemically synthesized
ctctagtattccagacctgaag

SEQ ID NO: 7202 - DNA, 22 bp, Artificial Sequence
  chemically synthesized
tagtattccagacctgaagaat

SEQ ID NO: 7203 - DNA, 22 bp, Artificial Sequence
  chemically synthesized
gtattccagacctgaagaatca

SEQ ID NO: 7204 - DNA, 22 bp, Artificial Sequence
  chemically synthesized
cagacctgaagaatcacaataa

SEQ ID NO: 7205 - DNA, 22 bp, Artificial Sequence
  chemically synthesized
aagaatcacaataattttctac

SEQ ID NO: 7206 - DNA, 22 bp, Artificial Sequence
  chemically synthesized
tctacctggtctctccttgttc

SEQ ID NO: 7207 - DNA, 22 bp, Artificial Sequence
  chemically synthesized
ctacctggtctctccttgttct

SEQ ID NO: 7208 - DNA, 22 bp, Artificial Sequence
  chemically synthesized
tacctggtctctccttgttctg

SEQ ID NO: 7209 - DNA, 22 bp, Artificial Sequence
  chemically synthesized
cctggtctctccttgttctgat

SEQ ID NO: 7210 - DNA, 22 bp, Artificial Sequence
  chemically synthesized
gtctctccttgttctgataatg

SEQ ID NO: 7211 - DNA, 22 bp, Artificial Sequence
  chemically synthesized
tccttgttctgataatgaaaat

SEQ ID NO: 7212 - DNA, 22 bp, Artificial Sequence
  chemically synthesized
cttgttctgataatgaaaatta

SEQ ID NO: 7213 - DNA, 22 bp, Artificial Sequence
  chemically synthesized
gttctgataatgaaaattatga

SEQ ID NO: 7214 - DNA, 22 bp, Artificial Sequence
  chemically synthesized
ttctgataatgaaaattatgat

SEQ ID NO: 7215 - DNA, 22 bp, Artificial Sequence
  chemically synthesized
tgataatgaaaattatgataag

SEQ ID NO: 7216 - DNA, 22 bp, Artificial Sequence
  chemically synthesized
ataatgaaaattatgataagga

SEQ ID NO: 7217 - DNA, 22 bp, Artificial Sequence
  chemically synthesized
tgataaggatgataaaagcact

SEQ ID NO: 7218 - DNA, 22 bp, Artificial Sequence
  chemically synthesized
acttcgtgtccgactcttctga

SEQ ID NO: 7219 - DNA, 22 bp, Artificial Sequence
  chemically synthesized
cttcgtgtccgactcttctgag

SEQ ID NO: 7220 - DNA, 22 bp, Artificial Sequence
  chemically synthesized
cgtgtccgactcttctgagcac

SEQ ID NO: 7221 - DNA, 22 bp, Artificial Sequence
  chemically synthesized
gtgtccgactcttctgagcacc

SEQ ID NO: 7222 - DNA, 22 bp, Artificial Sequence
  chemically synthesized
ttctgagcacctacttacatgc

SEQ ID NO: 7223 - DNA, 22 bp, Artificial Sequence
  chemically synthesized
ctgagcacctacttacatgcat

SEQ ID NO: 7224 - DNA, 22 bp, Artificial Sequence
  chemically synthesized
tgagcacctacttacatgcatt

SEQ ID NO: 7225 - DNA, 22 bp, Artificial Sequence
  chemically synthesized
agcacctacttacatgcattac

SEQ ID NO: 7226 - DNA, 22 bp, Artificial Sequence
  chemically synthesized
cttacatgcattactgcatgca

SEQ ID NO: 7227 - DNA, 22 bp, Artificial Sequence
  chemically synthesized
acatgcattactgcatgcactt

SEQ ID NO: 7228 - DNA, 22 bp, Artificial Sequence
  chemically synthesized
catgcattactgcatgcacttc

SEQ ID NO: 7229 - DNA, 22 bp, Artificial Sequence
  chemically synthesized
ctgcatgcacttcttacaataa

SEQ ID NO: 7230 - DNA, 22 bp, Artificial Sequence
  chemically synthesized
catgcacttcttacaataattc

SEQ ID NO: 7231 - DNA, 22 bp, Artificial Sequence
  chemically synthesized
cttacaataattctatgagata

SEQ ID NO: 7232 - DNA, 22 bp, Artificial Sequence
  chemically synthesized
ttacaataattctatgagatag

SEQ ID NO: 7233 - DNA, 22 bp, Artificial Sequence
  chemically synthesized
acaataattctatgagataggt

SEQ ID NO: 7234 - DNA, 22 bp, Artificial Sequence
  chemically synthesized
caataattctatgagataggta

SEQ ID NO: 7235 - DNA, 22 bp, Artificial Sequence
  chemically synthesized
tatgagataggtactattatcc

SEQ ID NO: 7236 - DNA, 22 bp, Artificial Sequence
  chemically synthesized
tgagataggtactattatcccc

SEQ ID NO: 7237 - DNA, 22 bp, Artificial Sequence
  chemically synthesized
ttatccccatttcttttttaaa

SEQ ID NO: 7238 - DNA, 22 bp, Artificial Sequence
  chemically synthesized
tccccatttcttttttaaatga

SEQ ID NO: 7239 - DNA, 22 bp, Artificial Sequence
  chemically synthesized
cttttttaaatgaagaaagtga

SEQ ID NO: 7240 - DNA, 22 bp, Artificial Sequence
  chemically synthesized
ttttttaaatgaagaaagtgaa

SEQ ID NO: 7241 - DNA, 22 bp, Artificial Sequence
  chemically synthesized
ttttaaatgaagaaagtgaagt

SEQ ID NO: 7242 - DNA, 22 bp, Artificial Sequence
  chemically synthesized
tttaaatgaagaaagtgaagta

SEQ ID NO: 7243 - DNA, 22 bp, Artificial Sequence
  chemically synthesized
ttaaatgaagaaagtgaagtag

SEQ ID NO: 7244 - DNA, 22 bp, Artificial Sequence
  chemically synthesized
taaatgaagaaagtgaagtagg

SEQ ID NO: 7245 - DNA, 22 bp, Artificial Sequence
  chemically synthesized
aaatgaagaaagtgaagtaggc

SEQ ID NO: 7246 - DNA, 22 bp, Artificial Sequence
  chemically synthesized
aatgaagaaagtgaagtaggcc

SEQ ID NO: 7247 - DNA, 22 bp, Artificial Sequence
  chemically synthesized
acgcctgtaatcccagcacttt

SEQ ID NO: 7248 - DNA, 22 bp, Artificial Sequence
  chemically synthesized
taatcccagcactttgggaggc

SEQ ID NO: 7249 - DNA, 22 bp, Artificial Sequence
  chemically synthesized
tgggaggccaaagcgggtggat

SEQ ID NO: 7250 - DNA, 22 bp, Artificial Sequence
  chemically synthesized
gggaggccaaagcgggtggatc

SEQ ID NO: 7251 - DNA, 22 bp, Artificial Sequence
  chemically synthesized
ggaggccaaagcgggtggatca

SEQ ID NO: 7252 - DNA, 22 bp, Artificial Sequence
  chemically synthesized
gctaacatggtgaaaccccatc

SEQ ID NO: 7253 - DNA, 22 bp, Artificial Sequence
  chemically synthesized
acatggtgaaaccccatctcta

SEQ ID NO: 7254 - DNA, 22 bp, Artificial Sequence
  chemically synthesized
taataaaaatacaaaaaattag

SEQ ID NO: 7255 - DNA, 22 bp, Artificial Sequence
  chemically synthesized
ataaaaatacaaaaaattagct

SEQ ID NO: 7256 - DNA, 22 bp, Artificial Sequence
  chemically synthesized
gctgggcgtggtggcagacgcc

SEQ ID NO: 7257 - DNA, 22 bp, Artificial Sequence
  chemically synthesized
ggcgtggtggcagacgcctgta

SEQ ID NO: 7258 - DNA, 22 bp, Artificial Sequence
  chemically synthesized
tagtcccagctactcggaaggc

SEQ ID NO: 7259 - DNA, 22 bp, Artificial Sequence
  chemically synthesized
ctcggaaggctgaggcaggaga

SEQ ID NO: 7260 - DNA, 22 bp, Artificial Sequence
  chemically synthesized
ggaaggctgaggcaggagaatg

SEQ ID NO: 7261 - DNA, 22 bp, Artificial Sequence
  chemically synthesized
aggcaggagaatggcatgaacc

SEQ ID NO: 7262 - DNA, 22 bp, Artificial Sequence
  chemically synthesized
gcagtgagccgagtttgcgcca

SEQ ID NO: 7263 - DNA, 22 bp, Artificial Sequence
  chemically synthesized
cagtgagccgagtttgcgccac

SEQ ID NO: 7264 - DNA, 22 bp, Artificial Sequence
  chemically synthesized
gcgccactgcactccagcctag

SEQ ID NO: 7265 - DNA, 22 bp, Artificial Sequence
  chemically synthesized
cgccactgcactccagcctagg

SEQ ID NO: 7266 - DNA, 22 bp, Artificial Sequence
  chemically synthesized
cactccagcctaggtgacagag

SEQ ID NO: 7267 - DNA, 22 bp, Artificial Sequence
  chemically synthesized
cagcctaggtgacagagtgaga

SEQ ID NO: 7268 - DNA, 22 bp, Artificial Sequence
  chemically synthesized
ggtgacagagtgagactccatc

SEQ ID NO: 7269 - DNA, 22 bp, Artificial Sequence
  chemically synthesized
catctcaaaaaaataaaaataa

SEQ ID NO: 7270 - DNA, 22 bp, Artificial Sequence
  chemically synthesized
aaaaaaataaaaataaaaataa

SEQ ID NO: 7271 - DNA, 22 bp, Artificial Sequence
  chemically synthesized
atagtttgtcagtgatagaaac

SEQ ID NO: 7272 - DNA, 22 bp, Artificial Sequence
  chemically synthesized
gtcagtgatagaaacaggtttc

SEQ ID NO: 7273 - DNA, 22 bp, Artificial Sequence
  chemically synthesized
tcagtgatagaaacaggtttca

SEQ ID NO: 7274 - DNA, 22 bp, Artificial Sequence
  chemically synthesized
caaactcagtcaatctgaccgt

SEQ ID NO: 7275 - DNA, 22 bp, Artificial Sequence
  chemically synthesized
aaactcagtcaatctgaccgtt

SEQ ID NO: 7276 - DNA, 22 bp, Artificial Sequence
  chemically synthesized
agtcaatctgaccgtttgatac

SEQ ID NO: 7277 - DNA, 22 bp, Artificial Sequence
  chemically synthesized
accgtttgatacatctcagaca

SEQ ID NO: 7278 - DNA, 22 bp, Artificial Sequence
  chemically synthesized
gatacatctcagacaccactac

SEQ ID NO: 7279 - DNA, 22 bp, Artificial Sequence
  chemically synthesized
atacatctcagacaccactaca

SEQ ID NO: 7280 - DNA, 22 bp, Artificial Sequence
  chemically synthesized
agacaccactacattcagtagt

SEQ ID NO: 7281 - DNA, 22 bp, Artificial Sequence
  chemically synthesized
cattcagtagtttagatgccta

SEQ ID NO: 7282 - DNA, 22 bp, Artificial Sequence
  chemically synthesized
agtagtttagatgcctagaata

SEQ ID NO: 7283 - DNA, 22 bp, Artificial Sequence
  chemically synthesized
agatgcctagaataaatagaga

SEQ ID NO: 7284 - DNA, 22 bp, Artificial Sequence
  chemically synthesized
gatgcctagaataaatagagaa

SEQ ID NO: 7285 - DNA, 22 bp, Artificial Sequence
  chemically synthesized
gaataaatagagaaggaaggag

SEQ ID NO: 7286 - DNA, 22 bp, Artificial Sequence
  chemically synthesized
ttctcttgtctcattgtgtttc

SEQ ID NO: 7287 - DNA, 22 bp, Artificial Sequence
  chemically synthesized
ctcttgtctcattgtgtttctt

SEQ ID NO: 7288 - DNA, 22 bp, Artificial Sequence
  chemically synthesized
tcttgtctcattgtgtttcttc

SEQ ID NO: 7289 - DNA, 22 bp, Artificial Sequence
  chemically synthesized
ttgtctcattgtgtttcttctg

SEQ ID NO: 7290 - DNA, 22 bp, Artificial Sequence
  chemically synthesized
gtctcattgtgtttcttctgag

SEQ ID NO: 7291 - DNA, 22 bp, Artificial Sequence
  chemically synthesized
tctcattgtgtttcttctgagt

SEQ ID NO: 7292 - DNA, 22 bp, Artificial Sequence
  chemically synthesized
attgtgtttcttctgagtgagc

SEQ ID NO: 7293 - DNA, 22 bp, Artificial Sequence
  chemically synthesized
tgtttcttctgagtgagcttga

SEQ ID NO: 7294 - DNA, 22 bp, Artificial Sequence
  chemically synthesized
cttctgagtgagcttgaatcac

SEQ ID NO: 7295 - DNA, 22 bp, Artificial Sequence
  chemically synthesized
ttctgagtgagcttgaatcaca

SEQ ID NO: 7296 - DNA, 22 bp, Artificial Sequence
  chemically synthesized
ctgagtgagcttgaatcacatg

SEQ ID NO: 7297 - DNA, 22 bp, Artificial Sequence
  chemically synthesized
tgagtgagcttgaatcacatga

SEQ ID NO: 7298 - DNA, 22 bp, Artificial Sequence
  chemically synthesized
agtgagcttgaatcacatgaag

SEQ ID NO: 7299 - DNA, 22 bp, Artificial Sequence
  chemically synthesized
gaatcacatgaaggggaacagc

SEQ ID NO: 7300 - DNA, 22 bp, Artificial Sequence
  chemically synthesized
aatcacatgaaggggaacagca

SEQ ID NO: 7301 - DNA, 22 bp, Artificial Sequence
  chemically synthesized
atcctcagctgtcatgtttcct

SEQ ID NO: 7302 - DNA, 22 bp, Artificial Sequence
  chemically synthesized
agctgtcatgtttcctttaaaa

SEQ ID NO: 7303 - DNA, 22 bp, Artificial Sequence
  chemically synthesized
tcatgtttcctttaaaagtccc

SEQ ID NO: 7304 - DNA, 22 bp, Artificial Sequence
  chemically synthesized
cctttaaaagtccctgaaggaa

SEQ ID NO: 7305 - DNA, 22 bp, Artificial Sequence
  chemically synthesized
ctttaaaagtccctgaaggaag

SEQ ID NO: 7306 - DNA, 22 bp, Artificial Sequence
  chemically synthesized
taaaagtccctgaaggaaggtc

SEQ ID NO: 7307 - DNA, 22 bp, Artificial Sequence
  chemically synthesized
aaaagtccctgaaggaaggtcc

SEQ ID NO: 7308 - DNA, 22 bp, Artificial Sequence
  chemically synthesized
aaagtccctgaaggaaggtcct

SEQ ID NO: 7309 - DNA, 22 bp, Artificial Sequence
  chemically synthesized
aaggaaggtcctggaatgtgac

SEQ ID NO: 7310 - DNA, 22 bp, Artificial Sequence
  chemically synthesized
gaatgtgactcccttgctcctc

SEQ ID NO: 7311 - DNA, 22 bp, Artificial Sequence
  chemically synthesized
ccttgctcctctgttgctctct

SEQ ID NO: 7312 - DNA, 22 bp, Artificial Sequence
  chemically synthesized
gctcctctgttgctctctttgg

SEQ ID NO: 7313 - DNA, 22 bp, Artificial Sequence
  chemically synthesized
ctcctctgttgctctctttggc

SEQ ID NO: 7314 - DNA, 22 bp, Artificial Sequence
  chemically synthesized
ctctgttgctctctttggcatt

SEQ ID NO: 7315 - DNA, 22 bp, Artificial Sequence
  chemically synthesized
tgttgctctctttggcattcat

SEQ ID NO: 7316 - DNA, 22 bp, Artificial Sequence
  chemically synthesized
ttgctctctttggcattcattt

SEQ ID NO: 7317 - DNA, 22 bp, Artificial Sequence
  chemically synthesized
ctctctttggcattcatttctt

SEQ ID NO: 7318 - DNA, 22 bp, Artificial Sequence
  chemically synthesized
tctttggcattcatttctttgg

SEQ ID NO: 7319 - DNA, 22 bp, Artificial Sequence
  chemically synthesized
tttggcattcatttctttggac

SEQ ID NO: 7320 - DNA, 22 bp, Artificial Sequence
  chemically synthesized
tggcattcatttctttggaccc

SEQ ID NO: 7321 - DNA, 22 bp, Artificial Sequence
  chemically synthesized
ggcattcatttctttggaccct

SEQ ID NO: 7322 - DNA, 22 bp, Artificial Sequence
  chemically synthesized
gcattcatttctttggacccta

SEQ ID NO: 7323 - DNA, 22 bp, Artificial Sequence
  chemically synthesized
atttctttggaccctacgcaag

SEQ ID NO: 7324 - DNA, 22 bp, Artificial Sequence
  chemically synthesized
ctttggaccctacgcaaggact

SEQ ID NO: 7325 - DNA, 22 bp, Artificial Sequence
  chemically synthesized
tttggaccctacgcaaggactg

SEQ ID NO: 7326 - DNA, 22 bp, Artificial Sequence
  chemically synthesized
tggaccctacgcaaggactgta

SEQ ID NO: 7327 - DNA, 22 bp, Artificial Sequence
  chemically synthesized
ggaccctacgcaaggactgtaa

SEQ ID NO: 7328 - DNA, 22 bp, Artificial Sequence
  chemically synthesized
gaccctacgcaaggactgtaat

SEQ ID NO: 7329 - DNA, 22 bp, Artificial Sequence
  chemically synthesized
cgcaaggactgtaattggtggg

SEQ ID NO: 7330 - DNA, 22 bp, Artificial Sequence
  chemically synthesized
taattggtggggacagctagtg

SEQ ID NO: 7331 - DNA, 22 bp, Artificial Sequence
  chemically synthesized
gtggggacagctagtggccctg

SEQ ID NO: 7332 - DNA, 22 bp, Artificial Sequence
  chemically synthesized
gtggccctgctgggcttcacac

SEQ ID NO: 7333 - DNA, 22 bp, Artificial Sequence
  chemically synthesized
ctgggcttcacacacggtgtcc

SEQ ID NO: 7334 - DNA, 22 bp, Artificial Sequence
  chemically synthesized
ggcttcacacacggtgtcctcc

SEQ ID NO: 7335 - DNA, 22 bp, Artificial Sequence
  chemically synthesized
cacacacggtgtcctccctagg

SEQ ID NO: 7336 - DNA, 22 bp, Artificial Sequence
  chemically synthesized
acacacggtgtcctccctaggc

SEQ ID NO: 7337 - DNA, 22 bp, Artificial Sequence
  chemically synthesized
cctaggccagtgcctctggagt

SEQ ID NO: 7338 - DNA, 22 bp, Artificial Sequence
  chemically synthesized
ggccagtgcctctggagtcaga

SEQ ID NO: 7339 - DNA, 22 bp, Artificial Sequence
  chemically synthesized
tggagtcagaactctggtggta

SEQ ID NO: 7340 - DNA, 22 bp, Artificial Sequence
  chemically synthesized
gagtcagaactctggtggtatt

SEQ ID NO: 7341 - DNA, 22 bp, Artificial Sequence
  chemically synthesized
tggtggtatttccctcaatgaa

SEQ ID NO: 7342 - DNA, 22 bp, Artificial Sequence
  chemically synthesized
gtggtatttccctcaatgaagt

SEQ ID NO: 7343 - DNA, 22 bp, Artificial Sequence
  chemically synthesized
ccctcaatgaagtggagtaagc

SEQ ID NO: 7344 - DNA, 22 bp, Artificial Sequence
  chemically synthesized
cctcaatgaagtggagtaagct

SEQ ID NO: 7345 - DNA, 22 bp, Artificial Sequence
  chemically synthesized
aatgaagtggagtaagctctct

SEQ ID NO: 7346 - DNA, 22 bp, Artificial Sequence
  chemically synthesized
tctcattttgagatggtataat

SEQ ID NO: 7347 - DNA, 22 bp, Artificial Sequence
  chemically synthesized
tcattttgagatggtataatgg

SEQ ID NO: 7348 - DNA, 22 bp, Artificial Sequence
  chemically synthesized
attttgagatggtataatggaa

SEQ ID NO: 7349 - DNA, 22 bp, Artificial Sequence
  chemically synthesized
tgagatggtataatggaagcca

SEQ ID NO: 7350 - DNA, 22 bp, Artificial Sequence
  chemically synthesized
gagatggtataatggaagccac

SEQ ID NO: 7351 - DNA, 22 bp, Artificial Sequence
  chemically synthesized
agatggtataatggaagccacc

SEQ ID NO: 7352 - DNA, 22 bp, Artificial Sequence
  chemically synthesized
agaggatgcccaggtccttcca

SEQ ID NO: 7353 - DNA, 22 bp, Artificial Sequence
  chemically synthesized
gaggatgcccaggtccttccat

SEQ ID NO: 7354 - DNA, 22 bp, Artificial Sequence
  chemically synthesized
ccatggagccactggggttccg

SEQ ID NO: 7355 - DNA, 22 bp, Artificial Sequence
  chemically synthesized
catggagccactggggttccgg

SEQ ID NO: 7356 - DNA, 22 bp, Artificial Sequence
  chemically synthesized
gggttccggtgcacattaaaaa

SEQ ID NO: 7357 - DNA, 22 bp, Artificial Sequence
  chemically synthesized
cggtgcacattaaaaaaaaaat

SEQ ID NO: 7358 - DNA, 22 bp, Artificial Sequence
  chemically synthesized
aaaaaaaaatctaaccaggaca

SEQ ID NO: 7359 - DNA, 22 bp, Artificial Sequence
  chemically synthesized
accaggacattcaggaattgct

SEQ ID NO: 7360 - DNA, 22 bp, Artificial Sequence
  chemically synthesized
aggaattgctagattctgggaa

SEQ ID NO: 7361 - DNA, 22 bp, Artificial Sequence
  chemically synthesized
ctagattctgggaaatcagttc

SEQ ID NO: 7362 - DNA, 22 bp, Artificial Sequence
  chemically synthesized
gattctgggaaatcagttcacc

SEQ ID NO: 7363 - DNA, 22 bp, Artificial Sequence
  chemically synthesized
tgggaaatcagttcaccatgtt

SEQ ID NO: 7364 - DNA, 22 bp, Artificial Sequence
  chemically synthesized
ggaaatcagttcaccatgttca

SEQ ID NO: 7365 - DNA, 22 bp, Artificial Sequence
  chemically synthesized
accatgttcaaaagagtctttt

SEQ ID NO: 7366 - DNA, 22 bp, Artificial Sequence
  chemically synthesized
aaaagagtcttttttttttttt

SEQ ID NO: 7367 - DNA, 22 bp, Artificial Sequence
  chemically synthesized
ttttttttttttgagactctat

SEQ ID NO: 7368 - DNA, 22 bp, Artificial Sequence
  chemically synthesized
tttttttttttgagactctatt

SEQ ID NO: 7369 - DNA, 22 bp, Artificial Sequence
  chemically synthesized
ttttttttttgagactctattg

SEQ ID NO: 7370 - DNA, 22 bp, Artificial Sequence
  chemically synthesized
tttttttttgagactctattgc

SEQ ID NO: 7371 - DNA, 22 bp, Artificial Sequence
  chemically synthesized
ttttttttgagactctattgcc

SEQ ID NO: 7372 - DNA, 22 bp, Artificial Sequence
  chemically synthesized
tttttttgagactctattgccc

SEQ ID NO: 7373 - DNA, 22 bp, Artificial Sequence
  chemically synthesized
ttttttgagactctattgccca

SEQ ID NO: 7374 - DNA, 22 bp, Artificial Sequence
  chemically synthesized
tttttgagactctattgcccag

SEQ ID NO: 7375 - DNA, 22 bp, Artificial Sequence
  chemically synthesized
ttttgagactctattgcccagg

SEQ ID NO: 7376 - DNA, 22 bp, Artificial Sequence
  chemically synthesized
tttgagactctattgcccaggc

SEQ ID NO: 7377 - DNA, 22 bp, Artificial Sequence
  chemically synthesized
ttgagactctattgcccaggct

SEQ ID NO: 7378 - DNA, 22 bp, Artificial Sequence
  chemically synthesized
tgagactctattgcccaggctg

SEQ ID NO: 7379 - DNA, 22 bp, Artificial Sequence
  chemically synthesized
gagactctattgcccaggctgg

SEQ ID NO: 7380 - DNA, 22 bp, Artificial Sequence
  chemically synthesized
agactctattgcccaggctgga

SEQ ID NO: 7381 - DNA, 22 bp, Artificial Sequence
  chemically synthesized
tattgcccaggctggagtgcaa

SEQ ID NO: 7382 - DNA, 22 bp, Artificial Sequence
  chemically synthesized
ttgcccaggctggagtgcaatg

SEQ ID NO: 7383 - DNA, 22 bp, Artificial Sequence
  chemically synthesized
cccaggctggagtgcaatggca

SEQ ID NO: 7384 - DNA, 22 bp, Artificial Sequence
  chemically synthesized
gagtgcaatggcatgatctcgg

SEQ ID NO: 7385 - DNA, 22 bp, Artificial Sequence
  chemically synthesized
ggctcactgtaacctctgcctc

SEQ ID NO: 7386 - DNA, 22 bp, Artificial Sequence
  chemically synthesized
actgtaacctctgcctcccagg

SEQ ID NO: 7387 - DNA, 22 bp, Artificial Sequence
  chemically synthesized
taacctctgcctcccaggttca

SEQ ID NO: 7388 - DNA, 22 bp, Artificial Sequence
  chemically synthesized
tgcctcccaggttcaagcgatt

SEQ ID NO: 7389 - DNA, 22 bp, Artificial Sequence
  chemically synthesized
cctcccaggttcaagcgattct

SEQ ID NO: 7390 - DNA, 22 bp, Artificial Sequence
  chemically synthesized
ccaggttcaagcgattctcctg

SEQ ID NO: 7391 - DNA, 22 bp, Artificial Sequence
  chemically synthesized
aagcgattctcctgtctcagcc

SEQ ID NO: 7392 - DNA, 22 bp, Artificial Sequence
  chemically synthesized
tcctgtctcagcctcccaagta

SEQ ID NO: 7393 - DNA, 22 bp, Artificial Sequence
  chemically synthesized
ctgtctcagcctcccaagtagc

SEQ ID NO: 7394 - DNA, 22 bp, Artificial Sequence
  chemically synthesized
tctcagcctcccaagtagctgg

SEQ ID NO: 7395 - DNA, 22 bp, Artificial Sequence
  chemically synthesized
agcctcccaagtagctgggatt

SEQ ID NO: 7396 - DNA, 22 bp, Artificial Sequence
  chemically synthesized
ccaagtagctgggattacaggc

SEQ ID NO: 7397 - DNA, 22 bp, Artificial Sequence
  chemically synthesized
ggattacaggcgtgcaccacca

SEQ ID NO: 7398 - DNA, 22 bp, Artificial Sequence
  chemically synthesized
caggcgtgcaccaccatgcccg

SEQ ID NO: 7399 - DNA, 22 bp, Artificial Sequence
  chemically synthesized
atttttgtatttttagtagaga

SEQ ID NO: 7400 - DNA, 22 bp, Artificial Sequence
  chemically synthesized
ttgtatttttagtagagacagg

SEQ ID NO: 7401 - DNA, 22 bp, Artificial Sequence
  chemically synthesized
tgtatttttagtagagacaggg

SEQ ID NO: 7402 - DNA, 22 bp, Artificial Sequence
  chemically synthesized
gtatttttagtagagacagggt

SEQ ID NO: 7403 - DNA, 22 bp, Artificial Sequence
  chemically synthesized
tatttttagtagagacagggtt

SEQ ID NO: 7404 - DNA, 22 bp, Artificial Sequence
  chemically synthesized
ttagtagagacagggtttcacc

SEQ ID NO: 7405 - DNA, 22 bp, Artificial Sequence
  chemically synthesized
tagtagagacagggtttcacca

SEQ ID NO: 7406 - DNA, 22 bp, Artificial Sequence
  chemically synthesized
agtagagacagggtttcaccat

SEQ ID NO: 7407 - DNA, 22 bp, Artificial Sequence
  chemically synthesized
gtagagacagggtttcaccatg

SEQ ID NO: 7408 - DNA, 22 bp, Artificial Sequence
  chemically synthesized
caccatgttggccaggctggtc

SEQ ID NO: 7409 - DNA, 22 bp, Artificial Sequence
  chemically synthesized
accatgttggccaggctggtct

SEQ ID NO: 7410 - DNA, 22 bp, Artificial Sequence
  chemically synthesized
gccaggctggtctcgaactctc

SEQ ID NO: 7411 - DNA, 22 bp, Artificial Sequence
  chemically synthesized
gtctcgaactctcctgacctcg

SEQ ID NO: 7412 - DNA, 22 bp, Artificial Sequence
  chemically synthesized
gaactctcctgacctcgtgatc

SEQ ID NO: 7413 - DNA, 22 bp, Artificial Sequence
  chemically synthesized
tcctgacctcgtgatccgcctg

SEQ ID NO: 7414 - DNA, 22 bp, Artificial Sequence
  chemically synthesized
ctgacctcgtgatccgcctgcc

SEQ ID NO: 7415 - DNA, 22 bp, Artificial Sequence
  chemically synthesized
acctcgtgatccgcctgcctcg

SEQ ID NO: 7416 - DNA, 22 bp, Artificial Sequence
  chemically synthesized
gtgatccgcctgcctcggcctc

SEQ ID NO: 7417 - DNA, 22 bp, Artificial Sequence
  chemically synthesized
cctcggcctcccaaagtgctga

SEQ ID NO: 7418 - DNA, 22 bp, Artificial Sequence
  chemically synthesized
ggcctcccaaagtgctgagatt

SEQ ID NO: 7419 - DNA, 22 bp, Artificial Sequence
  chemically synthesized
ccaaagtgctgagattacaggt

SEQ ID NO: 7420 - DNA, 22 bp, Artificial Sequence
  chemically synthesized
agattacaggtgtgagccaccc

SEQ ID NO: 7421 - DNA, 22 bp, Artificial Sequence
  chemically synthesized
caggtgtgagccaccctgccca

SEQ ID NO: 7422 - DNA, 22 bp, Artificial Sequence
  chemically synthesized
cccagccgtcaaaagagtctta

SEQ ID NO: 7423 - DNA, 22 bp, Artificial Sequence
  chemically synthesized
aatatatatatccagatggcat

SEQ ID NO: 7424 - DNA, 22 bp, Artificial Sequence
  chemically synthesized
atatatatatccagatggcatg

SEQ ID NO: 7425 - DNA, 22 bp, Artificial Sequence
  chemically synthesized
actttatgttactacatgcact

SEQ ID NO: 7426 - DNA, 22 bp, Artificial Sequence
  chemically synthesized
ctttatgttactacatgcactt

SEQ ID NO: 7427 - DNA, 22 bp, Artificial Sequence
  chemically synthesized
tatgttactacatgcacttggc

SEQ ID NO: 7428 - DNA, 22 bp, Artificial Sequence
  chemically synthesized
atgttactacatgcacttggct

SEQ ID NO: 7429 - DNA, 22 bp, Artificial Sequence
  chemically synthesized
tgttactacatgcacttggctg

SEQ ID NO: 7430 - DNA, 22 bp, Artificial Sequence
  chemically synthesized
ctacatgcacttggctgcataa

SEQ ID NO: 7431 - DNA, 22 bp, Artificial Sequence
  chemically synthesized
catgcacttggctgcataaatg

SEQ ID NO: 7432 - DNA, 22 bp, Artificial Sequence
  chemically synthesized
ggctgcataaatgtggtacaag

SEQ ID NO: 7433 - DNA, 22 bp, Artificial Sequence
  chemically synthesized
gctgcataaatgtggtacaagc

SEQ ID NO: 7434 - DNA, 22 bp, Artificial Sequence
  chemically synthesized
cataaatgtggtacaagcattc

SEQ ID NO: 7435 - DNA, 22 bp, Artificial Sequence
  chemically synthesized
tgtcttgaagggcaggtgcttc

SEQ ID NO: 7436 - DNA, 22 bp, Artificial Sequence
  chemically synthesized
tcttgaagggcaggtgcttcag

SEQ ID NO: 7437 - DNA, 22 bp, Artificial Sequence
  chemically synthesized
gaagggcaggtgcttcaggata

SEQ ID NO: 7438 - DNA, 22 bp, Artificial Sequence
  chemically synthesized
aagggcaggtgcttcaggatac

SEQ ID NO: 7439 - DNA, 22 bp, Artificial Sequence
  chemically synthesized
caggataccatatacagctcag

SEQ ID NO: 7440 - DNA, 22 bp, Artificial Sequence
  chemically synthesized
aggataccatatacagctcaga

SEQ ID NO: 7441 - DNA, 22 bp, Artificial Sequence
  chemically synthesized
agaagtttcttctttaggcatt

SEQ ID NO: 7442 - DNA, 22 bp, Artificial Sequence
  chemically synthesized
cttctttaggcattaaatttta

SEQ ID NO: 7443 - DNA, 22 bp, Artificial Sequence
  chemically synthesized
ttctttaggcattaaattttag

SEQ ID NO: 7444 - DNA, 22 bp, Artificial Sequence
  chemically synthesized
ctttaggcattaaattttagca

SEQ ID NO: 7445 - DNA, 22 bp, Artificial Sequence
  chemically synthesized
tttaggcattaaattttagcaa

SEQ ID NO: 7446 - DNA, 22 bp, Artificial Sequence
  chemically synthesized
taggcattaaattttagcaaag

SEQ ID NO: 7447 - DNA, 22 bp, Artificial Sequence
  chemically synthesized
aggcattaaattttagcaaaga

SEQ ID NO: 7448 - DNA, 22 bp, Artificial Sequence
  chemically synthesized
ggcattaaattttagcaaagat

SEQ ID NO: 7449 - DNA, 22 bp, Artificial Sequence
  chemically synthesized
aattttagcaaagatatctcat

SEQ ID NO: 7450 - DNA, 22 bp, Artificial Sequence
  chemically synthesized
tagcaaagatatctcatctctt

SEQ ID NO: 7451 - DNA, 22 bp, Artificial Sequence
  chemically synthesized
agcaaagatatctcatctcttc

SEQ ID NO: 7452 - DNA, 22 bp, Artificial Sequence
  chemically synthesized
gcaaagatatctcatctcttct

SEQ ID NO: 7453 - DNA, 22 bp, Artificial Sequence
  chemically synthesized
atctcttcttttaaaccatttt

SEQ ID NO: 7454 - DNA, 22 bp, Artificial Sequence
  chemically synthesized
ttcttttaaaccattttctttt

SEQ ID NO: 7455 - DNA, 22 bp, Artificial Sequence
  chemically synthesized
cttttaaaccattttctttttt

SEQ ID NO: 7456 - DNA, 22 bp, Artificial Sequence
  chemically synthesized
ttttaaaccattttcttttttt

SEQ ID NO: 7457 - DNA, 22 bp, Artificial Sequence
  chemically synthesized
ttaaaccattttctttttttgt

SEQ ID NO: 7458 - DNA, 22 bp, Artificial Sequence
  chemically synthesized
taaaccattttctttttttgtg

SEQ ID NO: 7459 - DNA, 22 bp, Artificial Sequence
  chemically synthesized
aaaccattttctttttttgtgg

SEQ ID NO: 7460 - DNA, 22 bp, Artificial Sequence
  chemically synthesized
aaccattttctttttttgtggt

SEQ ID NO: 7461 - DNA, 22 bp, Artificial Sequence
  chemically synthesized
tctttttttgtggttagaaaag

SEQ ID NO: 7462 - DNA, 22 bp, Artificial Sequence
  chemically synthesized
ctttttttgtggttagaaaagt

SEQ ID NO: 7463 - DNA, 22 bp, Artificial Sequence
  chemically synthesized
tttttttgtggttagaaaagtt

SEQ ID NO: 7464 - DNA, 22 bp, Artificial Sequence
  chemically synthesized
tttttgtggttagaaaagttat

SEQ ID NO: 7465 - DNA, 22 bp, Artificial Sequence
  chemically synthesized
ttttgtggttagaaaagttatg

SEQ ID NO: 7466 - DNA, 22 bp, Artificial Sequence
  chemically synthesized
tttgtggttagaaaagttatgt

SEQ ID NO: 7467 - DNA, 22 bp, Artificial Sequence
  chemically synthesized
ttgtggttagaaaagttatgta

SEQ ID NO: 7468 - DNA, 22 bp, Artificial Sequence
  chemically synthesized
tgtggttagaaaagttatgtag

SEQ ID NO: 7469 - DNA, 22 bp, Artificial Sequence
  chemically synthesized
gtggttagaaaagttatgtaga

SEQ ID NO: 7470 - DNA, 22 bp, Artificial Sequence
  chemically synthesized
tggttagaaaagttatgtagaa

SEQ ID NO: 7471 - DNA, 22 bp, Artificial Sequence
  chemically synthesized
gaaaagttatgtagaaaaaagt

SEQ ID NO: 7472 - DNA, 22 bp, Artificial Sequence
  chemically synthesized
tgtagaaaaaagtaaatgtgat

SEQ ID NO: 7473 - DNA, 22 bp, Artificial Sequence
  chemically synthesized
acgctcattgtagaaaagctat

SEQ ID NO: 7474 - DNA, 22 bp, Artificial Sequence
  chemically synthesized
cgctcattgtagaaaagctata

SEQ ID NO: 7475 - DNA, 22 bp, Artificial Sequence
  chemically synthesized
attgtagaaaagctataaaatg

SEQ ID NO: 7476 - DNA, 22 bp, Artificial Sequence
  chemically synthesized
tagaaaagctataaaatgaata

SEQ ID NO: 7477 - DNA, 22 bp, Artificial Sequence
  chemically synthesized
taaaatgaatacaattaaagct

SEQ ID NO: 7478 - DNA, 22 bp, Artificial Sequence
  chemically synthesized
aagctgttatttaattagccag

SEQ ID NO: 7479 - DNA, 22 bp, Artificial Sequence
  chemically synthesized
ttatttaattagccagtgaaaa

SEQ ID NO: 7480 - DNA, 22 bp, Artificial Sequence
  chemically synthesized
tttaattagccagtgaaaaact

SEQ ID NO: 7481 - DNA, 22 bp, Artificial Sequence
  chemically synthesized
aattagccagtgaaaaactatt

SEQ ID NO: 7482 - DNA, 22 bp, Artificial Sequence
  chemically synthesized
attagccagtgaaaaactatta

SEQ ID NO: 7483 - DNA, 22 bp, Artificial Sequence
  chemically synthesized
gccagtgaaaaactattaacaa

SEQ ID NO: 7484 - DNA, 22 bp, Artificial Sequence
  chemically synthesized
ttaacaacttgtctattacctg

SEQ ID NO: 7485 - DNA, 22 bp, Artificial Sequence
  chemically synthesized
acaacttgtctattacctgtta

SEQ ID NO: 7486 - DNA, 22 bp, Artificial Sequence
  chemically synthesized
gtctattacctgttagtattat

SEQ ID NO: 7487 - DNA, 22 bp, Artificial Sequence
  chemically synthesized
tctattacctgttagtattatt

SEQ ID NO: 7488 - DNA, 22 bp, Artificial Sequence
  chemically synthesized
ttacctgttagtattattgttg

SEQ ID NO: 7489 - DNA, 22 bp, Artificial Sequence
  chemically synthesized
cctgttagtattattgttgcat

SEQ ID NO: 7490 - DNA, 22 bp, Artificial Sequence
  chemically synthesized
ttagtattattgttgcattaaa

SEQ ID NO: 7491 - DNA, 22 bp, Artificial Sequence
  chemically synthesized
gtattattgttgcattaaaaat

SEQ ID NO: 7492 - DNA, 22 bp, Artificial Sequence
  chemically synthesized
ttgttgcattaaaaatgcatat

SEQ ID NO: 7493 - DNA, 22 bp, Artificial Sequence
  chemically synthesized
ttgcattaaaaatgcatatact

SEQ ID NO: 7494 - DNA, 22 bp, Artificial Sequence
  chemically synthesized
cattaaaaatgcatatacttta

SEQ ID NO: 7495 - DNA, 22 bp, Artificial Sequence
  chemically synthesized
aaaatgcatatactttaataaa

SEQ ID NO: 7496 - DNA, 22 bp, Artificial Sequence
  chemically synthesized
taataaatgtatattgtattgt

SEQ ID NO: 7497 - DNA, 22 bp, Artificial Sequence
  chemically synthesized
aataaatgtatattgtattgta

SEQ ID NO: 7498 - DNA, 22 bp, Artificial Sequence
  chemically synthesized
ataaatgtatattgtattgtat

SEQ ID NO: 7499 - DNA, 22 bp, Artificial Sequence
  chemically synthesized
tattgtatactgcatgatttta

SEQ ID NO: 7500 - DNA, 22 bp, Artificial Sequence
  chemically synthesized
tatactgcatgattttattgaa

SEQ ID NO: 7501 - DNA, 22 bp, Artificial Sequence
  chemically synthesized
catgattttattgaagttcttg

SEQ ID NO: 7502 - DNA, 22 bp, Artificial Sequence
  chemically synthesized
tattgaagttcttgttcatctt

SEQ ID NO: 7503 - DNA, 22 bp, Artificial Sequence
  chemically synthesized
attgaagttcttgttcatcttg

SEQ ID NO: 7504 - DNA, 22 bp, Artificial Sequence
  chemically synthesized
ttgaagttcttgttcatcttgt

SEQ ID NO: 7505 - DNA, 22 bp, Artificial Sequence
  chemically synthesized
aagttcttgttcatcttgtgta

SEQ ID NO: 7506 - DNA, 22 bp, Artificial Sequence
  chemically synthesized
ttgttcatcttgtgtatatact

SEQ ID NO: 7507 - DNA, 22 bp, Artificial Sequence
  chemically synthesized
gttcatcttgtgtatatactta

SEQ ID NO: 7508 - DNA, 22 bp, Artificial Sequence
  chemically synthesized
ttcatcttgtgtatatacttaa

SEQ ID NO: 7509 - DNA, 22 bp, Artificial Sequence
  chemically synthesized
atcttgtgtatatacttaatcg

SEQ ID NO: 7510 - DNA, 22 bp, Artificial Sequence
  chemically synthesized
gtgtatatacttaatcgctttg

SEQ ID NO: 7511 - DNA, 22 bp, Artificial Sequence
  chemically synthesized
tgtatatacttaatcgctttgt

SEQ ID NO: 7512 - DNA, 22 bp, Artificial Sequence
  chemically synthesized
aatcgctttgtcattttggaga

SEQ ID NO: 7513 - DNA, 22 bp, Artificial Sequence
  chemically synthesized
atcgctttgtcattttggagac

SEQ ID NO: 7514 - DNA, 22 bp, Artificial Sequence
  chemically synthesized
tgtcattttggagacatttatt

SEQ ID NO: 7515 - DNA, 22 bp, Artificial Sequence
  chemically synthesized
gtcattttggagacatttattt

SEQ ID NO: 7516 - DNA, 22 bp, Artificial Sequence
  chemically synthesized
tcattttggagacatttatttt

SEQ ID NO: 7517 - DNA, 22 bp, Artificial Sequence
  chemically synthesized
tggagacatttattttgcttct

SEQ ID NO: 7518 - DNA, 22 bp, Artificial Sequence
  chemically synthesized
ggagacatttattttgcttcta

SEQ ID NO: 7519 - DNA, 22 bp, Artificial Sequence
  chemically synthesized
gagacatttattttgcttctaa

SEQ ID NO: 7520 - DNA, 22 bp, Artificial Sequence
  chemically synthesized
attttgcttctaatttctttac

SEQ ID NO: 7521 - DNA, 22 bp, Artificial Sequence
  chemically synthesized
ttttgcttctaatttctttaca

SEQ ID NO: 7522 - DNA, 22 bp, Artificial Sequence
  chemically synthesized
tgcttctaatttctttacattt

SEQ ID NO: 7523 - DNA, 22 bp, Artificial Sequence
  chemically synthesized
gcttctaatttctttacatttt

SEQ ID NO: 7524 - DNA, 22 bp, Artificial Sequence
  chemically synthesized
cttctaatttctttacattttg

SEQ ID NO: 7525 - DNA, 22 bp, Artificial Sequence
  chemically synthesized
ctaatttctttacattttgtct

SEQ ID NO: 7526 - DNA, 22 bp, Artificial Sequence
  chemically synthesized
taatttctttacattttgtctt

SEQ ID NO: 7527 - DNA, 22 bp, Artificial Sequence
  chemically synthesized
atttctttacattttgtcttac

SEQ ID NO: 7528 - DNA, 22 bp, Artificial Sequence
  chemically synthesized
ctttacattttgtcttacggaa

SEQ ID NO: 7529 - DNA, 22 bp, Artificial Sequence
  chemically synthesized
tttacattttgtcttacggaat

SEQ ID NO: 7530 - DNA, 22 bp, Artificial Sequence
  chemically synthesized
tacattttgtcttacggaatat

SEQ ID NO: 7531 - DNA, 22 bp, Artificial Sequence
  chemically synthesized
acattttgtcttacggaatatt

SEQ ID NO: 7532 - DNA, 22 bp, Artificial Sequence
  chemically synthesized
cattttgtcttacggaatattt

SEQ ID NO: 7533 - DNA, 22 bp, Artificial Sequence
  chemically synthesized
tgtcttacggaatattttcatt

SEQ ID NO: 7534 - DNA, 22 bp, Artificial Sequence
  chemically synthesized
gtcttacggaatattttcattc

SEQ ID NO: 7535 - DNA, 22 bp, Artificial Sequence
  chemically synthesized
tcttacggaatattttcattca

SEQ ID NO: 7536 - DNA, 22 bp, Artificial Sequence
  chemically synthesized
acggaatattttcattcaactg

SEQ ID NO: 7537 - DNA, 22 bp, Artificial Sequence
  chemically synthesized
cggaatattttcattcaactgt

SEQ ID NO: 7538 - DNA, 22 bp, Artificial Sequence
  chemically synthesized
tcattcaactgtggtagccgaa

SEQ ID NO: 7539 - DNA, 22 bp, Artificial Sequence
  chemically synthesized
cattcaactgtggtagccgaat

SEQ ID NO: 7540 - DNA, 22 bp, Artificial Sequence
  chemically synthesized
attcaactgtggtagccgaatt

SEQ ID NO: 7541 - DNA, 22 bp, Artificial Sequence
  chemically synthesized
aactgtggtagccgaattaatc

SEQ ID NO: 7542 - DNA, 22 bp, Artificial Sequence
  chemically synthesized
tggtagccgaattaatcgtgtt

SEQ ID NO: 7543 - DNA, 22 bp, Artificial Sequence
  chemically synthesized
atcgtgtttcttcactctaggg

SEQ ID NO: 7544 - DNA, 22 bp, Artificial Sequence
  chemically synthesized
cttcactctagggacattgtcg

SEQ ID NO: 7545 - DNA, 22 bp, Artificial Sequence
  chemically synthesized
ttcactctagggacattgtcgt

SEQ ID NO: 7546 - DNA, 22 bp, Artificial Sequence
  chemically synthesized
cactctagggacattgtcgtct

SEQ ID NO: 7547 - DNA, 22 bp, Artificial Sequence
  chemically synthesized
actctagggacattgtcgtcta

SEQ ID NO: 7548 - DNA, 22 bp, Artificial Sequence
  chemically synthesized
tagggacattgtcgtctaagtt

SEQ ID NO: 7549 - DNA, 22 bp, Artificial Sequence
  chemically synthesized
gggacattgtcgtctaagttgt

SEQ ID NO: 7550 - DNA, 22 bp, Artificial Sequence
  chemically synthesized
tcgtctaagttgtaagacattg

SEQ ID NO: 7551 - DNA, 22 bp, Artificial Sequence
  chemically synthesized
agttgtaagacattggttattt

SEQ ID NO: 7552 - DNA, 22 bp, Artificial Sequence
  chemically synthesized
taagacattggttattttacca

SEQ ID NO: 7553 - DNA, 22 bp, Artificial Sequence
  chemically synthesized
gttattttaccagcaaaccatt

SEQ ID NO: 7554 - DNA, 22 bp, Artificial Sequence
  chemically synthesized
ttttaccagcaaaccattctga

SEQ ID NO: 7555 - DNA, 22 bp, Artificial Sequence
  chemically synthesized
taccagcaaaccattctgaaag

SEQ ID NO: 7556 - DNA, 22 bp, Artificial Sequence
  chemically synthesized
accagcaaaccattctgaaagc

SEQ ID NO: 7557 - DNA, 22 bp, Artificial Sequence
  chemically synthesized
ccagcaaaccattctgaaagca

SEQ ID NO: 7558 - DNA, 22 bp, Artificial Sequence
  chemically synthesized
tgaaagcatatgacaaattatt

SEQ ID NO: 7559 - DNA, 22 bp, Artificial Sequence
  chemically synthesized
aaagcatatgacaaattatttc

SEQ ID NO: 7560 - DNA, 22 bp, Artificial Sequence
  chemically synthesized
tttctctcttaatatcttacta

SEQ ID NO: 7561 - DNA, 22 bp, Artificial Sequence
  chemically synthesized
ctctcttaatatcttactatac

SEQ ID NO: 7562 - DNA, 22 bp, Artificial Sequence
  chemically synthesized
tctcttaatatcttactatact

SEQ ID NO: 7563 - DNA, 22 bp, Artificial Sequence
  chemically synthesized
tcttaatatcttactatactga

SEQ ID NO: 7564 - DNA, 22 bp, Artificial Sequence
  chemically synthesized
ttaatatcttactatactgaaa

SEQ ID NO: 7565 - DNA, 22 bp, Artificial Sequence
  chemically synthesized
aatatcttactatactgaaagc

SEQ ID NO: 7566 - DNA, 22 bp, Artificial Sequence
  chemically synthesized
atatcttactatactgaaagca

SEQ ID NO: 7567 - DNA, 22 bp, Artificial Sequence
  chemically synthesized
actatactgaaagcagactgct

SEQ ID NO: 7568 - DNA, 22 bp, Artificial Sequence
  chemically synthesized
ctatactgaaagcagactgcta

SEQ ID NO: 7569 - DNA, 22 bp, Artificial Sequence
  chemically synthesized
tactgaaagcagactgctataa

SEQ ID NO: 7570 - DNA, 22 bp, Artificial Sequence
  chemically synthesized
aaagcagactgctataaggctt

SEQ ID NO: 7571 - DNA, 22 bp, Artificial Sequence
  chemically synthesized
ctataaggcttcacttactctt

SEQ ID NO: 7572 - DNA, 22 bp, Artificial Sequence
  chemically synthesized
taaggcttcacttactcttcta

SEQ ID NO: 7573 - DNA, 22 bp, Artificial Sequence
  chemically synthesized
cacttactcttctacctcataa

SEQ ID NO: 7574 - DNA, 22 bp, Artificial Sequence
  chemically synthesized
acttactcttctacctcataag

SEQ ID NO: 7575 - DNA, 22 bp, Artificial Sequence
  chemically synthesized
actcttctacctcataaggaat

SEQ ID NO: 7576 - DNA, 22 bp, Artificial Sequence
  chemically synthesized
ctcttctacctcataaggaata

SEQ ID NO: 7577 - DNA, 22 bp, Artificial Sequence
  chemically synthesized
ttctacctcataaggaatatgt

SEQ ID NO: 7578 - DNA, 22 bp, Artificial Sequence
  chemically synthesized
ctacctcataaggaatatgtta

SEQ ID NO: 7579 - DNA, 22 bp, Artificial Sequence
  chemically synthesized
tacctcataaggaatatgttac

SEQ ID NO: 7580 - DNA, 22 bp, Artificial Sequence
  chemically synthesized
cctcataaggaatatgttacaa

SEQ ID NO: 7581 - DNA, 22 bp, Artificial Sequence
  chemically synthesized
ataaggaatatgttacaattaa

SEQ ID NO: 7582 - DNA, 22 bp, Artificial Sequence
  chemically synthesized
caattaatttattaggtaagca

SEQ ID NO: 7583 - DNA, 22 bp, Artificial Sequence
  chemically synthesized
atttattaggtaagcatttgtt

SEQ ID NO: 7584 - DNA, 22 bp, Artificial Sequence
  chemically synthesized
attaggtaagcatttgttttat

SEQ ID NO: 7585 - DNA, 22 bp, Artificial Sequence
  chemically synthesized
ttaggtaagcatttgttttata

SEQ ID NO: 7586 - DNA, 22 bp, Artificial Sequence
  chemically synthesized
ggtaagcatttgttttatattg

SEQ ID NO: 7587 - DNA, 22 bp, Artificial Sequence
  chemically synthesized
gttttatattggttttatttca

SEQ ID NO: 7588 - DNA, 22 bp, Artificial Sequence
  chemically synthesized
ttttatattggttttatttcac

SEQ ID NO: 7589 - DNA, 22 bp, Artificial Sequence
  chemically synthesized
tatattggttttatttcacctg

SEQ ID NO: 7590 - DNA, 22 bp, Artificial Sequence
  chemically synthesized
atattggttttatttcacctgg

SEQ ID NO: 7591 - DNA, 22 bp, Artificial Sequence
  chemically synthesized
tattggttttatttcacctggg

SEQ ID NO: 7592 - DNA, 22 bp, Artificial Sequence
  chemically synthesized
gttttatttcacctgggctgag

SEQ ID NO: 7593 - DNA, 22 bp, Artificial Sequence
  chemically synthesized
tatttcacctgggctgagattt

SEQ ID NO: 7594 - DNA, 22 bp, Artificial Sequence
  chemically synthesized
atttcacctgggctgagatttc

SEQ ID NO: 7595 - DNA, 22 bp, Artificial Sequence
  chemically synthesized
tttcacctgggctgagatttca

SEQ ID NO: 7596 - DNA, 22 bp, Artificial Sequence
  chemically synthesized
cacctgggctgagatttcaaga

SEQ ID NO: 7597 - DNA, 22 bp, Artificial Sequence
  chemically synthesized
acctgggctgagatttcaagaa

SEQ ID NO: 7598 - DNA, 22 bp, Artificial Sequence
  chemically synthesized
ggctgagatttcaagaaacacc

SEQ ID NO: 7599 - DNA, 22 bp, Artificial Sequence
  chemically synthesized
agatttcaagaaacaccccagt

SEQ ID NO: 7600 - DNA, 22 bp, Artificial Sequence
  chemically synthesized
caagaaacaccccagtcttcac

SEQ ID NO: 7601 - DNA, 22 bp, Artificial Sequence
  chemically synthesized
aagaaacaccccagtcttcaca

SEQ ID NO: 7602 - DNA, 22 bp, Artificial Sequence
  chemically synthesized
cacagtaacacatttcactaac

SEQ ID NO: 7603 - DNA, 22 bp, Artificial Sequence
  chemically synthesized
acagtaacacatttcactaaca

SEQ ID NO: 7604 - DNA, 22 bp, Artificial Sequence
  chemically synthesized
cactaacacatttactaaacat

SEQ ID NO: 7605 - DNA, 22 bp, Artificial Sequence
  chemically synthesized
actaacacatttactaaacatc

SEQ ID NO: 7606 - DNA, 22 bp, Artificial Sequence
  chemically synthesized
acacatttactaaacatcagca

SEQ ID NO: 7607 - DNA, 22 bp, Artificial Sequence
  chemically synthesized
actaaacatcagcaactgtggc

SEQ ID NO: 7608 - DNA, 22 bp, Artificial Sequence
  chemically synthesized
ctaaacatcagcaactgtggcc

SEQ ID NO: 7609 - DNA, 22 bp, Artificial Sequence
  chemically synthesized
aacatcagcaactgtggcctgt

SEQ ID NO: 7610 - DNA, 22 bp, Artificial Sequence
  chemically synthesized
tggcctgttaatttttttaata

SEQ ID NO: 7611 - DNA, 22 bp, Artificial Sequence
  chemically synthesized
ttaatttttttaatagaaattt

SEQ ID NO: 7612 - DNA, 22 bp, Artificial Sequence
  chemically synthesized
atttttttaatagaaattttaa

SEQ ID NO: 7613 - DNA, 22 bp, Artificial Sequence
  chemically synthesized
ttttaatagaaattttaagtcc

SEQ ID NO: 7614 - DNA, 22 bp, Artificial Sequence
  chemically synthesized
tttaatagaaattttaagtcct

SEQ ID NO: 7615 - DNA, 22 bp, Artificial Sequence
  chemically synthesized
ttaatagaaattttaagtcctc

SEQ ID NO: 7616 - DNA, 22 bp, Artificial Sequence
  chemically synthesized
taatagaaattttaagtcctca

SEQ ID NO: 7617 - DNA, 22 bp, Artificial Sequence
  chemically synthesized
aatagaaattttaagtcctcat

SEQ ID NO: 7618 - DNA, 22 bp, Artificial Sequence
  chemically synthesized
atagaaattttaagtcctcatt

SEQ ID NO: 7619 - DNA, 22 bp, Artificial Sequence
  chemically synthesized
taagtcctcattttctttcggt

SEQ ID NO: 7620 - DNA, 22 bp, Artificial Sequence
  chemically synthesized
aagtcctcattttctttcggtg

SEQ ID NO: 7621 - DNA, 22 bp, Artificial Sequence
  chemically synthesized
agtcctcattttctttcggtgt

SEQ ID NO: 7622 - DNA, 22 bp, Artificial Sequence
  chemically synthesized
attttctttcggtgttttttaa

SEQ ID NO: 7623 - DNA, 22 bp, Artificial Sequence
  chemically synthesized
tctttcggtgttttttaagctt

SEQ ID NO: 7624 - DNA, 22 bp, Artificial Sequence
  chemically synthesized
ctttcggtgttttttaagctta

SEQ ID NO: 7625 - DNA, 22 bp, Artificial Sequence
  chemically synthesized
tttcggtgttttttaagcttaa

SEQ ID NO: 7626 - DNA, 22 bp, Artificial Sequence
  chemically synthesized
tcggtgttttttaagcttaatt

SEQ ID NO: 7627 - DNA, 22 bp, Artificial Sequence
  chemically synthesized
cggtgttttttaagcttaattt

SEQ ID NO: 7628 - DNA, 22 bp, Artificial Sequence
  chemically synthesized
ggtgttttttaagcttaatttt

SEQ ID NO: 7629 - DNA, 22 bp, Artificial Sequence
  chemically synthesized
tttaagcttaatttttctggct

SEQ ID NO: 7630 - DNA, 22 bp, Artificial Sequence
  chemically synthesized
ttaagcttaatttttctggctt

SEQ ID NO: 7631 - DNA, 22 bp, Artificial Sequence
  chemically synthesized
taagcttaatttttctggcttt

SEQ ID NO: 7632 - DNA, 22 bp, Artificial Sequence
  chemically synthesized
aagcttaatttttctggcttta

SEQ ID NO: 7633 - DNA, 22 bp, Artificial Sequence
  chemically synthesized
agcttaatttttctggctttat

SEQ ID NO: 7634 - DNA, 22 bp, Artificial Sequence
  chemically synthesized
aatttttctggctttattcata

SEQ ID NO: 7635 - DNA, 22 bp, Artificial Sequence
  chemically synthesized
atttttctggctttattcataa

SEQ ID NO: 7636 - DNA, 22 bp, Artificial Sequence
  chemically synthesized
ttctggctttattcataaattc

SEQ ID NO: 7637 - DNA, 22 bp, Artificial Sequence
  chemically synthesized
tctggctttattcataaattct

SEQ ID NO: 7638 - DNA, 22 bp, Artificial Sequence
  chemically synthesized
ctggctttattcataaattctt

SEQ ID NO: 7639 - DNA, 22 bp, Artificial Sequence
  chemically synthesized
tggctttattcataaattctta

SEQ ID NO: 7640 - DNA, 22 bp, Artificial Sequence
  chemically synthesized
gctttattcataaattcttaag

SEQ ID NO: 7641 - DNA, 22 bp, Artificial Sequence
  chemically synthesized
tattcataaattcttaaggtca

SEQ ID NO: 7642 - DNA, 22 bp, Artificial Sequence
  chemically synthesized
attcataaattcttaaggtcaa

SEQ ID NO: 7643 - DNA, 22 bp, Artificial Sequence
  chemically synthesized
ttcataaattcttaaggtcaac

SEQ ID NO: 7644 - DNA, 22 bp, Artificial Sequence
  chemically synthesized
ataaattcttaaggtcaactac

SEQ ID NO: 7645 - DNA, 22 bp, Artificial Sequence
  chemically synthesized
ttaaggtcaactacatttgaaa

SEQ ID NO: 7646 - DNA, 22 bp, Artificial Sequence
  chemically synthesized
aaggtcaactacatttgaaaaa

SEQ ID NO: 7647 - DNA, 22 bp, Artificial Sequence
  chemically synthesized
aggtcaactacatttgaaaaat

SEQ ID NO: 7648 - DNA, 22 bp, Artificial Sequence
  chemically synthesized
catttgaaaaatcaaagacctg

SEQ ID NO: 7649 - DNA, 22 bp, Artificial Sequence
  chemically synthesized
gaaaaatcaaagacctgcattt

SEQ ID NO: 7650 - DNA, 22 bp, Artificial Sequence
  chemically synthesized
aaaaatcaaagacctgcatttt

SEQ ID NO: 7651 - DNA, 22 bp, Artificial Sequence
  chemically synthesized
cattttaaattcttattcacct

SEQ ID NO: 7652 - DNA, 22 bp, Artificial Sequence
  chemically synthesized
taaattcttattcacctctggc

SEQ ID NO: 7653 - DNA, 22 bp, Artificial Sequence
  chemically synthesized
aaattcttattcacctctggca

SEQ ID NO: 7654 - DNA, 22 bp, Artificial Sequence
  chemically synthesized
aattcttattcacctctggcaa

SEQ ID NO: 7655 - DNA, 22 bp, Artificial Sequence
  chemically synthesized
ttattcacctctggcaaaacca

SEQ ID NO: 7656 - DNA, 22 bp, Artificial Sequence
  chemically synthesized
attcacctctggcaaaaccatt

SEQ ID NO: 7657 - DNA, 22 bp, Artificial Sequence
  chemically synthesized
ttcacctctggcaaaaccattc

SEQ ID NO: 7658 - DNA, 22 bp, Artificial Sequence
  chemically synthesized
acctctggcaaaaccattcaca

SEQ ID NO: 7659 - DNA, 22 bp, Artificial Sequence
  chemically synthesized
tggcaaaaccattcacaaacca

SEQ ID NO: 7660 - DNA, 22 bp, Artificial Sequence
  chemically synthesized
gcaaaaccattcacaaaccatg

SEQ ID NO: 7661 - DNA, 22 bp, Artificial Sequence
  chemically synthesized
acaaaccatggtagtaaagaga

SEQ ID NO: 7662 - DNA, 22 bp, Artificial Sequence
  chemically synthesized
gtggccataggtaaatgtacca

SEQ ID NO: 7663 - DNA, 22 bp, Artificial Sequence
  chemically synthesized
agggttttcctgaaggtaaagg

SEQ ID NO: 7664 - DNA, 22 bp, Artificial Sequence
  chemically synthesized
tcctgaaggtaaaggaataaag

SEQ ID NO: 7665 - DNA, 22 bp, Artificial Sequence
  chemically synthesized
cctgaaggtaaaggaataaaga

SEQ ID NO: 7666 - DNA, 22 bp, Artificial Sequence
  chemically synthesized
ctgaaggtaaaggaataaagaa

SEQ ID NO: 7667 - DNA, 22 bp, Artificial Sequence
  chemically synthesized
aaggtaaaggaataaagaatgg

SEQ ID NO: 7668 - DNA, 22 bp, Artificial Sequence
  chemically synthesized
gaaatcacttgtagagaaaagc

SEQ ID NO: 7669 - DNA, 22 bp, Artificial Sequence
  chemically synthesized
gtagagaaaagcccctgaaaat

SEQ ID NO: 7670 - DNA, 22 bp, Artificial Sequence
  chemically synthesized
tagagaaaagcccctgaaaatt

SEQ ID NO: 7671 - DNA, 22 bp, Artificial Sequence
  chemically synthesized
aaaatttgagaaaacaaacaag

SEQ ID NO: 7672 - DNA, 22 bp, Artificial Sequence
  chemically synthesized
gagaaaacaaacaagaaactac

SEQ ID NO: 7673 - DNA, 22 bp, Artificial Sequence
  chemically synthesized
agaaaacaaacaagaaactact

SEQ ID NO: 7674 - DNA, 22 bp, Artificial Sequence
  chemically synthesized
cttaccagctatttgaattgct

SEQ ID NO: 7675 - DNA, 22 bp, Artificial Sequence
  chemically synthesized
accagctatttgaattgctgga

SEQ ID NO: 7676 - DNA, 22 bp, Artificial Sequence
  chemically synthesized
ccagctatttgaattgctggaa

SEQ ID NO: 7677 - DNA, 22 bp, Artificial Sequence
  chemically synthesized
tttgaattgctggaatcacagg

SEQ ID NO: 7678 - DNA, 22 bp, Artificial Sequence
  chemically synthesized
gaattgctggaatcacaggcca

SEQ ID NO: 7679 - DNA, 22 bp, Artificial Sequence
  chemically synthesized
aattgctggaatcacaggccat

SEQ ID NO: 7680 - DNA, 22 bp, Artificial Sequence
  chemically synthesized
ctggaatcacaggccattgctg

SEQ ID NO: 7681 - DNA, 22 bp, Artificial Sequence
  chemically synthesized
gaatcacaggccattgctgagc

SEQ ID NO: 7682 - DNA, 22 bp, Artificial Sequence
  chemically synthesized
ctgagctgcctgaactgggaac

SEQ ID NO: 7683 - DNA, 22 bp, Artificial Sequence
  chemically synthesized
agctgcctgaactgggaacaca

SEQ ID NO: 7684 - DNA, 22 bp, Artificial Sequence
  chemically synthesized
cctgaactgggaacacaacaga

SEQ ID NO: 7685 - DNA, 22 bp, Artificial Sequence
  chemically synthesized
aactgggaacacaacagaagga

SEQ ID NO: 7686 - DNA, 22 bp, Artificial Sequence
  chemically synthesized
ggaacacaacagaaggaaaaca

SEQ ID NO: 7687 - DNA, 22 bp, Artificial Sequence
  chemically synthesized
tgataatcattgagtcaagtac

SEQ ID NO: 7688 - DNA, 22 bp, Artificial Sequence
  chemically synthesized
ataatcattgagtcaagtacag

SEQ ID NO: 7689 - DNA, 22 bp, Artificial Sequence
  chemically synthesized
agtcaagtacagcaggtgattg

SEQ ID NO: 7690 - DNA, 22 bp, Artificial Sequence
  chemically synthesized
aggactgctgagaggtacaggc

SEQ ID NO: 7691 - DNA, 22 bp, Artificial Sequence
  chemically synthesized
ctgagaggtacaggccaaaatt

SEQ ID NO: 7692 - DNA, 22 bp, Artificial Sequence
  chemically synthesized
agaggtacaggccaaaattctt

SEQ ID NO: 7693 - DNA, 22 bp, Artificial Sequence
  chemically synthesized
ttatgttgtattataataatgt

SEQ ID NO: 7694 - DNA, 22 bp, Artificial Sequence
  chemically synthesized
atgttgtattataataatgtca

SEQ ID NO: 7695 - DNA, 22 bp, Artificial Sequence
  chemically synthesized
tgttgtattataataatgtcat

SEQ ID NO: 7696 - DNA, 22 bp, Artificial Sequence
  chemically synthesized
tattataataatgtcatcttat

SEQ ID NO: 7697 - DNA, 22 bp, Artificial Sequence
  chemically synthesized
taataatgtcatcttataatac

SEQ ID NO: 7698 - DNA, 22 bp, Artificial Sequence
  chemically synthesized
ataatactgtcagtattttata

SEQ ID NO: 7699 - DNA, 22 bp, Artificial Sequence
  chemically synthesized
taatactgtcagtattttataa

SEQ ID NO: 7700 - DNA, 22 bp, Artificial Sequence
  chemically synthesized
tcagtattttataaaacattct

SEQ ID NO: 7701 - DNA, 22 bp, Artificial Sequence
  chemically synthesized
tataaaacattcttcacaaact

SEQ ID NO: 7702 - DNA, 22 bp, Artificial Sequence
  chemically synthesized
ataaaacattcttcacaaactc

SEQ ID NO: 7703 - DNA, 22 bp, Artificial Sequence
  chemically synthesized
taaaacattcttcacaaactca

SEQ ID NO: 7704 - DNA, 22 bp, Artificial Sequence
  chemically synthesized
ttcacaaactcacacacattta

SEQ ID NO: 7705 - DNA, 22 bp, Artificial Sequence
  chemically synthesized
cacaaactcacacacatttaaa

SEQ ID NO: 7706 - DNA, 22 bp, Artificial Sequence
  chemically synthesized
acaaactcacacacatttaaaa

SEQ ID NO: 7707 - DNA, 22 bp, Artificial Sequence
  chemically synthesized
acacacatttaaaaacaaaaca

SEQ ID NO: 7708 - DNA, 22 bp, Artificial Sequence
  chemically synthesized
aaaaacaaaacactgtctctaa

SEQ ID NO: 7709 - DNA, 22 bp, Artificial Sequence
  chemically synthesized
aaaacaaaacactgtctctaaa

SEQ ID NO: 7710 - DNA, 22 bp, Artificial Sequence
  chemically synthesized
tctctaaaatccccaaattttt

SEQ ID NO: 7711 - DNA, 22 bp, Artificial Sequence
  chemically synthesized
taaaatccccaaatttttcata

SEQ ID NO: 7712 - DNA, 22 bp, Artificial Sequence
  chemically synthesized
aaatccccaaatttttcataaa

SEQ ID NO: 7713 - DNA, 22 bp, Artificial Sequence
  chemically synthesized
ttcataaactcagttttaaact

SEQ ID NO: 7714 - DNA, 22 bp, Artificial Sequence
  chemically synthesized
tcataaactcagttttaaacta

SEQ ID NO: 7715 - DNA, 22 bp, Artificial Sequence
  chemically synthesized
cataaactcagttttaaactaa

SEQ ID NO: 7716 - DNA, 22 bp, Artificial Sequence
  chemically synthesized
ataaactcagttttaaactaac

SEQ ID NO: 7717 - DNA, 22 bp, Artificial Sequence
  chemically synthesized
agttttaaactaactttttttc

SEQ ID NO: 7718 - DNA, 22 bp, Artificial Sequence
  chemically synthesized
taaactaactttttttcaaacc

SEQ ID NO: 7719 - DNA, 22 bp, Artificial Sequence
  chemically synthesized
aaactaactttttttcaaacca

SEQ ID NO: 7720 - DNA, 22 bp, Artificial Sequence
  chemically synthesized
aactaactttttttcaaaccac

SEQ ID NO: 7721 - DNA, 22 bp, Artificial Sequence
  chemically synthesized
actttttttcaaaccacaatct

SEQ ID NO: 7722 - DNA, 22 bp, Artificial Sequence
  chemically synthesized
tttttcaaaccacaatctgatt

SEQ ID NO: 7723 - DNA, 22 bp, Artificial Sequence
  chemically synthesized
ttttcaaaccacaatctgattt

SEQ ID NO: 7724 - DNA, 22 bp, Artificial Sequence
  chemically synthesized
tttcaaaccacaatctgattta

SEQ ID NO: 7725 - DNA, 22 bp, Artificial Sequence
  chemically synthesized
ttcaaaccacaatctgatttaa

SEQ ID NO: 7726 - DNA, 22 bp, Artificial Sequence
  chemically synthesized
tcaaaccacaatctgatttaac

SEQ ID NO: 7727 - DNA, 22 bp, Artificial Sequence
  chemically synthesized
caaaccacaatctgatttaaca

SEQ ID NO: 7728 - DNA, 22 bp, Artificial Sequence
  chemically synthesized
aaaccacaatctgatttaacaa

SEQ ID NO: 7729 - DNA, 22 bp, Artificial Sequence
  chemically synthesized
atttaacaatgactatcattta

SEQ ID NO: 7730 - DNA, 22 bp, Artificial Sequence
  chemically synthesized
aacaatgactatcatttaaata

SEQ ID NO: 7731 - DNA, 22 bp, Artificial Sequence
  chemically synthesized
acaatgactatcatttaaatat

SEQ ID NO: 7732 - DNA, 22 bp, Artificial Sequence
  chemically synthesized
tcatttaaatatttctgacttt

SEQ ID NO: 7733 - DNA, 22 bp, Artificial Sequence
  chemically synthesized
aaatatttctgactttcaaatt

SEQ ID NO: 7734 - DNA, 22 bp, Artificial Sequence
  chemically synthesized
aatatttctgactttcaaatta

SEQ ID NO: 7735 - DNA, 22 bp, Artificial Sequence
  chemically synthesized
ctgactttcaaattaaagattt

SEQ ID NO: 7736 - DNA, 22 bp, Artificial Sequence
  chemically synthesized
tgactttcaaattaaagatttt

SEQ ID NO: 7737 - DNA, 22 bp, Artificial Sequence
  chemically synthesized
actttcaaattaaagattttca

SEQ ID NO: 7738 - DNA, 22 bp, Artificial Sequence
  chemically synthesized
tcaaattaaagattttcacatg

SEQ ID NO: 7739 - DNA, 22 bp, Artificial Sequence
  chemically synthesized
caaattaaagattttcacatgc

SEQ ID NO: 7740 - DNA, 22 bp, Artificial Sequence
  chemically synthesized
aaattaaagattttcacatgca

SEQ ID NO: 7741 - DNA, 22 bp, Artificial Sequence
  chemically synthesized
aagattttcacatgcaggctga

SEQ ID NO: 7742 - DNA, 22 bp, Artificial Sequence
  chemically synthesized
tcacatgcaggctgatatttgt

SEQ ID NO: 7743 - DNA, 22 bp, Artificial Sequence
  chemically synthesized
cacatgcaggctgatatttgta

SEQ ID NO: 7744 - DNA, 22 bp, Artificial Sequence
  chemically synthesized
acatgcaggctgatatttgtaa

SEQ ID NO: 7745 - DNA, 22 bp, Artificial Sequence
  chemically synthesized
atatttgtaattgtgattctct

SEQ ID NO: 7746 - DNA, 22 bp, Artificial Sequence
  chemically synthesized
gtaattgtgattctctctgtag

SEQ ID NO: 7747 - DNA, 22 bp, Artificial Sequence
  chemically synthesized
taattgtgattctctctgtagg

SEQ ID NO: 7748 - DNA, 22 bp, Artificial Sequence
  chemically synthesized
tgattctctctgtaggctttgg

SEQ ID NO: 7749 - DNA, 22 bp, Artificial Sequence
  chemically synthesized
tctctgtaggctttgggtataa

SEQ ID NO: 7750 - DNA, 22 bp, Artificial Sequence
  chemically synthesized
tctgtaggctttgggtataatg

SEQ ID NO: 7751 - DNA, 22 bp, Artificial Sequence
  chemically synthesized
tgtaggctttgggtataatgtg

SEQ ID NO: 7752 - DNA, 22 bp, Artificial Sequence
  chemically synthesized
taggctttgggtataatgtgtt

SEQ ID NO: 7753 - DNA, 22 bp, Artificial Sequence
  chemically synthesized
tgggtataatgtgttcttttcc

SEQ ID NO: 7754 - DNA, 22 bp, Artificial Sequence
  chemically synthesized
gggtataatgtgttcttttcct

SEQ ID NO: 7755 - DNA, 22 bp, Artificial Sequence
  chemically synthesized
ggtataatgtgttcttttcctt

SEQ ID NO: 7756 - DNA, 22 bp, Artificial Sequence
  chemically synthesized
ttttccttttttgcatcagcga

SEQ ID NO: 7757 - DNA, 22 bp, Artificial Sequence
  chemically synthesized
ttccttttttgcatcagcgatt

SEQ ID NO: 7758 - DNA, 22 bp, Artificial Sequence
  chemically synthesized
tccttttttgcatcagcgatta

SEQ ID NO: 7759 - DNA, 22 bp, Artificial Sequence
  chemically synthesized
ccttttttgcatcagcgattaa

SEQ ID NO: 7760 - DNA, 22 bp, Artificial Sequence
  chemically synthesized
cttttttgcatcagcgattaac

SEQ ID NO: 7761 - DNA, 22 bp, Artificial Sequence
  chemically synthesized
ttttgcatcagcgattaacttc

SEQ ID NO: 7762 - DNA, 22 bp, Artificial Sequence
  chemically synthesized
tttgcatcagcgattaacttct

SEQ ID NO: 7763 - DNA, 22 bp, Artificial Sequence
  chemically synthesized
ttgcatcagcgattaacttcta

SEQ ID NO: 7764 - DNA, 22 bp, Artificial Sequence
  chemically synthesized
tgcatcagcgattaacttctac

SEQ ID NO: 7765 - DNA, 22 bp, Artificial Sequence
  chemically synthesized
gcatcagcgattaacttctaca

SEQ ID NO: 7766 - DNA, 22 bp, Artificial Sequence
  chemically synthesized
catcagcgattaacttctacac

SEQ ID NO: 7767 - DNA, 22 bp, Artificial Sequence
  chemically synthesized
acttctacactctaacatgtag

SEQ ID NO: 7768 - DNA, 22 bp, Artificial Sequence
  chemically synthesized
ctacactctaacatgtagaatg

SEQ ID NO: 7769 - DNA, 22 bp, Artificial Sequence
  chemically synthesized
tacactctaacatgtagaatgt

SEQ ID NO: 7770 - DNA, 22 bp, Artificial Sequence
  chemically synthesized
cactctaacatgtagaatgtta

SEQ ID NO: 7771 - DNA, 22 bp, Artificial Sequence
  chemically synthesized
taacatgtagaatgttactaca

SEQ ID NO: 7772 - DNA, 22 bp, Artificial Sequence
  chemically synthesized
acatgtagaatgttactacaat

SEQ ID NO: 7773 - DNA, 22 bp, Artificial Sequence
  chemically synthesized
ctacaatattaaagtattttgt

SEQ ID NO: 7774 - DNA, 22 bp, Artificial Sequence
  chemically synthesized
caatattaaagtattttgtatg

SEQ ID NO: 7775 - DNA, 22 bp, Artificial Sequence
  chemically synthesized
aagtattttgtatgacaatttt

SEQ ID NO: 7776 - DNA, 22 bp, Artificial Sequence
  chemically synthesized
tgtatgacaattttatttgaaa

SEQ ID NO: 7777 - DNA, 22 bp, Artificial Sequence
  chemically synthesized
gtatgacaattttatttgaaag

SEQ ID NO: 7778 - DNA, 22 bp, Artificial Sequence
  chemically synthesized
tatgacaattttatttgaaagc

SEQ ID NO: 7779 - DNA, 22 bp, Artificial Sequence
  chemically synthesized
tatttgaaagcctaggatgcgt

SEQ ID NO: 7780 - DNA, 22 bp, Artificial Sequence
  chemically synthesized
atttgaaagcctaggatgcgtt

SEQ ID NO: 7781 - DNA, 22 bp, Artificial Sequence
  chemically synthesized
tttgaaagcctaggatgcgttg

SEQ ID NO: 7782 - DNA, 22 bp, Artificial Sequence
  chemically synthesized
gaaagcctaggatgcgttgaca

SEQ ID NO: 7783 - DNA, 22 bp, Artificial Sequence
  chemically synthesized
aaagcctaggatgcgttgacat

SEQ ID NO: 7784 - DNA, 22 bp, Artificial Sequence
  chemically synthesized
ggatgcgttgacatcctgcatg

SEQ ID NO: 7785 - DNA, 22 bp, Artificial Sequence
  chemically synthesized
acatcctgcatgcatttattac

SEQ ID NO: 7786 - DNA, 22 bp, Artificial Sequence
  chemically synthesized
catgcatttattacttgatatg

SEQ ID NO: 7787 - DNA, 22 bp, Artificial Sequence
  chemically synthesized
attacttgatatgcatgcattc

SEQ ID NO: 7788 - DNA, 22 bp, Artificial Sequence
  chemically synthesized
ttacttgatatgcatgcattct

SEQ ID NO: 7789 - DNA, 22 bp, Artificial Sequence
  chemically synthesized
cttgatatgcatgcattctggt

SEQ ID NO: 7790 - DNA, 22 bp, Artificial Sequence
  chemically synthesized
gatatgcatgcattctggtatc

SEQ ID NO: 7791 - DNA, 22 bp, Artificial Sequence
  chemically synthesized
atatgcatgcattctggtatct

SEQ ID NO: 7792 - DNA, 22 bp, Artificial Sequence
  chemically synthesized
tggtatctcaagcattctattt

SEQ ID NO: 7793 - DNA, 22 bp, Artificial Sequence
  chemically synthesized
gtatctcaagcattctatttct

SEQ ID NO: 7794 - DNA, 22 bp, Artificial Sequence
  chemically synthesized
aagcattctatttctgagtaat

SEQ ID NO: 7795 - DNA, 22 bp, Artificial Sequence
  chemically synthesized
aacaattactcagaaatagaat

SEQ ID NO: 7796 - DNA, 22 bp, Artificial Sequence
  chemically synthesized
ctcagaaatagaatgcttgaga

SEQ ID NO: 7797 - DNA, 22 bp, Artificial Sequence
  chemically synthesized
agaaatagaatgcttgagatac

SEQ ID NO: 7798 - DNA, 22 bp, Artificial Sequence
  chemically synthesized
gagataccagaatgcatgcata

SEQ ID NO: 7799 - DNA, 22 bp, Artificial Sequence
  chemically synthesized
agataccagaatgcatgcatat

SEQ ID NO: 7800 - DNA, 22 bp, Artificial Sequence
  chemically synthesized
ggctttcaaataaaattgtcat

SEQ ID NO: 7801 - DNA, 22 bp, Artificial Sequence
  chemically synthesized
tcaaataaaattgtcatacaaa

SEQ ID NO: 7802 - DNA, 22 bp, Artificial Sequence
  chemically synthesized
caaataaaattgtcatacaaaa

SEQ ID NO: 7803 - DNA, 22 bp, Artificial Sequence
  chemically synthesized
aaataaaattgtcatacaaaat

SEQ ID NO: 7804 - DNA, 22 bp, Artificial Sequence
  chemically synthesized
tcatacaaaatactttaatatt

SEQ ID NO: 7805 - DNA, 22 bp, Artificial Sequence
  chemically synthesized
taatattgtagtaacattctac

SEQ ID NO: 7806 - DNA, 22 bp, Artificial Sequence
  chemically synthesized
aatattgtagtaacattctaca

SEQ ID NO: 7807 - DNA, 22 bp, Artificial Sequence
  chemically synthesized
atattgtagtaacattctacat

SEQ ID NO: 7808 - DNA, 22 bp, Artificial Sequence
  chemically synthesized
tagtaacattctacatgttaga

SEQ ID NO: 7809 - DNA, 22 bp, Artificial Sequence
  chemically synthesized
tacatgttagagtgtagaagtt

SEQ ID NO: 7810 - DNA, 22 bp, Artificial Sequence
  chemically synthesized
catgttagagtgtagaagttaa

SEQ ID NO: 7811 - DNA, 22 bp, Artificial Sequence
  chemically synthesized
gagtgtagaagttaatcgctga

SEQ ID NO: 7812 - DNA, 22 bp, Artificial Sequence
  chemically synthesized
atcgctgatgcaaaaaaggaaa

SEQ ID NO: 7813 - DNA, 22 bp, Artificial Sequence
  chemically synthesized
atgcaaaaaaggaaaagaacac

SEQ ID NO: 7814 - DNA, 22 bp, Artificial Sequence
  chemically synthesized
tacccaaagcctacagagagaa

SEQ ID NO: 7815 - DNA, 22 bp, Artificial Sequence
  chemically synthesized
cagagagaatcacaattacaaa

SEQ ID NO: 7816 - DNA, 22 bp, Artificial Sequence
  chemically synthesized
caaatatcagcctgcatgtgaa

SEQ ID NO: 7817 - DNA, 22 bp, Artificial Sequence
  chemically synthesized
catgtgaaaatctttaatttga

SEQ ID NO: 7818 - DNA, 22 bp, Artificial Sequence
  chemically synthesized
taatttgaaagtcagaaatatt

SEQ ID NO: 7819 - DNA, 22 bp, Artificial Sequence
  chemically synthesized
aatttgaaagtcagaaatattt

SEQ ID NO: 7820 - DNA, 22 bp, Artificial Sequence
  chemically synthesized
atttgaaagtcagaaatattta

SEQ ID NO: 7821 - DNA, 22 bp, Artificial Sequence
  chemically synthesized
gaaagtcagaaatatttaaatg

SEQ ID NO: 7822 - DNA, 22 bp, Artificial Sequence
  chemically synthesized
aaagtcagaaatatttaaatga

SEQ ID NO: 7823 - DNA, 22 bp, Artificial Sequence
  chemically synthesized
aaatgatagtcattgttaaatc

SEQ ID NO: 7824 - DNA, 22 bp, Artificial Sequence
  chemically synthesized
aatgatagtcattgttaaatca

SEQ ID NO: 7825 - DNA, 22 bp, Artificial Sequence
  chemically synthesized
ttaaatcagattgtggtttgaa

SEQ ID NO: 7826 - DNA, 22 bp, Artificial Sequence
  chemically synthesized
aatcagattgtggtttgaaaaa

SEQ ID NO: 7827 - DNA, 22 bp, Artificial Sequence
  chemically synthesized
tggtttgaaaaaaagttagttt

SEQ ID NO: 7828 - DNA, 22 bp, Artificial Sequence
  chemically synthesized
gaaaaaaagttagtttaaaact

SEQ ID NO: 7829 - DNA, 22 bp, Artificial Sequence
  chemically synthesized
aaaaaaagttagtttaaaactg

SEQ ID NO: 7830 - DNA, 22 bp, Artificial Sequence
  chemically synthesized
gtttaaaactgagtttatgaaa

SEQ ID NO: 7831 - DNA, 22 bp, Artificial Sequence
  chemically synthesized
aaaactgagtttatgaaaaatt

SEQ ID NO: 7832 - DNA, 22 bp, Artificial Sequence
  chemically synthesized
aaactgagtttatgaaaaattt

SEQ ID NO: 7833 - DNA, 22 bp, Artificial Sequence
  chemically synthesized
agtttatgaaaaatttggggat

SEQ ID NO: 7834 - DNA, 22 bp, Artificial Sequence
  chemically synthesized
atgaaaaatttggggattttag

SEQ ID NO: 7835 - DNA, 22 bp, Artificial Sequence
  chemically synthesized
tgaaaaatttggggattttaga

SEQ ID NO: 7836 - DNA, 22 bp, Artificial Sequence
  chemically synthesized
ggggattttagagacagtgttt

SEQ ID NO: 7837 - DNA, 22 bp, Artificial Sequence
  chemically synthesized
gggattttagagacagtgtttt

SEQ ID NO: 7838 - DNA, 22 bp, Artificial Sequence
  chemically synthesized
tagagacagtgttttgttttta

SEQ ID NO: 7839 - DNA, 22 bp, Artificial Sequence
  chemically synthesized
agagacagtgttttgtttttaa

SEQ ID NO: 7840 - DNA, 22 bp, Artificial Sequence
  chemically synthesized
gagacagtgttttgtttttaaa

SEQ ID NO: 7841 - DNA, 22 bp, Artificial Sequence
  chemically synthesized
tgtttttaaatgtgtgtgagtt

SEQ ID NO: 7842 - DNA, 22 bp, Artificial Sequence
  chemically synthesized
gtttttaaatgtgtgtgagttt

SEQ ID NO: 7843 - DNA, 22 bp, Artificial Sequence
  chemically synthesized
tttttaaatgtgtgtgagtttg

SEQ ID NO: 7844 - DNA, 22 bp, Artificial Sequence
  chemically synthesized
ttaaatgtgtgtgagtttgtga

SEQ ID NO: 7845 - DNA, 22 bp, Artificial Sequence
  chemically synthesized
taaatgtgtgtgagtttgtgaa

SEQ ID NO: 7846 - DNA, 22 bp, Artificial Sequence
  chemically synthesized
aaatgtgtgtgagtttgtgaag

SEQ ID NO: 7847 - DNA, 22 bp, Artificial Sequence
  chemically synthesized
aatgtgtgtgagtttgtgaaga

SEQ ID NO: 7848 - DNA, 22 bp, Artificial Sequence
  chemically synthesized
gtgaagaatgttttataaaata

SEQ ID NO: 7849 - DNA, 22 bp, Artificial Sequence
  chemically synthesized
tgaagaatgttttataaaatac

SEQ ID NO: 7850 - DNA, 22 bp, Artificial Sequence
  chemically synthesized
tataaaatactgacagtattat

SEQ ID NO: 7851 - DNA, 22 bp, Artificial Sequence
  chemically synthesized
ataaaatactgacagtattata

SEQ ID NO: 7852 - DNA, 22 bp, Artificial Sequence
  chemically synthesized
taaaatactgacagtattataa

SEQ ID NO: 7853 - DNA, 22 bp, Artificial Sequence
  chemically synthesized
acagtattataagatgacatta

SEQ ID NO: 7854 - DNA, 22 bp, Artificial Sequence
  chemically synthesized
taagatgacattattataatac

SEQ ID NO: 7855 - DNA, 22 bp, Artificial Sequence
  chemically synthesized
ttataatacaacataagaattt

SEQ ID NO: 7856 - DNA, 22 bp, Artificial Sequence
  chemically synthesized
taatacaacataagaattttgg

SEQ ID NO: 7857 - DNA, 22 bp, Artificial Sequence
  chemically synthesized
tggcctgtacctctcagcagtc

SEQ ID NO: 7858 - DNA, 22 bp, Artificial Sequence
  chemically synthesized
ggcctgtacctctcagcagtcc

SEQ ID NO: 7859 - DNA, 22 bp, Artificial Sequence
  chemically synthesized
gcctgtacctctcagcagtcct

SEQ ID NO: 7860 - DNA, 22 bp, Artificial Sequence
  chemically synthesized
tacctctcagcagtcctcaatc

SEQ ID NO: 7861 - DNA, 22 bp, Artificial Sequence
  chemically synthesized
tcagcagtcctcaatcacctgc

SEQ ID NO: 7862 - DNA, 22 bp, Artificial Sequence
  chemically synthesized
agcagtcctcaatcacctgctg

SEQ ID NO: 7863 - DNA, 22 bp, Artificial Sequence
  chemically synthesized
aatcacctgctgtacttgactc

SEQ ID NO: 7864 - DNA, 22 bp, Artificial Sequence
  chemically synthesized
ctgtacttgactcaatgattat

SEQ ID NO: 7865 - DNA, 22 bp, Artificial Sequence
  chemically synthesized
tacttgactcaatgattatcag

SEQ ID NO: 7866 - DNA, 22 bp, Artificial Sequence
  chemically synthesized
gactcaatgattatcagagtgg

SEQ ID NO: 7867 - DNA, 22 bp, Artificial Sequence
  chemically synthesized
actcaatgattatcagagtggt

SEQ ID NO: 7868 - DNA, 22 bp, Artificial Sequence
  chemically synthesized
aatgattatcagagtggtttgt

SEQ ID NO: 7869 - DNA, 22 bp, Artificial Sequence
  chemically synthesized
tcagagtggtttgttttccttc

SEQ ID NO: 7870 - DNA, 22 bp, Artificial Sequence
  chemically synthesized
gttttccttctgttgtgttccc

SEQ ID NO: 7871 - DNA, 22 bp, Artificial Sequence
  chemically synthesized
ttttccttctgttgtgttccca

SEQ ID NO: 7872 - DNA, 22 bp, Artificial Sequence
  chemically synthesized
tccttctgttgtgttcccagtt

SEQ ID NO: 7873 - DNA, 22 bp, Artificial Sequence
  chemically synthesized
ccttctgttgtgttcccagttc

SEQ ID NO: 7874 - DNA, 22 bp, Artificial Sequence
  chemically synthesized
cttctgttgtgttcccagttca

SEQ ID NO: 7875 - DNA, 22 bp, Artificial Sequence
  chemically synthesized
ctgttgtgttcccagttcaggc

SEQ ID NO: 7876 - DNA, 22 bp, Artificial Sequence
  chemically synthesized
tgttgtgttcccagttcaggca

SEQ ID NO: 7877 - DNA, 22 bp, Artificial Sequence
  chemically synthesized
ttgtgttcccagttcaggcagc

SEQ ID NO: 7878 - DNA, 22 bp, Artificial Sequence
  chemically synthesized
tgttcccagttcaggcagctca

SEQ ID NO: 7879 - DNA, 22 bp, Artificial Sequence
  chemically synthesized
ccagttcaggcagctcagcaat

SEQ ID NO: 7880 - DNA, 22 bp, Artificial Sequence
  chemically synthesized
aggcagctcagcaatggcctgt

SEQ ID NO: 7881 - DNA, 22 bp, Artificial Sequence
  chemically synthesized
agcaatggcctgtgattccagc

SEQ ID NO: 7882 - DNA, 22 bp, Artificial Sequence
  chemically synthesized
tgattccagcaattcaaatagc

SEQ ID NO: 7883 - DNA, 22 bp, Artificial Sequence
  chemically synthesized
cagcaattcaaatagctggtaa

SEQ ID NO: 7884 - DNA, 22 bp, Artificial Sequence
  chemically synthesized
aaatagctggtaagtagtttct

SEQ ID NO: 7885 - DNA, 22 bp, Artificial Sequence
  chemically synthesized
gtaagtagtttcttgtttgttt

SEQ ID NO: 7886 - DNA, 22 bp, Artificial Sequence
  chemically synthesized
cttgtttgttttctcaaatttt

SEQ ID NO: 7887 - DNA, 22 bp, Artificial Sequence
  chemically synthesized
ttgtttgttttctcaaattttc

SEQ ID NO: 7888 - DNA, 22 bp, Artificial Sequence
  chemically synthesized
gtttgttttctcaaattttcag

SEQ ID NO: 7889 - DNA, 22 bp, Artificial Sequence
  chemically synthesized
tttgttttctcaaattttcagg

SEQ ID NO: 7890 - DNA, 22 bp, Artificial Sequence
  chemically synthesized
gttttctcaaattttcaggggc

SEQ ID NO: 7891 - DNA, 22 bp, Artificial Sequence
  chemically synthesized
ttttctcaaattttcaggggct

SEQ ID NO: 7892 - DNA, 22 bp, Artificial Sequence
  chemically synthesized
tctcaaattttcaggggctttt

SEQ ID NO: 7893 - DNA, 22 bp, Artificial Sequence
  chemically synthesized
ctcaaattttcaggggcttttc

SEQ ID NO: 7894 - DNA, 22 bp, Artificial Sequence
  chemically synthesized
tcaaattttcaggggcttttct

SEQ ID NO: 7895 - DNA, 22 bp, Artificial Sequence
  chemically synthesized
aaattttcaggggcttttctct

SEQ ID NO: 7896 - DNA, 22 bp, Artificial Sequence
  chemically synthesized
tcaggggcttttctctacaagt

SEQ ID NO: 7897 - DNA, 22 bp, Artificial Sequence
  chemically synthesized
caggggcttttctctacaagtg

SEQ ID NO: 7898 - DNA, 22 bp, Artificial Sequence
  chemically synthesized
aggggcttttctctacaagtga

SEQ ID NO: 7899 - DNA, 22 bp, Artificial Sequence
  chemically synthesized
ttctctacaagtgatttccagt

SEQ ID NO: 7900 - DNA, 22 bp, Artificial Sequence
  chemically synthesized
tctctacaagtgatttccagtg

SEQ ID NO: 7901 - DNA, 22 bp, Artificial Sequence
  chemically synthesized
ctctacaagtgatttccagtgc

SEQ ID NO: 7902 - DNA, 22 bp, Artificial Sequence
  chemically synthesized
tctacaagtgatttccagtgca

SEQ ID NO: 7903 - DNA, 22 bp, Artificial Sequence
  chemically synthesized
tacaagtgatttccagtgcacg

SEQ ID NO: 7904 - DNA, 22 bp, Artificial Sequence
  chemically synthesized
caagtgatttccagtgcacgcc

SEQ ID NO: 7905 - DNA, 22 bp, Artificial Sequence
  chemically synthesized
ccagtgcacgcccctccaccca

SEQ ID NO: 7906 - DNA, 22 bp, Artificial Sequence
  chemically synthesized
cagtgcacgcccctccacccat

SEQ ID NO: 7907 - DNA, 22 bp, Artificial Sequence
  chemically synthesized
cacccattctttattcctttac

SEQ ID NO: 7908 - DNA, 22 bp, Artificial Sequence
  chemically synthesized
tttattcctttaccttcaggaa

SEQ ID NO: 7909 - DNA, 22 bp, Artificial Sequence
  chemically synthesized
tattcctttaccttcaggaaaa

SEQ ID NO: 7910 - DNA, 22 bp, Artificial Sequence
  chemically synthesized
attcctttaccttcaggaaaac

SEQ ID NO: 7911 - DNA, 22 bp, Artificial Sequence
  chemically synthesized
ttcctttaccttcaggaaaacc

SEQ ID NO: 7912 - DNA, 22 bp, Artificial Sequence
  chemically synthesized
ctttaccttcaggaaaaccctc

SEQ ID NO: 7913 - DNA, 22 bp, Artificial Sequence
  chemically synthesized
taccttcaggaaaaccctcagc

SEQ ID NO: 7914 - DNA, 22 bp, Artificial Sequence
  chemically synthesized
accttcaggaaaaccctcagcg

SEQ ID NO: 7915 - DNA, 22 bp, Artificial Sequence
  chemically synthesized
ccttcaggaaaaccctcagcgc

SEQ ID NO: 7916 - DNA, 22 bp, Artificial Sequence
  chemically synthesized
caggaaaaccctcagcgctgca

SEQ ID NO: 7917 - DNA, 22 bp, Artificial Sequence
  chemically synthesized
aggaaaaccctcagcgctgcat

SEQ ID NO: 7918 - DNA, 22 bp, Artificial Sequence
  chemically synthesized
agcgctgcatctctggtcaccg

SEQ ID NO: 7919 - DNA, 22 bp, Artificial Sequence
  chemically synthesized
catctctggtcaccggaccacc

SEQ ID NO: 7920 - DNA, 22 bp, Artificial Sequence
  chemically synthesized
tggtcaccggaccaccgtggta

SEQ ID NO: 7921 - DNA, 22 bp, Artificial Sequence
  chemically synthesized
gtcaccggaccaccgtggtaca

SEQ ID NO: 7922 - DNA, 22 bp, Artificial Sequence
  chemically synthesized
acctatggccaccaggtgtcac

SEQ ID NO: 7923 - DNA, 22 bp, Artificial Sequence
  chemically synthesized
cctatggccaccaggtgtcacc

SEQ ID NO: 7924 - DNA, 22 bp, Artificial Sequence
  chemically synthesized
tggccaccaggtgtcacccttc

SEQ ID NO: 7925 - DNA, 22 bp, Artificial Sequence
  chemically synthesized
ctctttactaccatggtttgtg

SEQ ID NO: 7926 - DNA, 22 bp, Artificial Sequence
  chemically synthesized
tctttactaccatggtttgtga

SEQ ID NO: 7927 - DNA, 22 bp, Artificial Sequence
  chemically synthesized
tttactaccatggtttgtgaat

SEQ ID NO: 7928 - DNA, 22 bp, Artificial Sequence
  chemically synthesized
tactaccatggtttgtgaatgg

SEQ ID NO: 7929 - DNA, 22 bp, Artificial Sequence
  chemically synthesized
actaccatggtttgtgaatggt

SEQ ID NO: 7930 - DNA, 22 bp, Artificial Sequence
  chemically synthesized
ctaccatggtttgtgaatggtt

SEQ ID NO: 7931 - DNA, 22 bp, Artificial Sequence
  chemically synthesized
ccatggtttgtgaatggttttg

SEQ ID NO: 7932 - DNA, 22 bp, Artificial Sequence
  chemically synthesized
gtgaatggttttgccagaggtg

SEQ ID NO: 7933 - DNA, 22 bp, Artificial Sequence
  chemically synthesized
tgaatggttttgccagaggtga

SEQ ID NO: 7934 - DNA, 22 bp, Artificial Sequence
  chemically synthesized
tgccagaggtgaataagaattt

SEQ ID NO: 7935 - DNA, 22 bp, Artificial Sequence
  chemically synthesized
gccagaggtgaataagaattta

SEQ ID NO: 7936 - DNA, 22 bp, Artificial Sequence
  chemically synthesized
ccagaggtgaataagaatttaa

SEQ ID NO: 7937 - DNA, 22 bp, Artificial Sequence
  chemically synthesized
aaaatgcaggtctttgattttt

SEQ ID NO: 7938 - DNA, 22 bp, Artificial Sequence
  chemically synthesized
aaatgcaggtctttgatttttc

SEQ ID NO: 7939 - DNA, 22 bp, Artificial Sequence
  chemically synthesized
tgatttttcaaatgtagttgac

SEQ ID NO: 7940 - DNA, 22 bp, Artificial Sequence
  chemically synthesized
gatttttcaaatgtagttgacc

SEQ ID NO: 7941 - DNA, 22 bp, Artificial Sequence
  chemically synthesized
atttttcaaatgtagttgacct

SEQ ID NO: 7942 - DNA, 22 bp, Artificial Sequence
  chemically synthesized
ttcaaatgtagttgaccttaag

SEQ ID NO: 7943 - DNA, 22 bp, Artificial Sequence
  chemically synthesized
tcaaatgtagttgaccttaaga

SEQ ID NO: 7944 - DNA, 22 bp, Artificial Sequence
  chemically synthesized
caaatgtagttgaccttaagaa

SEQ ID NO: 7945 - DNA, 22 bp, Artificial Sequence
  chemically synthesized
aaatgtagttgaccttaagaat

SEQ ID NO: 7946 - DNA, 22 bp, Artificial Sequence
  chemically synthesized
accttaagaatttatgaataaa

SEQ ID NO: 7947 - DNA, 22 bp, Artificial Sequence
  chemically synthesized
aagaatttatgaataaagccag

SEQ ID NO: 7948 - DNA, 22 bp, Artificial Sequence
  chemically synthesized
agaatttatgaataaagccaga

SEQ ID NO: 7949 - DNA, 22 bp, Artificial Sequence
  chemically synthesized
atgaataaagccagaaaaatta

SEQ ID NO: 7950 - DNA, 22 bp, Artificial Sequence
  chemically synthesized
tgaataaagccagaaaaattaa

SEQ ID NO: 7951 - DNA, 22 bp, Artificial Sequence
  chemically synthesized
agcttaaaaaacaccgaaagaa

SEQ ID NO: 7952 - DNA, 22 bp, Artificial Sequence
  chemically synthesized
aaaaaacaccgaaagaaaatga

SEQ ID NO: 7953 - DNA, 22 bp, Artificial Sequence
  chemically synthesized
aaaaacaccgaaagaaaatgag

SEQ ID NO: 7954 - DNA, 22 bp, Artificial Sequence
  chemically synthesized
aaaatttctattaaaaaaatta

SEQ ID NO: 7955 - DNA, 22 bp, Artificial Sequence
  chemically synthesized
aaatttctattaaaaaaattaa

SEQ ID NO: 7956 - DNA, 22 bp, Artificial Sequence
  chemically synthesized
ctattaaaaaaattaacaggcc

SEQ ID NO: 7957 - DNA, 22 bp, Artificial Sequence
  chemically synthesized
tattaaaaaaattaacaggcca

SEQ ID NO: 7958 - DNA, 22 bp, Artificial Sequence
  chemically synthesized
ttaaaaaaattaacaggccaca

SEQ ID NO: 7959 - DNA, 22 bp, Artificial Sequence
  chemically synthesized
aaaaaattaacaggccacagtt

SEQ ID NO: 7960 - DNA, 22 bp, Artificial Sequence
  chemically synthesized
acaggccacagttgctgatgtt

SEQ ID NO: 7961 - DNA, 22 bp, Artificial Sequence
  chemically synthesized
ctgatgtttagtaaatgtgtta

SEQ ID NO: 7962 - DNA, 22 bp, Artificial Sequence
  chemically synthesized
atgtttagtaaatgtgttagtg

SEQ ID NO: 7963 - DNA, 22 bp, Artificial Sequence
  chemically synthesized
agtaaatgtgttagtgaaatgt

SEQ ID NO: 7964 - DNA, 22 bp, Artificial Sequence
  chemically synthesized
gtaaatgtgttagtgaaatgtg

SEQ ID NO: 7965 - DNA, 22 bp, Artificial Sequence
  chemically synthesized
gtgaaatgtgttactgtgaaga

SEQ ID NO: 7966 - DNA, 22 bp, Artificial Sequence
  chemically synthesized
ctgtgaagactggggtgtttct

SEQ ID NO: 7967 - DNA, 22 bp, Artificial Sequence
  chemically synthesized
tgaagactggggtgtttcttga

SEQ ID NO: 7968 - DNA, 22 bp, Artificial Sequence
  chemically synthesized
gggtgtttcttgaaatctcagc

SEQ ID NO: 7969 - DNA, 22 bp, Artificial Sequence
  chemically synthesized
cttgaaatctcagcccaggtga

SEQ ID NO: 7970 - DNA, 22 bp, Artificial Sequence
  chemically synthesized
ttgaaatctcagcccaggtgaa

SEQ ID NO: 7971 - DNA, 22 bp, Artificial Sequence
  chemically synthesized
gaaatctcagcccaggtgaaat

SEQ ID NO: 7972 - DNA, 22 bp, Artificial Sequence
  chemically synthesized
aaatctcagcccaggtgaaata

SEQ ID NO: 7973 - DNA, 22 bp, Artificial Sequence
  chemically synthesized
agcccaggtgaaataaaaccaa

SEQ ID NO: 7974 - DNA, 22 bp, Artificial Sequence
  chemically synthesized
acctaataaattaattgtaaca

SEQ ID NO: 7975 - DNA, 22 bp, Artificial Sequence
  chemically synthesized
cctaataaattaattgtaacat

SEQ ID NO: 7976 - DNA, 22 bp, Artificial Sequence
  chemically synthesized
ataaattaattgtaacatattc

SEQ ID NO: 7977 - DNA, 22 bp, Artificial Sequence
  chemically synthesized
attgtaacatattccttatgag

SEQ ID NO: 7978 - DNA, 22 bp, Artificial Sequence
  chemically synthesized
taacatattccttatgaggtag

SEQ ID NO: 7979 - DNA, 22 bp, Artificial Sequence
  chemically synthesized
cttatgaggtagaagagtaagt

SEQ ID NO: 7980 - DNA, 22 bp, Artificial Sequence
  chemically synthesized
atgaggtagaagagtaagtgaa

SEQ ID NO: 7981 - DNA, 22 bp, Artificial Sequence
  chemically synthesized
tgaggtagaagagtaagtgaag

SEQ ID NO: 7982 - DNA, 22 bp, Artificial Sequence
  chemically synthesized
atagcagtctgctttcagtata

SEQ ID NO: 7983 - DNA, 22 bp, Artificial Sequence
  chemically synthesized
tagcagtctgctttcagtatag

SEQ ID NO: 7984 - DNA, 22 bp, Artificial Sequence
  chemically synthesized
ctttcagtatagtaagatatta

SEQ ID NO: 7985 - DNA, 22 bp, Artificial Sequence
  chemically synthesized
tcagtatagtaagatattaaga

SEQ ID NO: 7986 - DNA, 22 bp, Artificial Sequence
  chemically synthesized
cagtatagtaagatattaagag

SEQ ID NO: 7987 - DNA, 22 bp, Artificial Sequence
  chemically synthesized
agtatagtaagatattaagaga

SEQ ID NO: 7988 - DNA, 22 bp, Artificial Sequence
  chemically synthesized
agagagaaataatttgtcatat

SEQ ID NO: 7989 - DNA, 22 bp, Artificial Sequence
  chemically synthesized
gtcatatgctttcagaatggtt

SEQ ID NO: 7990 - DNA, 22 bp, Artificial Sequence
  chemically synthesized
tcatatgctttcagaatggttt

SEQ ID NO: 7991 - DNA, 22 bp, Artificial Sequence
  chemically synthesized
tcagaatggtttgctggtaaaa

SEQ ID NO: 7992 - DNA, 22 bp, Artificial Sequence
  chemically synthesized
cagaatggtttgctggtaaaat

SEQ ID NO: 7993 - DNA, 22 bp, Artificial Sequence
  chemically synthesized
agaatggtttgctggtaaaata

SEQ ID NO: 7994 - DNA, 22 bp, Artificial Sequence
  chemically synthesized
gctggtaaaataaccaatgtct

SEQ ID NO: 7995 - DNA, 22 bp, Artificial Sequence
  chemically synthesized
ctggtaaaataaccaatgtctt

SEQ ID NO: 7996 - DNA, 22 bp, Artificial Sequence
  chemically synthesized
gtaaaataaccaatgtcttaca

SEQ ID NO: 7997 - DNA, 22 bp, Artificial Sequence
  chemically synthesized
acaacttagacgacaatgtccc

SEQ ID NO: 7998 - DNA, 22 bp, Artificial Sequence
  chemically synthesized
caacttagacgacaatgtccct

SEQ ID NO: 7999 - DNA, 22 bp, Artificial Sequence
  chemically synthesized
agacgacaatgtccctagagtg

SEQ ID NO: 8000 - DNA, 22 bp, Artificial Sequence
  chemically synthesized
gacgacaatgtccctagagtga

SEQ ID NO: 8001 - DNA, 22 bp, Artificial Sequence
  chemically synthesized
gagtgaagaaacacgattaatt

SEQ ID NO: 8002 - DNA, 22 bp, Artificial Sequence
  chemically synthesized
attcggctaccacagttgaatg

SEQ ID NO: 8003 - DNA, 22 bp, Artificial Sequence
  chemically synthesized
ggctaccacagttgaatgaaaa

SEQ ID NO: 8004 - DNA, 22 bp, Artificial Sequence
  chemically synthesized
ccacagttgaatgaaaatattc

SEQ ID NO: 8005 - DNA, 22 bp, Artificial Sequence
  chemically synthesized
aatgaaaatattccgtaagaca

SEQ ID NO: 8006 - DNA, 22 bp, Artificial Sequence
  chemically synthesized
cgtaagacaaaatgtaaagaaa

SEQ ID NO: 8007 - DNA, 22 bp, Artificial Sequence
  chemically synthesized
gaagcaaaataaatgtctccaa

SEQ ID NO: 8008 - DNA, 22 bp, Artificial Sequence
  chemically synthesized
caaaatgacaaagcgattaagt

SEQ ID NO: 8009 - DNA, 22 bp, Artificial Sequence
  chemically synthesized
agtatatacacaagatgaacaa

SEQ ID NO: 8010 - DNA, 22 bp, Artificial Sequence
  chemically synthesized
caataaaatcatgcagtataca

SEQ ID NO: 8011 - DNA, 22 bp, Artificial Sequence
  chemically synthesized
aataaaatcatgcagtatacaa

SEQ ID NO: 8012 - DNA, 22 bp, Artificial Sequence
  chemically synthesized
attaaagtatatgcatttttaa

SEQ ID NO: 8013 - DNA, 22 bp, Artificial Sequence
  chemically synthesized
ttaaagtatatgcatttttaat

SEQ ID NO: 8014 - DNA, 22 bp, Artificial Sequence
  chemically synthesized
aagtatatgcatttttaatgca

SEQ ID NO: 8015 - DNA, 22 bp, Artificial Sequence
  chemically synthesized
ttaatgcaacaataatactaac

SEQ ID NO: 8016 - DNA, 22 bp, Artificial Sequence
  chemically synthesized
taatgcaacaataatactaaca

SEQ ID NO: 8017 - DNA, 22 bp, Artificial Sequence
  chemically synthesized
aatgcaacaataatactaacag

SEQ ID NO: 8018 - DNA, 22 bp, Artificial Sequence
  chemically synthesized
atgcaacaataatactaacagg

SEQ ID NO: 8019 - DNA, 22 bp, Artificial Sequence
  chemically synthesized
acaggtaatagacaagttgtta

SEQ ID NO: 8020 - DNA, 22 bp, Artificial Sequence
  chemically synthesized
ttaatagtttttcactggctaa

SEQ ID NO: 8021 - DNA, 22 bp, Artificial Sequence
  chemically synthesized
atagtttttcactggctaatta

SEQ ID NO: 8022 - DNA, 22 bp, Artificial Sequence
  chemically synthesized
ttcactggctaattaaataaca

SEQ ID NO: 8023 - DNA, 22 bp, Artificial Sequence
  chemically synthesized
tcactggctaattaaataacag

SEQ ID NO: 8024 - DNA, 22 bp, Artificial Sequence
  chemically synthesized
cactggctaattaaataacagc

SEQ ID NO: 8025 - DNA, 22 bp, Artificial Sequence
  chemically synthesized
actggctaattaaataacagct

SEQ ID NO: 8026 - DNA, 22 bp, Artificial Sequence
  chemically synthesized
gctaattaaataacagctttaa

SEQ ID NO: 8027 - DNA, 22 bp, Artificial Sequence
  chemically synthesized
attaaataacagctttaattgt

SEQ ID NO: 8028 - DNA, 22 bp, Artificial Sequence
  chemically synthesized
aataacagctttaattgtattc

SEQ ID NO: 8029 - DNA, 22 bp, Artificial Sequence
  chemically synthesized
taattgtattcattttatagct

SEQ ID NO: 8030 - DNA, 22 bp, Artificial Sequence
  chemically synthesized
aattgtattcattttatagctt

SEQ ID NO: 8031 - DNA, 22 bp, Artificial Sequence
  chemically synthesized
attgtattcattttatagcttt

SEQ ID NO: 8032 - DNA, 22 bp, Artificial Sequence
  chemically synthesized
tattcattttatagcttttcta

SEQ ID NO: 8033 - DNA, 22 bp, Artificial Sequence
  chemically synthesized
attttatagcttttctacaatg

SEQ ID NO: 8034 - DNA, 22 bp, Artificial Sequence
  chemically synthesized
tatagcttttctacaatgagcg

SEQ ID NO: 8035 - DNA, 22 bp, Artificial Sequence
  chemically synthesized
atagcttttctacaatgagcgt

SEQ ID NO: 8036 - DNA, 22 bp, Artificial Sequence
  chemically synthesized
tagcttttctacaatgagcgta

SEQ ID NO: 8037 - DNA, 22 bp, Artificial Sequence
  chemically synthesized
ttctacaatgagcgtaaatcac

SEQ ID NO: 8038 - DNA, 22 bp, Artificial Sequence
  chemically synthesized
tctacaatgagcgtaaatcaca

SEQ ID NO: 8039 - DNA, 22 bp, Artificial Sequence
  chemically synthesized
ctacaatgagcgtaaatcacat

SEQ ID NO: 8040 - DNA, 22 bp, Artificial Sequence
  chemically synthesized
tacaatgagcgtaaatcacatt

SEQ ID NO: 8041 - DNA, 22 bp, Artificial Sequence
  chemically synthesized
caatgagcgtaaatcacattta

SEQ ID NO: 8042 - DNA, 22 bp, Artificial Sequence
  chemically synthesized
acttttttctacataacttttc

SEQ ID NO: 8043 - DNA, 22 bp, Artificial Sequence
  chemically synthesized
cttttttctacataacttttct

SEQ ID NO: 8044 - DNA, 22 bp, Artificial Sequence
  chemically synthesized
ttttctacataacttttctaac

SEQ ID NO: 8045 - DNA, 22 bp, Artificial Sequence
  chemically synthesized
tttctacataacttttctaacc

SEQ ID NO: 8046 - DNA, 22 bp, Artificial Sequence
  chemically synthesized
ttctacataacttttctaacca

SEQ ID NO: 8047 - DNA, 22 bp, Artificial Sequence
  chemically synthesized
tctacataacttttctaaccac

SEQ ID NO: 8048 - DNA, 22 bp, Artificial Sequence
  chemically synthesized
ctacataacttttctaaccaca

SEQ ID NO: 8049 - DNA, 22 bp, Artificial Sequence
  chemically synthesized
tacataacttttctaaccacaa

SEQ ID NO: 8050 - DNA, 22 bp, Artificial Sequence
  chemically synthesized
cataacttttctaaccacaaaa

SEQ ID NO: 8051 - DNA, 22 bp, Artificial Sequence
  chemically synthesized
ttctaaccacaaaaaaagaaaa

SEQ ID NO: 8052 - DNA, 22 bp, Artificial Sequence
  chemically synthesized
tctaaccacaaaaaaagaaaat

SEQ ID NO: 8053 - DNA, 22 bp, Artificial Sequence
  chemically synthesized
ctaaccacaaaaaaagaaaatg

SEQ ID NO: 8054 - DNA, 22 bp, Artificial Sequence
  chemically synthesized
taaccacaaaaaaagaaaatgg

SEQ ID NO: 8055 - DNA, 22 bp, Artificial Sequence
  chemically synthesized
accacaaaaaaagaaaatggtt

SEQ ID NO: 8056 - DNA, 22 bp, Artificial Sequence
  chemically synthesized
aaaagaagagatgagatatctt

SEQ ID NO: 8057 - DNA, 22 bp, Artificial Sequence
  chemically synthesized
aaagaagagatgagatatcttt

SEQ ID NO: 8058 - DNA, 22 bp, Artificial Sequence
  chemically synthesized
tgctaaaatttaatgcctaaag

SEQ ID NO: 8059 - DNA, 22 bp, Artificial Sequence
  chemically synthesized
gctaaaatttaatgcctaaaga

SEQ ID NO: 8060 - DNA, 22 bp, Artificial Sequence
  chemically synthesized
ctaaaatttaatgcctaaagaa

SEQ ID NO: 8061 - DNA, 22 bp, Artificial Sequence
  chemically synthesized
aaatttaatgcctaaagaagaa

SEQ ID NO: 8062 - DNA, 22 bp, Artificial Sequence
  chemically synthesized
aatgcctaaagaagaaacttct

SEQ ID NO: 8063 - DNA, 22 bp, Artificial Sequence
  chemically synthesized
atgcctaaagaagaaacttctg

SEQ ID NO: 8064 - DNA, 22 bp, Artificial Sequence
  chemically synthesized
aagaagaaacttctgagctgta

SEQ ID NO: 8065 - DNA, 22 bp, Artificial Sequence
  chemically synthesized
ctgagctgtatatggtatcctg

SEQ ID NO: 8066 - DNA, 22 bp, Artificial Sequence
  chemically synthesized
tgagctgtatatggtatcctga

SEQ ID NO: 8067 - DNA, 22 bp, Artificial Sequence
  chemically synthesized
agctgtatatggtatcctgaag

SEQ ID NO: 8068 - DNA, 22 bp, Artificial Sequence
  chemically synthesized
tatatggtatcctgaagcacct

SEQ ID NO: 8069 - DNA, 22 bp, Artificial Sequence
  chemically synthesized
aagcacctgcccttcaagacag

SEQ ID NO: 8070 - DNA, 22 bp, Artificial Sequence
  chemically synthesized
cccttcaagacagaatgcttgt

SEQ ID NO: 8071 - DNA, 22 bp, Artificial Sequence
  chemically synthesized
caagacagaatgcttgtaccac

SEQ ID NO: 8072 - DNA, 22 bp, Artificial Sequence
  chemically synthesized
aagacagaatgcttgtaccaca

SEQ ID NO: 8073 - DNA, 22 bp, Artificial Sequence
  chemically synthesized
gtaccacatttatgcagccaag

SEQ ID NO: 8074 - DNA, 22 bp, Artificial Sequence
  chemically synthesized
taccacatttatgcagccaagt

SEQ ID NO: 8075 - DNA, 22 bp, Artificial Sequence
  chemically synthesized
atgcagccaagtgcatgtagta

SEQ ID NO: 8076 - DNA, 22 bp, Artificial Sequence
  chemically synthesized
tgcagccaagtgcatgtagtaa

SEQ ID NO: 8077 - DNA, 22 bp, Artificial Sequence
  chemically synthesized
gatatatatattaagactcttt

SEQ ID NO: 8078 - DNA, 22 bp, Artificial Sequence
  chemically synthesized
agactcttttgacggctgggca

SEQ ID NO: 8079 - DNA, 22 bp, Artificial Sequence
  chemically synthesized
ttttgacggctgggcagggtgg

SEQ ID NO: 8080 - DNA, 22 bp, Artificial Sequence
  chemically synthesized
ttgacggctgggcagggtggct

SEQ ID NO: 8081 - DNA, 22 bp, Artificial Sequence
  chemically synthesized
tgacggctgggcagggtggctc

SEQ ID NO: 8082 - DNA, 22 bp, Artificial Sequence
  chemically synthesized
gacggctgggcagggtggctca

SEQ ID NO: 8083 - DNA, 22 bp, Artificial Sequence
  chemically synthesized
acggctgggcagggtggctcac

SEQ ID NO: 8084 - DNA, 22 bp, Artificial Sequence
  chemically synthesized
ggcagggtggctcacacctgta

SEQ ID NO: 8085 - DNA, 22 bp, Artificial Sequence
  chemically synthesized
acacctgtaatctcagcacttt

SEQ ID NO: 8086 - DNA, 22 bp, Artificial Sequence
  chemically synthesized
taatctcagcactttgggaggc

SEQ ID NO: 8087 - DNA, 22 bp, Artificial Sequence
  chemically synthesized
agcactttgggaggccgaggca

SEQ ID NO: 8088 - DNA, 22 bp, Artificial Sequence
  chemically synthesized
tgggaggccgaggcaggcggat

SEQ ID NO: 8089 - DNA, 22 bp, Artificial Sequence
  chemically synthesized
gggaggccgaggcaggcggatc

SEQ ID NO: 8090 - DNA, 22 bp, Artificial Sequence
  chemically synthesized
ggaggccgaggcaggcggatca

SEQ ID NO: 8091 - DNA, 22 bp, Artificial Sequence
  chemically synthesized
gagaccagcctggccaacatgg

SEQ ID NO: 8092 - DNA, 22 bp, Artificial Sequence
  chemically synthesized
gccaacatggtgaaaccctgtc

SEQ ID NO: 8093 - DNA, 22 bp, Artificial Sequence
  chemically synthesized
tctctactaaaaatacaaaaat

SEQ ID NO: 8094 - DNA, 22 bp, Artificial Sequence
  chemically synthesized
tactaaaaatacaaaaattagc

SEQ ID NO: 8095 - DNA, 22 bp, Artificial Sequence
  chemically synthesized
ctaaaaatacaaaaattagccg

SEQ ID NO: 8096 - DNA, 22 bp, Artificial Sequence
  chemically synthesized
aaaatacaaaaattagccgggc

SEQ ID NO: 8097 - DNA, 22 bp, Artificial Sequence
  chemically synthesized
gccgggcatggtggtgcacgcc

SEQ ID NO: 8098 - DNA, 22 bp, Artificial Sequence
  chemically synthesized
taatcccagctacttgggaggc

SEQ ID NO: 8099 - DNA, 22 bp, Artificial Sequence
  chemically synthesized
cttgggaggctgagacaggaga

SEQ ID NO: 8100 - DNA, 22 bp, Artificial Sequence
  chemically synthesized
gggaggctgagacaggagaatc

SEQ ID NO: 8101 - DNA, 22 bp, Artificial Sequence
  chemically synthesized
ggaggctgagacaggagaatcg

SEQ ID NO: 8102 - DNA, 22 bp, Artificial Sequence
  chemically synthesized
agacaggagaatcgcttgaacc

SEQ ID NO: 8103 - DNA, 22 bp, Artificial Sequence
  chemically synthesized
gaacctgggaggcagaggttac

SEQ ID NO: 8104 - DNA, 22 bp, Artificial Sequence
  chemically synthesized
aacctgggaggcagaggttaca

SEQ ID NO: 8105 - DNA, 22 bp, Artificial Sequence
  chemically synthesized
ggaggcagaggttacagtgagc

SEQ ID NO: 8106 - DNA, 22 bp, Artificial Sequence
  chemically synthesized
cagtgagccgagatcatgccat

SEQ ID NO: 8107 - DNA, 22 bp, Artificial Sequence
  chemically synthesized
cactccagcctgggcaatagag

SEQ ID NO: 8108 - DNA, 22 bp, Artificial Sequence
  chemically synthesized
cagcctgggcaatagagtctca

SEQ ID NO: 8109 - DNA, 22 bp, Artificial Sequence
  chemically synthesized
ggcaatagagtctcaaaaaaaa

SEQ ID NO: 8110 - DNA, 22 bp, Artificial Sequence
  chemically synthesized
aaaaaaaaaaaaaagactcttt

SEQ ID NO: 8111 - DNA, 22 bp, Artificial Sequence
  chemically synthesized
ttttgaacatggtgaactgatt

SEQ ID NO: 8112 - DNA, 22 bp, Artificial Sequence
  chemically synthesized
ttgaacatggtgaactgatttc

SEQ ID NO: 8113 - DNA, 22 bp, Artificial Sequence
  chemically synthesized
tgaacatggtgaactgatttcc

SEQ ID NO: 8114 - DNA, 22 bp, Artificial Sequence
  chemically synthesized
gaacatggtgaactgatttccc

SEQ ID NO: 8115 - DNA, 22 bp, Artificial Sequence
  chemically synthesized
aacatggtgaactgatttccca

SEQ ID NO: 8116 - DNA, 22 bp, Artificial Sequence
  chemically synthesized
atttcccagaatctagcaattc

SEQ ID NO: 8117 - DNA, 22 bp, Artificial Sequence
  chemically synthesized
cccagaatctagcaattcctga

SEQ ID NO: 8118 - DNA, 22 bp, Artificial Sequence
  chemically synthesized
ccagaatctagcaattcctgaa

SEQ ID NO: 8119 - DNA, 22 bp, Artificial Sequence
  chemically synthesized
gcaattcctgaatgtcctggtt

SEQ ID NO: 8120 - DNA, 22 bp, Artificial Sequence
  chemically synthesized
ctgaatgtcctggttagatttt

SEQ ID NO: 8121 - DNA, 22 bp, Artificial Sequence
  chemically synthesized
aatgtcctggttagattttttt

SEQ ID NO: 8122 - DNA, 22 bp, Artificial Sequence
  chemically synthesized
gttagattttttttttaatgtg

SEQ ID NO: 8123 - DNA, 22 bp, Artificial Sequence
  chemically synthesized
gattttttttttaatgtgcacc

SEQ ID NO: 8124 - DNA, 22 bp, Artificial Sequence
  chemically synthesized
tttttttaatgtgcaccggaac

SEQ ID NO: 8125 - DNA, 22 bp, Artificial Sequence
  chemically synthesized
ttttttaatgtgcaccggaacc

SEQ ID NO: 8126 - DNA, 22 bp, Artificial Sequence
  chemically synthesized
tttttaatgtgcaccggaaccc

SEQ ID NO: 8127 - DNA, 22 bp, Artificial Sequence
  chemically synthesized
ttttaatgtgcaccggaacccc

SEQ ID NO: 8128 - DNA, 22 bp, Artificial Sequence
  chemically synthesized
tttaatgtgcaccggaacccca

SEQ ID NO: 8129 - DNA, 22 bp, Artificial Sequence
  chemically synthesized
ttaatgtgcaccggaaccccag

SEQ ID NO: 8130 - DNA, 22 bp, Artificial Sequence
  chemically synthesized
taatgtgcaccggaaccccagt

SEQ ID NO: 8131 - DNA, 22 bp, Artificial Sequence
  chemically synthesized
aatgtgcaccggaaccccagtg

SEQ ID NO: 8132 - DNA, 22 bp, Artificial Sequence
  chemically synthesized
atgtgcaccggaaccccagtgg

SEQ ID NO: 8133 - DNA, 22 bp, Artificial Sequence
  chemically synthesized
catggaaggacctgggcatcct

SEQ ID NO: 8134 - DNA, 22 bp, Artificial Sequence
  chemically synthesized
ggcatcctctaagccacttggt

SEQ ID NO: 8135 - DNA, 22 bp, Artificial Sequence
  chemically synthesized
taagccacttggtggcttccat

SEQ ID NO: 8136 - DNA, 22 bp, Artificial Sequence
  chemically synthesized
agccacttggtggcttccatta

SEQ ID NO: 8137 - DNA, 22 bp, Artificial Sequence
  chemically synthesized
ggtggcttccattataccatct

SEQ ID NO: 8138 - DNA, 22 bp, Artificial Sequence
  chemically synthesized
gtggcttccattataccatctc

SEQ ID NO: 8139 - DNA, 22 bp, Artificial Sequence
  chemically synthesized
ccattataccatctcaaaatga

SEQ ID NO: 8140 - DNA, 22 bp, Artificial Sequence
  chemically synthesized
cattataccatctcaaaatgag

SEQ ID NO: 8141 - DNA, 22 bp, Artificial Sequence
  chemically synthesized
taccatctcaaaatgagagagc

SEQ ID NO: 8142 - DNA, 22 bp, Artificial Sequence
  chemically synthesized
aaaatgagagagcttactccac

SEQ ID NO: 8143 - DNA, 22 bp, Artificial Sequence
  chemically synthesized
actccacttcattgagggaaat

SEQ ID NO: 8144 - DNA, 22 bp, Artificial Sequence
  chemically synthesized
ctccacttcattgagggaaata

SEQ ID NO: 8145 - DNA, 22 bp, Artificial Sequence
  chemically synthesized
cacttcattgagggaaatacca

SEQ ID NO: 8146 - DNA, 22 bp, Artificial Sequence
  chemically synthesized
cattgagggaaataccaccaga

SEQ ID NO: 8147 - DNA, 22 bp, Artificial Sequence
  chemically synthesized
attgagggaaataccaccagag

SEQ ID NO: 8148 - DNA, 22 bp, Artificial Sequence
  chemically synthesized
agggaaataccaccagagttct

SEQ ID NO: 8149 - DNA, 22 bp, Artificial Sequence
  chemically synthesized
tgactccagaggcactggccta

SEQ ID NO: 8150 - DNA, 22 bp, Artificial Sequence
  chemically synthesized
actccagaggcactggcctagg

SEQ ID NO: 8151 - DNA, 22 bp, Artificial Sequence
  chemically synthesized
cagaggcactggcctagggagg

SEQ ID NO: 8152 - DNA, 22 bp, Artificial Sequence
  chemically synthesized
gcctagggaggacaccgtgtgt

SEQ ID NO: 8153 - DNA, 22 bp, Artificial Sequence
  chemically synthesized
gggaggacaccgtgtgtgaagc

SEQ ID NO: 8154 - DNA, 22 bp, Artificial Sequence
  chemically synthesized
gctgtccccaccaattacagtc

SEQ ID NO: 8155 - DNA, 22 bp, Artificial Sequence
  chemically synthesized
tccccaccaattacagtccttg

SEQ ID NO: 8156 - DNA, 22 bp, Artificial Sequence
  chemically synthesized
cagtccttgcgtagggtccaaa

SEQ ID NO: 8157 - DNA, 22 bp, Artificial Sequence
  chemically synthesized
gcgtagggtccaaagaaatgaa

SEQ ID NO: 8158 - DNA, 22 bp, Artificial Sequence
  chemically synthesized
cgtagggtccaaagaaatgaat

SEQ ID NO: 8159 - DNA, 22 bp, Artificial Sequence
  chemically synthesized
caggaccttccttcagggactt

SEQ ID NO: 8160 - DNA, 22 bp, Artificial Sequence
  chemically synthesized
ccttcagggacttttaaaggaa

SEQ ID NO: 8161 - DNA, 22 bp, Artificial Sequence
  chemically synthesized
cttcagggacttttaaaggaaa

SEQ ID NO: 8162 - DNA, 22 bp, Artificial Sequence
  chemically synthesized
cagggacttttaaaggaaacat

SEQ ID NO: 8163 - DNA, 22 bp, Artificial Sequence
  chemically synthesized
agggacttttaaaggaaacatg

SEQ ID NO: 8164 - DNA, 22 bp, Artificial Sequence
  chemically synthesized
ttaaaggaaacatgacagctga

SEQ ID NO: 8165 - DNA, 22 bp, Artificial Sequence
  chemically synthesized
taaaggaaacatgacagctgag

SEQ ID NO: 8166 - DNA, 22 bp, Artificial Sequence
  chemically synthesized
aaaggaaacatgacagctgagg

SEQ ID NO: 8167 - DNA, 22 bp, Artificial Sequence
  chemically synthesized
aaggaaacatgacagctgagga

SEQ ID NO: 8168 - DNA, 22 bp, Artificial Sequence
  chemically synthesized
aggatcagttggttgttttctg

SEQ ID NO: 8169 - DNA, 22 bp, Artificial Sequence
  chemically synthesized
gttgttttctgctgttcccctt

SEQ ID NO: 8170 - DNA, 22 bp, Artificial Sequence
  chemically synthesized
ttttctgctgttccccttcatg

SEQ ID NO: 8171 - DNA, 22 bp, Artificial Sequence
  chemically synthesized
tctgctgttccccttcatgtga

SEQ ID NO: 8172 - DNA, 22 bp, Artificial Sequence
  chemically synthesized
ctgctgttccccttcatgtgat

SEQ ID NO: 8173 - DNA, 22 bp, Artificial Sequence
  chemically synthesized
tgctgttccccttcatgtgatt

SEQ ID NO: 8174 - DNA, 22 bp, Artificial Sequence
  chemically synthesized
ctgttccccttcatgtgattca

SEQ ID NO: 8175 - DNA, 22 bp, Artificial Sequence
  chemically synthesized
ttccccttcatgtgattcaagc

SEQ ID NO: 8176 - DNA, 22 bp, Artificial Sequence
  chemically synthesized
cccttcatgtgattcaagctca

SEQ ID NO: 8177 - DNA, 22 bp, Artificial Sequence
  chemically synthesized
catgtgattcaagctcactcag

SEQ ID NO: 8178 - DNA, 22 bp, Artificial Sequence
  chemically synthesized
atgtgattcaagctcactcaga

SEQ ID NO: 8179 - DNA, 22 bp, Artificial Sequence
  chemically synthesized
aagctcactcagaagaaacaca

SEQ ID NO: 8180 - DNA, 22 bp, Artificial Sequence
  chemically synthesized
actcagaagaaacacaatgaga

SEQ ID NO: 8181 - DNA, 22 bp, Artificial Sequence
  chemically synthesized
agaagaaacacaatgagacaag

SEQ ID NO: 8182 - DNA, 22 bp, Artificial Sequence
  chemically synthesized
cttccttctctatttattctag

SEQ ID NO: 8183 - DNA, 22 bp, Artificial Sequence
  chemically synthesized
ccttctctatttattctaggca

SEQ ID NO: 8184 - DNA, 22 bp, Artificial Sequence
  chemically synthesized
cttctctatttattctaggcat

SEQ ID NO: 8185 - DNA, 22 bp, Artificial Sequence
  chemically synthesized
ctctatttattctaggcatcta

SEQ ID NO: 8186 - DNA, 22 bp, Artificial Sequence
  chemically synthesized
tctatttattctaggcatctaa

SEQ ID NO: 8187 - DNA, 22 bp, Artificial Sequence
  chemically synthesized
tatttattctaggcatctaaac

SEQ ID NO: 8188 - DNA, 22 bp, Artificial Sequence
  chemically synthesized
tttattctaggcatctaaacta

SEQ ID NO: 8189 - DNA, 22 bp, Artificial Sequence
  chemically synthesized
attctaggcatctaaactactg

SEQ ID NO: 8190 - DNA, 22 bp, Artificial Sequence
  chemically synthesized
ttctaggcatctaaactactga

SEQ ID NO: 8191 - DNA, 22 bp, Artificial Sequence
  chemically synthesized
taggcatctaaactactgaatg

SEQ ID NO: 8192 - DNA, 22 bp, Artificial Sequence
  chemically synthesized
ggcatctaaactactgaatgta

SEQ ID NO: 8193 - DNA, 22 bp, Artificial Sequence
  chemically synthesized
aactactgaatgtagtggtgtc

SEQ ID NO: 8194 - DNA, 22 bp, Artificial Sequence
  chemically synthesized
ctgaatgtagtggtgtctgaga

SEQ ID NO: 8195 - DNA, 22 bp, Artificial Sequence
  chemically synthesized
aatgtagtggtgtctgagatgt

SEQ ID NO: 8196 - DNA, 22 bp, Artificial Sequence
  chemically synthesized
agatgtatcaaacggtcagatt

SEQ ID NO: 8197 - DNA, 22 bp, Artificial Sequence
  chemically synthesized
actgagtttgaaacctgtttct

SEQ ID NO: 8198 - DNA, 22 bp, Artificial Sequence
  chemically synthesized
agtttgaaacctgtttctatca

SEQ ID NO: 8199 - DNA, 22 bp, Artificial Sequence
  chemically synthesized
gaaacctgtttctatcactgac

SEQ ID NO: 8200 - DNA, 22 bp, Artificial Sequence
  chemically synthesized
aaacctgtttctatcactgaca

SEQ ID NO: 8201 - DNA, 22 bp, Artificial Sequence
  chemically synthesized
tttctatcactgacaaactatg

SEQ ID NO: 8202 - DNA, 22 bp, Artificial Sequence
  chemically synthesized
ctatcactgacaaactatgaga

SEQ ID NO: 8203 - DNA, 22 bp, Artificial Sequence
  chemically synthesized
tatcactgacaaactatgagat

SEQ ID NO: 8204 - DNA, 22 bp, Artificial Sequence
  chemically synthesized
tcactgacaaactatgagatac

SEQ ID NO: 8205 - DNA, 22 bp, Artificial Sequence
  chemically synthesized
acaaactatgagatactctata

SEQ ID NO: 8206 - DNA, 22 bp, Artificial Sequence
  chemically synthesized
tgagatactctatacttcactt

SEQ ID NO: 8207 - DNA, 22 bp, Artificial Sequence
  chemically synthesized
tatacttcactttctttttttt

SEQ ID NO: 8208 - DNA, 22 bp, Artificial Sequence
  chemically synthesized
tacttcactttctttttttttt

SEQ ID NO: 8209 - DNA, 22 bp, Artificial Sequence
  chemically synthesized
cactttcttttttttttcattt

SEQ ID NO: 8210 - DNA, 22 bp, Artificial Sequence
  chemically synthesized
actttcttttttttttcatttt

SEQ ID NO: 8211 - DNA, 22 bp, Artificial Sequence
  chemically synthesized
tcttttttttttcattttttta

SEQ ID NO: 8212 - DNA, 22 bp, Artificial Sequence
  chemically synthesized
cttttttttttcatttttttat

SEQ ID NO: 8213 - DNA, 22 bp, Artificial Sequence
  chemically synthesized
ttttttttttcatttttttatt

SEQ ID NO: 8214 - DNA, 22 bp, Artificial Sequence
  chemically synthesized
ttttttttcatttttttatttt

SEQ ID NO: 8215 - DNA, 22 bp, Artificial Sequence
  chemically synthesized
tttttttcatttttttattttt

SEQ ID NO: 8216 - DNA, 22 bp, Artificial Sequence
  chemically synthesized
ttttttcatttttttattttta

SEQ ID NO: 8217 - DNA, 22 bp, Artificial Sequence
  chemically synthesized
tttttcatttttttatttttat

SEQ ID NO: 8218 - DNA, 22 bp, Artificial Sequence
  chemically synthesized
ttttcatttttttatttttatt

SEQ ID NO: 8219 - DNA, 22 bp, Artificial Sequence
  chemically synthesized
tttcatttttttatttttattt

SEQ ID NO: 8220 - DNA, 22 bp, Artificial Sequence
  chemically synthesized
ttcatttttttatttttatttt

SEQ ID NO: 8221 - DNA, 22 bp, Artificial Sequence
  chemically synthesized
tcatttttttatttttattttt

SEQ ID NO: 8222 - DNA, 22 bp, Artificial Sequence
  chemically synthesized
catttttttatttttattttta

SEQ ID NO: 8223 - DNA, 22 bp, Artificial Sequence
  chemically synthesized
atttttttatttttatttttat

SEQ ID NO: 8224 - DNA, 22 bp, Artificial Sequence
  chemically synthesized
ttttatttttatttttattttt

SEQ ID NO: 8225 - DNA, 22 bp, Artificial Sequence
  chemically synthesized
tttatttttatttttatttttt

SEQ ID NO: 8226 - DNA, 22 bp, Artificial Sequence
  chemically synthesized
ttatttttatttttattttttt

SEQ ID NO: 8227 - DNA, 22 bp, Artificial Sequence
  chemically synthesized
tatttttatttttatttttttg

SEQ ID NO: 8228 - DNA, 22 bp, Artificial Sequence
  chemically synthesized
atttttatttttatttttttga

SEQ ID NO: 8229 - DNA, 22 bp, Artificial Sequence
  chemically synthesized
tttttatttttatttttttgag

SEQ ID NO: 8230 - DNA, 22 bp, Artificial Sequence
  chemically synthesized
ttatttttatttttttgagatg

SEQ ID NO: 8231 - DNA, 22 bp, Artificial Sequence
  chemically synthesized
tatttttatttttttgagatgg

SEQ ID NO: 8232 - DNA, 22 bp, Artificial Sequence
  chemically synthesized
atttttatttttttgagatgga

SEQ ID NO: 8233 - DNA, 22 bp, Artificial Sequence
  chemically synthesized
tttttatttttttgagatggag

SEQ ID NO: 8234 - DNA, 22 bp, Artificial Sequence
  chemically synthesized
ttatttttttgagatggagtct

SEQ ID NO: 8235 - DNA, 22 bp, Artificial Sequence
  chemically synthesized
tatttttttgagatggagtctc

SEQ ID NO: 8236 - DNA, 22 bp, Artificial Sequence
  chemically synthesized
atttttttgagatggagtctca

SEQ ID NO: 8237 - DNA, 22 bp, Artificial Sequence
  chemically synthesized
tttttttgagatggagtctcac

SEQ ID NO: 8238 - DNA, 22 bp, Artificial Sequence
  chemically synthesized
ttttgagatggagtctcactct

SEQ ID NO: 8239 - DNA, 22 bp, Artificial Sequence
  chemically synthesized
tttgagatggagtctcactctg

SEQ ID NO: 8240 - DNA, 22 bp, Artificial Sequence
  chemically synthesized
ttgagatggagtctcactctgt

SEQ ID NO: 8241 - DNA, 22 bp, Artificial Sequence
  chemically synthesized
tgagatggagtctcactctgtc

SEQ ID NO: 8242 - DNA, 22 bp, Artificial Sequence
  chemically synthesized
gagatggagtctcactctgtca

SEQ ID NO: 8243 - DNA, 22 bp, Artificial Sequence
  chemically synthesized
agatggagtctcactctgtcac

SEQ ID NO: 8244 - DNA, 22 bp, Artificial Sequence
  chemically synthesized
actctgtcacctaggctggagt

SEQ ID NO: 8245 - DNA, 22 bp, Artificial Sequence
  chemically synthesized
tgtcacctaggctggagtgcag

SEQ ID NO: 8246 - DNA, 22 bp, Artificial Sequence
  chemically synthesized
tcacctaggctggagtgcagtg

SEQ ID NO: 8247 - DNA, 22 bp, Artificial Sequence
  chemically synthesized
ggctggagtgcagtggcgcaaa

SEQ ID NO: 8248 - DNA, 22 bp, Artificial Sequence
  chemically synthesized
gagtgcagtggcgcaaactcgg

SEQ ID NO: 8249 - DNA, 22 bp, Artificial Sequence
  chemically synthesized
ggctcactgcaagctctgcctc

SEQ ID NO: 8250 - DNA, 22 bp, Artificial Sequence
  chemically synthesized
actgcaagctctgcctcctggg

SEQ ID NO: 8251 - DNA, 22 bp, Artificial Sequence
  chemically synthesized
caagctctgcctcctgggttca

SEQ ID NO: 8252 - DNA, 22 bp, Artificial Sequence
  chemically synthesized
tgcctcctgggttcatgccatt

SEQ ID NO: 8253 - DNA, 22 bp, Artificial Sequence
  chemically synthesized
cctcctgggttcatgccattct

SEQ ID NO: 8254 - DNA, 22 bp, Artificial Sequence
  chemically synthesized
ctgggttcatgccattctcctg

SEQ ID NO: 8255 - DNA, 22 bp, Artificial Sequence
  chemically synthesized
ggttcatgccattctcctgcct

SEQ ID NO: 8256 - DNA, 22 bp, Artificial Sequence
  chemically synthesized
atgccattctcctgcctcagcc

SEQ ID NO: 8257 - DNA, 22 bp, Artificial Sequence
  chemically synthesized
tcctgcctcagccttccgagta

SEQ ID NO: 8258 - DNA, 22 bp, Artificial Sequence
  chemically synthesized
ctgcctcagccttccgagtagc

SEQ ID NO: 8259 - DNA, 22 bp, Artificial Sequence
  chemically synthesized
cctcagccttccgagtagctgg

SEQ ID NO: 8260 - DNA, 22 bp, Artificial Sequence
  chemically synthesized
agccttccgagtagctgggact

SEQ ID NO: 8261 - DNA, 22 bp, Artificial Sequence
  chemically synthesized
ccgagtagctgggactacaggc

SEQ ID NO: 8262 - DNA, 22 bp, Artificial Sequence
  chemically synthesized
cgagtagctgggactacaggcg

SEQ ID NO: 8263 - DNA, 22 bp, Artificial Sequence
  chemically synthesized
ggactacaggcgtctgccacca

SEQ ID NO: 8264 - DNA, 22 bp, Artificial Sequence
  chemically synthesized
caggcgtctgccaccacgccca

SEQ ID NO: 8265 - DNA, 22 bp, Artificial Sequence
  chemically synthesized
ccaccacgcccagctaattttt

SEQ ID NO: 8266 - DNA, 22 bp, Artificial Sequence
  chemically synthesized
attttttgtatttttattagag

SEQ ID NO: 8267 - DNA, 22 bp, Artificial Sequence
  chemically synthesized
tttgtatttttattagagatgg

SEQ ID NO: 8268 - DNA, 22 bp, Artificial Sequence
  chemically synthesized
ttgtatttttattagagatggg

SEQ ID NO: 8269 - DNA, 22 bp, Artificial Sequence
  chemically synthesized
tgtatttttattagagatgggg

SEQ ID NO: 8270 - DNA, 22 bp, Artificial Sequence
  chemically synthesized
gtatttttattagagatggggt

SEQ ID NO: 8271 - DNA, 22 bp, Artificial Sequence
  chemically synthesized
tatttttattagagatggggtt

SEQ ID NO: 8272 - DNA, 22 bp, Artificial Sequence
  chemically synthesized
ttattagagatggggtttcacc

SEQ ID NO: 8273 - DNA, 22 bp, Artificial Sequence
  chemically synthesized
tattagagatggggtttcacca

SEQ ID NO: 8274 - DNA, 22 bp, Artificial Sequence
  chemically synthesized
attagagatggggtttcaccat

SEQ ID NO: 8275 - DNA, 22 bp, Artificial Sequence
  chemically synthesized
ttagagatggggtttcaccatg

SEQ ID NO: 8276 - DNA, 22 bp, Artificial Sequence
  chemically synthesized
gagatggggtttcaccatgtta

SEQ ID NO: 8277 - DNA, 22 bp, Artificial Sequence
  chemically synthesized
caccatgttagccaggatggtc

SEQ ID NO: 8278 - DNA, 22 bp, Artificial Sequence
  chemically synthesized
accatgttagccaggatggtct

SEQ ID NO: 8279 - DNA, 22 bp, Artificial Sequence
  chemically synthesized
gccaggatggtctcgatctcct

SEQ ID NO: 8280 - DNA, 22 bp, Artificial Sequence
  chemically synthesized
gatctcctgacctcgtgatcca

SEQ ID NO: 8281 - DNA, 22 bp, Artificial Sequence
  chemically synthesized
ctgacctcgtgatccacccgct

SEQ ID NO: 8282 - DNA, 22 bp, Artificial Sequence
  chemically synthesized
acctcgtgatccacccgctttg

SEQ ID NO: 8283 - DNA, 22 bp, Artificial Sequence
  chemically synthesized
gtgatccacccgctttggcctc

SEQ ID NO: 8284 - DNA, 22 bp, Artificial Sequence
  chemically synthesized
tggcctcccaaagtgctgggat

SEQ ID NO: 8285 - DNA, 22 bp, Artificial Sequence
  chemically synthesized
ggcctcccaaagtgctgggatt

SEQ ID NO: 8286 - DNA, 22 bp, Artificial Sequence
  chemically synthesized
gcctcccaaagtgctgggatta

SEQ ID NO: 8287 - DNA, 22 bp, Artificial Sequence
  chemically synthesized
ccaaagtgctgggattacaggc

SEQ ID NO: 8288 - DNA, 22 bp, Artificial Sequence
  chemically synthesized
ggattacaggcgtgagccaccg

SEQ ID NO: 8289 - DNA, 22 bp, Artificial Sequence
  chemically synthesized
caggcgtgagccaccgtgcccg

SEQ ID NO: 8290 - DNA, 22 bp, Artificial Sequence
  chemically synthesized
cttcactttcttcatttaaaaa

SEQ ID NO: 8291 - DNA, 22 bp, Artificial Sequence
  chemically synthesized
cactttcttcatttaaaaaaga

SEQ ID NO: 8292 - DNA, 22 bp, Artificial Sequence
  chemically synthesized
actttcttcatttaaaaaagaa

SEQ ID NO: 8293 - DNA, 22 bp, Artificial Sequence
  chemically synthesized
tcttcatttaaaaaagaaatgg

SEQ ID NO: 8294 - DNA, 22 bp, Artificial Sequence
  chemically synthesized
cttcatttaaaaaagaaatggg

SEQ ID NO: 8295 - DNA, 22 bp, Artificial Sequence
  chemically synthesized
ttcatttaaaaaagaaatgggg

SEQ ID NO: 8296 - DNA, 22 bp, Artificial Sequence
  chemically synthesized
catttaaaaaagaaatggggat

SEQ ID NO: 8297 - DNA, 22 bp, Artificial Sequence
  chemically synthesized
atttaaaaaagaaatggggata

SEQ ID NO: 8298 - DNA, 22 bp, Artificial Sequence
  chemically synthesized
aaaaaagaaatggggataatag

SEQ ID NO: 8299 - DNA, 22 bp, Artificial Sequence
  chemically synthesized
aaaaagaaatggggataatagt

SEQ ID NO: 8300 - DNA, 22 bp, Artificial Sequence
  chemically synthesized
tctcatagaattattgtaagaa

SEQ ID NO: 8301 - DNA, 22 bp, Artificial Sequence
  chemically synthesized
atagaattattgtaagaagtgc

SEQ ID NO: 8302 - DNA, 22 bp, Artificial Sequence
  chemically synthesized
ttgtaagaagtgcatgcagtaa

SEQ ID NO: 8303 - DNA, 22 bp, Artificial Sequence
  chemically synthesized
taagaagtgcatgcagtaatgc

SEQ ID NO: 8304 - DNA, 22 bp, Artificial Sequence
  chemically synthesized
agaagagtcggacacgaagtaa

SEQ ID NO: 8305 - DNA, 22 bp, Artificial Sequence
  chemically synthesized
ttatcatccttatcataatttt

SEQ ID NO: 8306 - DNA, 22 bp, Artificial Sequence
  chemically synthesized
tatcatccttatcataattttc

SEQ ID NO: 8307 - DNA, 22 bp, Artificial Sequence
  chemically synthesized
atcatccttatcataattttca

SEQ ID NO: 8308 - DNA, 22 bp, Artificial Sequence
  chemically synthesized
tcatccttatcataattttcat

SEQ ID NO: 8309 - DNA, 22 bp, Artificial Sequence
  chemically synthesized
atcataattttcattatcagaa

SEQ ID NO: 8310 - DNA, 22 bp, Artificial Sequence
  chemically synthesized
tcataattttcattatcagaac

SEQ ID NO: 8311 - DNA, 22 bp, Artificial Sequence
  chemically synthesized
tcattatcagaacaaggagaga

SEQ ID NO: 8312 - DNA, 22 bp, Artificial Sequence
  chemically synthesized
cattatcagaacaaggagagac

SEQ ID NO: 8313 - DNA, 22 bp, Artificial Sequence
  chemically synthesized
attatcagaacaaggagagacc

SEQ ID NO: 8314 - DNA, 22 bp, Artificial Sequence
  chemically synthesized
tcagaacaaggagagaccaggt

SEQ ID NO: 8315 - DNA, 22 bp, Artificial Sequence
  chemically synthesized
ttgtgattcttcaggtctggaa

SEQ ID NO: 8316 - DNA, 22 bp, Artificial Sequence
  chemically synthesized
tgattcttcaggtctggaatac

SEQ ID NO: 8317 - DNA, 22 bp, Artificial Sequence
  chemically synthesized
ttcaggtctggaatactagagt

SEQ ID NO: 8318 - DNA, 22 bp, Artificial Sequence
  chemically synthesized
caggtctggaatactagagtag

SEQ ID NO: 8319 - DNA, 22 bp, Artificial Sequence
  chemically synthesized
aggtctggaatactagagtagc

SEQ ID NO: 8320 - DNA, 22 bp, Artificial Sequence
  chemically synthesized
gaatactagagtagcatcccaa

SEQ ID NO: 8321 - DNA, 22 bp, Artificial Sequence
  chemically synthesized
gagtagcatcccaaatgaaggc

SEQ ID NO: 8322 - DNA, 22 bp, Artificial Sequence
  chemically synthesized
aactttgcaaatctgtatgaca

SEQ ID NO: 8323 - DNA, 22 bp, Artificial Sequence
  chemically synthesized
tgcaaatctgtatgacaccttc

SEQ ID NO: 8324 - DNA, 22 bp, Artificial Sequence
  chemically synthesized
gcaaatctgtatgacaccttca

SEQ ID NO: 8325 - DNA, 22 bp, Artificial Sequence
  chemically synthesized
caaatctgtatgacaccttcat

SEQ ID NO: 8326 - DNA, 22 bp, Artificial Sequence
  chemically synthesized
tatgacaccttcatgccaatta

SEQ ID NO: 8327 - DNA, 22 bp, Artificial Sequence
  chemically synthesized
catgccaattagaaaaaacacc

SEQ ID NO: 8328 - DNA, 22 bp, Artificial Sequence
  chemically synthesized
atgccaattagaaaaaacacct

SEQ ID NO: 8329 - DNA, 22 bp, Artificial Sequence
  chemically synthesized
gaaaaaacacctcttcacaacc

SEQ ID NO: 8330 - DNA, 22 bp, Artificial Sequence
  chemically synthesized
ttcacaacccctttcaagatat

SEQ ID NO: 8331 - DNA, 22 bp, Artificial Sequence
  chemically synthesized
cacaacccctttcaagatattt

SEQ ID NO: 8332 - DNA, 22 bp, Artificial Sequence
  chemically synthesized
acaacccctttcaagatatttg

SEQ ID NO: 8333 - DNA, 22 bp, Artificial Sequence
  chemically synthesized
tcaagatatttgcctcctacct

SEQ ID NO: 8334 - DNA, 22 bp, Artificial Sequence
  chemically synthesized
caagatatttgcctcctacctg

SEQ ID NO: 8335 - DNA, 22 bp, Artificial Sequence
  chemically synthesized
aagatatttgcctcctacctgc

SEQ ID NO: 8336 - DNA, 22 bp, Artificial Sequence
  chemically synthesized
gcctcctacctgctaaaaacac

SEQ ID NO: 8337 - DNA, 22 bp, Artificial Sequence
  chemically synthesized
cctcctacctgctaaaaacacc

SEQ ID NO: 8338 - DNA, 22 bp, Artificial Sequence
  chemically synthesized
ctacctgctaaaaacacccatc

SEQ ID NO: 8339 - DNA, 22 bp, Artificial Sequence
  chemically synthesized
cctgctaaaaacacccatcata

SEQ ID NO: 8340 - DNA, 22 bp, Artificial Sequence
  chemically synthesized
ctaaaaacacccatcatactac

SEQ ID NO: 8341 - DNA, 22 bp, Artificial Sequence
  chemically synthesized
aaaacacccatcatactaccca

SEQ ID NO: 8342 - DNA, 22 bp, Artificial Sequence
  chemically synthesized
cccacagatagccatgatgctt

SEQ ID NO: 8343 - DNA, 22 bp, Artificial Sequence
  chemically synthesized
tttctgggacaggtgcctcttc

SEQ ID NO: 8344 - DNA, 22 bp, Artificial Sequence
  chemically synthesized
ttctgggacaggtgcctcttcc

SEQ ID NO: 8345 - DNA, 22 bp, Artificial Sequence
  chemically synthesized
tctgggacaggtgcctcttcca

SEQ ID NO: 8346 - DNA, 22 bp, Artificial Sequence
  chemically synthesized
ctgggacaggtgcctcttccat

SEQ ID NO: 8347 - DNA, 22 bp, Artificial Sequence
  chemically synthesized
tgggacaggtgcctcttccatt

SEQ ID NO: 8348 - DNA, 22 bp, Artificial Sequence
  chemically synthesized
ggacaggtgcctcttccattcg

SEQ ID NO: 8349 - DNA, 22 bp, Artificial Sequence
  chemically synthesized
ttccattcgtgcagtgtacagc

SEQ ID NO: 8350 - DNA, 22 bp, Artificial Sequence
  chemically synthesized
ccattcgtgcagtgtacagcct

SEQ ID NO: 8351 - DNA, 22 bp, Artificial Sequence
  chemically synthesized
cattcgtgcagtgtacagcctt

SEQ ID NO: 8352 - DNA, 22 bp, Artificial Sequence
  chemically synthesized
gtgcagtgtacagccttcatag

SEQ ID NO: 8353 - DNA, 22 bp, Artificial Sequence
  chemically synthesized
catagctgtgcaactcacatca

SEQ ID NO: 8354 - DNA, 22 bp, Artificial Sequence
  chemically synthesized
atagctgtgcaactcacatcac

SEQ ID NO: 8355 - DNA, 22 bp, Artificial Sequence
  chemically synthesized
tgcaactcacatcacaatcaga

SEQ ID NO: 8356 - DNA, 22 bp, Artificial Sequence
  chemically synthesized
acatcacaatcagatggaagaa

SEQ ID NO: 8357 - DNA, 22 bp, Artificial Sequence
  chemically synthesized
ggtgacagatgagttactgggt

SEQ ID NO: 8358 - DNA, 22 bp, Artificial Sequence
  chemically synthesized
gtgacagatgagttactgggta

SEQ ID NO: 8359 - DNA, 22 bp, Artificial Sequence
  chemically synthesized
ctgggtaacacagagagaggat

SEQ ID NO: 8360 - DNA, 22 bp, Artificial Sequence
  chemically synthesized
ggtaacacagagagaggattca

SEQ ID NO: 8361 - DNA, 22 bp, Artificial Sequence
  chemically synthesized
aaaggaaaagttgaacgggtcc

SEQ ID NO: 8362 - DNA, 22 bp, Artificial Sequence
  chemically synthesized
aacgggtccagaaaatgcatag

SEQ ID NO: 8363 - DNA, 22 bp, Artificial Sequence
  chemically synthesized
gtaaggttatgactagccacgt

SEQ ID NO: 8364 - DNA, 22 bp, Artificial Sequence
  chemically synthesized
tgactagccacgtcccagggtt

SEQ ID NO: 8365 - DNA, 22 bp, Artificial Sequence
  chemically synthesized
gccacgtcccagggttcaaagc

SEQ ID NO: 8366 - DNA, 22 bp, Artificial Sequence
  chemically synthesized
aaagcttttctcagatgttaaa

SEQ ID NO: 8367 - DNA, 22 bp, Artificial Sequence
  chemically synthesized
ttctcagatgttaaaatgaatc

SEQ ID NO: 8368 - DNA, 22 bp, Artificial Sequence
  chemically synthesized
tctcagatgttaaaatgaatca

SEQ ID NO: 8369 - DNA, 22 bp, Artificial Sequence
  chemically synthesized
ctcagatgttaaaatgaatcat

SEQ ID NO: 8370 - DNA, 22 bp, Artificial Sequence
  chemically synthesized
tcagatgttaaaatgaatcatg

SEQ ID NO: 8371 - DNA, 22 bp, Artificial Sequence
  chemically synthesized
agatgttaaaatgaatcatgta

SEQ ID NO: 8372 - DNA, 22 bp, Artificial Sequence
  chemically synthesized
aaatgaatcatgtaagtccccc

SEQ ID NO: 8373 - DNA, 22 bp, Artificial Sequence
  chemically synthesized
aaggagtcctcttccaaaaata

SEQ ID NO: 8374 - DNA, 22 bp, Artificial Sequence
  chemically synthesized
aggagtcctcttccaaaaatag

SEQ ID NO: 8375 - DNA, 22 bp, Artificial Sequence
  chemically synthesized
ttccaaaaataggaaatgaaat

SEQ ID NO: 8376 - DNA, 22 bp, Artificial Sequence
  chemically synthesized
ccaaaaataggaaatgaaatga

SEQ ID NO: 8377 - DNA, 22 bp, Artificial Sequence
  chemically synthesized
caaaaataggaaatgaaatgac

SEQ ID NO: 8378 - DNA, 22 bp, Artificial Sequence
  chemically synthesized
tgaggtgacggaggaaatgaag

SEQ ID NO: 8379 - DNA, 22 bp, Artificial Sequence
  chemically synthesized
aggtgacggaggaaatgaagga

SEQ ID NO: 8380 - DNA, 22 bp, Artificial Sequence
  chemically synthesized
tagatgcagcttgaggttcatg

SEQ ID NO: 8381 - DNA, 22 bp, Artificial Sequence
  chemically synthesized
gatgcagcttgaggttcatgag

SEQ ID NO: 8382 - DNA, 22 bp, Artificial Sequence
  chemically synthesized
gaggttcatgagagacagttcc

SEQ ID NO: 8383 - DNA, 22 bp, Artificial Sequence
  chemically synthesized
aggttcatgagagacagttcca

SEQ ID NO: 8384 - DNA, 22 bp, Artificial Sequence
  chemically synthesized
atgagagacagttccaggggag

SEQ ID NO: 8385 - DNA, 22 bp, Artificial Sequence
  chemically synthesized
caggggagaggtcacagctagg

SEQ ID NO: 8386 - DNA, 22 bp, Artificial Sequence
  chemically synthesized
gggatcaccggcatgcaggaac

SEQ ID NO: 8387 - DNA, 22 bp, Artificial Sequence
  chemically synthesized
agaaacctaaatggggaaatct

SEQ ID NO: 8388 - DNA, 22 bp, Artificial Sequence
  chemically synthesized
aatggggaaatctttttgagga

SEQ ID NO: 8389 - DNA, 22 bp, Artificial Sequence
  chemically synthesized
tttgaggaaatgaacagagaag

SEQ ID NO: 8390 - DNA, 22 bp, Artificial Sequence
  chemically synthesized
ttgaggaaatgaacagagaagg

SEQ ID NO: 8391 - DNA, 22 bp, Artificial Sequence
  chemically synthesized
tgaggaaatgaacagagaaggc

SEQ ID NO: 8392 - DNA, 22 bp, Artificial Sequence
  chemically synthesized
gaggaaatgaacagagaaggct

SEQ ID NO: 8393 - DNA, 22 bp, Artificial Sequence
  chemically synthesized
aggaaatgaacagagaaggcta

SEQ ID NO: 8394 - DNA, 22 bp, Artificial Sequence
  chemically synthesized
aaatcaaggagttcgtcaggca

SEQ ID NO: 8395 - DNA, 22 bp, Artificial Sequence
  chemically synthesized
gtcaggcaatttctatgtttag

SEQ ID NO: 8396 - DNA, 22 bp, Artificial Sequence
  chemically synthesized
ctatgtttaggttcaactctct

SEQ ID NO: 8397 - DNA, 22 bp, Artificial Sequence
  chemically synthesized
tatgtttaggttcaactctctc

SEQ ID NO: 8398 - DNA, 22 bp, Artificial Sequence
  chemically synthesized
tgtttaggttcaactctctcct

SEQ ID NO: 8399 - DNA, 22 bp, Artificial Sequence
  chemically synthesized
aggttcaactctctcctgaaac

SEQ ID NO: 8400 - DNA, 22 bp, Artificial Sequence
  chemically synthesized
ggttcaactctctcctgaaaca

SEQ ID NO: 8401 - DNA, 22 bp, Artificial Sequence
  chemically synthesized
aactctctcctgaaacatgaag

SEQ ID NO: 8402 - DNA, 22 bp, Artificial Sequence
  chemically synthesized
tctcctgaaacatgaagagctc

SEQ ID NO: 8403 - DNA, 22 bp, Artificial Sequence
  chemically synthesized
tcctgaaacatgaagagctcat

SEQ ID NO: 8404 - DNA, 22 bp, Artificial Sequence
  chemically synthesized
ctgaaacatgaagagctcataa

SEQ ID NO: 8405 - DNA, 22 bp, Artificial Sequence
  chemically synthesized
aaacatgaagagctcataaatg

SEQ ID NO: 8406 - DNA, 22 bp, Artificial Sequence
  chemically synthesized
ataaatgcactccctctttgag

SEQ ID NO: 8407 - DNA, 22 bp, Artificial Sequence
  chemically synthesized
cctctttgagtctctagttttg

SEQ ID NO: 8408 - DNA, 22 bp, Artificial Sequence
  chemically synthesized
tttgagtctctagttttgtctc

SEQ ID NO: 8409 - DNA, 22 bp, Artificial Sequence
  chemically synthesized
tgagtctctagttttgtctcct

SEQ ID NO: 8410 - DNA, 22 bp, Artificial Sequence
  chemically synthesized
gagtctctagttttgtctcctt

SEQ ID NO: 8411 - DNA, 22 bp, Artificial Sequence
  chemically synthesized
agtctctagttttgtctccttc

SEQ ID NO: 8412 - DNA, 22 bp, Artificial Sequence
  chemically synthesized
tagttttgtctccttcccacag

SEQ ID NO: 8413 - DNA, 22 bp, Artificial Sequence
  chemically synthesized
gttttgtctccttcccacagtg

SEQ ID NO: 8414 - DNA, 22 bp, Artificial Sequence
  chemically synthesized
tgtctccttcccacagtgagtc

SEQ ID NO: 8415 - DNA, 22 bp, Artificial Sequence
  chemically synthesized
gtctccttcccacagtgagtct

SEQ ID NO: 8416 - DNA, 22 bp, Artificial Sequence
  chemically synthesized
tctccttcccacagtgagtctg

SEQ ID NO: 8417 - DNA, 22 bp, Artificial Sequence
  chemically synthesized
cttcccacagtgagtctgcagg

SEQ ID NO: 8418 - DNA, 22 bp, Artificial Sequence
  chemically synthesized
cccacagtgagtctgcaggctg

SEQ ID NO: 8419 - DNA, 22 bp, Artificial Sequence
  chemically synthesized
ccacagtgagtctgcaggctgc

SEQ ID NO: 8420 - DNA, 22 bp, Artificial Sequence
  chemically synthesized
caggctgcgtgtcactcacgtt

SEQ ID NO: 8421 - DNA, 22 bp, Artificial Sequence
  chemically synthesized
cgtgtcactcacgttcagctaa

SEQ ID NO: 8422 - DNA, 22 bp, Artificial Sequence
  chemically synthesized
acgttcagctaagacgtagtgc

SEQ ID NO: 8423 - DNA, 22 bp, Artificial Sequence
  chemically synthesized
agctaagacgtagtgccccatg

SEQ ID NO: 8424 - DNA, 22 bp, Artificial Sequence
  chemically synthesized
agacgtagtgccccatggctcc

SEQ ID NO: 8425 - DNA, 22 bp, Artificial Sequence
  chemically synthesized
ctcctgtggagacaagagaccc

SEQ ID NO: 8426 - DNA, 22 bp, Artificial Sequence
  chemically synthesized
ctgtggagacaagagacccagg

SEQ ID NO: 8427 - DNA, 22 bp, Artificial Sequence
  chemically synthesized
tggagacaagagacccaggaaa

SEQ ID NO: 8428 - DNA, 22 bp, Artificial Sequence
  chemically synthesized
ggcaccatcttgcctcttctct

SEQ ID NO: 8429 - DNA, 22 bp, Artificial Sequence
  chemically synthesized
gcctcttctctcttccttattt

SEQ ID NO: 8430 - DNA, 22 bp, Artificial Sequence
  chemically synthesized
cctcttctctcttccttatttt

SEQ ID NO: 8431 - DNA, 22 bp, Artificial Sequence
  chemically synthesized
ttctctcttccttattttcctc

SEQ ID NO: 8432 - DNA, 22 bp, Artificial Sequence
  chemically synthesized
ctctcttccttattttcctcat

SEQ ID NO: 8433 - DNA, 22 bp, Artificial Sequence
  chemically synthesized
tctcttccttattttcctcatt

SEQ ID NO: 8434 - DNA, 22 bp, Artificial Sequence
  chemically synthesized
tcttccttattttcctcattca

SEQ ID NO: 8435 - DNA, 22 bp, Artificial Sequence
  chemically synthesized
ttccttattttcctcattcacc

SEQ ID NO: 8436 - DNA, 22 bp, Artificial Sequence
  chemically synthesized
ccttattttcctcattcaccca

SEQ ID NO: 8437 - DNA, 22 bp, Artificial Sequence
  chemically synthesized
cttattttcctcattcacccat

SEQ ID NO: 8438 - DNA, 22 bp, Artificial Sequence
  chemically synthesized
attttcctcattcacccatctc

SEQ ID NO: 8439 - DNA, 22 bp, Artificial Sequence
  chemically synthesized
ttttcctcattcacccatctca

SEQ ID NO: 8440 - DNA, 22 bp, Artificial Sequence
  chemically synthesized
tcctcattcacccatctcaatt

SEQ ID NO: 8441 - DNA, 22 bp, Artificial Sequence
  chemically synthesized
cctcattcacccatctcaattt

SEQ ID NO: 8442 - DNA, 22 bp, Artificial Sequence
  chemically synthesized
ctcattcacccatctcaattta

SEQ ID NO: 8443 - DNA, 22 bp, Artificial Sequence
  chemically synthesized
attcacccatctcaatttagac

SEQ ID NO: 8444 - DNA, 22 bp, Artificial Sequence
  chemically synthesized
acccatctcaatttagacctgg

SEQ ID NO: 8445 - DNA, 22 bp, Artificial Sequence
  chemically synthesized
aatttagacctgggcactattg

SEQ ID NO: 8446 - DNA, 22 bp, Artificial Sequence
  chemically synthesized
agacctgggcactattggattt

SEQ ID NO: 8447 - DNA, 22 bp, Artificial Sequence
  chemically synthesized
gacctgggcactattggatttc

SEQ ID NO: 8448 - DNA, 22 bp, Artificial Sequence
  chemically synthesized
ggcactattggatttcaagaac

SEQ ID NO: 8449 - DNA, 22 bp, Artificial Sequence
  chemically synthesized
ttggatttcaagaaccattatc

SEQ ID NO: 8450 - DNA, 22 bp, Artificial Sequence
  chemically synthesized
gatttcaagaaccattatctct

SEQ ID NO: 8451 - DNA, 22 bp, Artificial Sequence
  chemically synthesized
caagaaccattatctctcatct

SEQ ID NO: 8452 - DNA, 22 bp, Artificial Sequence
  chemically synthesized
aagaaccattatctctcatctg

SEQ ID NO: 8453 - DNA, 22 bp, Artificial Sequence
  chemically synthesized
tctctcatctggaaatgcttat

SEQ ID NO: 8454 - DNA, 22 bp, Artificial Sequence
  chemically synthesized
tcatctggaaatgcttattggc

SEQ ID NO: 8455 - DNA, 22 bp, Artificial Sequence
  chemically synthesized
atctggaaatgcttattggctt

SEQ ID NO: 8456 - DNA, 22 bp, Artificial Sequence
  chemically synthesized
gaaatgcttattggctttctaa

SEQ ID NO: 8457 - DNA, 22 bp, Artificial Sequence
  chemically synthesized
attggctttctaactggtctcc

SEQ ID NO: 8458 - DNA, 22 bp, Artificial Sequence
  chemically synthesized
ttggctttctaactggtctcct

SEQ ID NO: 8459 - DNA, 22 bp, Artificial Sequence
  chemically synthesized
gctttctaactggtctcctcac

SEQ ID NO: 8460 - DNA, 22 bp, Artificial Sequence
  chemically synthesized
tctaactggtctcctcacctct

SEQ ID NO: 8461 - DNA, 22 bp, Artificial Sequence
  chemically synthesized
ctaactggtctcctcacctctc

SEQ ID NO: 8462 - DNA, 22 bp, Artificial Sequence
  chemically synthesized
taactggtctcctcacctctca

SEQ ID NO: 8463 - DNA, 22 bp, Artificial Sequence
  chemically synthesized
actggtctcctcacctctcatc

SEQ ID NO: 8464 - DNA, 22 bp, Artificial Sequence
  chemically synthesized
gtctcctcacctctcatctaac

SEQ ID NO: 8465 - DNA, 22 bp, Artificial Sequence
  chemically synthesized
ctcacctctcatctaacttctt

SEQ ID NO: 8466 - DNA, 22 bp, Artificial Sequence
  chemically synthesized
acctctcatctaacttcttaac

SEQ ID NO: 8467 - DNA, 22 bp, Artificial Sequence
  chemically synthesized
tcatctaacttcttaacaacac

SEQ ID NO: 8468 - DNA, 22 bp, Artificial Sequence
  chemically synthesized
atctaacttcttaacaacacat

SEQ ID NO: 8469 - DNA, 22 bp, Artificial Sequence
  chemically synthesized
acttcttaacaacacattcacc

SEQ ID NO: 8470 - DNA, 22 bp, Artificial Sequence
  chemically synthesized
cttaacaacacattcaccatat

SEQ ID NO: 8471 - DNA, 22 bp, Artificial Sequence
  chemically synthesized
ttaacaacacattcaccatata

SEQ ID NO: 8472 - DNA, 22 bp, Artificial Sequence
  chemically synthesized
aacaacacattcaccatataag

SEQ ID NO: 8473 - DNA, 22 bp, Artificial Sequence
  chemically synthesized
acaacacattcaccatataagg

SEQ ID NO: 8474 - DNA, 22 bp, Artificial Sequence
  chemically synthesized
accatataagggagatcgtggt

SEQ ID NO: 8475 - DNA, 22 bp, Artificial Sequence
  chemically synthesized
ctttcttaggatccttcaatga

SEQ ID NO: 8476 - DNA, 22 bp, Artificial Sequence
  chemically synthesized
tcttaggatccttcaatgacac

SEQ ID NO: 8477 - DNA, 22 bp, Artificial Sequence
  chemically synthesized
cttaggatccttcaatgacacc

SEQ ID NO: 8478 - DNA, 22 bp, Artificial Sequence
  chemically synthesized
ttaggatccttcaatgacaccc

SEQ ID NO: 8479 - DNA, 22 bp, Artificial Sequence
  chemically synthesized
aggatccttcaatgacacccca

SEQ ID NO: 8480 - DNA, 22 bp, Artificial Sequence
  chemically synthesized
ggatccttcaatgacaccccag

SEQ ID NO: 8481 - DNA, 22 bp, Artificial Sequence
  chemically synthesized
caatgacaccccagtgatcata

SEQ ID NO: 8482 - DNA, 22 bp, Artificial Sequence
  chemically synthesized
aatgacaccccagtgatcataa

SEQ ID NO: 8483 - DNA, 22 bp, Artificial Sequence
  chemically synthesized
ggactctgtatgagctggcttc

SEQ ID NO: 8484 - DNA, 22 bp, Artificial Sequence
  chemically synthesized
gactctgtatgagctggcttct

SEQ ID NO: 8485 - DNA, 22 bp, Artificial Sequence
  chemically synthesized
tgtatgagctggcttctttctg

SEQ ID NO: 8486 - DNA, 22 bp, Artificial Sequence
  chemically synthesized
tatgagctggcttctttctgat

SEQ ID NO: 8487 - DNA, 22 bp, Artificial Sequence
  chemically synthesized
gcttctttctgattctcttttc

SEQ ID NO: 8488 - DNA, 22 bp, Artificial Sequence
  chemically synthesized
ctttctgattctcttttcccta

SEQ ID NO: 8489 - DNA, 22 bp, Artificial Sequence
  chemically synthesized
tttctgattctcttttccctac

SEQ ID NO: 8490 - DNA, 22 bp, Artificial Sequence
  chemically synthesized
tctgattctcttttccctacac

SEQ ID NO: 8491 - DNA, 22 bp, Artificial Sequence
  chemically synthesized
ctgattctcttttccctacacc

SEQ ID NO: 8492 - DNA, 22 bp, Artificial Sequence
  chemically synthesized
tgattctcttttccctacacca

SEQ ID NO: 8493 - DNA, 22 bp, Artificial Sequence
  chemically synthesized
attctcttttccctacaccaca

SEQ ID NO: 8494 - DNA, 22 bp, Artificial Sequence
  chemically synthesized
tcttttccctacaccacagatg

SEQ ID NO: 8495 - DNA, 22 bp, Artificial Sequence
  chemically synthesized
ttttccctacaccacagatgtt

SEQ ID NO: 8496 - DNA, 22 bp, Artificial Sequence
  chemically synthesized
ttccctacaccacagatgttca

SEQ ID NO: 8497 - DNA, 22 bp, Artificial Sequence
  chemically synthesized
tccctacaccacagatgttcag

SEQ ID NO: 8498 - DNA, 22 bp, Artificial Sequence
  chemically synthesized
ccctacaccacagatgttcagg

SEQ ID NO: 8499 - DNA, 22 bp, Artificial Sequence
  chemically synthesized
cctacaccacagatgttcaggg

SEQ ID NO: 8500 - DNA, 22 bp, Artificial Sequence
  chemically synthesized
caccacagatgttcagggggta

SEQ ID NO: 8501 - DNA, 22 bp, Artificial Sequence
  chemically synthesized
agggggtagaaatgcataattg

SEQ ID NO: 8502 - DNA, 22 bp, Artificial Sequence
  chemically synthesized
gtgagtgatagctacgcaaact

SEQ ID NO: 8503 - DNA, 22 bp, Artificial Sequence
  chemically synthesized
cgcaaactcagggttaaggtac

SEQ ID NO: 8504 - DNA, 22 bp, Artificial Sequence
  chemically synthesized
agggttaaggtacagtaattat

SEQ ID NO: 8505 - DNA, 22 bp, Artificial Sequence
  chemically synthesized
aggtacagtaattatttctaat

SEQ ID NO: 8506 - DNA, 22 bp, Artificial Sequence
  chemically synthesized
tttctaatctcccagtatgcct

SEQ ID NO: 8507 - DNA, 22 bp, Artificial Sequence
  chemically synthesized
ctaatctcccagtatgccttat

SEQ ID NO: 8508 - DNA, 22 bp, Artificial Sequence
  chemically synthesized
taatctcccagtatgccttata

SEQ ID NO: 8509 - DNA, 22 bp, Artificial Sequence
  chemically synthesized
atctcccagtatgccttatact

SEQ ID NO: 8510 - DNA, 22 bp, Artificial Sequence
  chemically synthesized
ccagtatgccttatactctcct

SEQ ID NO: 8511 - DNA, 22 bp, Artificial Sequence
  chemically synthesized
atactctcctacttggcatggt

SEQ ID NO: 8512 - DNA, 22 bp, Artificial Sequence
  chemically synthesized
tactctcctacttggcatggtt

SEQ ID NO: 8513 - DNA, 22 bp, Artificial Sequence
  chemically synthesized
tcctacttggcatggttgctcc

SEQ ID NO: 8514 - DNA, 22 bp, Artificial Sequence
  chemically synthesized
ctacttggcatggttgctccgt

SEQ ID NO: 8515 - DNA, 22 bp, Artificial Sequence
  chemically synthesized
cttggcatggttgctccgtctg

SEQ ID NO: 8516 - DNA, 22 bp, Artificial Sequence
  chemically synthesized
ggcatggttgctccgtctgtgt

SEQ ID NO: 8517 - DNA, 22 bp, Artificial Sequence
  chemically synthesized
gcatggttgctccgtctgtgta

SEQ ID NO: 8518 - DNA, 22 bp, Artificial Sequence
  chemically synthesized
ctccgtctgtgtagacctccca

SEQ ID NO: 8519 - DNA, 22 bp, Artificial Sequence
  chemically synthesized
cgtctgtgtagacctcccatca

SEQ ID NO: 8520 - DNA, 22 bp, Artificial Sequence
  chemically synthesized
tgtagacctcccatcatcttca

SEQ ID NO: 8521 - DNA, 22 bp, Artificial Sequence
  chemically synthesized
ccatcatcttcaacctcaccta

SEQ ID NO: 8522 - DNA, 22 bp, Artificial Sequence
  chemically synthesized
caacctcacctaatggaatcca

SEQ ID NO: 8523 - DNA, 22 bp, Artificial Sequence
  chemically synthesized
aacctcacctaatggaatccag

SEQ ID NO: 8524 - DNA, 22 bp, Artificial Sequence
  chemically synthesized
acctaatggaatccagcttctc

SEQ ID NO: 8525 - DNA, 22 bp, Artificial Sequence
  chemically synthesized
atggaatccagcttctccttca

SEQ ID NO: 8526 - DNA, 22 bp, Artificial Sequence
  chemically synthesized
ctccttcaagatccagaaggct

SEQ ID NO: 8527 - DNA, 22 bp, Artificial Sequence
  chemically synthesized
tccttcaagatccagaaggcta

SEQ ID NO: 8528 - DNA, 22 bp, Artificial Sequence
  chemically synthesized
cttcaagatccagaaggctatc

SEQ ID NO: 8529 - DNA, 22 bp, Artificial Sequence
  chemically synthesized
caagatccagaaggctatcttg

SEQ ID NO: 8530 - DNA, 22 bp, Artificial Sequence
  chemically synthesized
aagatccagaaggctatcttga

SEQ ID NO: 8531 - DNA, 22 bp, Artificial Sequence
  chemically synthesized
tcttgatccccagctgaatgtg

SEQ ID NO: 8532 - DNA, 22 bp, Artificial Sequence
  chemically synthesized
gatccccagctgaatgtgatca

SEQ ID NO: 8533 - DNA, 22 bp, Artificial Sequence
  chemically synthesized
atccccagctgaatgtgatcat

SEQ ID NO: 8534 - DNA, 22 bp, Artificial Sequence
  chemically synthesized
aatgtgatcattctttcctttg

SEQ ID NO: 8535 - DNA, 22 bp, Artificial Sequence
  chemically synthesized
tttcctttgacaccctaagcat

SEQ ID NO: 8536 - DNA, 22 bp, Artificial Sequence
  chemically synthesized
tcctttgacaccctaagcattt

SEQ ID NO: 8537 - DNA, 22 bp, Artificial Sequence
  chemically synthesized
cctttgacaccctaagcatttg

SEQ ID NO: 8538 - DNA, 22 bp, Artificial Sequence
  chemically synthesized
ctttgacaccctaagcatttgc

SEQ ID NO: 8539 - DNA, 22 bp, Artificial Sequence
  chemically synthesized
tgacaccctaagcatttgcttc

SEQ ID NO: 8540 - DNA, 22 bp, Artificial Sequence
  chemically synthesized
gacaccctaagcatttgcttcc

SEQ ID NO: 8541 - DNA, 22 bp, Artificial Sequence
  chemically synthesized
acaccctaagcatttgcttcct

SEQ ID NO: 8542 - DNA, 22 bp, Artificial Sequence
  chemically synthesized
agcatttgcttcctgcctgctt

SEQ ID NO: 8543 - DNA, 22 bp, Artificial Sequence
  chemically synthesized
gcttcctgcctgctttaggacc

SEQ ID NO: 8544 - DNA, 22 bp, Artificial Sequence
  chemically synthesized
cttcctgcctgctttaggacct

SEQ ID NO: 8545 - DNA, 22 bp, Artificial Sequence
  chemically synthesized
cctgcctgctttaggacctcat

SEQ ID NO: 8546 - DNA, 22 bp, Artificial Sequence
  chemically synthesized
ctgcctgctttaggacctcatg

SEQ ID NO: 8547 - DNA, 22 bp, Artificial Sequence
  chemically synthesized
cctgctttaggacctcatgggg

SEQ ID NO: 8548 - DNA, 22 bp, Artificial Sequence
  chemically synthesized
ctttaggacctcatggggtctt

SEQ ID NO: 8549 - DNA, 22 bp, Artificial Sequence
  chemically synthesized
taggacctcatggggtcttctt

SEQ ID NO: 8550 - DNA, 22 bp, Artificial Sequence
  chemically synthesized
aggacctcatggggtcttcttt

SEQ ID NO: 8551 - DNA, 22 bp, Artificial Sequence
  chemically synthesized
ggacctcatggggtcttcttta

SEQ ID NO: 8552 - DNA, 22 bp, Artificial Sequence
  chemically synthesized
atggggtcttctttaactacat

SEQ ID NO: 8553 - DNA, 22 bp, Artificial Sequence
  chemically synthesized
ctttaactacatttacttgcta

SEQ ID NO: 8554 - DNA, 22 bp, Artificial Sequence
  chemically synthesized
tttaactacatttacttgctat

SEQ ID NO: 8555 - DNA, 22 bp, Artificial Sequence
  chemically synthesized
taactacatttacttgctatca

SEQ ID NO: 8556 - DNA, 22 bp, Artificial Sequence
  chemically synthesized
aactacatttacttgctatcaa

SEQ ID NO: 8557 - DNA, 22 bp, Artificial Sequence
  chemically synthesized
actacatttacttgctatcaat

SEQ ID NO: 8558 - DNA, 22 bp, Artificial Sequence
  chemically synthesized
catttacttgctatcaatttca

SEQ ID NO: 8559 - DNA, 22 bp, Artificial Sequence
  chemically synthesized
acttgctatcaatttcattccc

SEQ ID NO: 8560 - DNA, 22 bp, Artificial Sequence
  chemically synthesized
cttgctatcaatttcattccct

SEQ ID NO: 8561 - DNA, 22 bp, Artificial Sequence
  chemically synthesized
gctatcaatttcattccctacc

SEQ ID NO: 8562 - DNA, 22 bp, Artificial Sequence
  chemically synthesized
ctatcaatttcattccctacca

SEQ ID NO: 8563 - DNA, 22 bp, Artificial Sequence
  chemically synthesized
tcaatttcattccctaccagat

SEQ ID NO: 8564 - DNA, 22 bp, Artificial Sequence
  chemically synthesized
cattccctaccagatttgggtt

SEQ ID NO: 8565 - DNA, 22 bp, Artificial Sequence
  chemically synthesized
attccctaccagatttgggttc

SEQ ID NO: 8566 - DNA, 22 bp, Artificial Sequence
  chemically synthesized
cctaccagatttgggttctgag

SEQ ID NO: 8567 - DNA, 22 bp, Artificial Sequence
  chemically synthesized
ccagatttgggttctgagaata

SEQ ID NO: 8568 - DNA, 22 bp, Artificial Sequence
  chemically synthesized
gggttctgagaatagccacagt

SEQ ID NO: 8569 - DNA, 22 bp, Artificial Sequence
  chemically synthesized
ggttctgagaatagccacagtg

SEQ ID NO: 8570 - DNA, 22 bp, Artificial Sequence
  chemically synthesized
tgagaatagccacagtgacttc

SEQ ID NO: 8571 - DNA, 22 bp, Artificial Sequence
  chemically synthesized
agaatagccacagtgacttctc

SEQ ID NO: 8572 - DNA, 22 bp, Artificial Sequence
  chemically synthesized
ctcaacctcaaagcccctgtac

SEQ ID NO: 8573 - DNA, 22 bp, Artificial Sequence
  chemically synthesized
tcaacctcaaagcccctgtact

SEQ ID NO: 8574 - DNA, 22 bp, Artificial Sequence
  chemically synthesized
aacctcaaagcccctgtactac

SEQ ID NO: 8575 - DNA, 22 bp, Artificial Sequence
  chemically synthesized
aaagcccctgtactaccttaaa

SEQ ID NO: 8576 - DNA, 22 bp, Artificial Sequence
  chemically synthesized
tactaccttaaacagctcttgc

SEQ ID NO: 8577 - DNA, 22 bp, Artificial Sequence
  chemically synthesized
ccttaaacagctcttgcaaaat

SEQ ID NO: 8578 - DNA, 22 bp, Artificial Sequence
  chemically synthesized
aaacagctcttgcaaaatagta

SEQ ID NO: 8579 - DNA, 22 bp, Artificial Sequence
  chemically synthesized
aacagctcttgcaaaatagtag

SEQ ID NO: 8580 - DNA, 22 bp, Artificial Sequence
  chemically synthesized
ttgcaaaatagtaggtgctctg

SEQ ID NO: 8581 - DNA, 22 bp, Artificial Sequence
  chemically synthesized
gcaaaatagtaggtgctctgaa

SEQ ID NO: 8582 - DNA, 22 bp, Artificial Sequence
  chemically synthesized
caaaatagtaggtgctctgaag

SEQ ID NO: 8583 - DNA, 22 bp, Artificial Sequence
  chemically synthesized
tgaagatgtttgttgaattaga

SEQ ID NO: 8584 - DNA, 22 bp, Artificial Sequence
  chemically synthesized
aagatgtttgttgaattagaga

SEQ ID NO: 8585 - DNA, 22 bp, Artificial Sequence
  chemically synthesized
gttgaattagagactttcattc

SEQ ID NO: 8586 - DNA, 22 bp, Artificial Sequence
  chemically synthesized
ttgaattagagactttcattct

SEQ ID NO: 8587 - DNA, 22 bp, Artificial Sequence
  chemically synthesized
aattagagactttcattctggg

SEQ ID NO: 8588 - DNA, 22 bp, Artificial Sequence
  chemically synthesized
gagactttcattctggggagaa

SEQ ID NO: 8589 - DNA, 22 bp, Artificial Sequence
  chemically synthesized
tcattctggggagaaccattat

SEQ ID NO: 8590 - DNA, 22 bp, Artificial Sequence
  chemically synthesized
cattctggggagaaccattatt

SEQ ID NO: 8591 - DNA, 22 bp, Artificial Sequence
  chemically synthesized
attctggggagaaccattattt

SEQ ID NO: 8592 - DNA, 22 bp, Artificial Sequence
  chemically synthesized
tggggagaaccattattttctg

SEQ ID NO: 8593 - DNA, 22 bp, Artificial Sequence
  chemically synthesized
gggagaaccattattttctgtc

SEQ ID NO: 8594 - DNA, 22 bp, Artificial Sequence
  chemically synthesized
ttttctgtctcccagggagctg

SEQ ID NO: 8595 - DNA, 22 bp, Artificial Sequence
  chemically synthesized
tctgtctcccagggagctgctg

SEQ ID NO: 8596 - DNA, 22 bp, Artificial Sequence
  chemically synthesized
ctgtctcccagggagctgctgg

SEQ ID NO: 8597 - DNA, 22 bp, Artificial Sequence
  chemically synthesized
tgtctcccagggagctgctggt

SEQ ID NO: 8598 - DNA, 22 bp, Artificial Sequence
  chemically synthesized
tctcccagggagctgctggtgt

SEQ ID NO: 8599 - DNA, 22 bp, Artificial Sequence
  chemically synthesized
ccagggagctgctggtgtcccc

SEQ ID NO: 8600 - DNA, 22 bp, Artificial Sequence
  chemically synthesized
ctggtgtccccaaagaatataa

SEQ ID NO: 8601 - DNA, 22 bp, Artificial Sequence
  chemically synthesized
gtgtccccaaagaatataaatg

SEQ ID NO: 8602 - DNA, 22 bp, Artificial Sequence
  chemically synthesized
cccatggatgccagatcccctc

SEQ ID NO: 8603 - DNA, 22 bp, Artificial Sequence
  chemically synthesized
ccatggatgccagatcccctct

SEQ ID NO: 8604 - DNA, 22 bp, Artificial Sequence
  chemically synthesized
tgcccctcttcccactgtgccc

SEQ ID NO: 8605 - DNA, 22 bp, Artificial Sequence
  chemically synthesized
cccctcttcccactgtgccctg

SEQ ID NO: 8606 - DNA, 22 bp, Artificial Sequence
  chemically synthesized
ttcccactgtgccctggggcag

SEQ ID NO: 8607 - DNA, 22 bp, Artificial Sequence
  chemically synthesized
cccactgtgccctggggcagag

SEQ ID NO: 8608 - DNA, 22 bp, Artificial Sequence
  chemically synthesized
ccactgtgccctggggcagagg

SEQ ID NO: 8609 - DNA, 22 bp, Artificial Sequence
  chemically synthesized
tgccctggggcagaggtactaa

SEQ ID NO: 8610 - DNA, 22 bp, Artificial Sequence
  chemically synthesized
gggcagaggtactaagagactt

SEQ ID NO: 8611 - DNA, 22 bp, Artificial Sequence
  chemically synthesized
agagacttcccccttgttccta

SEQ ID NO: 8612 - DNA, 22 bp, Artificial Sequence
  chemically synthesized
cccccttgttcctactcacttg

SEQ ID NO: 8613 - DNA, 22 bp, Artificial Sequence
  chemically synthesized
ccccttgttcctactcacttga

SEQ ID NO: 8614 - DNA, 22 bp, Artificial Sequence
  chemically synthesized
gttcctactcacttgaaccctg

SEQ ID NO: 8615 - DNA, 22 bp, Artificial Sequence
  chemically synthesized
ttcctactcacttgaaccctgc

SEQ ID NO: 8616 - DNA, 22 bp, Artificial Sequence
  chemically synthesized
ctactcacttgaaccctgcctc

SEQ ID NO: 8617 - DNA, 22 bp, Artificial Sequence
  chemically synthesized
ctcacttgaaccctgcctcttc

SEQ ID NO: 8618 - DNA, 22 bp, Artificial Sequence
  chemically synthesized
acttgaaccctgcctcttcctt

SEQ ID NO: 8619 - DNA, 22 bp, Artificial Sequence
  chemically synthesized
gaaccctgcctcttccttaata

SEQ ID NO: 8620 - DNA, 22 bp, Artificial Sequence
  chemically synthesized
aaccctgcctcttccttaatat

SEQ ID NO: 8621 - DNA, 22 bp, Artificial Sequence
  chemically synthesized
cctcttccttaatattatgaac

SEQ ID NO: 8622 - DNA, 22 bp, Artificial Sequence
  chemically synthesized
ttccttaatattatgaacaaaa

SEQ ID NO: 8623 - DNA, 22 bp, Artificial Sequence
  chemically synthesized
ccttaatattatgaacaaaatt

SEQ ID NO: 8624 - DNA, 22 bp, Artificial Sequence
  chemically synthesized
cttaatattatgaacaaaattc

SEQ ID NO: 8625 - DNA, 22 bp, Artificial Sequence
  chemically synthesized
aatattatgaacaaaattccaa

SEQ ID NO: 8626 - DNA, 22 bp, Artificial Sequence
  chemically synthesized
atattatgaacaaaattccaat

SEQ ID NO: 8627 - DNA, 22 bp, Artificial Sequence
  chemically synthesized
tgaacaaaattccaatgaacaa

SEQ ID NO: 8628 - DNA, 22 bp, Artificial Sequence
  chemically synthesized
caatgaacaagatgacgacaaa

SEQ ID NO: 8629 - DNA, 22 bp, Artificial Sequence
  chemically synthesized
cactgatgactccaatgactag

SEQ ID NO: 8630 - DNA, 22 bp, Artificial Sequence
  chemically synthesized
atgactccaatgactagggtgc

SEQ ID NO: 8631 - DNA, 22 bp, Artificial Sequence
  chemically synthesized
caatgactagggtgccagacgg

SEQ ID NO: 8632 - DNA, 22 bp, Artificial Sequence
  chemically synthesized
gggtgccagacggtgagggctc

SEQ ID NO: 8633 - DNA, 22 bp, Artificial Sequence
  chemically synthesized
taaaacagaaaaagcaagttaa

SEQ ID NO: 8634 - DNA, 22 bp, Artificial Sequence
  chemically synthesized
aaacagaaaaagcaagttaaag

SEQ ID NO: 8635 - DNA, 22 bp, Artificial Sequence
  chemically synthesized
aagcctttgattgccaccctca

SEQ ID NO: 8636 - DNA, 22 bp, Artificial Sequence
  chemically synthesized
tgattgccaccctcagcccacc

SEQ ID NO: 8637 - DNA, 22 bp, Artificial Sequence
  chemically synthesized
gattgccaccctcagcccaccc

SEQ ID NO: 8638 - DNA, 22 bp, Artificial Sequence
  chemically synthesized
attgccaccctcagcccacccc

SEQ ID NO: 8639 - DNA, 22 bp, Artificial Sequence
  chemically synthesized
ccaccctcagcccaccccctaa

SEQ ID NO: 8640 - DNA, 22 bp, Artificial Sequence
  chemically synthesized
agcccaccccctaacaaagagc

SEQ ID NO: 8641 - DNA, 22 bp, Artificial Sequence
  chemically synthesized
acaaagagcagatcctcatctc

SEQ ID NO: 8642 - DNA, 22 bp, Artificial Sequence
  chemically synthesized
atctcactgccataattacctc

SEQ ID NO: 8643 - DNA, 22 bp, Artificial Sequence
  chemically synthesized
actgccataattacctcctcag

SEQ ID NO: 8644 - DNA, 22 bp, Artificial Sequence
  chemically synthesized
ccataattacctcctcaggcac

SEQ ID NO: 8645 - DNA, 22 bp, Artificial Sequence
  chemically synthesized
cctcctcaggcactcctctcaa

SEQ ID NO: 8646 - DNA, 22 bp, Artificial Sequence
  chemically synthesized
ctcaggcactcctctcaacccc

SEQ ID NO: 8647 - DNA, 22 bp, Artificial Sequence
  chemically synthesized
aggcactcctctcaacccccaa

SEQ ID NO: 8648 - DNA, 22 bp, Artificial Sequence
  chemically synthesized
ctctcaacccccaatagatttt

SEQ ID NO: 8649 - DNA, 22 bp, Artificial Sequence
  chemically synthesized
tcaacccccaatagattttctc

SEQ ID NO: 8650 - DNA, 22 bp, Artificial Sequence
  chemically synthesized
aacccccaatagattttctcag

SEQ ID NO: 8651 - DNA, 22 bp, Artificial Sequence
  chemically synthesized
tctcagctcctggctctcatca

SEQ ID NO: 8652 - DNA, 22 bp, Artificial Sequence
  chemically synthesized
ctcagctcctggctctcatcag

SEQ ID NO: 8653 - DNA, 22 bp, Artificial Sequence
  chemically synthesized
tcagctcctggctctcatcagt

SEQ ID NO: 8654 - DNA, 22 bp, Artificial Sequence
  chemically synthesized
agctcctggctctcatcagtca

SEQ ID NO: 8655 - DNA, 22 bp, Artificial Sequence
  chemically synthesized
ctggctctcatcagtcacatac

SEQ ID NO: 8656 - DNA, 22 bp, Artificial Sequence
  chemically synthesized
gctctcatcagtcacatacccc

SEQ ID NO: 8657 - DNA, 22 bp, Artificial Sequence
  chemically synthesized
tcatcagtcacataccccagat

SEQ ID NO: 8658 - DNA, 22 bp, Artificial Sequence
  chemically synthesized
atcagtcacataccccagatca

SEQ ID NO: 8659 - DNA, 22 bp, Artificial Sequence
  chemically synthesized
atccaggcctgggtgctccacc

SEQ ID NO: 8660 - DNA, 22 bp, Artificial Sequence
  chemically synthesized
ggtgctccacctggcacgtata

SEQ ID NO: 8661 - DNA, 22 bp, Artificial Sequence
  chemically synthesized
cacctggcacgtatatctctgc

SEQ ID NO: 8662 - DNA, 22 bp, Artificial Sequence
  chemically synthesized
gcacgtatatctctgctcttcc

SEQ ID NO: 8663 - DNA, 22 bp, Artificial Sequence
  chemically synthesized
tgctcttccccagggggtacag

SEQ ID NO: 8664 - DNA, 22 bp, Artificial Sequence
  chemically synthesized
ctcttccccagggggtacagcc

SEQ ID NO: 8665 - DNA, 22 bp, Artificial Sequence
  chemically synthesized
ttccccagggggtacagccaag

SEQ ID NO: 8666 - DNA, 22 bp, Artificial Sequence
  chemically synthesized
ccccagggggtacagccaaggt

SEQ ID NO: 8667 - DNA, 22 bp, Artificial Sequence
  chemically synthesized
cccagggggtacagccaaggtt

SEQ ID NO: 8668 - DNA, 22 bp, Artificial Sequence
  chemically synthesized
tccagccctggtaggtcccatc

SEQ ID NO: 8669 - DNA, 22 bp, Artificial Sequence
  chemically synthesized
gtaggtcccatccccattgggc

SEQ ID NO: 8670 - DNA, 22 bp, Artificial Sequence
  chemically synthesized
ggcaatacgtctttaggttcga

SEQ ID NO: 8671 - DNA, 22 bp, Artificial Sequence
  chemically synthesized
taggttcgaactccttggcatc

SEQ ID NO: 8672 - DNA, 22 bp, Artificial Sequence
  chemically synthesized
aggttcgaactccttggcatcc

SEQ ID NO: 8673 - DNA, 22 bp, Artificial Sequence
  chemically synthesized
ggttcgaactccttggcatcca

SEQ ID NO: 8674 - DNA, 22 bp, Artificial Sequence
  chemically synthesized
gaactccttggcatccattggc

SEQ ID NO: 8675 - DNA, 22 bp, Artificial Sequence
  chemically synthesized
cttggcatccattggctgctta

SEQ ID NO: 8676 - DNA, 22 bp, Artificial Sequence
  chemically synthesized
ggcatccattggctgcttatcc

SEQ ID NO: 8677 - DNA, 22 bp, Artificial Sequence
  chemically synthesized
gcatccattggctgcttatcct

SEQ ID NO: 8678 - DNA, 22 bp, Artificial Sequence
  chemically synthesized
gctgcttatccttcagccactt

SEQ ID NO: 8679 - DNA, 22 bp, Artificial Sequence
  chemically synthesized
cttatccttcagccacttcatg

SEQ ID NO: 8680 - DNA, 22 bp, Artificial Sequence
  chemically synthesized
atccttcagccacttcatggtg

SEQ ID NO: 8681 - DNA, 22 bp, Artificial Sequence
  chemically synthesized
tccttcagccacttcatggtga

SEQ ID NO: 8682 - DNA, 22 bp, Artificial Sequence
  chemically synthesized
cagccacttcatggtgatgttc

SEQ ID NO: 8683 - DNA, 22 bp, Artificial Sequence
  chemically synthesized
agccacttcatggtgatgttct

SEQ ID NO: 8684 - DNA, 22 bp, Artificial Sequence
  chemically synthesized
catggtgatgttctgggggtag

SEQ ID NO: 8685 - DNA, 22 bp, Artificial Sequence
  chemically synthesized
atggtgatgttctgggggtagt

SEQ ID NO: 8686 - DNA, 22 bp, Artificial Sequence
  chemically synthesized
tgggggtagtagttcaaggccc

SEQ ID NO: 8687 - DNA, 22 bp, Artificial Sequence
  chemically synthesized
ggggtagtagttcaaggcccga

SEQ ID NO: 8688 - DNA, 22 bp, Artificial Sequence
  chemically synthesized
aaggcccgacaccgtagagtgg

SEQ ID NO: 8689 - DNA, 22 bp, Artificial Sequence
  chemically synthesized
aagaggtcacatgatgtgtcac

SEQ ID NO: 8690 - DNA, 22 bp, Artificial Sequence
  chemically synthesized
caccaaaggaggcacttgacag

SEQ ID NO: 8691 - DNA, 22 bp, Artificial Sequence
  chemically synthesized
accaaaggaggcacttgacagg

SEQ ID NO: 8692 - DNA, 22 bp, Artificial Sequence
  chemically synthesized
gacaggaaagaggaaggatgag

SEQ ID NO: 8693 - DNA, 22 bp, Artificial Sequence
  chemically synthesized
acaggaaagaggaaggatgagg

SEQ ID NO: 8694 - DNA, 22 bp, Artificial Sequence
  chemically synthesized
tttacccttgccaggaagactg

SEQ ID NO: 8695 - DNA, 22 bp, Artificial Sequence
  chemically synthesized
acccttgccaggaagactggaa

SEQ ID NO: 8696 - DNA, 22 bp, Artificial Sequence
  chemically synthesized
cccttgccaggaagactggaac

SEQ ID NO: 8697 - DNA, 22 bp, Artificial Sequence
  chemically synthesized
gccaggaagactggaactttca

SEQ ID NO: 8698 - DNA, 22 bp, Artificial Sequence
  chemically synthesized
ccaggaagactggaactttcac

SEQ ID NO: 8699 - DNA, 22 bp, Artificial Sequence
  chemically synthesized
gaactttcacttccttctatag

SEQ ID NO: 8700 - DNA, 22 bp, Artificial Sequence
  chemically synthesized
tcacttccttctataggttgga

SEQ ID NO: 8701 - DNA, 22 bp, Artificial Sequence
  chemically synthesized
cacttccttctataggttggag

SEQ ID NO: 8702 - DNA, 22 bp, Artificial Sequence
  chemically synthesized
acttccttctataggttggagg

SEQ ID NO: 8703 - DNA, 22 bp, Artificial Sequence
  chemically synthesized
ccttctataggttggaggaagg

SEQ ID NO: 8704 - DNA, 22 bp, Artificial Sequence
  chemically synthesized
cttctataggttggaggaagga

SEQ ID NO: 8705 - DNA, 22 bp, Artificial Sequence
  chemically synthesized
ctataggttggaggaaggaaat

SEQ ID NO: 8706 - DNA, 22 bp, Artificial Sequence
  chemically synthesized
tataggttggaggaaggaaata

SEQ ID NO: 8707 - DNA, 22 bp, Artificial Sequence
  chemically synthesized
taggttggaggaaggaaatacc

SEQ ID NO: 8708 - DNA, 22 bp, Artificial Sequence
  chemically synthesized
gaggaaggaaatacccttttca

SEQ ID NO: 8709 - DNA, 22 bp, Artificial Sequence
  chemically synthesized
ttcagaaaaaaacaagctacag

SEQ ID NO: 8710 - DNA, 22 bp, Artificial Sequence
  chemically synthesized
tcagaaaaaaacaagctacagg

SEQ ID NO: 8711 - DNA, 22 bp, Artificial Sequence
  chemically synthesized
cagaaaaaaacaagctacagga

SEQ ID NO: 8712 - DNA, 22 bp, Artificial Sequence
  chemically synthesized
agaaaaaaacaagctacaggag

SEQ ID NO: 8713 - DNA, 22 bp, Artificial Sequence
  chemically synthesized
caggagagacaccattttgtgt

SEQ ID NO: 8714 - DNA, 22 bp, Artificial Sequence
  chemically synthesized
tgtgtcctaagattggactcta

SEQ ID NO: 8715 - DNA, 22 bp, Artificial Sequence
  chemically synthesized
gtgtcctaagattggactctaa

SEQ ID NO: 8716 - DNA, 22 bp, Artificial Sequence
  chemically synthesized
tgtcctaagattggactctaac

SEQ ID NO: 8717 - DNA, 22 bp, Artificial Sequence
  chemically synthesized
agattggactctaacacagtgt

SEQ ID NO: 8718 - DNA, 22 bp, Artificial Sequence
  chemically synthesized
gactctaacacagtgtcacttg

SEQ ID NO: 8719 - DNA, 22 bp, Artificial Sequence
  chemically synthesized
taacacagtgtcacttggagag

SEQ ID NO: 8720 - DNA, 22 bp, Artificial Sequence
  chemically synthesized
acacagtgtcacttggagagca

SEQ ID NO: 8721 - DNA, 22 bp, Artificial Sequence
  chemically synthesized
ggagagcagtcagatcagcttg

SEQ ID NO: 8722 - DNA, 22 bp, Artificial Sequence
  chemically synthesized
gagagcagtcagatcagcttgt

SEQ ID NO: 8723 - DNA, 22 bp, Artificial Sequence
  chemically synthesized
gttctcctcacatgtaaatata

SEQ ID NO: 8724 - DNA, 22 bp, Artificial Sequence
  chemically synthesized
ttctcctcacatgtaaatatac

SEQ ID NO: 8725 - DNA, 22 bp, Artificial Sequence
  chemically synthesized
tcctcacatgtaaatatacata

SEQ ID NO: 8726 - DNA, 22 bp, Artificial Sequence
  chemically synthesized
ctcacatgtaaatatacatatc

SEQ ID NO: 8727 - DNA, 22 bp, Artificial Sequence
  chemically synthesized
acatgtaaatatacatatctgt

SEQ ID NO: 8728 - DNA, 22 bp, Artificial Sequence
  chemically synthesized
ttacccatgttctttgttctga

SEQ ID NO: 8729 - DNA, 22 bp, Artificial Sequence
  chemically synthesized
cccatgttctttgttctgatag

SEQ ID NO: 8730 - DNA, 22 bp, Artificial Sequence
  chemically synthesized
tttgttctgatagataaaattg

SEQ ID NO: 8731 - DNA, 22 bp, Artificial Sequence
  chemically synthesized
tgttctgatagataaaattgcc

SEQ ID NO: 8732 - DNA, 22 bp, Artificial Sequence
  chemically synthesized
gttctgatagataaaattgccc

SEQ ID NO: 8733 - DNA, 22 bp, Artificial Sequence
  chemically synthesized
ttctgatagataaaattgccct

SEQ ID NO: 8734 - DNA, 22 bp, Artificial Sequence
  chemically synthesized
tgatagataaaattgcccttta

SEQ ID NO: 8735 - DNA, 22 bp, Artificial Sequence
  chemically synthesized
atagataaaattgccctttatg

SEQ ID NO: 8736 - DNA, 22 bp, Artificial Sequence
  chemically synthesized
ccctttatgtgcattgaaaatg

SEQ ID NO: 8737 - DNA, 22 bp, Artificial Sequence
  chemically synthesized
tatgtgcattgaaaatgattga

SEQ ID NO: 8738 - DNA, 22 bp, Artificial Sequence
  chemically synthesized
atgtgcattgaaaatgattgaa

SEQ ID NO: 8739 - DNA, 22 bp, Artificial Sequence
  chemically synthesized
tgtgcattgaaaatgattgaat

SEQ ID NO: 8740 - DNA, 22 bp, Artificial Sequence
  chemically synthesized
aaaatgattgaatacagatggt

SEQ ID NO: 8741 - DNA, 22 bp, Artificial Sequence
  chemically synthesized
aatacagatggtcagtttcacc

SEQ ID NO: 8742 - DNA, 22 bp, Artificial Sequence
  chemically synthesized
cacctgggtcaacctaggaggc

SEQ ID NO: 8743 - DNA, 22 bp, Artificial Sequence
  chemically synthesized
acctgggtcaacctaggaggca

SEQ ID NO: 8744 - DNA, 22 bp, Artificial Sequence
  chemically synthesized
ggtcaacctaggaggcattgtt

SEQ ID NO: 8745 - DNA, 22 bp, Artificial Sequence
  chemically synthesized
ggaggcattgttataagaagcg

SEQ ID NO: 8746 - DNA, 22 bp, Artificial Sequence
  chemically synthesized
ttataagaagcggacttgtaag

SEQ ID NO: 8747 - DNA, 22 bp, Artificial Sequence
  chemically synthesized
taagaagcggacttgtaagata

SEQ ID NO: 8748 - DNA, 22 bp, Artificial Sequence
  chemically synthesized
gtaagataggtagcttcagtga

SEQ ID NO: 8749 - DNA, 22 bp, Artificial Sequence
  chemically synthesized
taagataggtagcttcagtgat

SEQ ID NO: 8750 - DNA, 22 bp, Artificial Sequence
  chemically synthesized
cagtgattattgctatgttcta

SEQ ID NO: 8751 - DNA, 22 bp, Artificial Sequence
  chemically synthesized
agtgattattgctatgttctat

SEQ ID NO: 8752 - DNA, 22 bp, Artificial Sequence
  chemically synthesized
ttgctatgttctatgaaagaaa

SEQ ID NO: 8753 - DNA, 22 bp, Artificial Sequence
  chemically synthesized
ctatgttctatgaaagaaactt

SEQ ID NO: 8754 - DNA, 22 bp, Artificial Sequence
  chemically synthesized
tgttctatgaaagaaactttta

SEQ ID NO: 8755 - DNA, 22 bp, Artificial Sequence
  chemically synthesized
tatgaaagaaacttttaaccta

SEQ ID NO: 8756 - DNA, 22 bp, Artificial Sequence
  chemically synthesized
tgaaagaaacttttaacctaaa

SEQ ID NO: 8757 - DNA, 22 bp, Artificial Sequence
  chemically synthesized
ttaacctaaaggattcttctac

SEQ ID NO: 8758 - DNA, 22 bp, Artificial Sequence
  chemically synthesized
taacctaaaggattcttctact

SEQ ID NO: 8759 - DNA, 22 bp, Artificial Sequence
  chemically synthesized
aacctaaaggattcttctactc

SEQ ID NO: 8760 - DNA, 22 bp, Artificial Sequence
  chemically synthesized
acctaaaggattcttctactct

SEQ ID NO: 8761 - DNA, 22 bp, Artificial Sequence
  chemically synthesized
aaggattcttctactctgataa

SEQ ID NO: 8762 - DNA, 22 bp, Artificial Sequence
  chemically synthesized
ttctactctgataagtggcctc

SEQ ID NO: 8763 - DNA, 22 bp, Artificial Sequence
  chemically synthesized
ctactctgataagtggcctcac

SEQ ID NO: 8764 - DNA, 22 bp, Artificial Sequence
  chemically synthesized
tactctgataagtggcctcact

SEQ ID NO: 8765 - DNA, 22 bp, Artificial Sequence
  chemically synthesized
ctctgataagtggcctcacttg

SEQ ID NO: 8766 - DNA, 22 bp, Artificial Sequence
  chemically synthesized
tgataagtggcctcacttgata

SEQ ID NO: 8767 - DNA, 22 bp, Artificial Sequence
  chemically synthesized
ataagtggcctcacttgatatt

SEQ ID NO: 8768 - DNA, 22 bp, Artificial Sequence
  chemically synthesized
acttgatattttgtcctggtat

SEQ ID NO: 8769 - DNA, 22 bp, Artificial Sequence
  chemically synthesized
gatattttgtcctggtattcat

SEQ ID NO: 8770 - DNA, 22 bp, Artificial Sequence
  chemically synthesized
atattttgtcctggtattcata

SEQ ID NO: 8771 - DNA, 22 bp, Artificial Sequence
  chemically synthesized
tgtcctggtattcatatgatag

SEQ ID NO: 8772 - DNA, 22 bp, Artificial Sequence
  chemically synthesized
gtcctggtattcatatgatagc

SEQ ID NO: 8773 - DNA, 22 bp, Artificial Sequence
  chemically synthesized
tcctggtattcatatgatagct

SEQ ID NO: 8774 - DNA, 22 bp, Artificial Sequence
  chemically synthesized
gtattcatatgatagctgagat

SEQ ID NO: 8775 - DNA, 22 bp, Artificial Sequence
  chemically synthesized
atatgatagctgagatctctga

SEQ ID NO: 8776 - DNA, 22 bp, Artificial Sequence
  chemically synthesized
agatctctgaattctctttttt

SEQ ID NO: 8777 - DNA, 22 bp, Artificial Sequence
  chemically synthesized
tgaattctcttttttttttttt

SEQ ID NO: 8778 - DNA, 22 bp, Artificial Sequence
  chemically synthesized
aattctcttttttttttttttt

SEQ ID NO: 8779 - DNA, 22 bp, Artificial Sequence
  chemically synthesized
tctttttttttttttttttttt

SEQ ID NO: 8780 - DNA, 22 bp, Artificial Sequence
  chemically synthesized
tttttttttttttttttttttt

SEQ ID NO: 8781 - DNA, 22 bp, Artificial Sequence
  chemically synthesized
ttttttttttttttttttttta

SEQ ID NO: 8782 - DNA, 22 bp, Artificial Sequence
  chemically synthesized
ttttttttttttttttttttaa

SEQ ID NO: 8783 - DNA, 22 bp, Artificial Sequence
  chemically synthesized
tttttttttttttttttttaag

SEQ ID NO: 8784 - DNA, 22 bp, Artificial Sequence
  chemically synthesized
ttttttttttttttttttaaga

SEQ ID NO: 8785 - DNA, 22 bp, Artificial Sequence
  chemically synthesized
tttttttttttttttttaagat

SEQ ID NO: 8786 - DNA, 22 bp, Artificial Sequence
  chemically synthesized
ttttttttttttttttaagatg

SEQ ID NO: 8787 - DNA, 22 bp, Artificial Sequence
  chemically synthesized
tttttttttttttttaagatgg

SEQ ID NO: 8788 - DNA, 22 bp, Artificial Sequence
  chemically synthesized
ttttttttttttttaagatgga

SEQ ID NO: 8789 - DNA, 22 bp, Artificial Sequence
  chemically synthesized
tttttttttttttaagatggag

SEQ ID NO: 8790 - DNA, 22 bp, Artificial Sequence
  chemically synthesized
ttttttttttttaagatggagt

SEQ ID NO: 8791 - DNA, 22 bp, Artificial Sequence
  chemically synthesized
tttttttttttaagatggagtc

SEQ ID NO: 8792 - DNA, 22 bp, Artificial Sequence
  chemically synthesized
ttttttttttaagatggagtct

SEQ ID NO: 8793 - DNA, 22 bp, Artificial Sequence
  chemically synthesized
tttttttttaagatggagtctc

SEQ ID NO: 8794 - DNA, 22 bp, Artificial Sequence
  chemically synthesized
ttttttttaagatggagtctca

SEQ ID NO: 8795 - DNA, 22 bp, Artificial Sequence
  chemically synthesized
tttttttaagatggagtctcac

SEQ ID NO: 8796 - DNA, 22 bp, Artificial Sequence
  chemically synthesized
ttttttaagatggagtctcact

SEQ ID NO: 8797 - DNA, 22 bp, Artificial Sequence
  chemically synthesized
tttttaagatggagtctcactc

SEQ ID NO: 8798 - DNA, 22 bp, Artificial Sequence
  chemically synthesized
ttttaagatggagtctcactct

SEQ ID NO: 8799 - DNA, 22 bp, Artificial Sequence
  chemically synthesized
tttaagatggagtctcactctg

SEQ ID NO: 8800 - DNA, 22 bp, Artificial Sequence
  chemically synthesized
ttaagatggagtctcactctgc

SEQ ID NO: 8801 - DNA, 22 bp, Artificial Sequence
  chemically synthesized
taagatggagtctcactctgct

SEQ ID NO: 8802 - DNA, 22 bp, Artificial Sequence
  chemically synthesized
aagatggagtctcactctgctg

SEQ ID NO: 8803 - DNA, 22 bp, Artificial Sequence
  chemically synthesized
agatggagtctcactctgctgc

SEQ ID NO: 8804 - DNA, 22 bp, Artificial Sequence
  chemically synthesized
actctgctgcctaggctggagt

SEQ ID NO: 8805 - DNA, 22 bp, Artificial Sequence
  chemically synthesized
tgctgcctaggctggagtgcag

SEQ ID NO: 8806 - DNA, 22 bp, Artificial Sequence
  chemically synthesized
ctgcctaggctggagtgcagtg

SEQ ID NO: 8807 - DNA, 22 bp, Artificial Sequence
  chemically synthesized
cctaggctggagtgcagtggcg

SEQ ID NO: 8808 - DNA, 22 bp, Artificial Sequence
  chemically synthesized
ggctggagtgcagtggcgcgat

SEQ ID NO: 8809 - DNA, 22 bp, Artificial Sequence
  chemically synthesized
gagtgcagtggcgcgatcttgg

SEQ ID NO: 8810 - DNA, 22 bp, Artificial Sequence
  chemically synthesized
ggctcagtgcaacttccgcttc

SEQ ID NO: 8811 - DNA, 22 bp, Artificial Sequence
  chemically synthesized
gctcagtgcaacttccgcttcc

SEQ ID NO: 8812 - DNA, 22 bp, Artificial Sequence
  chemically synthesized
agtgcaacttccgcttcccagg

SEQ ID NO: 8813 - DNA, 22 bp, Artificial Sequence
  chemically synthesized
ccgcttcccaggttcaagcgat

SEQ ID NO: 8814 - DNA, 22 bp, Artificial Sequence
  chemically synthesized
cgcttcccaggttcaagcgatg

SEQ ID NO: 8815 - DNA, 22 bp, Artificial Sequence
  chemically synthesized
cccaggttcaagcgatgctcct

SEQ ID NO: 8816 - DNA, 22 bp, Artificial Sequence
  chemically synthesized
ccaggttcaagcgatgctcctg

SEQ ID NO: 8817 - DNA, 22 bp, Artificial Sequence
  chemically synthesized
aagcgatgctcctgcctcagcc

SEQ ID NO: 8818 - DNA, 22 bp, Artificial Sequence
  chemically synthesized
ctgcctcagccttccaattagc

SEQ ID NO: 8819 - DNA, 22 bp, Artificial Sequence
  chemically synthesized
cctcagccttccaattagctgg

SEQ ID NO: 8820 - DNA, 22 bp, Artificial Sequence
  chemically synthesized
agccttccaattagctgggact

SEQ ID NO: 8821 - DNA, 22 bp, Artificial Sequence
  chemically synthesized
ccaattagctgggactacaggt

SEQ ID NO: 8822 - DNA, 22 bp, Artificial Sequence
  chemically synthesized
caattagctgggactacaggtg

SEQ ID NO: 8823 - DNA, 22 bp, Artificial Sequence
  chemically synthesized
gctgggactacaggtgcgcatg

SEQ ID NO: 8824 - DNA, 22 bp, Artificial Sequence
  chemically synthesized
ggactacaggtgcgcatgactg

SEQ ID NO: 8825 - DNA, 22 bp, Artificial Sequence
  chemically synthesized
caggtgcgcatgactgtgacca

SEQ ID NO: 8826 - DNA, 22 bp, Artificial Sequence
  chemically synthesized
tgaccagctaatttttgtattt

SEQ ID NO: 8827 - DNA, 22 bp, Artificial Sequence
  chemically synthesized
atttttgtatttttttagagac

SEQ ID NO: 8828 - DNA, 22 bp, Artificial Sequence
  chemically synthesized
ttgtatttttttagagacgggt

SEQ ID NO: 8829 - DNA, 22 bp, Artificial Sequence
  chemically synthesized
tgtatttttttagagacgggtt

SEQ ID NO: 8830 - DNA, 22 bp, Artificial Sequence
  chemically synthesized
gtatttttttagagacgggttt

SEQ ID NO: 8831 - DNA, 22 bp, Artificial Sequence
  chemically synthesized
tatttttttagagacgggtttc

SEQ ID NO: 8832 - DNA, 22 bp, Artificial Sequence
  chemically synthesized
ttttagagacgggtttcaccat

SEQ ID NO: 8833 - DNA, 22 bp, Artificial Sequence
  chemically synthesized
tttagagacgggtttcaccatg

SEQ ID NO: 8834 - DNA, 22 bp, Artificial Sequence
  chemically synthesized
ttagagacgggtttcaccatgt

SEQ ID NO: 8835 - DNA, 22 bp, Artificial Sequence
  chemically synthesized
tagagacgggtttcaccatgtt

SEQ ID NO: 8836 - DNA, 22 bp, Artificial Sequence
  chemically synthesized
agagacgggtttcaccatgttg

SEQ ID NO: 8837 - DNA, 22 bp, Artificial Sequence
  chemically synthesized
gagacgggtttcaccatgttgg

SEQ ID NO: 8838 - DNA, 22 bp, Artificial Sequence
  chemically synthesized
caccatgttggtcaggctggtc

SEQ ID NO: 8839 - DNA, 22 bp, Artificial Sequence
  chemically synthesized
accatgttggtcaggctggtct

SEQ ID NO: 8840 - DNA, 22 bp, Artificial Sequence
  chemically synthesized
gtcaggctggtctcaaactcct

SEQ ID NO: 8841 - DNA, 22 bp, Artificial Sequence
  chemically synthesized
gtctcaaactcctgaccttgtg

SEQ ID NO: 8842 - DNA, 22 bp, Artificial Sequence
  chemically synthesized
aaactcctgaccttgtgaccac

SEQ ID NO: 8843 - DNA, 22 bp, Artificial Sequence
  chemically synthesized
ctgaccttgtgaccacccgcct

SEQ ID NO: 8844 - DNA, 22 bp, Artificial Sequence
  chemically synthesized
accttgtgaccacccgcctcgg

SEQ ID NO: 8845 - DNA, 22 bp, Artificial Sequence
  chemically synthesized
gtgaccacccgcctcggcctcc

SEQ ID NO: 8846 - DNA, 22 bp, Artificial Sequence
  chemically synthesized
tgaccacccgcctcggcctccc

SEQ ID NO: 8847 - DNA, 22 bp, Artificial Sequence
  chemically synthesized
ggcctcccaaagtgctgggatt

SEQ ID NO: 8848 - DNA, 22 bp, Artificial Sequence
  chemically synthesized
ccaaagtgctgggattacaggg

SEQ ID NO: 8849 - DNA, 22 bp, Artificial Sequence
  chemically synthesized
ggattacaggggtgagccaccg

SEQ ID NO: 8850 - DNA, 22 bp, Artificial Sequence
  chemically synthesized
caggggtgagccaccgtgcccg

SEQ ID NO: 8851 - DNA, 22 bp, Artificial Sequence
  chemically synthesized
gacatttctgaatttttaacag

SEQ ID NO: 8852 - DNA, 22 bp, Artificial Sequence
  chemically synthesized
acatttctgaatttttaacagg

SEQ ID NO: 8853 - DNA, 22 bp, Artificial Sequence
  chemically synthesized
ctgaatttttaacaggtataaa

SEQ ID NO: 8854 - DNA, 22 bp, Artificial Sequence
  chemically synthesized
tgaatttttaacaggtataaat

SEQ ID NO: 8855 - DNA, 22 bp, Artificial Sequence
  chemically synthesized
aatttttaacaggtataaatat

SEQ ID NO: 8856 - DNA, 22 bp, Artificial Sequence
  chemically synthesized
ttaacaggtataaatatacaaa

SEQ ID NO: 8857 - DNA, 22 bp, Artificial Sequence
  chemically synthesized
taacaggtataaatatacaaaa

SEQ ID NO: 8858 - DNA, 22 bp, Artificial Sequence
  chemically synthesized
aacaggtataaatatacaaaag

SEQ ID NO: 8859 - DNA, 22 bp, Artificial Sequence
  chemically synthesized
acaggtataaatatacaaaaga

SEQ ID NO: 8860 - DNA, 22 bp, Artificial Sequence
  chemically synthesized
ttggttaaataaaaagcaaggg

SEQ ID NO: 8861 - DNA, 22 bp, Artificial Sequence
  chemically synthesized
gttaaataaaaagcaagggcca

SEQ ID NO: 8862 - DNA, 22 bp, Artificial Sequence
  chemically synthesized
aataaaaagcaagggccataga

SEQ ID NO: 8863 - DNA, 22 bp, Artificial Sequence
  chemically synthesized
ccctttgagccatatgcatgga

SEQ ID NO: 8864 - DNA, 22 bp, Artificial Sequence
  chemically synthesized
cctttgagccatatgcatggag

SEQ ID NO: 8865 - DNA, 22 bp, Artificial Sequence
  chemically synthesized
tgagccatatgcatggagaaaa

SEQ ID NO: 8866 - DNA, 22 bp, Artificial Sequence
  chemically synthesized
gagccatatgcatggagaaaag

SEQ ID NO: 8867 - DNA, 22 bp, Artificial Sequence
  chemically synthesized
agccatatgcatggagaaaaga

SEQ ID NO: 8868 - DNA, 22 bp, Artificial Sequence
  chemically synthesized
aacccatgacttgtggctgtct

SEQ ID NO: 8869 - DNA, 22 bp, Artificial Sequence
  chemically synthesized
gtggctgtctcatacatctcaa

SEQ ID NO: 8870 - DNA, 22 bp, Artificial Sequence
  chemically synthesized
tggctgtctcatacatctcaat

SEQ ID NO: 8871 - DNA, 22 bp, Artificial Sequence
  chemically synthesized
tctcatacatctcaattataag

SEQ ID NO: 8872 - DNA, 22 bp, Artificial Sequence
  chemically synthesized
atacatctcaattataaggtag

SEQ ID NO: 8873 - DNA, 22 bp, Artificial Sequence
  chemically synthesized
aattataaggtagagactctag

SEQ ID NO: 8874 - DNA, 22 bp, Artificial Sequence
  chemically synthesized
taaggtagagactctaggattg

SEQ ID NO: 8875 - DNA, 22 bp, Artificial Sequence
  chemically synthesized
taggattgagaaagtcccttcc

SEQ ID NO: 8876 - DNA, 22 bp, Artificial Sequence
  chemically synthesized
ggattgagaaagtcccttccca

SEQ ID NO: 8877 - DNA, 22 bp, Artificial Sequence
  chemically synthesized
agaaagtcccttcccagaattt

SEQ ID NO: 8878 - DNA, 22 bp, Artificial Sequence
  chemically synthesized
cccagaatttggagaggcacac

SEQ ID NO: 8879 - DNA, 22 bp, Artificial Sequence
  chemically synthesized
ccagaatttggagaggcacaca

SEQ ID NO: 8880 - DNA, 22 bp, Artificial Sequence
  chemically synthesized
ggagaggcacacagcctcagcc

SEQ ID NO: 8881 - DNA, 22 bp, Artificial Sequence
  chemically synthesized
gagaggcacacagcctcagcca

SEQ ID NO: 8882 - DNA, 22 bp, Artificial Sequence
  chemically synthesized
agccacctctgaaactccaacc

SEQ ID NO: 8883 - DNA, 22 bp, Artificial Sequence
  chemically synthesized
tgaaactccaaccagggattcc

SEQ ID NO: 8884 - DNA, 22 bp, Artificial Sequence
  chemically synthesized
aaactccaaccagggattccgt

SEQ ID NO: 8885 - DNA, 22 bp, Artificial Sequence
  chemically synthesized
caaccagggattccgtgccctg

SEQ ID NO: 8886 - DNA, 22 bp, Artificial Sequence
  chemically synthesized
cgtgccctgcaacctcctccac

SEQ ID NO: 8887 - DNA, 22 bp, Artificial Sequence
  chemically synthesized
caacctcctccactctgccact

SEQ ID NO: 8888 - DNA, 22 bp, Artificial Sequence
  chemically synthesized
ctccactctgccactagagtat

SEQ ID NO: 8889 - DNA, 22 bp, Artificial Sequence
  chemically synthesized
cactctgccactagagtatagg

SEQ ID NO: 8890 - DNA, 22 bp, Artificial Sequence
  chemically synthesized
tgccactagagtataggggcag

SEQ ID NO: 8891 - DNA, 22 bp, Artificial Sequence
  chemically synthesized
ccactagagtataggggcagaa

SEQ ID NO: 8892 - DNA, 22 bp, Artificial Sequence
  chemically synthesized
gagtataggggcagaagtgtgt

SEQ ID NO: 8893 - DNA, 22 bp, Artificial Sequence
  chemically synthesized
ccaccataccttgttggtccaa

SEQ ID NO: 8894 - DNA, 22 bp, Artificial Sequence
  chemically synthesized
caccataccttgttggtccaaa

SEQ ID NO: 8895 - DNA, 22 bp, Artificial Sequence
  chemically synthesized
gttggtccaaaacacctctccc

SEQ ID NO: 8896 - DNA, 22 bp, Artificial Sequence
  chemically synthesized
ttggtccaaaacacctctcccc

SEQ ID NO: 8897 - DNA, 22 bp, Artificial Sequence
  chemically synthesized
gtccaaaacacctctccccagc

SEQ ID NO: 8898 - DNA, 22 bp, Artificial Sequence
  chemically synthesized
tccccagctccagcaactgctg

SEQ ID NO: 8899 - DNA, 22 bp, Artificial Sequence
  chemically synthesized
cccagctccagcaactgctgca

SEQ ID NO: 8900 - DNA, 22 bp, Artificial Sequence
  chemically synthesized
cagcaactgctgcagctgtgca

SEQ ID NO: 8901 - DNA, 22 bp, Artificial Sequence
  chemically synthesized
ctgcagctgtgcagggcagtcc

SEQ ID NO: 8902 - DNA, 22 bp, Artificial Sequence
  chemically synthesized
cagctgtgcagggcagtccctc

SEQ ID NO: 8903 - DNA, 22 bp, Artificial Sequence
  chemically synthesized
tgcagggcagtccctctccagg

SEQ ID NO: 8904 - DNA, 22 bp, Artificial Sequence
  chemically synthesized
tccaggtaggccctgttctgcc

SEQ ID NO: 8905 - DNA, 22 bp, Artificial Sequence
  chemically synthesized
caggtaggccctgttctgcctg

SEQ ID NO: 8906 - DNA, 22 bp, Artificial Sequence
  chemically synthesized
ttctgcctggcccgaatcttgt

SEQ ID NO: 8907 - DNA, 22 bp, Artificial Sequence
  chemically synthesized
tgcctggcccgaatcttgtgcc

SEQ ID NO: 8908 - DNA, 22 bp, Artificial Sequence
  chemically synthesized
cctggcccgaatcttgtgcctt

SEQ ID NO: 8909 - DNA, 22 bp, Artificial Sequence
  chemically synthesized
gcccgaatcttgtgcctttccc

SEQ ID NO: 8910 - DNA, 22 bp, Artificial Sequence
  chemically synthesized
gtgcctttcccactccagcttg

SEQ ID NO: 8911 - DNA, 22 bp, Artificial Sequence
  chemically synthesized
tgcctttcccactccagcttgg

SEQ ID NO: 8912 - DNA, 22 bp, Artificial Sequence
  chemically synthesized
tcccactccagcttggtgggcc

SEQ ID NO: 8913 - DNA, 22 bp, Artificial Sequence
  chemically synthesized
cccactccagcttggtgggcca

SEQ ID NO: 8914 - DNA, 22 bp, Artificial Sequence
  chemically synthesized
ccactccagcttggtgggccag

SEQ ID NO: 8915 - DNA, 22 bp, Artificial Sequence
  chemically synthesized
cagcttggtgggccaggccctg

SEQ ID NO: 8916 - DNA, 22 bp, Artificial Sequence
  chemically synthesized
ggtgggccaggccctgggttct

SEQ ID NO: 8917 - DNA, 22 bp, Artificial Sequence
  chemically synthesized
gtgggccaggccctgggttctg

SEQ ID NO: 8918 - DNA, 22 bp, Artificial Sequence
  chemically synthesized
ggttctgctgctctccaatcca

SEQ ID NO: 8919 - DNA, 22 bp, Artificial Sequence
  chemically synthesized
tgctgctctccaatccagtgtg

SEQ ID NO: 8920 - DNA, 22 bp, Artificial Sequence
  chemically synthesized
ctgctctccaatccagtgtgtc

SEQ ID NO: 8921 - DNA, 22 bp, Artificial Sequence
  chemically synthesized
ctctccaatccagtgtgtcagg

SEQ ID NO: 8922 - DNA, 22 bp, Artificial Sequence
  chemically synthesized
tccaatccagtgtgtcagggca

SEQ ID NO: 8923 - DNA, 22 bp, Artificial Sequence
  chemically synthesized
caatccagtgtgtcagggcaga

SEQ ID NO: 8924 - DNA, 22 bp, Artificial Sequence
  chemically synthesized
aaggtggtcctgcccatcatac

SEQ ID NO: 8925 - DNA, 22 bp, Artificial Sequence
  chemically synthesized
cccatcatacccgtacttccag

SEQ ID NO: 8926 - DNA, 22 bp, Artificial Sequence
  chemically synthesized
ccagtagccctcggtactgttg

SEQ ID NO: 8927 - DNA, 22 bp, Artificial Sequence
  chemically synthesized
cagtagccctcggtactgttgt

SEQ ID NO: 8928 - DNA, 22 bp, Artificial Sequence
  chemically synthesized
ggtactgttgtcttcttgcatt

SEQ ID NO: 8929 - DNA, 22 bp, Artificial Sequence
  chemically synthesized
ttgtcttcttgcatttcacagc

SEQ ID NO: 8930 - DNA, 22 bp, Artificial Sequence
  chemically synthesized
tcttcttgcatttcacagccca

SEQ ID NO: 8931 - DNA, 22 bp, Artificial Sequence
  chemically synthesized
cttgcatttcacagcccaggat

SEQ ID NO: 8932 - DNA, 22 bp, Artificial Sequence
  chemically synthesized
ttgcatttcacagcccaggatg

SEQ ID NO: 8933 - DNA, 22 bp, Artificial Sequence
  chemically synthesized
gcatttcacagcccaggatgac

SEQ ID NO: 8934 - DNA, 22 bp, Artificial Sequence
  chemically synthesized
catttcacagcccaggatgacc

SEQ ID NO: 8935 - DNA, 22 bp, Artificial Sequence
  chemically synthesized
cacagcccaggatgacctgcag

SEQ ID NO: 8936 - DNA, 22 bp, Artificial Sequence
  chemically synthesized
acagcccaggatgacctgcagg

SEQ ID NO: 8937 - DNA, 22 bp, Artificial Sequence
  chemically synthesized
cagggtgtgggactctggaaaa

SEQ ID NO: 8938 - DNA, 22 bp, Artificial Sequence
  chemically synthesized
tggaaaaatccccagccttgtt

SEQ ID NO: 8939 - DNA, 22 bp, Artificial Sequence
  chemically synthesized
gaaaaatccccagccttgttaa

SEQ ID NO: 8940 - DNA, 22 bp, Artificial Sequence
  chemically synthesized
gttaactgcaaccaaaggaata

SEQ ID NO: 8941 - DNA, 22 bp, Artificial Sequence
  chemically synthesized
ttaactgcaaccaaaggaatag

SEQ ID NO: 8942 - DNA, 22 bp, Artificial Sequence
  chemically synthesized
actgcaaccaaaggaataggtc

SEQ ID NO: 8943 - DNA, 22 bp, Artificial Sequence
  chemically synthesized
caaccaaaggaataggtcccta

SEQ ID NO: 8944 - DNA, 22 bp, Artificial Sequence
  chemically synthesized
tttccaccatccccaaggacca

SEQ ID NO: 8945 - DNA, 22 bp, Artificial Sequence
  chemically synthesized
ccaccatccccaaggaccaaat

SEQ ID NO: 8946 - DNA, 22 bp, Artificial Sequence
  chemically synthesized
caccatccccaaggaccaaatg

SEQ ID NO: 8947 - DNA, 22 bp, Artificial Sequence
  chemically synthesized
aggaagcaaattccttccctct

SEQ ID NO: 8948 - DNA, 22 bp, Artificial Sequence
  chemically synthesized
cttccctcttccctgctcccac

SEQ ID NO: 8949 - DNA, 22 bp, Artificial Sequence
  chemically synthesized
ccctcttccctgctcccacaag

SEQ ID NO: 8950 - DNA, 22 bp, Artificial Sequence
  chemically synthesized
cctcttccctgctcccacaaga

SEQ ID NO: 8951 - DNA, 22 bp, Artificial Sequence
  chemically synthesized
ttccctgctcccacaagacctc

SEQ ID NO: 8952 - DNA, 22 bp, Artificial Sequence
  chemically synthesized
ccctgctcccacaagacctcag

SEQ ID NO: 8953 - DNA, 22 bp, Artificial Sequence
  chemically synthesized
cctgctcccacaagacctcaga

SEQ ID NO: 8954 - DNA, 22 bp, Artificial Sequence
  chemically synthesized
ctcccacaagacctcagacttc

SEQ ID NO: 8955 - DNA, 22 bp, Artificial Sequence
  chemically synthesized
ccacaagacctcagacttccag

SEQ ID NO: 8956 - DNA, 22 bp, Artificial Sequence
  chemically synthesized
agacttccagctgtttccttca

SEQ ID NO: 8957 - DNA, 22 bp, Artificial Sequence
  chemically synthesized
ccagctgtttccttcaagatgc

SEQ ID NO: 8958 - DNA, 22 bp, Artificial Sequence
  chemically synthesized
cagctgtttccttcaagatgca

SEQ ID NO: 8959 - DNA, 22 bp, Artificial Sequence
  chemically synthesized
tttccttcaagatgcatgaaaa

SEQ ID NO: 8960 - DNA, 22 bp, Artificial Sequence
  chemically synthesized
ccttcaagatgcatgaaaagat

SEQ ID NO: 8961 - DNA, 22 bp, Artificial Sequence
  chemically synthesized
cttcaagatgcatgaaaagatg

SEQ ID NO: 8962 - DNA, 22 bp, Artificial Sequence
  chemically synthesized
caagatgcatgaaaagatgaaa

SEQ ID NO: 8963 - DNA, 22 bp, Artificial Sequence
  chemically synthesized
aagatgcatgaaaagatgaaaa

SEQ ID NO: 8964 - DNA, 22 bp, Artificial Sequence
  chemically synthesized
tgacaacctcaggaaggtgagg

SEQ ID NO: 8965 - DNA, 22 bp, Artificial Sequence
  chemically synthesized
acaacctcaggaaggtgaggcc

SEQ ID NO: 8966 - DNA, 22 bp, Artificial Sequence
  chemically synthesized
aggaaggtgaggccccctctcc

SEQ ID NO: 8967 - DNA, 22 bp, Artificial Sequence
  chemically synthesized
tccacatacccttgctgtggtt

SEQ ID NO: 8968 - DNA, 22 bp, Artificial Sequence
  chemically synthesized
cacatacccttgctgtggttgt

SEQ ID NO: 8969 - DNA, 22 bp, Artificial Sequence
  chemically synthesized
gctgtggttgtgattttccata

SEQ ID NO: 8970 - DNA, 22 bp, Artificial Sequence
  chemically synthesized
ctgtggttgtgattttccataa

SEQ ID NO: 8971 - DNA, 22 bp, Artificial Sequence
  chemically synthesized
tggttgtgattttccataatag

SEQ ID NO: 8972 - DNA, 22 bp, Artificial Sequence
  chemically synthesized
tgattttccataatagtccaga

SEQ ID NO: 8973 - DNA, 22 bp, Artificial Sequence
  chemically synthesized
tccataatagtccagaagtcaa

SEQ ID NO: 8974 - DNA, 22 bp, Artificial Sequence
  chemically synthesized
ccataatagtccagaagtcaac

SEQ ID NO: 8975 - DNA, 22 bp, Artificial Sequence
  chemically synthesized
cataatagtccagaagtcaaca

SEQ ID NO: 8976 - DNA, 22 bp, Artificial Sequence
  chemically synthesized
tcagactctgactcagctgcag

SEQ ID NO: 8977 - DNA, 22 bp, Artificial Sequence
  chemically synthesized
cagactctgactcagctgcagc

SEQ ID NO: 8978 - DNA, 22 bp, Artificial Sequence
  chemically synthesized
agactctgactcagctgcagcc

SEQ ID NO: 8979 - DNA, 22 bp, Artificial Sequence
  chemically synthesized
tgactcagctgcagccacatct

SEQ ID NO: 8980 - DNA, 22 bp, Artificial Sequence
  chemically synthesized
actcagctgcagccacatctgg

SEQ ID NO: 8981 - DNA, 22 bp, Artificial Sequence
  chemically synthesized
agctgcagccacatctggcttg

SEQ ID NO: 8982 - DNA, 22 bp, Artificial Sequence
  chemically synthesized
cagccacatctggcttgaaatt

SEQ ID NO: 8983 - DNA, 22 bp, Artificial Sequence
  chemically synthesized
gcttgaaattctactggaaacc

SEQ ID NO: 8984 - DNA, 22 bp, Artificial Sequence
  chemically synthesized
gaaattctactggaaacccatg

SEQ ID NO: 8985 - DNA, 22 bp, Artificial Sequence
  chemically synthesized
aaattctactggaaacccatgg

SEQ ID NO: 8986 - DNA, 22 bp, Artificial Sequence
  chemically synthesized
tactggaaacccatggagttcg

SEQ ID NO: 8987 - DNA, 22 bp, Artificial Sequence
  chemically synthesized
ctggaaacccatggagttcggg

SEQ ID NO: 8988 - DNA, 22 bp, Artificial Sequence
  chemically synthesized
gaaacccatggagttcggggct

SEQ ID NO: 8989 - DNA, 22 bp, Artificial Sequence
  chemically synthesized
ggggctccacacggcgactctc

SEQ ID NO: 8990 - DNA, 22 bp, Artificial Sequence
  chemically synthesized
cacacggcgactctcatgatca

SEQ ID NO: 8991 - DNA, 22 bp, Artificial Sequence
  chemically synthesized
tcatgatcatagaacacgaaca

SEQ ID NO: 8992 - DNA, 22 bp, Artificial Sequence
  chemically synthesized
atgatcatagaacacgaacagc

SEQ ID NO: 8993 - DNA, 22 bp, Artificial Sequence
  chemically synthesized
gtcatccacgtagcccaaagct

SEQ ID NO: 8994 - DNA, 22 bp, Artificial Sequence
  chemically synthesized
caaacaaggaaagaccaaggtc

SEQ ID NO: 8995 - DNA, 22 bp, Artificial Sequence
  chemically synthesized
aaacaaggaaagaccaaggtcc

SEQ ID NO: 8996 - DNA, 22 bp, Artificial Sequence
  chemically synthesized
ctctgaggcacccatgaagagg

SEQ ID NO: 8997 - DNA, 22 bp, Artificial Sequence
  chemically synthesized
tgaggcacccatgaagaggtag

SEQ ID NO: 8998 - DNA, 22 bp, Artificial Sequence
  chemically synthesized
aggcacccatgaagaggtagtg

SEQ ID NO: 8999 - DNA, 22 bp, Artificial Sequence
  chemically synthesized
gagacagagcaacaggccttaa

SEQ ID NO: 9000 - DNA, 22 bp, Artificial Sequence
  chemically synthesized
aaccatgtgtagtaggagggga

SEQ ID NO: 9001 - DNA, 22 bp, Artificial Sequence
  chemically synthesized
accatgtgtagtaggaggggag

SEQ ID NO: 9002 - DNA, 22 bp, Artificial Sequence
  chemically synthesized
aggctccacacacctgcatcaa

SEQ ID NO: 9003 - DNA, 22 bp, Artificial Sequence
  chemically synthesized
cacacacctgcatcaactcata

SEQ ID NO: 9004 - DNA, 22 bp, Artificial Sequence
  chemically synthesized
catcaactcataccatcagctg

SEQ ID NO: 9005 - DNA, 22 bp, Artificial Sequence
  chemically synthesized
ataccatcagctgtgtctggtc

SEQ ID NO: 9006 - DNA, 22 bp, Artificial Sequence
  chemically synthesized
tgtctggtcctcattttgtgaa

SEQ ID NO: 9007 - DNA, 22 bp, Artificial Sequence
  chemically synthesized
gtcctcattttgtgaagggtga

SEQ ID NO: 9008 - DNA, 22 bp, Artificial Sequence
  chemically synthesized
attttgtgaagggtgagttgca

SEQ ID NO: 9009 - DNA, 22 bp, Artificial Sequence
  chemically synthesized
tgtgaagggtgagttgcagtcc

SEQ ID NO: 9010 - DNA, 22 bp, Artificial Sequence
  chemically synthesized
gtgaagggtgagttgcagtcct

SEQ ID NO: 9011 - DNA, 22 bp, Artificial Sequence
  chemically synthesized
tgaagggtgagttgcagtcctg

SEQ ID NO: 9012 - DNA, 22 bp, Artificial Sequence
  chemically synthesized
cagtcctgtctttcttccatat

SEQ ID NO: 9013 - DNA, 22 bp, Artificial Sequence
  chemically synthesized
tctttcttccatatgacagtcc

SEQ ID NO: 9014 - DNA, 22 bp, Artificial Sequence
  chemically synthesized
tcttccatatgacagtcctggg

SEQ ID NO: 9015 - DNA, 22 bp, Artificial Sequence
  chemically synthesized
cttccatatgacagtcctgggt

SEQ ID NO: 9016 - DNA, 22 bp, Artificial Sequence
  chemically synthesized
ttccatatgacagtcctgggtg

SEQ ID NO: 9017 - DNA, 22 bp, Artificial Sequence
  chemically synthesized
ccatatgacagtcctgggtgct

SEQ ID NO: 9018 - DNA, 22 bp, Artificial Sequence
  chemically synthesized
catatgacagtcctgggtgctc

SEQ ID NO: 9019 - DNA, 22 bp, Artificial Sequence
  chemically synthesized
ggtgctctttccttgtgtgctt

SEQ ID NO: 9020 - DNA, 22 bp, Artificial Sequence
  chemically synthesized
tttccttgtgtgcttttctctg

SEQ ID NO: 9021 - DNA, 22 bp, Artificial Sequence
  chemically synthesized
tccttgtgtgcttttctctgcc

SEQ ID NO: 9022 - DNA, 22 bp, Artificial Sequence
  chemically synthesized
ccttgtgtgcttttctctgcca

SEQ ID NO: 9023 - DNA, 22 bp, Artificial Sequence
  chemically synthesized
cttgtgtgcttttctctgccac

SEQ ID NO: 9024 - DNA, 22 bp, Artificial Sequence
  chemically synthesized
gtgtgcttttctctgccacacg

SEQ ID NO: 9025 - DNA, 22 bp, Artificial Sequence
  chemically synthesized
tgtgcttttctctgccacacgt

SEQ ID NO: 9026 - DNA, 22 bp, Artificial Sequence
  chemically synthesized
ttctctgccacacgtggctgcc

SEQ ID NO: 9027 - DNA, 22 bp, Artificial Sequence
  chemically synthesized
tctctgccacacgtggctgcca

SEQ ID NO: 9028 - DNA, 22 bp, Artificial Sequence
  chemically synthesized
ctctgccacacgtggctgccac

SEQ ID NO: 9029 - DNA, 22 bp, Artificial Sequence
  chemically synthesized
tctgccacacgtggctgccacc

SEQ ID NO: 9030 - DNA, 22 bp, Artificial Sequence
  chemically synthesized
tgccacacgtggctgccacccc

SEQ ID NO: 9031 - DNA, 22 bp, Artificial Sequence
  chemically synthesized
ccacacgtggctgccaccccct

SEQ ID NO: 9032 - DNA, 22 bp, Artificial Sequence
  chemically synthesized
ccaccccctcactgcccccaga

SEQ ID NO: 9033 - DNA, 22 bp, Artificial Sequence
  chemically synthesized
actgcccccagatcctattcca

SEQ ID NO: 9034 - DNA, 22 bp, Artificial Sequence
  chemically synthesized
cccccagatcctattccaatac

SEQ ID NO: 9035 - DNA, 22 bp, Artificial Sequence
  chemically synthesized
ttccaatactcatgattagaca

SEQ ID NO: 9036 - DNA, 22 bp, Artificial Sequence
  chemically synthesized
caatactcatgattagacagac

SEQ ID NO: 9037 - DNA, 22 bp, Artificial Sequence
  chemically synthesized
atgattagacagactccactaa

SEQ ID NO: 9038 - DNA, 22 bp, Artificial Sequence
  chemically synthesized
gacagactccactaaagctggt

SEQ ID NO: 9039 - DNA, 22 bp, Artificial Sequence
  chemically synthesized
cactaaagctggtggattctag

SEQ ID NO: 9040 - DNA, 22 bp, Artificial Sequence
  chemically synthesized
aagctggtggattctagaaaat

SEQ ID NO: 9041 - DNA, 22 bp, Artificial Sequence
  chemically synthesized
gtggattctagaaaatgttaag

SEQ ID NO: 9042 - DNA, 22 bp, Artificial Sequence
  chemically synthesized
tagaaaatgttaaggtgtgtct

SEQ ID NO: 9043 - DNA, 22 bp, Artificial Sequence
  chemically synthesized
gaaaatgttaaggtgtgtctag

SEQ ID NO: 9044 - DNA, 22 bp, Artificial Sequence
  chemically synthesized
aggtgtgtctagccatggtagt

SEQ ID NO: 9045 - DNA, 22 bp, Artificial Sequence
  chemically synthesized
gccatggtagttgaactcagga

SEQ ID NO: 9046 - DNA, 22 bp, Artificial Sequence
  chemically synthesized
aactcaggagttggtgctcagg

SEQ ID NO: 9047 - DNA, 22 bp, Artificial Sequence
  chemically synthesized
aggagttggtgctcagggcaaa

SEQ ID NO: 9048 - DNA, 22 bp, Artificial Sequence
  chemically synthesized
gtgctcagggcaaattagaccc

SEQ ID NO: 9049 - DNA, 22 bp, Artificial Sequence
  chemically synthesized
agggcaaattagacccaaatcc

SEQ ID NO: 9050 - DNA, 22 bp, Artificial Sequence
  chemically synthesized
gacccaaatcctgaggaataat

SEQ ID NO: 9051 - DNA, 22 bp, Artificial Sequence
  chemically synthesized
aggaataattccttcagttttt

SEQ ID NO: 9052 - DNA, 22 bp, Artificial Sequence
  chemically synthesized
cttcagtttttttttttttttt

SEQ ID NO: 9053 - DNA, 22 bp, Artificial Sequence
  chemically synthesized
cagttttttttttttttttttt

SEQ ID NO: 9054 - DNA, 22 bp, Artificial Sequence
  chemically synthesized
agtttttttttttttttttttt

SEQ ID NO: 9055 - DNA, 22 bp, Artificial Sequence
  chemically synthesized
tttttttttttttttttttttt

SEQ ID NO: 9056 - DNA, 22 bp, Artificial Sequence
  chemically synthesized
tttttttttttttttttttttt

SEQ ID NO: 9057 - DNA, 22 bp, Artificial Sequence
  chemically synthesized
tttttttttttttttttttttt

SEQ ID NO: 9058 - DNA, 22 bp, Artificial Sequence
  chemically synthesized
tttttttttttttttttttttt

SEQ ID NO: 9059 - DNA, 22 bp, Artificial Sequence
  chemically synthesized
tttttttttttttttttttttt

SEQ ID NO: 9060 - DNA, 22 bp, Artificial Sequence
  chemically synthesized
tttttttttttttttttttttg

SEQ ID NO: 9061 - DNA, 22 bp, Artificial Sequence
  chemically synthesized
ttttttttttttttttttttga

SEQ ID NO: 9062 - DNA, 22 bp, Artificial Sequence
  chemically synthesized
tttttttttttttttttttgag

SEQ ID NO: 9063 - DNA, 22 bp, Artificial Sequence
  chemically synthesized
ttttttttttttttttttgaga

SEQ ID NO: 9064 - DNA, 22 bp, Artificial Sequence
  chemically synthesized
tttttttttttttttttgagac

SEQ ID NO: 9065 - DNA, 22 bp, Artificial Sequence
  chemically synthesized
ttttttttttttttttgagaca

SEQ ID NO: 9066 - DNA, 22 bp, Artificial Sequence
  chemically synthesized
tttttttttttttttgagacag

SEQ ID NO: 9067 - DNA, 22 bp, Artificial Sequence
  chemically synthesized
ttttttttttttttgagacaga

SEQ ID NO: 9068 - DNA, 22 bp, Artificial Sequence
  chemically synthesized
tttttttttttttgagacagag

SEQ ID NO: 9069 - DNA, 22 bp, Artificial Sequence
  chemically synthesized
ttttttttttttgagacagagt

SEQ ID NO: 9070 - DNA, 22 bp, Artificial Sequence
  chemically synthesized
tttttttttttgagacagagtc

SEQ ID NO: 9071 - DNA, 22 bp, Artificial Sequence
  chemically synthesized
ttttttttttgagacagagtct

SEQ ID NO: 9072 - DNA, 22 bp, Artificial Sequence
  chemically synthesized
tttttttttgagacagagtctc

SEQ ID NO: 9073 - DNA, 22 bp, Artificial Sequence
  chemically synthesized
ttttttttgagacagagtctca

SEQ ID NO: 9074 - DNA, 22 bp, Artificial Sequence
  chemically synthesized
tttttttgagacagagtctcac

SEQ ID NO: 9075 - DNA, 22 bp, Artificial Sequence
  chemically synthesized
ttttttgagacagagtctcact

SEQ ID NO: 9076 - DNA, 22 bp, Artificial Sequence
  chemically synthesized
tttttgagacagagtctcactc

SEQ ID NO: 9077 - DNA, 22 bp, Artificial Sequence
  chemically synthesized
ttttgagacagagtctcactct

SEQ ID NO: 9078 - DNA, 22 bp, Artificial Sequence
  chemically synthesized
tttgagacagagtctcactcta

SEQ ID NO: 9079 - DNA, 22 bp, Artificial Sequence
  chemically synthesized
ttgagacagagtctcactctat

SEQ ID NO: 9080 - DNA, 22 bp, Artificial Sequence
  chemically synthesized
tgagacagagtctcactctatc

SEQ ID NO: 9081 - DNA, 22 bp, Artificial Sequence
  chemically synthesized
gagacagagtctcactctatca

SEQ ID NO: 9082 - DNA, 22 bp, Artificial Sequence
  chemically synthesized
agacagagtctcactctatcac

SEQ ID NO: 9083 - DNA, 22 bp, Artificial Sequence
  chemically synthesized
actctatcacccaggctggagt

SEQ ID NO: 9084 - DNA, 22 bp, Artificial Sequence
  chemically synthesized
tatcacccaggctggagtgcag

SEQ ID NO: 9085 - DNA, 22 bp, Artificial Sequence
  chemically synthesized
tcacccaggctggagtgcagtg

SEQ ID NO: 9086 - DNA, 22 bp, Artificial Sequence
  chemically synthesized
gagtgcagtggcacaatctcag

SEQ ID NO: 9087 - DNA, 22 bp, Artificial Sequence
  chemically synthesized
agctcactgcaacctgcacctc

SEQ ID NO: 9088 - DNA, 22 bp, Artificial Sequence
  chemically synthesized
actgcaacctgcacctcctggg

SEQ ID NO: 9089 - DNA, 22 bp, Artificial Sequence
  chemically synthesized
caacctgcacctcctgggttca

SEQ ID NO: 9090 - DNA, 22 bp, Artificial Sequence
  chemically synthesized
cacctcctgggttcaagggatt

SEQ ID NO: 9091 - DNA, 22 bp, Artificial Sequence
  chemically synthesized
ctgggttcaagggattctccta

SEQ ID NO: 9092 - DNA, 22 bp, Artificial Sequence
  chemically synthesized
ggttcaagggattctcctacct

SEQ ID NO: 9093 - DNA, 22 bp, Artificial Sequence
  chemically synthesized
aagggattctcctacctaagcc

SEQ ID NO: 9094 - DNA, 22 bp, Artificial Sequence
  chemically synthesized
tcctacctaagcctcctgaaaa

SEQ ID NO: 9095 - DNA, 22 bp, Artificial Sequence
  chemically synthesized
ctacctaagcctcctgaaaacc

SEQ ID NO: 9096 - DNA, 22 bp, Artificial Sequence
  chemically synthesized
cctaagcctcctgaaaacctgg

SEQ ID NO: 9097 - DNA, 22 bp, Artificial Sequence
  chemically synthesized
agcctcctgaaaacctgggact

SEQ ID NO: 9098 - DNA, 22 bp, Artificial Sequence
  chemically synthesized
ctgaaaacctgggactataggc

SEQ ID NO: 9099 - DNA, 22 bp, Artificial Sequence
  chemically synthesized
aaaacctgggactataggcgtg

SEQ ID NO: 9100 - DNA, 22 bp, Artificial Sequence
  chemically synthesized
ggactataggcgtgcgccacca

SEQ ID NO: 9101 - DNA, 22 bp, Artificial Sequence
  chemically synthesized
taggcgtgcgccaccacaccag

SEQ ID NO: 9102 - DNA, 22 bp, Artificial Sequence
  chemically synthesized
atttttgtatttttagtagaca

SEQ ID NO: 9103 - DNA, 22 bp, Artificial Sequence
  chemically synthesized
ttgtatttttagtagacatggg

SEQ ID NO: 9104 - DNA, 22 bp, Artificial Sequence
  chemically synthesized
tgtatttttagtagacatgggg

SEQ ID NO: 9105 - DNA, 22 bp, Artificial Sequence
  chemically synthesized
gtatttttagtagacatggggt

SEQ ID NO: 9106 - DNA, 22 bp, Artificial Sequence
  chemically synthesized
tatttttagtagacatggggtt

SEQ ID NO: 9107 - DNA, 22 bp, Artificial Sequence
  chemically synthesized
ttagtagacatggggtttcacc

SEQ ID NO: 9108 - DNA, 22 bp, Artificial Sequence
  chemically synthesized
tagtagacatggggtttcacca

SEQ ID NO: 9109 - DNA, 22 bp, Artificial Sequence
  chemically synthesized
agtagacatggggtttcaccat

SEQ ID NO: 9110 - DNA, 22 bp, Artificial Sequence
  chemically synthesized
gtagacatggggtttcaccatg

SEQ ID NO: 9111 - DNA, 22 bp, Artificial Sequence
  chemically synthesized
caccatgttggccaagcttgtc

SEQ ID NO: 9112 - DNA, 22 bp, Artificial Sequence
  chemically synthesized
accatgttggccaagcttgtct

SEQ ID NO: 9113 - DNA, 22 bp, Artificial Sequence
  chemically synthesized
gccaagcttgtctcaaactcct

SEQ ID NO: 9114 - DNA, 22 bp, Artificial Sequence
  chemically synthesized
gtctcaaactcctgacctcaaa

SEQ ID NO: 9115 - DNA, 22 bp, Artificial Sequence
  chemically synthesized
tctcaaactcctgacctcaaat

SEQ ID NO: 9116 - DNA, 22 bp, Artificial Sequence
  chemically synthesized
aaactcctgacctcaaatgatc

SEQ ID NO: 9117 - DNA, 22 bp, Artificial Sequence
  chemically synthesized
ctgacctcaaatgatctacctg

SEQ ID NO: 9118 - DNA, 22 bp, Artificial Sequence
  chemically synthesized
acctcaaatgatctacctgcct

SEQ ID NO: 9119 - DNA, 22 bp, Artificial Sequence
  chemically synthesized
aaatgatctacctgcctcagcc

SEQ ID NO: 9120 - DNA, 22 bp, Artificial Sequence
  chemically synthesized
cctgcctcagccaccaaagtgc

SEQ ID NO: 9121 - DNA, 22 bp, Artificial Sequence
  chemically synthesized
cctcagccaccaaagtgctggg

SEQ ID NO: 9122 - DNA, 22 bp, Artificial Sequence
  chemically synthesized
agccaccaaagtgctgggatta

SEQ ID NO: 9123 - DNA, 22 bp, Artificial Sequence
  chemically synthesized
ggattacagaagtgagccaccg

SEQ ID NO: 9124 - DNA, 22 bp, Artificial Sequence
  chemically synthesized
cagaagtgagccaccgtgccca

SEQ ID NO: 9125 - DNA, 22 bp, Artificial Sequence
  chemically synthesized
ggtcctgaattcttacactgaa

SEQ ID NO: 9126 - DNA, 22 bp, Artificial Sequence
  chemically synthesized
gtcctgaattcttacactgaac

SEQ ID NO: 9127 - DNA, 22 bp, Artificial Sequence
  chemically synthesized
aattcttacactgaactgccta

SEQ ID NO: 9128 - DNA, 22 bp, Artificial Sequence
  chemically synthesized
ttacactgaactgcctatgtgg

SEQ ID NO: 9129 - DNA, 22 bp, Artificial Sequence
  chemically synthesized
acactgaactgcctatgtggcc

SEQ ID NO: 9130 - DNA, 22 bp, Artificial Sequence
  chemically synthesized
cactgaactgcctatgtggcct

SEQ ID NO: 9131 - DNA, 22 bp, Artificial Sequence
  chemically synthesized
aactgcctatgtggcctcacca

SEQ ID NO: 9132 - DNA, 22 bp, Artificial Sequence
  chemically synthesized
cctatgtggcctcaccacttgg

SEQ ID NO: 9133 - DNA, 22 bp, Artificial Sequence
  chemically synthesized
tgtggcctcaccacttggaagc

SEQ ID NO: 9134 - DNA, 22 bp, Artificial Sequence
  chemically synthesized
accacttggaagcctgactgga

SEQ ID NO: 9135 - DNA, 22 bp, Artificial Sequence
  chemically synthesized
ggaagcctgactggaatctcaa

SEQ ID NO: 9136 - DNA, 22 bp, Artificial Sequence
  chemically synthesized
gaagcctgactggaatctcaaa

SEQ ID NO: 9137 - DNA, 22 bp, Artificial Sequence
  chemically synthesized
actggaatctcaaacttaacat

SEQ ID NO: 9138 - DNA, 22 bp, Artificial Sequence
  chemically synthesized
gaatctcaaacttaacatgtcc

SEQ ID NO: 9139 - DNA, 22 bp, Artificial Sequence
  chemically synthesized
aaacttaacatgtccaaatgca

SEQ ID NO: 9140 - DNA, 22 bp, Artificial Sequence
  chemically synthesized
aacatgtccaaatgcagatcct

SEQ ID NO: 9141 - DNA, 22 bp, Artificial Sequence
  chemically synthesized
acatgtccaaatgcagatcctt

SEQ ID NO: 9142 - DNA, 22 bp, Artificial Sequence
  chemically synthesized
gatttaccccaaactgctcttt

SEQ ID NO: 9143 - DNA, 22 bp, Artificial Sequence
  chemically synthesized
atttaccccaaactgctctttc

SEQ ID NO: 9144 - DNA, 22 bp, Artificial Sequence
  chemically synthesized
accccaaactgctctttcctct

SEQ ID NO: 9145 - DNA, 22 bp, Artificial Sequence
  chemically synthesized
ccccaaactgctctttcctctg

SEQ ID NO: 9146 - DNA, 22 bp, Artificial Sequence
  chemically synthesized
ctctttcctctgccttcaccat

SEQ ID NO: 9147 - DNA, 22 bp, Artificial Sequence
  chemically synthesized
tttcctctgccttcaccatctc

SEQ ID NO: 9148 - DNA, 22 bp, Artificial Sequence
  chemically synthesized
tcctctgccttcaccatctcag

SEQ ID NO: 9149 - DNA, 22 bp, Artificial Sequence
  chemically synthesized
cctctgccttcaccatctcaga

SEQ ID NO: 9150 - DNA, 22 bp, Artificial Sequence
  chemically synthesized
ctctgccttcaccatctcagaa

SEQ ID NO: 9151 - DNA, 22 bp, Artificial Sequence
  chemically synthesized
tgccttcaccatctcagaaatg

SEQ ID NO: 9152 - DNA, 22 bp, Artificial Sequence
  chemically synthesized
ccttcaccatctcagaaatggc

SEQ ID NO: 9153 - DNA, 22 bp, Artificial Sequence
  chemically synthesized
caccatctcagaaatggcattg

SEQ ID NO: 9154 - DNA, 22 bp, Artificial Sequence
  chemically synthesized
accatctcagaaatggcattgc

SEQ ID NO: 9155 - DNA, 22 bp, Artificial Sequence
  chemically synthesized
agaaatggcattgccaattacc

SEQ ID NO: 9156 - DNA, 22 bp, Artificial Sequence
  chemically synthesized
ccaattaccccactgctcaggc

SEQ ID NO: 9157 - DNA, 22 bp, Artificial Sequence
  chemically synthesized
ccccactgctcaggccaataaa

SEQ ID NO: 9158 - DNA, 22 bp, Artificial Sequence
  chemically synthesized
ctcaggccaataaaattaaaat

SEQ ID NO: 9159 - DNA, 22 bp, Artificial Sequence
  chemically synthesized
aggccaataaaattaaaataaa

SEQ ID NO: 9160 - DNA, 22 bp, Artificial Sequence
  chemically synthesized
aaataaagaacaaagtcaactt

SEQ ID NO: 9161 - DNA, 22 bp, Artificial Sequence
  chemically synthesized
taactcttctctttttcagggg

SEQ ID NO: 9162 - DNA, 22 bp, Artificial Sequence
  chemically synthesized
aactcttctctttttcaggggg

SEQ ID NO: 9163 - DNA, 22 bp, Artificial Sequence
  chemically synthesized
actcttctctttttcagggggt

SEQ ID NO: 9164 - DNA, 22 bp, Artificial Sequence
  chemically synthesized
ttctctttttcagggggtcagg

SEQ ID NO: 9165 - DNA, 22 bp, Artificial Sequence
  chemically synthesized
ctctttttcagggggtcagggg

SEQ ID NO: 9166 - DNA, 22 bp, Artificial Sequence
  chemically synthesized
tctttttcagggggtcagggga

SEQ ID NO: 9167 - DNA, 22 bp, Artificial Sequence
  chemically synthesized
tttttcagggggtcaggggaga

SEQ ID NO: 9168 - DNA, 22 bp, Artificial Sequence
  chemically synthesized
tttcagggggtcaggggagaca

SEQ ID NO: 9169 - DNA, 22 bp, Artificial Sequence
  chemically synthesized
ttcagggggtcaggggagacag

SEQ ID NO: 9170 - DNA, 22 bp, Artificial Sequence
  chemically synthesized
tcagggggtcaggggagacagg

SEQ ID NO: 9171 - DNA, 22 bp, Artificial Sequence
  chemically synthesized
cagggggtcaggggagacaggg

SEQ ID NO: 9172 - DNA, 22 bp, Artificial Sequence
  chemically synthesized
agggggtcaggggagacagggt

SEQ ID NO: 9173 - DNA, 22 bp, Artificial Sequence
  chemically synthesized
gctctgtcacctaggctgaagt

SEQ ID NO: 9174 - DNA, 22 bp, Artificial Sequence
  chemically synthesized
ctctgtcacctaggctgaagta

SEQ ID NO: 9175 - DNA, 22 bp, Artificial Sequence
  chemically synthesized
tgtcacctaggctgaagtacag

SEQ ID NO: 9176 - DNA, 22 bp, Artificial Sequence
  chemically synthesized
tcacctaggctgaagtacagtg

SEQ ID NO: 9177 - DNA, 22 bp, Artificial Sequence
  chemically synthesized
ggctgaagtacagtggcacagt

SEQ ID NO: 9178 - DNA, 22 bp, Artificial Sequence
  chemically synthesized
aagtacagtggcacagtcatgg

SEQ ID NO: 9179 - DNA, 22 bp, Artificial Sequence
  chemically synthesized
actgcagcctcaacttcctggg

SEQ ID NO: 9180 - DNA, 22 bp, Artificial Sequence
  chemically synthesized
cagcctcaacttcctgggctca

SEQ ID NO: 9181 - DNA, 22 bp, Artificial Sequence
  chemically synthesized
aacttcctgggctcaagcaata

SEQ ID NO: 9182 - DNA, 22 bp, Artificial Sequence
  chemically synthesized
cctgggctcaagcaataccctc

SEQ ID NO: 9183 - DNA, 22 bp, Artificial Sequence
  chemically synthesized
ctgggctcaagcaataccctcc

SEQ ID NO: 9184 - DNA, 22 bp, Artificial Sequence
  chemically synthesized
ggctcaagcaataccctccacc

SEQ ID NO: 9185 - DNA, 22 bp, Artificial Sequence
  chemically synthesized
aagcaataccctccacctcagc

SEQ ID NO: 9186 - DNA, 22 bp, Artificial Sequence
  chemically synthesized
cacctcagcctcccgagtagct

SEQ ID NO: 9187 - DNA, 22 bp, Artificial Sequence
  chemically synthesized
agcctcccgagtagctaggatc

SEQ ID NO: 9188 - DNA, 22 bp, Artificial Sequence
  chemically synthesized
ccgagtagctaggatcacaggt

SEQ ID NO: 9189 - DNA, 22 bp, Artificial Sequence
  chemically synthesized
ggatcacaggtgcatgccacca

SEQ ID NO: 9190 - DNA, 22 bp, Artificial Sequence
  chemically synthesized
atttttgtattttttgtagaga

SEQ ID NO: 9191 - DNA, 22 bp, Artificial Sequence
  chemically synthesized
ttgtattttttgtagagaaggg

SEQ ID NO: 9192 - DNA, 22 bp, Artificial Sequence
  chemically synthesized
tgtattttttgtagagaagggg

SEQ ID NO: 9193 - DNA, 22 bp, Artificial Sequence
  chemically synthesized
gtattttttgtagagaaggggt

SEQ ID NO: 9194 - DNA, 22 bp, Artificial Sequence
  chemically synthesized
tattttttgtagagaaggggtt

SEQ ID NO: 9195 - DNA, 22 bp, Artificial Sequence
  chemically synthesized
tttgtagagaaggggttttgct

SEQ ID NO: 9196 - DNA, 22 bp, Artificial Sequence
  chemically synthesized
ttgtagagaaggggttttgctg

SEQ ID NO: 9197 - DNA, 22 bp, Artificial Sequence
  chemically synthesized
tgtagagaaggggttttgctgt

SEQ ID NO: 9198 - DNA, 22 bp, Artificial Sequence
  chemically synthesized
gtagagaaggggttttgctgtg

SEQ ID NO: 9199 - DNA, 22 bp, Artificial Sequence
  chemically synthesized
tagagaaggggttttgctgtgt

SEQ ID NO: 9200 - DNA, 22 bp, Artificial Sequence
  chemically synthesized
tgctgtgttgcccaggctggtc

SEQ ID NO: 9201 - DNA, 22 bp, Artificial Sequence
  chemically synthesized
gctgtgttgcccaggctggtct

SEQ ID NO: 9202 - DNA, 22 bp, Artificial Sequence
  chemically synthesized
ctgtgttgcccaggctggtctt

SEQ ID NO: 9203 - DNA, 22 bp, Artificial Sequence
  chemically synthesized
tgttgcccaggctggtcttgaa

SEQ ID NO: 9204 - DNA, 22 bp, Artificial Sequence
  chemically synthesized
cccaggctggtcttgaactcct

SEQ ID NO: 9205 - DNA, 22 bp, Artificial Sequence
  chemically synthesized
gtcttgaactcctgagctcagg

SEQ ID NO: 9206 - DNA, 22 bp, Artificial Sequence
  chemically synthesized
gaactcctgagctcaggaatct

SEQ ID NO: 9207 - DNA, 22 bp, Artificial Sequence
  chemically synthesized
aactcctgagctcaggaatctg

SEQ ID NO: 9208 - DNA, 22 bp, Artificial Sequence
  chemically synthesized
ctgagctcaggaatctgctctc

SEQ ID NO: 9209 - DNA, 22 bp, Artificial Sequence
  chemically synthesized
agctcaggaatctgctctcctt

SEQ ID NO: 9210 - DNA, 22 bp, Artificial Sequence
  chemically synthesized
aggaatctgctctccttggcct

SEQ ID NO: 9211 - DNA, 22 bp, Artificial Sequence
  chemically synthesized
ctctccttggcctcctccttgg

SEQ ID NO: 9212 - DNA, 22 bp, Artificial Sequence
  chemically synthesized
tccttggcctcctccttggcat

SEQ ID NO: 9213 - DNA, 22 bp, Artificial Sequence
  chemically synthesized
cttggcctcctccttggcatga

SEQ ID NO: 9214 - DNA, 22 bp, Artificial Sequence
  chemically synthesized
ggcctcctccttggcatgagct

SEQ ID NO: 9215 - DNA, 22 bp, Artificial Sequence
  chemically synthesized
gcctcctccttggcatgagcta

SEQ ID NO: 9216 - DNA, 22 bp, Artificial Sequence
  chemically synthesized
ctccttggcatgagctactaca

SEQ ID NO: 9217 - DNA, 22 bp, Artificial Sequence
  chemically synthesized
cttggcatgagctactacaccc

SEQ ID NO: 9218 - DNA, 22 bp, Artificial Sequence
  chemically synthesized
ggcatgagctactacacccagc

SEQ ID NO: 9219 - DNA, 22 bp, Artificial Sequence
  chemically synthesized
gcatgagctactacacccagcc

SEQ ID NO: 9220 - DNA, 22 bp, Artificial Sequence
  chemically synthesized
ctacacccagccaattcttctc

SEQ ID NO: 9221 - DNA, 22 bp, Artificial Sequence
  chemically synthesized
cacccagccaattcttctcttt

SEQ ID NO: 9222 - DNA, 22 bp, Artificial Sequence
  chemically synthesized
ttctctttctctcacacaacat

SEQ ID NO: 9223 - DNA, 22 bp, Artificial Sequence
  chemically synthesized
ctctttctctcacacaacatag

SEQ ID NO: 9224 - DNA, 22 bp, Artificial Sequence
  chemically synthesized
tctttctctcacacaacataga

SEQ ID NO: 9225 - DNA, 22 bp, Artificial Sequence
  chemically synthesized
tttctctcacacaacatagaat

SEQ ID NO: 9226 - DNA, 22 bp, Artificial Sequence
  chemically synthesized
tctctcacacaacatagaatcc

SEQ ID NO: 9227 - DNA, 22 bp, Artificial Sequence
  chemically synthesized
ctctcacacaacatagaatcct

SEQ ID NO: 9228 - DNA, 22 bp, Artificial Sequence
  chemically synthesized
tctcacacaacatagaatcctt

SEQ ID NO: 9229 - DNA, 22 bp, Artificial Sequence
  chemically synthesized
tcacacaacatagaatccttca

SEQ ID NO: 9230 - DNA, 22 bp, Artificial Sequence
  chemically synthesized
acacaacatagaatccttcagc

SEQ ID NO: 9231 - DNA, 22 bp, Artificial Sequence
  chemically synthesized
cagcaacttccttcagaatata

SEQ ID NO: 9232 - DNA, 22 bp, Artificial Sequence
  chemically synthesized
agcaacttccttcagaatatat

SEQ ID NO: 9233 - DNA, 22 bp, Artificial Sequence
  chemically synthesized
ccttcagaatatattcaggaga

SEQ ID NO: 9234 - DNA, 22 bp, Artificial Sequence
  chemically synthesized
cttcagaatatattcaggagac

SEQ ID NO: 9235 - DNA, 22 bp, Artificial Sequence
  chemically synthesized
cagaatatattcaggagacaat

SEQ ID NO: 9236 - DNA, 22 bp, Artificial Sequence
  chemically synthesized
agaatatattcaggagacaatg

SEQ ID NO: 9237 - DNA, 22 bp, Artificial Sequence
  chemically synthesized
aggagacaatggtttgtcactc

SEQ ID NO: 9238 - DNA, 22 bp, Artificial Sequence
  chemically synthesized
gtcactcccttttctgttccca

SEQ ID NO: 9239 - DNA, 22 bp, Artificial Sequence
  chemically synthesized
tcactcccttttctgttcccac

SEQ ID NO: 9240 - DNA, 22 bp, Artificial Sequence
  chemically synthesized
ccttttctgttcccacccagcc

SEQ ID NO: 9241 - DNA, 22 bp, Artificial Sequence
  chemically synthesized
ttctgttcccacccagcccact

SEQ ID NO: 9242 - DNA, 22 bp, Artificial Sequence
  chemically synthesized
tctgttcccacccagcccactc

SEQ ID NO: 9243 - DNA, 22 bp, Artificial Sequence
  chemically synthesized
ctgttcccacccagcccactcc

SEQ ID NO: 9244 - DNA, 22 bp, Artificial Sequence
  chemically synthesized
tgttcccacccagcccactcca

SEQ ID NO: 9245 - DNA, 22 bp, Artificial Sequence
  chemically synthesized
ttcccacccagcccactccact

SEQ ID NO: 9246 - DNA, 22 bp, Artificial Sequence
  chemically synthesized
ccacccagcccactccactacc

SEQ ID NO: 9247 - DNA, 22 bp, Artificial Sequence
  chemically synthesized
cactacctcttgcctggactgt

SEQ ID NO: 9248 - DNA, 22 bp, Artificial Sequence
  chemically synthesized
cctcttgcctggactgtgtaac

SEQ ID NO: 9249 - DNA, 22 bp, Artificial Sequence
  chemically synthesized
ttgcctggactgtgtaacagct

SEQ ID NO: 9250 - DNA, 22 bp, Artificial Sequence
  chemically synthesized
gcctggactgtgtaacagcttc

SEQ ID NO: 9251 - DNA, 22 bp, Artificial Sequence
  chemically synthesized
cctggactgtgtaacagcttcc

SEQ ID NO: 9252 - DNA, 22 bp, Artificial Sequence
  chemically synthesized
gactgtgtaacagcttcctggc

SEQ ID NO: 9253 - DNA, 22 bp, Artificial Sequence
  chemically synthesized
tgtaacagcttcctggctgggc

SEQ ID NO: 9254 - DNA, 22 bp, Artificial Sequence
  chemically synthesized
cctggctgggctccctgctttt

SEQ ID NO: 9255 - DNA, 22 bp, Artificial Sequence
  chemically synthesized
ctggctgggctccctgctttta

SEQ ID NO: 9256 - DNA, 22 bp, Artificial Sequence
  chemically synthesized
gctgggctccctgcttttactg

SEQ ID NO: 9257 - DNA, 22 bp, Artificial Sequence
  chemically synthesized
ggctccctgcttttactgttgc

SEQ ID NO: 9258 - DNA, 22 bp, Artificial Sequence
  chemically synthesized
cctgcttttactgttgctccct

SEQ ID NO: 9259 - DNA, 22 bp, Artificial Sequence
  chemically synthesized
cttttactgttgctcccttcat

SEQ ID NO: 9260 - DNA, 22 bp, Artificial Sequence
  chemically synthesized
ttactgttgctcccttcattct

SEQ ID NO: 9261 - DNA, 22 bp, Artificial Sequence
  chemically synthesized
tactgttgctcccttcattctg

SEQ ID NO: 9262 - DNA, 22 bp, Artificial Sequence
  chemically synthesized
actgttgctcccttcattctgc

SEQ ID NO: 9263 - DNA, 22 bp, Artificial Sequence
  chemically synthesized
ctgttgctcccttcattctgct

SEQ ID NO: 9264 - DNA, 22 bp, Artificial Sequence
  chemically synthesized
ttgctcccttcattctgctttc

SEQ ID NO: 9265 - DNA, 22 bp, Artificial Sequence
  chemically synthesized
ctcccttcattctgctttccac

SEQ ID NO: 9266 - DNA, 22 bp, Artificial Sequence
  chemically synthesized
ccttcattctgctttccacata

SEQ ID NO: 9267 - DNA, 22 bp, Artificial Sequence
  chemically synthesized
cattctgctttccacatagcag

SEQ ID NO: 9268 - DNA, 22 bp, Artificial Sequence
  chemically synthesized
attctgctttccacatagcagc

SEQ ID NO: 9269 - DNA, 22 bp, Artificial Sequence
  chemically synthesized
tgctttccacatagcagccaga

SEQ ID NO: 9270 - DNA, 22 bp, Artificial Sequence
  chemically synthesized
ctttccacatagcagccagagc

SEQ ID NO: 9271 - DNA, 22 bp, Artificial Sequence
  chemically synthesized
tccacatagcagccagagcaat

SEQ ID NO: 9272 - DNA, 22 bp, Artificial Sequence
  chemically synthesized
ccacatagcagccagagcaatc

SEQ ID NO: 9273 - DNA, 22 bp, Artificial Sequence
  chemically synthesized
cacatagcagccagagcaatct

SEQ ID NO: 9274 - DNA, 22 bp, Artificial Sequence
  chemically synthesized
ttaaaagcctgtgacagatcac

SEQ ID NO: 9275 - DNA, 22 bp, Artificial Sequence
  chemically synthesized
taaaagcctgtgacagatcact

SEQ ID NO: 9276 - DNA, 22 bp, Artificial Sequence
  chemically synthesized
aaaagcctgtgacagatcactg

SEQ ID NO: 9277 - DNA, 22 bp, Artificial Sequence
  chemically synthesized
aaagcctgtgacagatcactgt

SEQ ID NO: 9278 - DNA, 22 bp, Artificial Sequence
  chemically synthesized
tgacagatcactgttactcctt

SEQ ID NO: 9279 - DNA, 22 bp, Artificial Sequence
  chemically synthesized
ttactccttggctagaattcac

SEQ ID NO: 9280 - DNA, 22 bp, Artificial Sequence
  chemically synthesized
ctccttggctagaattcacacc

SEQ ID NO: 9281 - DNA, 22 bp, Artificial Sequence
  chemically synthesized
cttggctagaattcacaccaca

SEQ ID NO: 9282 - DNA, 22 bp, Artificial Sequence
  chemically synthesized
ggctagaattcacaccacagcc

SEQ ID NO: 9283 - DNA, 22 bp, Artificial Sequence
  chemically synthesized
gctagaattcacaccacagcct

SEQ ID NO: 9284 - DNA, 22 bp, Artificial Sequence
  chemically synthesized
gaattcacaccacagcctacag

SEQ ID NO: 9285 - DNA, 22 bp, Artificial Sequence
  chemically synthesized
acaccacagcctacaggcgcct

SEQ ID NO: 9286 - DNA, 22 bp, Artificial Sequence
  chemically synthesized
caggcgcctgcacaaccttgtt

SEQ ID NO: 9287 - DNA, 22 bp, Artificial Sequence
  chemically synthesized
cacaaccttgtttgtggctcct

SEQ ID NO: 9288 - DNA, 22 bp, Artificial Sequence
  chemically synthesized
gtttgtggctcctcttctgagc

SEQ ID NO: 9289 - DNA, 22 bp, Artificial Sequence
  chemically synthesized
tttgtggctcctcttctgagcc

SEQ ID NO: 9290 - DNA, 22 bp, Artificial Sequence
  chemically synthesized
gtggctcctcttctgagcccat

SEQ ID NO: 9291 - DNA, 22 bp, Artificial Sequence
  chemically synthesized
tggctcctcttctgagcccatt

SEQ ID NO: 9292 - DNA, 22 bp, Artificial Sequence
  chemically synthesized
ctcttctgagcccattacctac

SEQ ID NO: 9293 - DNA, 22 bp, Artificial Sequence
  chemically synthesized
ttctgagcccattacctacttc

SEQ ID NO: 9294 - DNA, 22 bp, Artificial Sequence
  chemically synthesized
ctgagcccattacctacttctt

SEQ ID NO: 9295 - DNA, 22 bp, Artificial Sequence
  chemically synthesized
tgagcccattacctacttcttg

SEQ ID NO: 9296 - DNA, 22 bp, Artificial Sequence
  chemically synthesized
agcccattacctacttcttggc

SEQ ID NO: 9297 - DNA, 22 bp, Artificial Sequence
  chemically synthesized
cctacttcttggcctctactcc

SEQ ID NO: 9298 - DNA, 22 bp, Artificial Sequence
  chemically synthesized
cttcttggcctctactccccag

SEQ ID NO: 9299 - DNA, 22 bp, Artificial Sequence
  chemically synthesized
cttggcctctactccccagcac

SEQ ID NO: 9300 - DNA, 22 bp, Artificial Sequence
  chemically synthesized
ttggcctctactccccagcact

SEQ ID NO: 9301 - DNA, 22 bp, Artificial Sequence
  chemically synthesized
ggcctctactccccagcactac

SEQ ID NO: 9302 - DNA, 22 bp, Artificial Sequence
  chemically synthesized
gcctctactccccagcactact

SEQ ID NO: 9303 - DNA, 22 bp, Artificial Sequence
  chemically synthesized
tactccccagcactacttgttt

SEQ ID NO: 9304 - DNA, 22 bp, Artificial Sequence
  chemically synthesized
ctccccagcactacttgtttat

SEQ ID NO: 9305 - DNA, 22 bp, Artificial Sequence
  chemically synthesized
cccagcactacttgtttatttt

SEQ ID NO: 9306 - DNA, 22 bp, Artificial Sequence
  chemically synthesized
cttgtttatttttttcaacccg

SEQ ID NO: 9307 - DNA, 22 bp, Artificial Sequence
  chemically synthesized
gtttatttttttcaacccgagc

SEQ ID NO: 9308 - DNA, 22 bp, Artificial Sequence
  chemically synthesized
tttatttttttcaacccgagct

SEQ ID NO: 9309 - DNA, 22 bp, Artificial Sequence
  chemically synthesized
atttttttcaacccgagcttct

SEQ ID NO: 9310 - DNA, 22 bp, Artificial Sequence
  chemically synthesized
tttttttcaacccgagcttctt

SEQ ID NO: 9311 - DNA, 22 bp, Artificial Sequence
  chemically synthesized
ttttcaacccgagcttcttaac

SEQ ID NO: 9312 - DNA, 22 bp, Artificial Sequence
  chemically synthesized
tttcaacccgagcttcttaacc

SEQ ID NO: 9313 - DNA, 22 bp, Artificial Sequence
  chemically synthesized
ttcaacccgagcttcttaacca

SEQ ID NO: 9314 - DNA, 22 bp, Artificial Sequence
  chemically synthesized
tcaacccgagcttcttaaccag

SEQ ID NO: 9315 - DNA, 22 bp, Artificial Sequence
  chemically synthesized
caacccgagcttcttaaccagg

SEQ ID NO: 9316 - DNA, 22 bp, Artificial Sequence
  chemically synthesized
aacccgagcttcttaaccagga

SEQ ID NO: 9317 - DNA, 22 bp, Artificial Sequence
  chemically synthesized
cttaaccaggagtttgtctact

SEQ ID NO: 9318 - DNA, 22 bp, Artificial Sequence
  chemically synthesized
ttaaccaggagtttgtctacta

SEQ ID NO: 9319 - DNA, 22 bp, Artificial Sequence
  chemically synthesized
aaccaggagtttgtctactagg

SEQ ID NO: 9320 - DNA, 22 bp, Artificial Sequence
  chemically synthesized
accaggagtttgtctactaggt

SEQ ID NO: 9321 - DNA, 22 bp, Artificial Sequence
  chemically synthesized
gtctactaggtgacatgtggca

SEQ ID NO: 9322 - DNA, 22 bp, Artificial Sequence
  chemically synthesized
tctactaggtgacatgtggcaa

SEQ ID NO: 9323 - DNA, 22 bp, Artificial Sequence
  chemically synthesized
ctaggtgacatgtggcaaagtt

SEQ ID NO: 9324 - DNA, 22 bp, Artificial Sequence
  chemically synthesized
ggtgacatgtggcaaagtttag

SEQ ID NO: 9325 - DNA, 22 bp, Artificial Sequence
  chemically synthesized
agagacatttttggttgtcaag

SEQ ID NO: 9326 - DNA, 22 bp, Artificial Sequence
  chemically synthesized
gagacatttttggttgtcaaga

SEQ ID NO: 9327 - DNA, 22 bp, Artificial Sequence
  chemically synthesized
ttggttgtcaagactgggggag

SEQ ID NO: 9328 - DNA, 22 bp, Artificial Sequence
  chemically synthesized
tggttgtcaagactgggggagt

SEQ ID NO: 9329 - DNA, 22 bp, Artificial Sequence
  chemically synthesized
ggttgtcaagactgggggagtg

SEQ ID NO: 9330 - DNA, 22 bp, Artificial Sequence
  chemically synthesized
gttgtcaagactgggggagtgc

SEQ ID NO: 9331 - DNA, 22 bp, Artificial Sequence
  chemically synthesized
tcaagactgggggagtgctcct

SEQ ID NO: 9332 - DNA, 22 bp, Artificial Sequence
  chemically synthesized
ggggagtgctcctagcacctag

SEQ ID NO: 9333 - DNA, 22 bp, Artificial Sequence
  chemically synthesized
ctagcacctagtgagtagggag

SEQ ID NO: 9334 - DNA, 22 bp, Artificial Sequence
  chemically synthesized
gcacctagtgagtagggaggac

SEQ ID NO: 9335 - DNA, 22 bp, Artificial Sequence
  chemically synthesized
gtgagtagggaggacaggatac

SEQ ID NO: 9336 - DNA, 22 bp, Artificial Sequence
  chemically synthesized
ctagacatcctacatgcagatg

SEQ ID NO: 9337 - DNA, 22 bp, Artificial Sequence
  chemically synthesized
gacatcctacatgcagatggta

SEQ ID NO: 9338 - DNA, 22 bp, Artificial Sequence
  chemically synthesized
catgcagatggtagtccccctt

SEQ ID NO: 9339 - DNA, 22 bp, Artificial Sequence
  chemically synthesized
cccacccccacgccgccccccc

SEQ ID NO: 9340 - DNA, 22 bp, Artificial Sequence
  chemically synthesized
ccacccccacgccgcccccccc

SEQ ID NO: 9341 - DNA, 22 bp, Artificial Sequence
  chemically synthesized
agaaaacccgctttttaatcca

SEQ ID NO: 9342 - DNA, 22 bp, Artificial Sequence
  chemically synthesized
tttaatccaacttgccaggccc

SEQ ID NO: 9343 - DNA, 22 bp, Artificial Sequence
  chemically synthesized
ttaatccaacttgccaggccca

SEQ ID NO: 9344 - DNA, 22 bp, Artificial Sequence
  chemically synthesized
taatccaacttgccaggcccac

SEQ ID NO: 9345 - DNA, 22 bp, Artificial Sequence
  chemically synthesized
aatccaacttgccaggcccact

SEQ ID NO: 9346 - DNA, 22 bp, Artificial Sequence
  chemically synthesized
atccaacttgccaggcccactc

SEQ ID NO: 9347 - DNA, 22 bp, Artificial Sequence
  chemically synthesized
gccaggcccactcagtttgcct

SEQ ID NO: 9348 - DNA, 22 bp, Artificial Sequence
  chemically synthesized
ccaggcccactcagtttgcctg

SEQ ID NO: 9349 - DNA, 22 bp, Artificial Sequence
  chemically synthesized
agtttgcctgggaaatactgct

SEQ ID NO: 9350 - DNA, 22 bp, Artificial Sequence
  chemically synthesized
gcctgggaaatactgctcccag

SEQ ID NO: 9351 - DNA, 22 bp, Artificial Sequence
  chemically synthesized
cctgggaaatactgctcccagt

SEQ ID NO: 9352 - DNA, 22 bp, Artificial Sequence
  chemically synthesized
ggaaatactgctcccagtcaat

SEQ ID NO: 9353 - DNA, 22 bp, Artificial Sequence
  chemically synthesized
ctcccagtcaatatcattctta

SEQ ID NO: 9354 - DNA, 22 bp, Artificial Sequence
  chemically synthesized
ccagtcaatatcattcttattt

SEQ ID NO: 9355 - DNA, 22 bp, Artificial Sequence
  chemically synthesized
ttatttccttcatgtctctgct

SEQ ID NO: 9356 - DNA, 22 bp, Artificial Sequence
  chemically synthesized
atttccttcatgtctctgctca

SEQ ID NO: 9357 - DNA, 22 bp, Artificial Sequence
  chemically synthesized
tttccttcatgtctctgctcaa

SEQ ID NO: 9358 - DNA, 22 bp, Artificial Sequence
  chemically synthesized
ccttcatgtctctgctcaagtg

SEQ ID NO: 9359 - DNA, 22 bp, Artificial Sequence
  chemically synthesized
cttcatgtctctgctcaagtgt

SEQ ID NO: 9360 - DNA, 22 bp, Artificial Sequence
  chemically synthesized
catgtctctgctcaagtgtcag

SEQ ID NO: 9361 - DNA, 22 bp, Artificial Sequence
  chemically synthesized
atgtctctgctcaagtgtcagc

SEQ ID NO: 9362 - DNA, 22 bp, Artificial Sequence
  chemically synthesized
tgctcaagtgtcagccccagag

SEQ ID NO: 9363 - DNA, 22 bp, Artificial Sequence
  chemically synthesized
ctcaagtgtcagccccagagtg

SEQ ID NO: 9364 - DNA, 22 bp, Artificial Sequence
  chemically synthesized
aagtgtcagccccagagtgact

SEQ ID NO: 9365 - DNA, 22 bp, Artificial Sequence
  chemically synthesized
gccctgacttctctgcttctca

SEQ ID NO: 9366 - DNA, 22 bp, Artificial Sequence
  chemically synthesized
ccctgacttctctgcttctcac

SEQ ID NO: 9367 - DNA, 22 bp, Artificial Sequence
  chemically synthesized
acttctctgcttctcacaacac

SEQ ID NO: 9368 - DNA, 22 bp, Artificial Sequence
  chemically synthesized
ctctgcttctcacaacacccat

SEQ ID NO: 9369 - DNA, 22 bp, Artificial Sequence
  chemically synthesized
tctgcttctcacaacacccatg

SEQ ID NO: 9370 - DNA, 22 bp, Artificial Sequence
  chemically synthesized
tgcttctcacaacacccatgat

SEQ ID NO: 9371 - DNA, 22 bp, Artificial Sequence
  chemically synthesized
cttctcacaacacccatgattt

SEQ ID NO: 9372 - DNA, 22 bp, Artificial Sequence
  chemically synthesized
ctcacaacacccatgatttcct

SEQ ID NO: 9373 - DNA, 22 bp, Artificial Sequence
  chemically synthesized
tcacaacacccatgatttcctg

SEQ ID NO: 9374 - DNA, 22 bp, Artificial Sequence
  chemically synthesized
acaacacccatgatttcctgat

SEQ ID NO: 9375 - DNA, 22 bp, Artificial Sequence
  chemically synthesized
cctgatgttgtatatctttctg

SEQ ID NO: 9376 - DNA, 22 bp, Artificial Sequence
  chemically synthesized
ctgatgttgtatatctttctgc

SEQ ID NO: 9377 - DNA, 22 bp, Artificial Sequence
  chemically synthesized
atgttgtatatctttctgctca

SEQ ID NO: 9378 - DNA, 22 bp, Artificial Sequence
  chemically synthesized
tatatctttctgctcatttgct

SEQ ID NO: 9379 - DNA, 22 bp, Artificial Sequence
  chemically synthesized
tctgctcatttgcttattgtca

SEQ ID NO: 9380 - DNA, 22 bp, Artificial Sequence
  chemically synthesized
ctgctcatttgcttattgtcat

SEQ ID NO: 9381 - DNA, 22 bp, Artificial Sequence
  chemically synthesized
tgctcatttgcttattgtcatc

SEQ ID NO: 9382 - DNA, 22 bp, Artificial Sequence
  chemically synthesized
ctcatttgcttattgtcatctc

SEQ ID NO: 9383 - DNA, 22 bp, Artificial Sequence
  chemically synthesized
atttgcttattgtcatctctcc

SEQ ID NO: 9384 - DNA, 22 bp, Artificial Sequence
  chemically synthesized
gcttattgtcatctctcccact

SEQ ID NO: 9385 - DNA, 22 bp, Artificial Sequence
  chemically synthesized
cttattgtcatctctcccacta

SEQ ID NO: 9386 - DNA, 22 bp, Artificial Sequence
  chemically synthesized
attgtcatctctcccactagaa

SEQ ID NO: 9387 - DNA, 22 bp, Artificial Sequence
  chemically synthesized
ttgtcatctctcccactagaat

SEQ ID NO: 9388 - DNA, 22 bp, Artificial Sequence
  chemically synthesized
tcatctctcccactagaatgca

SEQ ID NO: 9389 - DNA, 22 bp, Artificial Sequence
  chemically synthesized
tcccactagaatgcaaaatatc

SEQ ID NO: 9390 - DNA, 22 bp, Artificial Sequence
  chemically synthesized
ccactagaatgcaaaatatcaa

SEQ ID NO: 9391 - DNA, 22 bp, Artificial Sequence
  chemically synthesized
gaatgcaaaatatcaaagggta

SEQ ID NO: 9392 - DNA, 22 bp, Artificial Sequence
  chemically synthesized
gtttccctgctctctcccttgg

SEQ ID NO: 9393 - DNA, 22 bp, Artificial Sequence
  chemically synthesized
tttccctgctctctcccttggg

SEQ ID NO: 9394 - DNA, 22 bp, Artificial Sequence
  chemically synthesized
ccctgctctctcccttggggct

SEQ ID NO: 9395 - DNA, 22 bp, Artificial Sequence
  chemically synthesized
cctgctctctcccttggggctt

SEQ ID NO: 9396 - DNA, 22 bp, Artificial Sequence
  chemically synthesized
ctctctcccttggggcttgaac

SEQ ID NO: 9397 - DNA, 22 bp, Artificial Sequence
  chemically synthesized
tctcccttggggcttgaacagt

SEQ ID NO: 9398 - DNA, 22 bp, Artificial Sequence
  chemically synthesized
tcccttggggcttgaacagtgc

SEQ ID NO: 9399 - DNA, 22 bp, Artificial Sequence
  chemically synthesized
ccttggggcttgaacagtgcaa

SEQ ID NO: 9400 - DNA, 22 bp, Artificial Sequence
  chemically synthesized
ggggcttgaacagtgcaacaca

SEQ ID NO: 9401 - DNA, 22 bp, Artificial Sequence
  chemically synthesized
gggcttgaacagtgcaacacat

SEQ ID NO: 9402 - DNA, 22 bp, Artificial Sequence
  chemically synthesized
gaacagtgcaacacatggctgg

SEQ ID NO: 9403 - DNA, 22 bp, Artificial Sequence
  chemically synthesized
aacagtgcaacacatggctggg

SEQ ID NO: 9404 - DNA, 22 bp, Artificial Sequence
  chemically synthesized
ggactcatttacacttgtaaac

SEQ ID NO: 9405 - DNA, 22 bp, Artificial Sequence
  chemically synthesized
atttacacttgtaaacaatgaa

SEQ ID NO: 9406 - DNA, 22 bp, Artificial Sequence
  chemically synthesized
acacttgtaaacaatgaatatt

SEQ ID NO: 9407 - DNA, 22 bp, Artificial Sequence
  chemically synthesized
cacttgtaaacaatgaatattt

SEQ ID NO: 9408 - DNA, 22 bp, Artificial Sequence
  chemically synthesized
gtaaacaatgaatatttctgct

SEQ ID NO: 9409 - DNA, 22 bp, Artificial Sequence
  chemically synthesized
taaacaatgaatatttctgctc

SEQ ID NO: 9410 - DNA, 22 bp, Artificial Sequence
  chemically synthesized
ctgctcaacatgaaattttatt

SEQ ID NO: 9411 - DNA, 22 bp, Artificial Sequence
  chemically synthesized
tgctcaacatgaaattttatta

SEQ ID NO: 9412 - DNA, 22 bp, Artificial Sequence
  chemically synthesized
ctcaacatgaaattttattatt

SEQ ID NO: 9413 - DNA, 22 bp, Artificial Sequence
  chemically synthesized
aacatgaaattttattattcaa

SEQ ID NO: 9414 - DNA, 22 bp, Artificial Sequence
  chemically synthesized
tattattcaacctctaatgcag

SEQ ID NO: 9415 - DNA, 22 bp, Artificial Sequence
  chemically synthesized
attattcaacctctaatgcagt

SEQ ID NO: 9416 - DNA, 22 bp, Artificial Sequence
  chemically synthesized
ttattcaacctctaatgcagtg

SEQ ID NO: 9417 - DNA, 22 bp, Artificial Sequence
  chemically synthesized
ttcaacctctaatgcagtgtga

SEQ ID NO: 9418 - DNA, 22 bp, Artificial Sequence
  chemically synthesized
aacctctaatgcagtgtgatgt

SEQ ID NO: 9419 - DNA, 22 bp, Artificial Sequence
  chemically synthesized
taatgcagtgtgatgtttaaga

SEQ ID NO: 9420 - DNA, 22 bp, Artificial Sequence
  chemically synthesized
atgcagtgtgatgtttaagaat

SEQ ID NO: 9421 - DNA, 22 bp, Artificial Sequence
  chemically synthesized
aagaatcatagctatgaagtgg

SEQ ID NO: 9422 - DNA, 22 bp, Artificial Sequence
  chemically synthesized
agaatcatagctatgaagtgga

SEQ ID NO: 9423 - DNA, 22 bp, Artificial Sequence
  chemically synthesized
tgaagtggagacatgagctctg

SEQ ID NO: 9424 - DNA, 22 bp, Artificial Sequence
  chemically synthesized
tgccaccaaagcccagtgtacc

SEQ ID NO: 9425 - DNA, 22 bp, Artificial Sequence
  chemically synthesized
ccaccaaagcccagtgtaccat

SEQ ID NO: 9426 - DNA, 22 bp, Artificial Sequence
  chemically synthesized
aataaatttgccaggaagcagg

SEQ ID NO: 9427 - DNA, 22 bp, Artificial Sequence
  chemically synthesized
gccaggaagcaggccgtgccat

SEQ ID NO: 9428 - DNA, 22 bp, Artificial Sequence
  chemically synthesized
ccaggaagcaggccgtgccatg

SEQ ID NO: 9429 - DNA, 22 bp, Artificial Sequence
  chemically synthesized
attcttgtcatgtgtaaaatgt

SEQ ID NO: 9430 - DNA, 22 bp, Artificial Sequence
  chemically synthesized
ttgtcatgtgtaaaatgtggat

SEQ ID NO: 9431 - DNA, 22 bp, Artificial Sequence
  chemically synthesized
gtcatgtgtaaaatgtggatac

SEQ ID NO: 9432 - DNA, 22 bp, Artificial Sequence
  chemically synthesized
tcatgtgtaaaatgtggataca

SEQ ID NO: 9433 - DNA, 22 bp, Artificial Sequence
  chemically synthesized
aaagtgctgtgctgaggccggc

SEQ ID NO: 9434 - DNA, 22 bp, Artificial Sequence
  chemically synthesized
tgctgaggccggcgtgtgaccc

SEQ ID NO: 9435 - DNA, 22 bp, Artificial Sequence
  chemically synthesized
aggccggcgtgtgacccacaga

SEQ ID NO: 9436 - DNA, 22 bp, Artificial Sequence
  chemically synthesized
tgctacactacagggcaaaatc

SEQ ID NO: 9437 - DNA, 22 bp, Artificial Sequence
  chemically synthesized
cactacagggcaaaatcactgt

SEQ ID NO: 9438 - DNA, 22 bp, Artificial Sequence
  chemically synthesized
cagggcaaaatcactgtcaact

SEQ ID NO: 9439 - DNA, 22 bp, Artificial Sequence
  chemically synthesized
tcaactaagattagaagcagct

SEQ ID NO: 9440 - DNA, 22 bp, Artificial Sequence
  chemically synthesized
agattagaagcagctgtagtac

SEQ ID NO: 9441 - DNA, 22 bp, Artificial Sequence
  chemically synthesized
gaagcagctgtagtacttgaaa

SEQ ID NO: 9442 - DNA, 22 bp, Artificial Sequence
  chemically synthesized
tagtacttgaaataacatcaga

SEQ ID NO: 9443 - DNA, 22 bp, Artificial Sequence
  chemically synthesized
gaaataacatcagaaaaccaga

SEQ ID NO: 9444 - DNA, 22 bp, Artificial Sequence
  chemically synthesized
aaataacatcagaaaaccagat

SEQ ID NO: 9445 - DNA, 22 bp, Artificial Sequence
  chemically synthesized
tttatgttctttgtaacctgaa

SEQ ID NO: 9446 - DNA, 22 bp, Artificial Sequence
  chemically synthesized
atgttctttgtaacctgaaaag

SEQ ID NO: 9447 - DNA, 22 bp, Artificial Sequence
  chemically synthesized
tgttctttgtaacctgaaaaga

SEQ ID NO: 9448 - DNA, 22 bp, Artificial Sequence
  chemically synthesized
tttgtaacctgaaaagagttat

SEQ ID NO: 9449 - DNA, 22 bp, Artificial Sequence
  chemically synthesized
tgtaacctgaaaagagttatat

SEQ ID NO: 9450 - DNA, 22 bp, Artificial Sequence
  chemically synthesized
gtaacctgaaaagagttatata

SEQ ID NO: 9451 - DNA, 22 bp, Artificial Sequence
  chemically synthesized
taacctgaaaagagttatataa

SEQ ID NO: 9452 - DNA, 22 bp, Artificial Sequence
  chemically synthesized
aaaagagttatataatctgaat

SEQ ID NO: 9453 - DNA, 22 bp, Artificial Sequence
  chemically synthesized
tataatctgaattccagttaac

SEQ ID NO: 9454 - DNA, 22 bp, Artificial Sequence
  chemically synthesized
aattccagttaacttctagtaa

SEQ ID NO: 9455 - DNA, 22 bp, Artificial Sequence
  chemically synthesized
cagttaacttctagtaaaataa

SEQ ID NO: 9456 - DNA, 22 bp, Artificial Sequence
  chemically synthesized
acttctagtaaaataaacgtat

SEQ ID NO: 9457 - DNA, 22 bp, Artificial Sequence
  chemically synthesized
ctagtaaaataaacgtattatt

SEQ ID NO: 9458 - DNA, 22 bp, Artificial Sequence
  chemically synthesized
tagtaaaataaacgtattatta

SEQ ID NO: 9459 - DNA, 22 bp, Artificial Sequence
  chemically synthesized
gtaaaataaacgtattattagc

SEQ ID NO: 9460 - DNA, 22 bp, Artificial Sequence
  chemically synthesized
ttagctcctacctccctatgcc

SEQ ID NO: 9461 - DNA, 22 bp, Artificial Sequence
  chemically synthesized
gctcctacctccctatgcctag

SEQ ID NO: 9462 - DNA, 22 bp, Artificial Sequence
  chemically synthesized
ctacctccctatgcctagtgaa

SEQ ID NO: 9463 - DNA, 22 bp, Artificial Sequence
  chemically synthesized
cctccctatgcctagtgaaaat

SEQ ID NO: 9464 - DNA, 22 bp, Artificial Sequence
  chemically synthesized
cctatgcctagtgaaaatcaaa

SEQ ID NO: 9465 - DNA, 22 bp, Artificial Sequence
  chemically synthesized
tgcctagtgaaaatcaaataag

SEQ ID NO: 9466 - DNA, 22 bp, Artificial Sequence
  chemically synthesized
gtgaaaatcaaataagatcaga

SEQ ID NO: 9467 - DNA, 22 bp, Artificial Sequence
  chemically synthesized
agaagtgagtgcattgcttaca

SEQ ID NO: 9468 - DNA, 22 bp, Artificial Sequence
  chemically synthesized
gaagtgagtgcattgcttacat

SEQ ID NO: 9469 - DNA, 22 bp, Artificial Sequence
  chemically synthesized
cttacatgttcattatcagtac

SEQ ID NO: 9470 - DNA, 22 bp, Artificial Sequence
  chemically synthesized
acatgttcattatcagtacttt

SEQ ID NO: 9471 - DNA, 22 bp, Artificial Sequence
  chemically synthesized
catgttcattatcagtactttg

SEQ ID NO: 9472 - DNA, 22 bp, Artificial Sequence
  chemically synthesized
attatcagtactttgtagagag

SEQ ID NO: 9473 - DNA, 22 bp, Artificial Sequence
  chemically synthesized
tcagtactttgtagagaggcct

SEQ ID NO: 9474 - DNA, 22 bp, Artificial Sequence
  chemically synthesized
tgtagagaggcctcttaattac

SEQ ID NO: 9475 - DNA, 22 bp, Artificial Sequence
  chemically synthesized
gtagagaggcctcttaattaca

SEQ ID NO: 9476 - DNA, 22 bp, Artificial Sequence
  chemically synthesized
tagagaggcctcttaattacac

SEQ ID NO: 9477 - DNA, 22 bp, Artificial Sequence
  chemically synthesized
ttaattacacagcacattgcaa

SEQ ID NO: 9478 - DNA, 22 bp, Artificial Sequence
  chemically synthesized
aattacacagcacattgcaaat

SEQ ID NO: 9479 - DNA, 22 bp, Artificial Sequence
  chemically synthesized
attacacagcacattgcaaatc

SEQ ID NO: 9480 - DNA, 22 bp, Artificial Sequence
  chemically synthesized
cacagcacattgcaaatcaata

SEQ ID NO: 9481 - DNA, 22 bp, Artificial Sequence
  chemically synthesized
caaatcaataaagcctagccga

SEQ ID NO: 9482 - DNA, 22 bp, Artificial Sequence
  chemically synthesized
gccgaaaagagaattgttcagt

SEQ ID NO: 9483 - DNA, 22 bp, Artificial Sequence
  chemically synthesized
ttcagttcaaacgttcaaaact

SEQ ID NO: 9484 - DNA, 22 bp, Artificial Sequence
  chemically synthesized
agttcaaacgttcaaaactaac

SEQ ID NO: 9485 - DNA, 22 bp, Artificial Sequence
  chemically synthesized
aaacgttcaaaactaacatata

SEQ ID NO: 9486 - DNA, 22 bp, Artificial Sequence
  chemically synthesized
aaaactaacatatacttaattt

SEQ ID NO: 9487 - DNA, 22 bp, Artificial Sequence
  chemically synthesized
acatatacttaattttccaggc

SEQ ID NO: 9488 - DNA, 22 bp, Artificial Sequence
  chemically synthesized
aattttccaggcaaaagaacaa

SEQ ID NO: 9489 - DNA, 22 bp, Artificial Sequence
  chemically synthesized
attttccaggcaaaagaacaat

SEQ ID NO: 9490 - DNA, 22 bp, Artificial Sequence
  chemically synthesized
tccaggcaaaagaacaattgcc

SEQ ID NO: 9491 - DNA, 22 bp, Artificial Sequence
  chemically synthesized
ccaggcaaaagaacaattgcca

SEQ ID NO: 9492 - DNA, 22 bp, Artificial Sequence
  chemically synthesized
caggcaaaagaacaattgccaa

SEQ ID NO: 9493 - DNA, 22 bp, Artificial Sequence
  chemically synthesized
ccaagagtggggaaaggcccga

SEQ ID NO: 9494 - DNA, 22 bp, Artificial Sequence
  chemically synthesized
tctcaggagcctcccaccctag

SEQ ID NO: 9495 - DNA, 22 bp, Artificial Sequence
  chemically synthesized
tcaggagcctcccaccctagag

SEQ ID NO: 9496 - DNA, 22 bp, Artificial Sequence
  chemically synthesized
aggagcctcccaccctagagac

SEQ ID NO: 9497 - DNA, 22 bp, Artificial Sequence
  chemically synthesized
ccaccctagagacctccacccc

SEQ ID NO: 9498 - DNA, 22 bp, Artificial Sequence
  chemically synthesized
gagacctccaccccaggtctca

SEQ ID NO: 9499 - DNA, 22 bp, Artificial Sequence
  chemically synthesized
caccccaggtctcaccaaaagt

SEQ ID NO: 9500 - DNA, 22 bp, Artificial Sequence
  chemically synthesized
accaaaagtgggtggaatggtg

SEQ ID NO: 9501 - DNA, 22 bp, Artificial Sequence
  chemically synthesized
agatccccaacgccactctttc

SEQ ID NO: 9502 - DNA, 22 bp, Artificial Sequence
  chemically synthesized
tttcgcgcccccaccgcccaac

SEQ ID NO: 9503 - DNA, 22 bp, Artificial Sequence
  chemically synthesized
tcgcgcccccaccgcccaacgc

SEQ ID NO: 9504 - DNA, 22 bp, Artificial Sequence
  chemically synthesized
cgcgcccccaccgcccaacgca

SEQ ID NO: 9505 - DNA, 22 bp, Artificial Sequence
  chemically synthesized
gcgcccccaccgcccaacgcat

SEQ ID NO: 9506 - DNA, 22 bp, Artificial Sequence
  chemically synthesized
gttctgaggtggaaaccccgtg

SEQ ID NO: 9507 - DNA, 22 bp, Artificial Sequence
  chemically synthesized
tgaggtggaaaccccgtgcgga

SEQ ID NO: 9508 - DNA, 22 bp, Artificial Sequence
  chemically synthesized
aggtggaaaccccgtgcggatc

SEQ ID NO: 9509 - DNA, 22 bp, Artificial Sequence
  chemically synthesized
ctgtgggtttgctcagccttct

SEQ ID NO: 9510 - DNA, 22 bp, Artificial Sequence
  chemically synthesized
tgggtttgctcagccttctcgg

SEQ ID NO: 9511 - DNA, 22 bp, Artificial Sequence
  chemically synthesized
gctcagccttctcggcaagcac

SEQ ID NO: 9512 - DNA, 22 bp, Artificial Sequence
  chemically synthesized
ctcagccttctcggcaagcact

SEQ ID NO: 9513 - DNA, 22 bp, Artificial Sequence
  chemically synthesized
agccttctcggcaagcactcag

SEQ ID NO: 9514 - DNA, 22 bp, Artificial Sequence
  chemically synthesized
ctcggcaagcactcagggaaga

SEQ ID NO: 9515 - DNA, 22 bp, Artificial Sequence
  chemically synthesized
tcggcaagcactcagggaagaa

SEQ ID NO: 9516 - DNA, 22 bp, Artificial Sequence
  chemically synthesized
ggcaagcactcagggaagaact

SEQ ID NO: 9517 - DNA, 22 bp, Artificial Sequence
  chemically synthesized
agggaagaacttcctgtttgga

SEQ ID NO: 9518 - DNA, 22 bp, Artificial Sequence
  chemically synthesized
cctgtttggagatgactgggga

SEQ ID NO: 9519 - DNA, 22 bp, Artificial Sequence
  chemically synthesized
ctgtttggagatgactggggaa

SEQ ID NO: 9520 - DNA, 22 bp, Artificial Sequence
  chemically synthesized
tttggagatgactggggaaaaa

SEQ ID NO: 9521 - DNA, 22 bp, Artificial Sequence
  chemically synthesized
ggagatgactggggaaaaaact

SEQ ID NO: 9522 - DNA, 22 bp, Artificial Sequence
  chemically synthesized
gagatgactggggaaaaaactg

SEQ ID NO: 9523 - DNA, 22 bp, Artificial Sequence
  chemically synthesized
gggaaaaaactgcacagctgac

SEQ ID NO: 9524 - DNA, 22 bp, Artificial Sequence
  chemically synthesized
cacagctgacattggaaataaa

SEQ ID NO: 9525 - DNA, 22 bp, Artificial Sequence
  chemically synthesized
acattggaaataaacccgagtt

SEQ ID NO: 9526 - DNA, 22 bp, Artificial Sequence
  chemically synthesized
gaaataaacccgagttccaggt

SEQ ID NO: 9527 - DNA, 22 bp, Artificial Sequence
  chemically synthesized
caggttcaaggagccccaggct

SEQ ID NO: 9528 - DNA, 22 bp, Artificial Sequence
  chemically synthesized
aaggagccccaggcttagctca

SEQ ID NO: 9529 - DNA, 22 bp, Artificial Sequence
  chemically synthesized
agctcagctcaagtgaggaact

SEQ ID NO: 9530 - DNA, 22 bp, Artificial Sequence
  chemically synthesized
gctcagctcaagtgaggaacta

SEQ ID NO: 9531 - DNA, 22 bp, Artificial Sequence
  chemically synthesized
agctcaagtgaggaactacgag

SEQ ID NO: 9532 - DNA, 22 bp, Artificial Sequence
  chemically synthesized
aagtgaggaactacgagattta

SEQ ID NO: 9533 - DNA, 22 bp, Artificial Sequence
  chemically synthesized
cgagatttatttaaaagcattc

SEQ ID NO: 9534 - DNA, 22 bp, Artificial Sequence
  chemically synthesized
atttaaaagcattctagttggg

SEQ ID NO: 9535 - DNA, 22 bp, Artificial Sequence
  chemically synthesized
tttaaaagcattctagttgggg

SEQ ID NO: 9536 - DNA, 22 bp, Artificial Sequence
  chemically synthesized
aaaagcattctagttgggggaa

SEQ ID NO: 9537 - DNA, 22 bp, Artificial Sequence
  chemically synthesized
aaagcattctagttgggggaag

SEQ ID NO: 9538 - DNA, 22 bp, Artificial Sequence
  chemically synthesized
tagttgggggaagggagtgggc

SEQ ID NO: 9539 - DNA, 22 bp, Artificial Sequence
  chemically synthesized
gttgggggaagggagtgggcgg

SEQ ID NO: 9540 - DNA, 22 bp, Artificial Sequence
  chemically synthesized
ggggaagggagtgggcggttcc

SEQ ID NO: 9541 - DNA, 22 bp, Artificial Sequence
  chemically synthesized
caaaagtcactccgcagagccg

SEQ ID NO: 9542 - DNA, 22 bp, Artificial Sequence
  chemically synthesized
cgcagagccgggacagccgggg

SEQ ID NO: 9543 - DNA, 22 bp, Artificial Sequence
  chemically synthesized
gggcgagggacccctatctgca

SEQ ID NO: 9544 - DNA, 22 bp, Artificial Sequence
  chemically synthesized
tctgcagttcagtggtaggcac

SEQ ID NO: 9545 - DNA, 22 bp, Artificial Sequence
  chemically synthesized
cagttcagtggtaggcactccc

SEQ ID NO: 9546 - DNA, 22 bp, Artificial Sequence
  chemically synthesized
agtggtaggcactccctcacgg

SEQ ID NO: 9547 - DNA, 22 bp, Artificial Sequence
  chemically synthesized
cctcacggggtctggacgcaga

SEQ ID NO: 9548 - DNA, 22 bp, Artificial Sequence
  chemically synthesized
acggggtctggacgcagaaagt

SEQ ID NO: 9549 - DNA, 22 bp, Artificial Sequence
  chemically synthesized
gacgcagaaagtagggagaggg

SEQ ID NO: 9550 - DNA, 22 bp, Artificial Sequence
  chemically synthesized
gcggatagggttgagcaggtcc

SEQ ID NO: 9551 - DNA, 22 bp, Artificial Sequence
  chemically synthesized
cggatagggttgagcaggtcct

SEQ ID NO: 9552 - DNA, 22 bp, Artificial Sequence
  chemically synthesized
agcaggtcctccaaagttagca

SEQ ID NO: 9553 - DNA, 22 bp, Artificial Sequence
  chemically synthesized
caaagttagcaaactcccaagc

SEQ ID NO: 9554 - DNA, 22 bp, Artificial Sequence
  chemically synthesized
gcaaactcccaagcgcaaagaa

SEQ ID NO: 9555 - DNA, 22 bp, Artificial Sequence
  chemically synthesized
ccaagcgcaaagaaaaagctag

SEQ ID NO: 9556 - DNA, 22 bp, Artificial Sequence
  chemically synthesized
gtttcgatttttccacccccgc

SEQ ID NO: 9557 - DNA, 22 bp, Artificial Sequence
  chemically synthesized
cgatttttccacccccgccgcg

SEQ ID NO: 9558 - DNA, 22 bp, Artificial Sequence
  chemically synthesized
gatttttccacccccgccgcgc

SEQ ID NO: 9559 - DNA, 22 bp, Artificial Sequence
  chemically synthesized
ttccacccccgccgcgccccta

SEQ ID NO: 9560 - DNA, 22 bp, Artificial Sequence
  chemically synthesized
tccacccccgccgcgcccctag

SEQ ID NO: 9561 - DNA, 22 bp, Artificial Sequence
  chemically synthesized
ccacccccgccgcgcccctagt

SEQ ID NO: 9562 - DNA, 22 bp, Artificial Sequence
  chemically synthesized
cacccccgccgcgcccctagtt

SEQ ID NO: 9563 - DNA, 22 bp, Artificial Sequence
  chemically synthesized
gttcgcccgcagccctcggact

SEQ ID NO: 9564 - DNA, 22 bp, Artificial Sequence
  chemically synthesized
gcccgcagccctcggactcacg

SEQ ID NO: 9565 - DNA, 22 bp, Artificial Sequence
  chemically synthesized
ggactcacgcagcaagcgcccc

SEQ ID NO: 9566 - DNA, 22 bp, Artificial Sequence
  chemically synthesized
acgcagcaagcgcccctgcagg

SEQ ID NO: 9567 - DNA, 22 bp, Artificial Sequence
  chemically synthesized
caggaccgcggtctgcaaaagc

SEQ ID NO: 9568 - DNA, 22 bp, Artificial Sequence
  chemically synthesized
caaaagcatcaggaggagaagc

SEQ ID NO: 9569 - DNA, 22 bp, Artificial Sequence
  chemically synthesized
gctcgcgggcccatttccccag

SEQ ID NO: 9570 - DNA, 22 bp, Artificial Sequence
  chemically synthesized
gcgggcccatttccccagctct

SEQ ID NO: 9571 - DNA, 22 bp, Artificial Sequence
  chemically synthesized
ccccagctctggccgcacgtcc

SEQ ID NO: 9572 - DNA, 22 bp, Artificial Sequence
  chemically synthesized
cccagctctggccgcacgtccc

SEQ ID NO: 9573 - DNA, 22 bp, Artificial Sequence
  chemically synthesized
tggccgcacgtccccgttaaat

SEQ ID NO: 9574 - DNA, 22 bp, Artificial Sequence
  chemically synthesized
gccgcacgtccccgttaaatct

SEQ ID NO: 9575 - DNA, 22 bp, Artificial Sequence
  chemically synthesized
aatctccgcttcttttgggggg

SEQ ID NO: 9576 - DNA, 22 bp, Artificial Sequence
  chemically synthesized
cgcttcttttggggggcgggga

SEQ ID NO: 9577 - DNA, 22 bp, Artificial Sequence
  chemically synthesized
cttttggggggcggggaaacgg

SEQ ID NO: 9578 - DNA, 22 bp, Artificial Sequence
  chemically synthesized
ttttggggggcggggaaacggg

SEQ ID NO: 9579 - DNA, 22 bp, Artificial Sequence
  chemically synthesized
ttggggggcggggaaacgggga

SEQ ID NO: 9580 - DNA, 22 bp, Artificial Sequence
  chemically synthesized
tggggggcggggaaacggggat

SEQ ID NO: 9581 - DNA, 22 bp, Artificial Sequence
  chemically synthesized
ggggggcggggaaacggggatg

SEQ ID NO: 9582 - DNA, 22 bp, Artificial Sequence
  chemically synthesized
gggggcggggaaacggggatgg

SEQ ID NO: 9583 - DNA, 22 bp, Artificial Sequence
  chemically synthesized
cagaagtcaccctacagctatt

SEQ ID NO: 9584 - DNA, 22 bp, Artificial Sequence
  chemically synthesized
cagctattgcctaggctcagga

SEQ ID NO: 9585 - DNA, 22 bp, Artificial Sequence
  chemically synthesized
ttgcctaggctcaggagatgcc

SEQ ID NO: 9586 - DNA, 22 bp, Artificial Sequence
  chemically synthesized
cctaggctcaggagatgcccag

SEQ ID NO: 9587 - DNA, 22 bp, Artificial Sequence
  chemically synthesized
ggctcaggagatgcccagtaaa

SEQ ID NO: 9588 - DNA, 22 bp, Artificial Sequence
  chemically synthesized
aggagatgcccagtaaaacttc

SEQ ID NO: 9589 - DNA, 22 bp, Artificial Sequence
  chemically synthesized
cctggtgaaaagcaacaggtct

SEQ ID NO: 9590 - DNA, 22 bp, Artificial Sequence
  chemically synthesized
ctggtgaaaagcaacaggtctt

SEQ ID NO: 9591 - DNA, 22 bp, Artificial Sequence
  chemically synthesized
gtgaaaagcaacaggtctttca

SEQ ID NO: 9592 - DNA, 22 bp, Artificial Sequence
  chemically synthesized
tcagaactttagttctctctct

SEQ ID NO: 9593 - DNA, 22 bp, Artificial Sequence
  chemically synthesized
cagaactttagttctctctctc

SEQ ID NO: 9594 - DNA, 22 bp, Artificial Sequence
  chemically synthesized
agaactttagttctctctctcc

SEQ ID NO: 9595 - DNA, 22 bp, Artificial Sequence
  chemically synthesized
tagttctctctctcctacagca

SEQ ID NO: 9596 - DNA, 22 bp, Artificial Sequence
  chemically synthesized
agttctctctctcctacagcag

SEQ ID NO: 9597 - DNA, 22 bp, Artificial Sequence
  chemically synthesized
gttctctctctcctacagcaga

SEQ ID NO: 9598 - DNA, 22 bp, Artificial Sequence
  chemically synthesized
tctctctcctacagcagaaggt

SEQ ID NO: 9599 - DNA, 22 bp, Artificial Sequence
  chemically synthesized
tctctcctacagcagaaggtac

SEQ ID NO: 9600 - DNA, 22 bp, Artificial Sequence
  chemically synthesized
tctcctacagcagaaggtacct

SEQ ID NO: 9601 - DNA, 22 bp, Artificial Sequence
  chemically synthesized
tcctacagcagaaggtacctgc

SEQ ID NO: 9602 - DNA, 22 bp, Artificial Sequence
  chemically synthesized
ctacagcagaaggtacctgctt

SEQ ID NO: 9603 - DNA, 22 bp, Artificial Sequence
  chemically synthesized
cagcagaaggtacctgcttgtg

SEQ ID NO: 9604 - DNA, 22 bp, Artificial Sequence
  chemically synthesized
cttgtgaaacactaggtgatcc

SEQ ID NO: 9605 - DNA, 22 bp, Artificial Sequence
  chemically synthesized
gtgaaacactaggtgatccagt

SEQ ID NO: 9606 - DNA, 22 bp, Artificial Sequence
  chemically synthesized
tgaaacactaggtgatccagtg

SEQ ID NO: 9607 - DNA, 22 bp, Artificial Sequence
  chemically synthesized
ggtgatccagtgtcccccttgg

SEQ ID NO: 9608 - DNA, 22 bp, Artificial Sequence
  chemically synthesized
ggtttttaaatcctgaaggggt

SEQ ID NO: 9609 - DNA, 22 bp, Artificial Sequence
  chemically synthesized
gtttttaaatcctgaaggggtg

SEQ ID NO: 9610 - DNA, 22 bp, Artificial Sequence
  chemically synthesized
ttaaatcctgaaggggtgttgt

SEQ ID NO: 9611 - DNA, 22 bp, Artificial Sequence
  chemically synthesized
taaatcctgaaggggtgttgtt

SEQ ID NO: 9612 - DNA, 22 bp, Artificial Sequence
  chemically synthesized
aaatcctgaaggggtgttgttg

SEQ ID NO: 9613 - DNA, 22 bp, Artificial Sequence
  chemically synthesized
aatcctgaaggggtgttgttga

SEQ ID NO: 9614 - DNA, 22 bp, Artificial Sequence
  chemically synthesized
aaggggtgttgttgattgggga

SEQ ID NO: 9615 - DNA, 22 bp, Artificial Sequence
  chemically synthesized
ttgattggggaaagtagcttcg

SEQ ID NO: 9616 - DNA, 22 bp, Artificial Sequence
  chemically synthesized
attggggaaagtagcttcgcaa

SEQ ID NO: 9617 - DNA, 22 bp, Artificial Sequence
  chemically synthesized
gggaaagtagcttcgcaatgtt

SEQ ID NO: 9618 - DNA, 22 bp, Artificial Sequence
  chemically synthesized
cgcaatgttctgatctgaactt

SEQ ID NO: 9619 - DNA, 22 bp, Artificial Sequence
  chemically synthesized
gcaatgttctgatctgaacttt

SEQ ID NO: 9620 - DNA, 22 bp, Artificial Sequence
  chemically synthesized
tgatctgaactttagatattta

SEQ ID NO: 9621 - DNA, 22 bp, Artificial Sequence
  chemically synthesized
atctgaactttagatatttaaa

SEQ ID NO: 9622 - DNA, 22 bp, Artificial Sequence
  chemically synthesized
aactttagatatttaaatattt

SEQ ID NO: 9623 - DNA, 22 bp, Artificial Sequence
  chemically synthesized
tagatatttaaatatttatgat

SEQ ID NO: 9624 - DNA, 22 bp, Artificial Sequence
  chemically synthesized
agatatttaaatatttatgatt

SEQ ID NO: 9625 - DNA, 22 bp, Artificial Sequence
  chemically synthesized
gatatttaaatatttatgattt

SEQ ID NO: 9626 - DNA, 22 bp, Artificial Sequence
  chemically synthesized
aaatatttatgattttcaaaat

SEQ ID NO: 9627 - DNA, 22 bp, Artificial Sequence
  chemically synthesized
aatatttatgattttcaaaatt

SEQ ID NO: 9628 - DNA, 22 bp, Artificial Sequence
  chemically synthesized
atgattttcaaaattcaatcat

SEQ ID NO: 9629 - DNA, 22 bp, Artificial Sequence
  chemically synthesized
tgattttcaaaattcaatcata

SEQ ID NO: 9630 - DNA, 22 bp, Artificial Sequence
  chemically synthesized
tcaaaattcaatcatacattta

SEQ ID NO: 9631 - DNA, 22 bp, Artificial Sequence
  chemically synthesized
caaaattcaatcatacatttaa

SEQ ID NO: 9632 - DNA, 22 bp, Artificial Sequence
  chemically synthesized
aaaattcaatcatacatttaaa

SEQ ID NO: 9633 - DNA, 22 bp, Artificial Sequence
  chemically synthesized
aatcatacatttaaaaatttta

SEQ ID NO: 9634 - DNA, 22 bp, Artificial Sequence
  chemically synthesized
aaaaattttatctcaaccttag

SEQ ID NO: 9635 - DNA, 22 bp, Artificial Sequence
  chemically synthesized
aaaattttatctcaaccttaga

SEQ ID NO: 9636 - DNA, 22 bp, Artificial Sequence
  chemically synthesized
tatctcaaccttagaccaactt

SEQ ID NO: 9637 - DNA, 22 bp, Artificial Sequence
  chemically synthesized
atctcaaccttagaccaactta

SEQ ID NO: 9638 - DNA, 22 bp, Artificial Sequence
  chemically synthesized
tctcaaccttagaccaacttat

SEQ ID NO: 9639 - DNA, 22 bp, Artificial Sequence
  chemically synthesized
aaccttagaccaacttatgtct

SEQ ID NO: 9640 - DNA, 22 bp, Artificial Sequence
  chemically synthesized
agaccaacttatgtcttatttg

SEQ ID NO: 9641 - DNA, 22 bp, Artificial Sequence
  chemically synthesized
gaccaacttatgtcttatttga

SEQ ID NO: 9642 - DNA, 22 bp, Artificial Sequence
  chemically synthesized
atgtcttatttgacttagaaat

SEQ ID NO: 9643 - DNA, 22 bp, Artificial Sequence
  chemically synthesized
tgtcttatttgacttagaaata

SEQ ID NO: 9644 - DNA, 22 bp, Artificial Sequence
  chemically synthesized
atttgacttagaaatataaagc

SEQ ID NO: 9645 - DNA, 22 bp, Artificial Sequence
  chemically synthesized
tttgacttagaaatataaagct

SEQ ID NO: 9646 - DNA, 22 bp, Artificial Sequence
  chemically synthesized
gacttagaaatataaagctttt

SEQ ID NO: 9647 - DNA, 22 bp, Artificial Sequence
  chemically synthesized
acttagaaatataaagcttttt

SEQ ID NO: 9648 - DNA, 22 bp, Artificial Sequence
  chemically synthesized
agaaatataaagctttttcatt

SEQ ID NO: 9649 - DNA, 22 bp, Artificial Sequence
  chemically synthesized
gaaatataaagctttttcattt

SEQ ID NO: 9650 - DNA, 22 bp, Artificial Sequence
  chemically synthesized
tttcattttgttttttgattca

SEQ ID NO: 9651 - DNA, 22 bp, Artificial Sequence
  chemically synthesized
ttcattttgttttttgattcaa

SEQ ID NO: 9652 - DNA, 22 bp, Artificial Sequence
  chemically synthesized
tcattttgttttttgattcaaa

SEQ ID NO: 9653 - DNA, 22 bp, Artificial Sequence
  chemically synthesized
cattttgttttttgattcaaat

SEQ ID NO: 9654 - DNA, 22 bp, Artificial Sequence
  chemically synthesized
attttgttttttgattcaaatt

SEQ ID NO: 9655 - DNA, 22 bp, Artificial Sequence
  chemically synthesized
tgttttttgattcaaattaatt

SEQ ID NO: 9656 - DNA, 22 bp, Artificial Sequence
  chemically synthesized
gttttttgattcaaattaatta

SEQ ID NO: 9657 - DNA, 22 bp, Artificial Sequence
  chemically synthesized
ttttttgattcaaattaattaa

SEQ ID NO: 9658 - DNA, 22 bp, Artificial Sequence
  chemically synthesized
tttgattcaaattaattaagtc

SEQ ID NO: 9659 - DNA, 22 bp, Artificial Sequence
  chemically synthesized
ttgattcaaattaattaagtca

SEQ ID NO: 9660 - DNA, 22 bp, Artificial Sequence
  chemically synthesized
tgattcaaattaattaagtcat

SEQ ID NO: 9661 - DNA, 22 bp, Artificial Sequence
  chemically synthesized
gattcaaattaattaagtcata

SEQ ID NO: 9662 - DNA, 22 bp, Artificial Sequence
  chemically synthesized
attcaaattaattaagtcataa

SEQ ID NO: 9663 - DNA, 22 bp, Artificial Sequence
  chemically synthesized
aaattaattaagtcataacatt

SEQ ID NO: 9664 - DNA, 22 bp, Artificial Sequence
  chemically synthesized
attaagtcataacattaaccaa

SEQ ID NO: 9665 - DNA, 22 bp, Artificial Sequence
  chemically synthesized
agtcataacattaaccaattag

SEQ ID NO: 9666 - DNA, 22 bp, Artificial Sequence
  chemically synthesized
accaattagatcctactgaaac

SEQ ID NO: 9667 - DNA, 22 bp, Artificial Sequence
  chemically synthesized
gatcctactgaaacaccttcca

SEQ ID NO: 9668 - DNA, 22 bp, Artificial Sequence
  chemically synthesized
ctgaaacaccttccacagcctt

SEQ ID NO: 9669 - DNA, 22 bp, Artificial Sequence
  chemically synthesized
aaacaccttccacagccttcat

SEQ ID NO: 9670 - DNA, 22 bp, Artificial Sequence
  chemically synthesized
ccacagccttcataattgaatt

SEQ ID NO: 9671 - DNA, 22 bp, Artificial Sequence
  chemically synthesized
cacagccttcataattgaatta

SEQ ID NO: 9672 - DNA, 22 bp, Artificial Sequence
  chemically synthesized
cataattgaattatctgacaag

SEQ ID NO: 9673 - DNA, 22 bp, Artificial Sequence
  chemically synthesized
ataattgaattatctgacaagt

SEQ ID NO: 9674 - DNA, 22 bp, Artificial Sequence
  chemically synthesized
aattatctgacaagtgtttcac

SEQ ID NO: 9675 - DNA, 22 bp, Artificial Sequence
  chemically synthesized
tctgacaagtgtttcacaaact

SEQ ID NO: 9676 - DNA, 22 bp, Artificial Sequence
  chemically synthesized
acaagtgtttcacaaactttac

SEQ ID NO: 9677 - DNA, 22 bp, Artificial Sequence
  chemically synthesized
cacaaactttacagtattggga

SEQ ID NO: 9678 - DNA, 22 bp, Artificial Sequence
  chemically synthesized
acaaactttacagtattgggat

SEQ ID NO: 9679 - DNA, 22 bp, Artificial Sequence
  chemically synthesized
tacagtattgggattatctgga

SEQ ID NO: 9680 - DNA, 22 bp, Artificial Sequence
  chemically synthesized
acagtattgggattatctggag

SEQ ID NO: 9681 - DNA, 22 bp, Artificial Sequence
  chemically synthesized
cagtattgggattatctggaga

SEQ ID NO: 9682 - DNA, 22 bp, Artificial Sequence
  chemically synthesized
ggattatctggagaatgattaa

SEQ ID NO: 9683 - DNA, 22 bp, Artificial Sequence
  chemically synthesized
tctggagaatgattaaacatat

SEQ ID NO: 9684 - DNA, 22 bp, Artificial Sequence
  chemically synthesized
gagaatgattaaacatattgag

SEQ ID NO: 9685 - DNA, 22 bp, Artificial Sequence
  chemically synthesized
aacatattgaggcctgctccta

SEQ ID NO: 9686 - DNA, 22 bp, Artificial Sequence
  chemically synthesized
aggcctgctcctaaccccagac

SEQ ID NO: 9687 - DNA, 22 bp, Artificial Sequence
  chemically synthesized
ctcctaaccccagacacactga

SEQ ID NO: 9688 - DNA, 22 bp, Artificial Sequence
  chemically synthesized
ctaaccccagacacactgattt

SEQ ID NO: 9689 - DNA, 22 bp, Artificial Sequence
  chemically synthesized
accccagacacactgatttaat

SEQ ID NO: 9690 - DNA, 22 bp, Artificial Sequence
  chemically synthesized
atttaatgggtaattgttaggt

SEQ ID NO: 9691 - DNA, 22 bp, Artificial Sequence
  chemically synthesized
aatgggtaattgttaggtagtt

SEQ ID NO: 9692 - DNA, 22 bp, Artificial Sequence
  chemically synthesized
atgggtaattgttaggtagtta

SEQ ID NO: 9693 - DNA, 22 bp, Artificial Sequence
  chemically synthesized
ttaggtagttagacattagcag

SEQ ID NO: 9694 - DNA, 22 bp, Artificial Sequence
  chemically synthesized
ggtagttagacattagcagttg

SEQ ID NO: 9695 - DNA, 22 bp, Artificial Sequence
  chemically synthesized
gacattagcagttgggagggga

SEQ ID NO: 9696 - DNA, 22 bp, Artificial Sequence
  chemically synthesized
gcagttgggaggggatgacaga

SEQ ID NO: 9697 - DNA, 22 bp, Artificial Sequence
  chemically synthesized
ggaggggatgacagaagagagc

SEQ ID NO: 9698 - DNA, 22 bp, Artificial Sequence
  chemically synthesized
tcactaagacagccactggccc

SEQ ID NO: 9699 - DNA, 22 bp, Artificial Sequence
  chemically synthesized
agacagccactggcccacctaa

SEQ ID NO: 9700 - DNA, 22 bp, Artificial Sequence
  chemically synthesized
gcccacctaaattcaggcccaa

SEQ ID NO: 9701 - DNA, 22 bp, Artificial Sequence
  chemically synthesized
aattcaggcccaagactaccct

SEQ ID NO: 9702 - DNA, 22 bp, Artificial Sequence
  chemically synthesized
aggcccaagactaccctaatgc

SEQ ID NO: 9703 - DNA, 22 bp, Artificial Sequence
  chemically synthesized
ccctaatgccaccctaagggat

SEQ ID NO: 9704 - DNA, 22 bp, Artificial Sequence
  chemically synthesized
atgccaccctaagggatggagt

SEQ ID NO: 9705 - DNA, 22 bp, Artificial Sequence
  chemically synthesized
agggatggagtttatgataaag

SEQ ID NO: 9706 - DNA, 22 bp, Artificial Sequence
  chemically synthesized
atgataaagtctgtggccaaaa

SEQ ID NO: 9707 - DNA, 22 bp, Artificial Sequence
  chemically synthesized
tgataaagtctgtggccaaaat

SEQ ID NO: 9708 - DNA, 22 bp, Artificial Sequence
  chemically synthesized
tggccaaaatatcctggagaaa

SEQ ID NO: 9709 - DNA, 22 bp, Artificial Sequence
  chemically synthesized
gagaaagagaaaggagggtaca

SEQ ID NO: 9710 - DNA, 22 bp, Artificial Sequence
  chemically synthesized
cctaaggtggcacatgcccaac

SEQ ID NO: 9711 - DNA, 22 bp, Artificial Sequence
  chemically synthesized
aggtggcacatgcccaacaaca

SEQ ID NO: 9712 - DNA, 22 bp, Artificial Sequence
  chemically synthesized
tcttcaagttcaccccaagttc

SEQ ID NO: 9713 - DNA, 22 bp, Artificial Sequence
  chemically synthesized
caagttcaccccaagttcatca

SEQ ID NO: 9714 - DNA, 22 bp, Artificial Sequence
  chemically synthesized
aagttcaccccaagttcatcat

SEQ ID NO: 9715 - DNA, 22 bp, Artificial Sequence
  chemically synthesized
accccaagttcatcatgccatc

SEQ ID NO: 9716 - DNA, 22 bp, Artificial Sequence
  chemically synthesized
atcatgccatcattataataga

SEQ ID NO: 9717 - DNA, 22 bp, Artificial Sequence
  chemically synthesized
taatagaatttacatacagttt

SEQ ID NO: 9718 - DNA, 22 bp, Artificial Sequence
  chemically synthesized
acatacagttttgcccccccat

SEQ ID NO: 9719 - DNA, 22 bp, Artificial Sequence
  chemically synthesized
catacagttttgcccccccatc

SEQ ID NO: 9720 - DNA, 22 bp, Artificial Sequence
  chemically synthesized
tgcccccccatccctgggaggc

SEQ ID NO: 9721 - DNA, 22 bp, Artificial Sequence
  chemically synthesized
gcccccccatccctgggaggct

SEQ ID NO: 9722 - DNA, 22 bp, Artificial Sequence
  chemically synthesized
cccccccatccctgggaggctt

SEQ ID NO: 9723 - DNA, 22 bp, Artificial Sequence
  chemically synthesized
ggaggcttttcttaacaaatta

SEQ ID NO: 9724 - DNA, 22 bp, Artificial Sequence
  chemically synthesized
ttcttaacaaattataggtaag

SEQ ID NO: 9725 - DNA, 22 bp, Artificial Sequence
  chemically synthesized
tcttaacaaattataggtaaga

SEQ ID NO: 9726 - DNA, 22 bp, Artificial Sequence
  chemically synthesized
cttaacaaattataggtaagac

SEQ ID NO: 9727 - DNA, 22 bp, Artificial Sequence
  chemically synthesized
ttaacaaattataggtaagacc

SEQ ID NO: 9728 - DNA, 22 bp, Artificial Sequence
  chemically synthesized
aacaaattataggtaagaccat

SEQ ID NO: 9729 - DNA, 22 bp, Artificial Sequence
  chemically synthesized
acaaattataggtaagaccatg

SEQ ID NO: 9730 - DNA, 22 bp, Artificial Sequence
  chemically synthesized
taggtaagaccatgcacagttt

SEQ ID NO: 9731 - DNA, 22 bp, Artificial Sequence
  chemically synthesized
aattttagattgtatagctata

SEQ ID NO: 9732 - DNA, 22 bp, Artificial Sequence
  chemically synthesized
attttagattgtatagctatac

SEQ ID NO: 9733 - DNA, 22 bp, Artificial Sequence
  chemically synthesized
tagattgtatagctatacactt

SEQ ID NO: 9734 - DNA, 22 bp, Artificial Sequence
  chemically synthesized
agattgtatagctatacacttc

SEQ ID NO: 9735 - DNA, 22 bp, Artificial Sequence
  chemically synthesized
gattgtatagctatacacttca

SEQ ID NO: 9736 - DNA, 22 bp, Artificial Sequence
  chemically synthesized
tatagctatacacttcaatcaa

SEQ ID NO: 9737 - DNA, 22 bp, Artificial Sequence
  chemically synthesized
tacacttcaatcaaataacatc

SEQ ID NO: 9738 - DNA, 22 bp, Artificial Sequence
  chemically synthesized
caatcaaataacatcatcctgt

SEQ ID NO: 9739 - DNA, 22 bp, Artificial Sequence
  chemically synthesized
aatcaaataacatcatcctgtc

SEQ ID NO: 9740 - DNA, 22 bp, Artificial Sequence
  chemically synthesized
tcactcagatacagcccaaacc

SEQ ID NO: 9741 - DNA, 22 bp, Artificial Sequence
  chemically synthesized
agatacagcccaaacctcaact

SEQ ID NO: 9742 - DNA, 22 bp, Artificial Sequence
  chemically synthesized
aactcctccccacaaaccccat

SEQ ID NO: 9743 - DNA, 22 bp, Artificial Sequence
  chemically synthesized
ctccccacaaaccccataaaag

SEQ ID NO: 9744 - DNA, 22 bp, Artificial Sequence
  chemically synthesized
cccacaaaccccataaaagcac

SEQ ID NO: 9745 - DNA, 22 bp, Artificial Sequence
  chemically synthesized
gagctctgtaaagaagtgctga

SEQ ID NO: 9746 - DNA, 22 bp, Artificial Sequence
  chemically synthesized
agctctgtaaagaagtgctgag

SEQ ID NO: 9747 - DNA, 22 bp, Artificial Sequence
  chemically synthesized
tgtaaagaagtgctgagttcac

SEQ ID NO: 9748 - DNA, 22 bp, Artificial Sequence
  chemically synthesized
taaagaagtgctgagttcactt

SEQ ID NO: 9749 - DNA, 22 bp, Artificial Sequence
  chemically synthesized
agttcacttcgcagaaataagc

SEQ ID NO: 9750 - DNA, 22 bp, Artificial Sequence
  chemically synthesized
acttcgcagaaataagcccgct

SEQ ID NO: 9751 - DNA, 22 bp, Artificial Sequence
  chemically synthesized
cgcagaaataagcccgctgtcc

SEQ ID NO: 9752 - DNA, 22 bp, Artificial Sequence
  chemically synthesized
gcagaaataagcccgctgtccc

SEQ ID NO: 9753 - DNA, 22 bp, Artificial Sequence
  chemically synthesized
tccctcagagtgtattattgtg

SEQ ID NO: 9754 - DNA, 22 bp, Artificial Sequence
  chemically synthesized
agagtgtattattgtgcttcaa

SEQ ID NO: 9755 - DNA, 22 bp, Artificial Sequence
  chemically synthesized
ttgtgcttcaataaactttgct

SEQ ID NO: 9756 - DNA, 22 bp, Artificial Sequence
  chemically synthesized
tgcttcaataaactttgcttta

SEQ ID NO: 9757 - DNA, 22 bp, Artificial Sequence
  chemically synthesized
caataaactttgctttaagctt

SEQ ID NO: 9758 - DNA, 22 bp, Artificial Sequence
  chemically synthesized
aataaactttgctttaagcttg

SEQ ID NO: 9759 - DNA, 22 bp, Artificial Sequence
  chemically synthesized
tgctttaagcttgcattttggt

SEQ ID NO: 9760 - DNA, 22 bp, Artificial Sequence
  chemically synthesized
gctttaagcttgcattttggtg

SEQ ID NO: 9761 - DNA, 22 bp, Artificial Sequence
  chemically synthesized
ctttaagcttgcattttggtgt

SEQ ID NO: 9762 - DNA, 22 bp, Artificial Sequence
  chemically synthesized
taagcttgcattttggtgttag

SEQ ID NO: 9763 - DNA, 22 bp, Artificial Sequence
  chemically synthesized
aagcttgcattttggtgttagt

SEQ ID NO: 9764 - DNA, 22 bp, Artificial Sequence
  chemically synthesized
agcttgcattttggtgttagtt

SEQ ID NO: 9765 - DNA, 22 bp, Artificial Sequence
  chemically synthesized
gcattttggtgttagtttgtag

SEQ ID NO: 9766 - DNA, 22 bp, Artificial Sequence
  chemically synthesized
cattttggtgttagtttgtagt

SEQ ID NO: 9767 - DNA, 22 bp, Artificial Sequence
  chemically synthesized
tggtgttagtttgtagttcttt

SEQ ID NO: 9768 - DNA, 22 bp, Artificial Sequence
  chemically synthesized
ggtgttagtttgtagttctttg

SEQ ID NO: 9769 - DNA, 22 bp, Artificial Sequence
  chemically synthesized
gtgttagtttgtagttctttgc

SEQ ID NO: 9770 - DNA, 22 bp, Artificial Sequence
  chemically synthesized
gtttgtagttctttgctcacta

SEQ ID NO: 9771 - DNA, 22 bp, Artificial Sequence
  chemically synthesized
gtagttctttgctcactatcac

SEQ ID NO: 9772 - DNA, 22 bp, Artificial Sequence
  chemically synthesized
tagttctttgctcactatcaca

SEQ ID NO: 9773 - DNA, 22 bp, Artificial Sequence
  chemically synthesized
tttgctcactatcacaagaact

SEQ ID NO: 9774 - DNA, 22 bp, Artificial Sequence
  chemically synthesized
tgctcactatcacaagaactga

SEQ ID NO: 9775 - DNA, 22 bp, Artificial Sequence
  chemically synthesized
gctcactatcacaagaactgag

SEQ ID NO: 9776 - DNA, 22 bp, Artificial Sequence
  chemically synthesized
ctcactatcacaagaactgaga

SEQ ID NO: 9777 - DNA, 22 bp, Artificial Sequence
  chemically synthesized
actatcacaagaactgagattg

SEQ ID NO: 9778 - DNA, 22 bp, Artificial Sequence
  chemically synthesized
tcacaagaactgagattgctgg

SEQ ID NO: 9779 - DNA, 22 bp, Artificial Sequence
  chemically synthesized
agattgctggttcagagctccg

SEQ ID NO: 9780 - DNA, 22 bp, Artificial Sequence
  chemically synthesized
ctggttcagagctccggctata

SEQ ID NO: 9781 - DNA, 22 bp, Artificial Sequence
  chemically synthesized
gttcagagctccggctataata

SEQ ID NO: 9782 - DNA, 22 bp, Artificial Sequence
  chemically synthesized
agagctccggctataataatct

SEQ ID NO: 9783 - DNA, 22 bp, Artificial Sequence
  chemically synthesized
cggctataataatctcctcggt

SEQ ID NO: 9784 - DNA, 22 bp, Artificial Sequence
  chemically synthesized
taataatctcctcggttaaagg

SEQ ID NO: 9785 - DNA, 22 bp, Artificial Sequence
  chemically synthesized
ctcggttaaaggatccatccca

SEQ ID NO: 9786 - DNA, 22 bp, Artificial Sequence
  chemically synthesized
ggttaaaggatccatcccaatg

SEQ ID NO: 9787 - DNA, 22 bp, Artificial Sequence
  chemically synthesized
aaggatccatcccaatgcataa

SEQ ID NO: 9788 - DNA, 22 bp, Artificial Sequence
  chemically synthesized
ccagtaacagtatgggatgcca

SEQ ID NO: 9789 - DNA, 22 bp, Artificial Sequence
  chemically synthesized
ggcaatgggattttaaaagctt

SEQ ID NO: 9790 - DNA, 22 bp, Artificial Sequence
  chemically synthesized
taaaagctttccttctccctca

SEQ ID NO: 9791 - DNA, 22 bp, Artificial Sequence
  chemically synthesized
aaaagctttccttctccctcaa

SEQ ID NO: 9792 - DNA, 22 bp, Artificial Sequence
  chemically synthesized
aaagctttccttctccctcaac

SEQ ID NO: 9793 - DNA, 22 bp, Artificial Sequence
  chemically synthesized
tccttctccctcaacgaagttt

SEQ ID NO: 9794 - DNA, 22 bp, Artificial Sequence
  chemically synthesized
ccttctccctcaacgaagtttg

SEQ ID NO: 9795 - DNA, 22 bp, Artificial Sequence
  chemically synthesized
cttctccctcaacgaagtttgg

SEQ ID NO: 9796 - DNA, 22 bp, Artificial Sequence
  chemically synthesized
ctccctcaacgaagtttgggaa

SEQ ID NO: 9797 - DNA, 22 bp, Artificial Sequence
  chemically synthesized
tccctcaacgaagtttgggaat

SEQ ID NO: 9798 - DNA, 22 bp, Artificial Sequence
  chemically synthesized
cctcaacgaagtttgggaatta

SEQ ID NO: 9799 - DNA, 22 bp, Artificial Sequence
  chemically synthesized
aacgaagtttgggaattattgc

SEQ ID NO: 9800 - DNA, 22 bp, Artificial Sequence
  chemically synthesized
gggaattattgccttagacatt

SEQ ID NO: 9801 - DNA, 22 bp, Artificial Sequence
  chemically synthesized
ggaattattgccttagacattt

SEQ ID NO: 9802 - DNA, 22 bp, Artificial Sequence
  chemically synthesized
ttgccttagacatttcaaacaa

SEQ ID NO: 9803 - DNA, 22 bp, Artificial Sequence
  chemically synthesized
ccttagacatttcaaacaatat

SEQ ID NO: 9804 - DNA, 22 bp, Artificial Sequence
  chemically synthesized
agacatttcaaacaatattaat

SEQ ID NO: 9805 - DNA, 22 bp, Artificial Sequence
  chemically synthesized
gacatttcaaacaatattaata

SEQ ID NO: 9806 - DNA, 22 bp, Artificial Sequence
  chemically synthesized
caaacaatattaataaatttaa

SEQ ID NO: 9807 - DNA, 22 bp, Artificial Sequence
  chemically synthesized
aaacaatattaataaatttaat

SEQ ID NO: 9808 - DNA, 22 bp, Artificial Sequence
  chemically synthesized
ataaatttaatacacctgattt

SEQ ID NO: 9809 - DNA, 22 bp, Artificial Sequence
  chemically synthesized
aatacacctgatttgctccaaa

SEQ ID NO: 9810 - DNA, 22 bp, Artificial Sequence
  chemically synthesized
atacacctgatttgctccaaac

SEQ ID NO: 9811 - DNA, 22 bp, Artificial Sequence
  chemically synthesized
atttgctccaaacctttacata

SEQ ID NO: 9812 - DNA, 22 bp, Artificial Sequence
  chemically synthesized
gctccaaacctttacatatcta

SEQ ID NO: 9813 - DNA, 22 bp, Artificial Sequence
  chemically synthesized
ctccaaacctttacatatctag

SEQ ID NO: 9814 - DNA, 22 bp, Artificial Sequence
  chemically synthesized
caaacctttacatatctagcaa

SEQ ID NO: 9815 - DNA, 22 bp, Artificial Sequence
  chemically synthesized
tacatatctagcaaattcaaca

SEQ ID NO: 9816 - DNA, 22 bp, Artificial Sequence
  chemically synthesized
acatatctagcaaattcaacag

SEQ ID NO: 9817 - DNA, 22 bp, Artificial Sequence
  chemically synthesized
catatctagcaaattcaacagg

SEQ ID NO: 9818 - DNA, 22 bp, Artificial Sequence
  chemically synthesized
gcaaattcaacaggcattattt

SEQ ID NO: 9819 - DNA, 22 bp, Artificial Sequence
  chemically synthesized
aacaggcattatttttgtaagc

SEQ ID NO: 9820 - DNA, 22 bp, Artificial Sequence
  chemically synthesized
tttttgtaagcatgtatgcaaa

SEQ ID NO: 9821 - DNA, 22 bp, Artificial Sequence
  chemically synthesized
ttgtaagcatgtatgcaaattt

SEQ ID NO: 9822 - DNA, 22 bp, Artificial Sequence
  chemically synthesized
tgtaagcatgtatgcaaatttt

SEQ ID NO: 9823 - DNA, 22 bp, Artificial Sequence
  chemically synthesized
gtaagcatgtatgcaaattttg

SEQ ID NO: 9824 - DNA, 22 bp, Artificial Sequence
  chemically synthesized
taagcatgtatgcaaattttgg

SEQ ID NO: 9825 - DNA, 22 bp, Artificial Sequence
  chemically synthesized
tggcaattcaagaaaatcaaac

SEQ ID NO: 9826 - DNA, 22 bp, Artificial Sequence
  chemically synthesized
ggcaattcaagaaaatcaaaca

SEQ ID NO: 9827 - DNA, 22 bp, Artificial Sequence
  chemically synthesized
gcaattcaagaaaatcaaacag

SEQ ID NO: 9828 - DNA, 22 bp, Artificial Sequence
  chemically synthesized
aagaaaatcaaacaggatatca

SEQ ID NO: 9829 - DNA, 22 bp, Artificial Sequence
  chemically synthesized
gactgtaggcaaacagatacaa

SEQ ID NO: 9830 - DNA, 22 bp, Artificial Sequence
  chemically synthesized
taggcaaacagatacaataaca

SEQ ID NO: 9831 - DNA, 22 bp, Artificial Sequence
  chemically synthesized
gaaacatgtagaatattgatga

SEQ ID NO: 9832 - DNA, 22 bp, Artificial Sequence
  chemically synthesized
atgatgggcacattggggctga

SEQ ID NO: 9833 - DNA, 22 bp, Artificial Sequence
  chemically synthesized
gggctgatagtactattccttt

SEQ ID NO: 9834 - DNA, 22 bp, Artificial Sequence
  chemically synthesized
atagtactattcctttttttca

SEQ ID NO: 9835 - DNA, 22 bp, Artificial Sequence
  chemically synthesized
ttcctttttttcaatttttggt

SEQ ID NO: 9836 - DNA, 22 bp, Artificial Sequence
  chemically synthesized
ctttttttcaatttttggtaag

SEQ ID NO: 9837 - DNA, 22 bp, Artificial Sequence
  chemically synthesized
tttttcaatttttggtaagata

SEQ ID NO: 9838 - DNA, 22 bp, Artificial Sequence
  chemically synthesized
ttttcaatttttggtaagatat

SEQ ID NO: 9839 - DNA, 22 bp, Artificial Sequence
  chemically synthesized
tttcaatttttggtaagatata

SEQ ID NO: 9840 - DNA, 22 bp, Artificial Sequence
  chemically synthesized
ttcaatttttggtaagatataa

SEQ ID NO: 9841 - DNA, 22 bp, Artificial Sequence
  chemically synthesized
tcaatttttggtaagatataat

SEQ ID NO: 9842 - DNA, 22 bp, Artificial Sequence
  chemically synthesized
caatttttggtaagatataatt

SEQ ID NO: 9843 - DNA, 22 bp, Artificial Sequence
  chemically synthesized
aatttttggtaagatataatta

SEQ ID NO: 9844 - DNA, 22 bp, Artificial Sequence
  chemically synthesized
ttggtaagatataattagcata

SEQ ID NO: 9845 - DNA, 22 bp, Artificial Sequence
  chemically synthesized
tggtaagatataattagcatac

SEQ ID NO: 9846 - DNA, 22 bp, Artificial Sequence
  chemically synthesized
ggtaagatataattagcatacc

SEQ ID NO: 9847 - DNA, 22 bp, Artificial Sequence
  chemically synthesized
gtaagatataattagcatacca

SEQ ID NO: 9848 - DNA, 22 bp, Artificial Sequence
  chemically synthesized
gcataccatataattcatctat

SEQ ID NO: 9849 - DNA, 22 bp, Artificial Sequence
  chemically synthesized
atctatgtaaaatgcaaaaatt

SEQ ID NO: 9850 - DNA, 22 bp, Artificial Sequence
  chemically synthesized
tgtaaaatgcaaaaattggccc

SEQ ID NO: 9851 - DNA, 22 bp, Artificial Sequence
  chemically synthesized
gcccggctcagtggctcacgct

SEQ ID NO: 9852 - DNA, 22 bp, Artificial Sequence
  chemically synthesized
agtggctcacgcttgtaatccc

SEQ ID NO: 9853 - DNA, 22 bp, Artificial Sequence
  chemically synthesized
acgcttgtaatcccagcacttt

SEQ ID NO: 9854 - DNA, 22 bp, Artificial Sequence
  chemically synthesized
gtaatcccagcactttgggcgg

SEQ ID NO: 9855 - DNA, 22 bp, Artificial Sequence
  chemically synthesized
taatcccagcactttgggcggc

SEQ ID NO: 9856 - DNA, 22 bp, Artificial Sequence
  chemically synthesized
tgggcggccgaggaaggcagat

SEQ ID NO: 9857 - DNA, 22 bp, Artificial Sequence
  chemically synthesized
gggcggccgaggaaggcagatc

SEQ ID NO: 9858 - DNA, 22 bp, Artificial Sequence
  chemically synthesized
ggcggccgaggaaggcagatca

SEQ ID NO: 9859 - DNA, 22 bp, Artificial Sequence
  chemically synthesized
agatcaggggttcgagaccagc

SEQ ID NO: 9860 - DNA, 22 bp, Artificial Sequence
  chemically synthesized
gagaccagcctggccaacatgg

SEQ ID NO: 9861 - DNA, 22 bp, Artificial Sequence
  chemically synthesized
gccaacatggtgaaaccccgtc

SEQ ID NO: 9862 - DNA, 22 bp, Artificial Sequence
  chemically synthesized
tactaaaaatacaaaaattagc

SEQ ID NO: 9863 - DNA, 22 bp, Artificial Sequence
  chemically synthesized
actaaaaatacaaaaattagcc

SEQ ID NO: 9864 - DNA, 22 bp, Artificial Sequence
  chemically synthesized
ctaaaaatacaaaaattagccg

SEQ ID NO: 9865 - DNA, 22 bp, Artificial Sequence
  chemically synthesized
aaaatacaaaaattagccgggc

SEQ ID NO: 9866 - DNA, 22 bp, Artificial Sequence
  chemically synthesized
gccgggcgtgatagcaggcaac

SEQ ID NO: 9867 - DNA, 22 bp, Artificial Sequence
  chemically synthesized
taatcccagctacattagaggc

SEQ ID NO: 9868 - DNA, 22 bp, Artificial Sequence
  chemically synthesized
cattagaggctgaggcaggaga

SEQ ID NO: 9869 - DNA, 22 bp, Artificial Sequence
  chemically synthesized
gaggctgaggcaggagaatcgc

SEQ ID NO: 9870 - DNA, 22 bp, Artificial Sequence
  chemically synthesized
aggcaggagaatcgcttgaacc

SEQ ID NO: 9871 - DNA, 22 bp, Artificial Sequence
  chemically synthesized
gaacccgggaggcgtaggttgc

SEQ ID NO: 9872 - DNA, 22 bp, Artificial Sequence
  chemically synthesized
aacccgggaggcgtaggttgca

SEQ ID NO: 9873 - DNA, 22 bp, Artificial Sequence
  chemically synthesized
cagtgagctaagatcgtgccat

SEQ ID NO: 9874 - DNA, 22 bp, Artificial Sequence
  chemically synthesized
agatcgtgccatcacactccag

SEQ ID NO: 9875 - DNA, 22 bp, Artificial Sequence
  chemically synthesized
cagcatgggagacaagagcaag

SEQ ID NO: 9876 - DNA, 22 bp, Artificial Sequence
  chemically synthesized
catctcaaaaaaaaaaaattag

SEQ ID NO: 9877 - DNA, 22 bp, Artificial Sequence
  chemically synthesized
atctcaaaaaaaaaaaattagc

SEQ ID NO: 9878 - DNA, 22 bp, Artificial Sequence
  chemically synthesized
aaaaaaaaaaaattagctgggt

SEQ ID NO: 9879 - DNA, 22 bp, Artificial Sequence
  chemically synthesized
gctgggtgtggtggcatgcacc

SEQ ID NO: 9880 - DNA, 22 bp, Artificial Sequence
  chemically synthesized
ggtgtggtggcatgcacctgta

SEQ ID NO: 9881 - DNA, 22 bp, Artificial Sequence
  chemically synthesized
taattccagctactcgggaagc

SEQ ID NO: 9882 - DNA, 22 bp, Artificial Sequence
  chemically synthesized
cagctactcgggaagctgagac

SEQ ID NO: 9883 - DNA, 22 bp, Artificial Sequence
  chemically synthesized
ctcgggaagctgagacaggaga

SEQ ID NO: 9884 - DNA, 22 bp, Artificial Sequence
  chemically synthesized
gggaagctgagacaggagaatc

SEQ ID NO: 9885 - DNA, 22 bp, Artificial Sequence
  chemically synthesized
agacaggagaatcgcttgaacc

SEQ ID NO: 9886 - DNA, 22 bp, Artificial Sequence
  chemically synthesized
gaacctgggaggcggaggttgt

SEQ ID NO: 9887 - DNA, 22 bp, Artificial Sequence
  chemically synthesized
aacctgggaggcggaggttgtg

SEQ ID NO: 9888 - DNA, 22 bp, Artificial Sequence
  chemically synthesized
ggaggcggaggttgtggtgagc

SEQ ID NO: 9889 - DNA, 22 bp, Artificial Sequence
  chemically synthesized
tggtgagccgagatcatgccat

SEQ ID NO: 9890 - DNA, 22 bp, Artificial Sequence
  chemically synthesized
cactccagcctgggcaacaaga

SEQ ID NO: 9891 - DNA, 22 bp, Artificial Sequence
  chemically synthesized
cagcctgggcaacaagagcgaa

SEQ ID NO: 9892 - DNA, 22 bp, Artificial Sequence
  chemically synthesized
ggcaacaagagcgaaactccgt

SEQ ID NO: 9893 - DNA, 22 bp, Artificial Sequence
  chemically synthesized
cgtctcaaaaataaaataaata

SEQ ID NO: 9894 - DNA, 22 bp, Artificial Sequence
  chemically synthesized
aaaaataaaataaataaaataa

SEQ ID NO: 9895 - DNA, 22 bp, Artificial Sequence
  chemically synthesized
atggattttagtatatttacag

SEQ ID NO: 9896 - DNA, 22 bp, Artificial Sequence
  chemically synthesized
tagtatatttacagagatgtgc

SEQ ID NO: 9897 - DNA, 22 bp, Artificial Sequence
  chemically synthesized
agtatatttacagagatgtgca

SEQ ID NO: 9898 - DNA, 22 bp, Artificial Sequence
  chemically synthesized
gtatatttacagagatgtgcaa

SEQ ID NO: 9899 - DNA, 22 bp, Artificial Sequence
  chemically synthesized
acagagatgtgcaaccattacc

SEQ ID NO: 9900 - DNA, 22 bp, Artificial Sequence
  chemically synthesized
cagagatgtgcaaccattacca

SEQ ID NO: 9901 - DNA, 22 bp, Artificial Sequence
  chemically synthesized
ccaaaattttacatttctatct

SEQ ID NO: 9902 - DNA, 22 bp, Artificial Sequence
  chemically synthesized
tacatttctatctccccaaaaa

SEQ ID NO: 9903 - DNA, 22 bp, Artificial Sequence
  chemically synthesized
acatttctatctccccaaaaag

SEQ ID NO: 9904 - DNA, 22 bp, Artificial Sequence
  chemically synthesized
catttctatctccccaaaaaga

SEQ ID NO: 9905 - DNA, 22 bp, Artificial Sequence
  chemically synthesized
ctatctccccaaaaagaaacca

SEQ ID NO: 9906 - DNA, 22 bp, Artificial Sequence
  chemically synthesized
tatctccccaaaaagaaaccat

SEQ ID NO: 9907 - DNA, 22 bp, Artificial Sequence
  chemically synthesized
tctccccaaaaagaaaccatgt

SEQ ID NO: 9908 - DNA, 22 bp, Artificial Sequence
  chemically synthesized
cccaaaaagaaaccatgttccc

SEQ ID NO: 9909 - DNA, 22 bp, Artificial Sequence
  chemically synthesized
ccctaattcagtacccttaatt

SEQ ID NO: 9910 - DNA, 22 bp, Artificial Sequence
  chemically synthesized
attcagtacccttaattcatcg

SEQ ID NO: 9911 - DNA, 22 bp, Artificial Sequence
  chemically synthesized
agtacccttaattcatcgcctc

SEQ ID NO: 9912 - DNA, 22 bp, Artificial Sequence
  chemically synthesized
aattcatcgcctcccagattcc

SEQ ID NO: 9913 - DNA, 22 bp, Artificial Sequence
  chemically synthesized
attcatcgcctcccagattcct

SEQ ID NO: 9914 - DNA, 22 bp, Artificial Sequence
  chemically synthesized
atcgcctcccagattcctccat

SEQ ID NO: 9915 - DNA, 22 bp, Artificial Sequence
  chemically synthesized
ccagattcctccattctcctcc

SEQ ID NO: 9916 - DNA, 22 bp, Artificial Sequence
  chemically synthesized
ctccattctcctcctcctcccc

SEQ ID NO: 9917 - DNA, 22 bp, Artificial Sequence
  chemically synthesized
cattctcctcctcctcccctcc

SEQ ID NO: 9918 - DNA, 22 bp, Artificial Sequence
  chemically synthesized
tcctcctcctcccctcccagcc

SEQ ID NO: 9919 - DNA, 22 bp, Artificial Sequence
  chemically synthesized
ctcctcctcccctcccagccct

SEQ ID NO: 9920 - DNA, 22 bp, Artificial Sequence
  chemically synthesized
ctcctcccctcccagccctaga

SEQ ID NO: 9921 - DNA, 22 bp, Artificial Sequence
  chemically synthesized
ctcccctcccagccctagacaa

SEQ ID NO: 9922 - DNA, 22 bp, Artificial Sequence
  chemically synthesized
ccctcccagccctagacaatct

SEQ ID NO: 9923 - DNA, 22 bp, Artificial Sequence
  chemically synthesized
ccagccctagacaatctttaat

SEQ ID NO: 9924 - DNA, 22 bp, Artificial Sequence
  chemically synthesized
gacaatctttaatctactttct

SEQ ID NO: 9925 - DNA, 22 bp, Artificial Sequence
  chemically synthesized
taatctactttctttctatttg

SEQ ID NO: 9926 - DNA, 22 bp, Artificial Sequence
  chemically synthesized
aatctactttctttctatttgg

SEQ ID NO: 9927 - DNA, 22 bp, Artificial Sequence
  chemically synthesized
atctactttctttctatttgga

SEQ ID NO: 9928 - DNA, 22 bp, Artificial Sequence
  chemically synthesized
ctttctttctatttggaacatt

SEQ ID NO: 9929 - DNA, 22 bp, Artificial Sequence
  chemically synthesized
tctttctatttggaacatttag

SEQ ID NO: 9930 - DNA, 22 bp, Artificial Sequence
  chemically synthesized
ctttctatttggaacatttagt

SEQ ID NO: 9931 - DNA, 22 bp, Artificial Sequence
  chemically synthesized
tttctatttggaacatttagta

SEQ ID NO: 9932 - DNA, 22 bp, Artificial Sequence
  chemically synthesized
tctatttggaacatttagtata

SEQ ID NO: 9933 - DNA, 22 bp, Artificial Sequence
  chemically synthesized
ctatttggaacatttagtatac

SEQ ID NO: 9934 - DNA, 22 bp, Artificial Sequence
  chemically synthesized
tatttggaacatttagtataca

SEQ ID NO: 9935 - DNA, 22 bp, Artificial Sequence
  chemically synthesized
tttggaacatttagtatacata

SEQ ID NO: 9936 - DNA, 22 bp, Artificial Sequence
  chemically synthesized
ggaacatttagtatacatagag

SEQ ID NO: 9937 - DNA, 22 bp, Artificial Sequence
  chemically synthesized
gaacatttagtatacatagagg

SEQ ID NO: 9938 - DNA, 22 bp, Artificial Sequence
  chemically synthesized
agtatacatagaggcatataat

SEQ ID NO: 9939 - DNA, 22 bp, Artificial Sequence
  chemically synthesized
gtatacatagaggcatataata

SEQ ID NO: 9940 - DNA, 22 bp, Artificial Sequence
  chemically synthesized
ctttgccgtgactggcttcttt

SEQ ID NO: 9941 - DNA, 22 bp, Artificial Sequence
  chemically synthesized
tgccgtgactggcttctttcat

SEQ ID NO: 9942 - DNA, 22 bp, Artificial Sequence
  chemically synthesized
gccgtgactggcttctttcatt

SEQ ID NO: 9943 - DNA, 22 bp, Artificial Sequence
  chemically synthesized
ccgtgactggcttctttcattt

SEQ ID NO: 9944 - DNA, 22 bp, Artificial Sequence
  chemically synthesized
gcttctttcatttagcataatg

SEQ ID NO: 9945 - DNA, 22 bp, Artificial Sequence
  chemically synthesized
ctttcatttagcataatgtttt

SEQ ID NO: 9946 - DNA, 22 bp, Artificial Sequence
  chemically synthesized
tttcatttagcataatgttttt

SEQ ID NO: 9947 - DNA, 22 bp, Artificial Sequence
  chemically synthesized
tcatttagcataatgtttttat

SEQ ID NO: 9948 - DNA, 22 bp, Artificial Sequence
  chemically synthesized
catttagcataatgtttttatg

SEQ ID NO: 9949 - DNA, 22 bp, Artificial Sequence
  chemically synthesized
atttagcataatgtttttatgt

SEQ ID NO: 9950 - DNA, 22 bp, Artificial Sequence
  chemically synthesized
agcataatgtttttatgtatgt

SEQ ID NO: 9951 - DNA, 22 bp, Artificial Sequence
  chemically synthesized
gcataatgtttttatgtatgtt

SEQ ID NO: 9952 - DNA, 22 bp, Artificial Sequence
  chemically synthesized
ttatgtatgtttttcatggacc

SEQ ID NO: 9953 - DNA, 22 bp, Artificial Sequence
  chemically synthesized
tatgtatgtttttcatggacca

SEQ ID NO: 9954 - DNA, 22 bp, Artificial Sequence
  chemically synthesized
atgtatgtttttcatggaccaa

SEQ ID NO: 9955 - DNA, 22 bp, Artificial Sequence
  chemically synthesized
tgtatgtttttcatggaccaat

SEQ ID NO: 9956 - DNA, 22 bp, Artificial Sequence
  chemically synthesized
ttcatggaccaataatatctat

SEQ ID NO: 9957 - DNA, 22 bp, Artificial Sequence
  chemically synthesized
tcatggaccaataatatctatt

SEQ ID NO: 9958 - DNA, 22 bp, Artificial Sequence
  chemically synthesized
catggaccaataatatctatta

SEQ ID NO: 9959 - DNA, 22 bp, Artificial Sequence
  chemically synthesized
atggaccaataatatctattat

SEQ ID NO: 9960 - DNA, 22 bp, Artificial Sequence
  chemically synthesized
ttataaggacataccacaacat

SEQ ID NO: 9961 - DNA, 22 bp, Artificial Sequence
  chemically synthesized
taaggacataccacaacatatt

SEQ ID NO: 9962 - DNA, 22 bp, Artificial Sequence
  chemically synthesized
tatttattcattcatcagccga

SEQ ID NO: 9963 - DNA, 22 bp, Artificial Sequence
  chemically synthesized
atttattcattcatcagccgat

SEQ ID NO: 9964 - DNA, 22 bp, Artificial Sequence
  chemically synthesized
tttattcattcatcagccgatg

SEQ ID NO: 9965 - DNA, 22 bp, Artificial Sequence
  chemically synthesized
attcattcatcagccgatggac

SEQ ID NO: 9966 - DNA, 22 bp, Artificial Sequence
  chemically synthesized
ttcattcatcagccgatggaca

SEQ ID NO: 9967 - DNA, 22 bp, Artificial Sequence
  chemically synthesized
attcatcagccgatggacattg

SEQ ID NO: 9968 - DNA, 22 bp, Artificial Sequence
  chemically synthesized
atcagccgatggacattggttt

SEQ ID NO: 9969 - DNA, 22 bp, Artificial Sequence
  chemically synthesized
gtttgtttctactttatggcta

SEQ ID NO: 9970 - DNA, 22 bp, Artificial Sequence
  chemically synthesized
gtttctactttatggctattgg

SEQ ID NO: 9971 - DNA, 22 bp, Artificial Sequence
  chemically synthesized
tttctactttatggctattggg

SEQ ID NO: 9972 - DNA, 22 bp, Artificial Sequence
  chemically synthesized
ctactttatggctattgggaat

SEQ ID NO: 9973 - DNA, 22 bp, Artificial Sequence
  chemically synthesized
tactttatggctattgggaata

SEQ ID NO: 9974 - DNA, 22 bp, Artificial Sequence
  chemically synthesized
ctttatggctattgggaatagt

SEQ ID NO: 9975 - DNA, 22 bp, Artificial Sequence
  chemically synthesized
tatggctattgggaatagtgct

SEQ ID NO: 9976 - DNA, 22 bp, Artificial Sequence
  chemically synthesized
atggctattgggaatagtgctg

SEQ ID NO: 9977 - DNA, 22 bp, Artificial Sequence
  chemically synthesized
tggctattgggaatagtgctgt

SEQ ID NO: 9978 - DNA, 22 bp, Artificial Sequence
  chemically synthesized
ttgggaatagtgctgttataaa

SEQ ID NO: 9979 - DNA, 22 bp, Artificial Sequence
  chemically synthesized
ggaatagtgctgttataaacat

SEQ ID NO: 9980 - DNA, 22 bp, Artificial Sequence
  chemically synthesized
ttataaacatttatgtacaagt

SEQ ID NO: 9981 - DNA, 22 bp, Artificial Sequence
  chemically synthesized
taaacatttatgtacaagtttt

SEQ ID NO: 9982 - DNA, 22 bp, Artificial Sequence
  chemically synthesized
atgtacaagtttttttgtagac

SEQ ID NO: 9983 - DNA, 22 bp, Artificial Sequence
  chemically synthesized
tgtacaagtttttttgtagact

SEQ ID NO: 9984 - DNA, 22 bp, Artificial Sequence
  chemically synthesized
ttttgtagacttatgttttgat

SEQ ID NO: 9985 - DNA, 22 bp, Artificial Sequence
  chemically synthesized
tttgtagacttatgttttgatt

SEQ ID NO: 9986 - DNA, 22 bp, Artificial Sequence
  chemically synthesized
ttgtagacttatgttttgattt

SEQ ID NO: 9987 - DNA, 22 bp, Artificial Sequence
  chemically synthesized
tgtagacttatgttttgatttc

SEQ ID NO: 9988 - DNA, 22 bp, Artificial Sequence
  chemically synthesized
gtagacttatgttttgatttct

SEQ ID NO: 9989 - DNA, 22 bp, Artificial Sequence
  chemically synthesized
tagacttatgttttgatttctt

SEQ ID NO: 9990 - DNA, 22 bp, Artificial Sequence
  chemically synthesized
atgttttgatttcttttggtta

SEQ ID NO: 9991 - DNA, 22 bp, Artificial Sequence
  chemically synthesized
tgttttgatttcttttggttat

SEQ ID NO: 9992 - DNA, 22 bp, Artificial Sequence
  chemically synthesized
tgatttcttttggttatatatc

SEQ ID NO: 9993 - DNA, 22 bp, Artificial Sequence
  chemically synthesized
gatttcttttggttatatatct

SEQ ID NO: 9994 - DNA, 22 bp, Artificial Sequence
  chemically synthesized
atttcttttggttatatatcta

SEQ ID NO: 9995 - DNA, 22 bp, Artificial Sequence
  chemically synthesized
cttttggttatatatctagaag

SEQ ID NO: 9996 - DNA, 22 bp, Artificial Sequence
  chemically synthesized
ttttggttatatatctagaagt

SEQ ID NO: 9997 - DNA, 22 bp, Artificial Sequence
  chemically synthesized
ttggttatatatctagaagtgg

SEQ ID NO: 9998 - DNA, 22 bp, Artificial Sequence
  chemically synthesized
tggttatatatctagaagtggg

SEQ ID NO: 9999 - DNA, 22 bp, Artificial Sequence
  chemically synthesized
ggttatatatctagaagtgggt

SEQ ID NO: 10000 - DNA, 22 bp, Artificial Sequence
  chemically synthesized
gttatatatctagaagtgggtt

SEQ ID NO: 10001 - DNA, 22 bp, Artificial Sequence
  chemically synthesized
tatatctagaagtgggtttgct

SEQ ID NO: 10002 - DNA, 22 bp, Artificial Sequence
  chemically synthesized
gaagtgggtttgctgggtcata

SEQ ID NO: 10003 - DNA, 22 bp, Artificial Sequence
  chemically synthesized
gctgggtcatatggtaacactg

SEQ ID NO: 10004 - DNA, 22 bp, Artificial Sequence
  chemically synthesized
ctgggtcatatggtaacactgt

SEQ ID NO: 10005 - DNA, 22 bp, Artificial Sequence
  chemically synthesized
ggtcatatggtaacactgttta

SEQ ID NO: 10006 - DNA, 22 bp, Artificial Sequence
  chemically synthesized
tttaaccttttgaggaattgcc

SEQ ID NO: 10007 - DNA, 22 bp, Artificial Sequence
  chemically synthesized
aaccttttgaggaattgccaca

SEQ ID NO: 10008 - DNA, 22 bp, Artificial Sequence
  chemically synthesized
accttttgaggaattgccacat

SEQ ID NO: 10009 - DNA, 22 bp, Artificial Sequence
  chemically synthesized
ttgaggaattgccacattcttt

SEQ ID NO: 10010 - DNA, 22 bp, Artificial Sequence
  chemically synthesized
tgaggaattgccacattctttt

SEQ ID NO: 10011 - DNA, 22 bp, Artificial Sequence
  chemically synthesized
gaggaattgccacattcttttc

SEQ ID NO: 10012 - DNA, 22 bp, Artificial Sequence
  chemically synthesized
aggaattgccacattcttttcc

SEQ ID NO: 10013 - DNA, 22 bp, Artificial Sequence
  chemically synthesized
ccacattcttttccaaagtaag

SEQ ID NO: 10014 - DNA, 22 bp, Artificial Sequence
  chemically synthesized
ttttccaaagtaagcattttat

SEQ ID NO: 10015 - DNA, 22 bp, Artificial Sequence
  chemically synthesized
ttccaaagtaagcattttatcc

SEQ ID NO: 10016 - DNA, 22 bp, Artificial Sequence
  chemically synthesized
tccaaagtaagcattttatcct

SEQ ID NO: 10017 - DNA, 22 bp, Artificial Sequence
  chemically synthesized
ccaaagtaagcattttatcctc

SEQ ID NO: 10018 - DNA, 22 bp, Artificial Sequence
  chemically synthesized
caaagtaagcattttatcctcc

SEQ ID NO: 10019 - DNA, 22 bp, Artificial Sequence
  chemically synthesized
tatcctcctatcagcagtgtat

SEQ ID NO: 10020 - DNA, 22 bp, Artificial Sequence
  chemically synthesized
atcctcctatcagcagtgtatg

SEQ ID NO: 10021 - DNA, 22 bp, Artificial Sequence
  chemically synthesized
tcctcctatcagcagtgtatga

SEQ ID NO: 10022 - DNA, 22 bp, Artificial Sequence
  chemically synthesized
ctatcagcagtgtatgagagtt

SEQ ID NO: 10023 - DNA, 22 bp, Artificial Sequence
  chemically synthesized
tcagcagtgtatgagagttctg

SEQ ID NO: 10024 - DNA, 22 bp, Artificial Sequence
  chemically synthesized
tgatttctctccatctttgcct

SEQ ID NO: 10025 - DNA, 22 bp, Artificial Sequence
  chemically synthesized
atttctctccatctttgcctgg

SEQ ID NO: 10026 - DNA, 22 bp, Artificial Sequence
  chemically synthesized
ctctccatctttgcctgggttt

SEQ ID NO: 10027 - DNA, 22 bp, Artificial Sequence
  chemically synthesized
tctccatctttgcctgggtttt

SEQ ID NO: 10028 - DNA, 22 bp, Artificial Sequence
  chemically synthesized
tccatctttgcctgggtttttg

SEQ ID NO: 10029 - DNA, 22 bp, Artificial Sequence
  chemically synthesized
catctttgcctgggtttttgaa

SEQ ID NO: 10030 - DNA, 22 bp, Artificial Sequence
  chemically synthesized
tgcctgggtttttgaatcaggg

SEQ ID NO: 10031 - DNA, 22 bp, Artificial Sequence
  chemically synthesized
gcctgggtttttgaatcagggc

SEQ ID NO: 10032 - DNA, 22 bp, Artificial Sequence
  chemically synthesized
cctgggtttttgaatcagggcc

SEQ ID NO: 10033 - DNA, 22 bp, Artificial Sequence
  chemically synthesized
ggtttttgaatcagggccccag

SEQ ID NO: 10034 - DNA, 22 bp, Artificial Sequence
  chemically synthesized
ttgaatcagggccccagataga

SEQ ID NO: 10035 - DNA, 22 bp, Artificial Sequence
  chemically synthesized
tgaatcagggccccagatagaa

SEQ ID NO: 10036 - DNA, 22 bp, Artificial Sequence
  chemically synthesized
gaatcagggccccagatagaac

SEQ ID NO: 10037 - DNA, 22 bp, Artificial Sequence
  chemically synthesized
aatcagggccccagatagaaca

SEQ ID NO: 10038 - DNA, 22 bp, Artificial Sequence
  chemically synthesized
ttcagttgttccaccatcactt

SEQ ID NO: 10039 - DNA, 22 bp, Artificial Sequence
  chemically synthesized
agttgttccaccatcacttgtt

SEQ ID NO: 10040 - DNA, 22 bp, Artificial Sequence
  chemically synthesized
ttccaccatcacttgttgagaa

SEQ ID NO: 10041 - DNA, 22 bp, Artificial Sequence
  chemically synthesized
caccatcacttgttgagaagac

SEQ ID NO: 10042 - DNA, 22 bp, Artificial Sequence
  chemically synthesized
gttgagaagactcttttttcat

SEQ ID NO: 10043 - DNA, 22 bp, Artificial Sequence
  chemically synthesized
ttgagaagactcttttttcatt

SEQ ID NO: 10044 - DNA, 22 bp, Artificial Sequence
  chemically synthesized
agaagactcttttttcattgaa

SEQ ID NO: 10045 - DNA, 22 bp, Artificial Sequence
  chemically synthesized
ttttttcattgaagtgttttgg

SEQ ID NO: 10046 - DNA, 22 bp, Artificial Sequence
  chemically synthesized
ttttcattgaagtgttttggca

SEQ ID NO: 10047 - DNA, 22 bp, Artificial Sequence
  chemically synthesized
tttcattgaagtgttttggcac

SEQ ID NO: 10048 - DNA, 22 bp, Artificial Sequence
  chemically synthesized
ttcattgaagtgttttggcacc

SEQ ID NO: 10049 - DNA, 22 bp, Artificial Sequence
  chemically synthesized
tcattgaagtgttttggcaccc

SEQ ID NO: 10050 - DNA, 22 bp, Artificial Sequence
  chemically synthesized
cattgaagtgttttggcaccct

SEQ ID NO: 10051 - DNA, 22 bp, Artificial Sequence
  chemically synthesized
attgaagtgttttggcaccctt

SEQ ID NO: 10052 - DNA, 22 bp, Artificial Sequence
  chemically synthesized
aagtgttttggcacccttatca

SEQ ID NO: 10053 - DNA, 22 bp, Artificial Sequence
  chemically synthesized
tggcacccttatcaaaaatcaa

SEQ ID NO: 10054 - DNA, 22 bp, Artificial Sequence
  chemically synthesized
ggcacccttatcaaaaatcaat

SEQ ID NO: 10055 - DNA, 22 bp, Artificial Sequence
  chemically synthesized
gcacccttatcaaaaatcaatc

SEQ ID NO: 10056 - DNA, 22 bp, Artificial Sequence
  chemically synthesized
atcaaaaatcaatctaccataa

SEQ ID NO: 10057 - DNA, 22 bp, Artificial Sequence
  chemically synthesized
tcaaaaatcaatctaccataaa

SEQ ID NO: 10058 - DNA, 22 bp, Artificial Sequence
  chemically synthesized
ccataaatgtgagagtttattt

SEQ ID NO: 10059 - DNA, 22 bp, Artificial Sequence
  chemically synthesized
atttctggagtctcaattttat

SEQ ID NO: 10060 - DNA, 22 bp, Artificial Sequence
  chemically synthesized
tttctggagtctcaattttatc

SEQ ID NO: 10061 - DNA, 22 bp, Artificial Sequence
  chemically synthesized
ctggagtctcaattttatccca

SEQ ID NO: 10062 - DNA, 22 bp, Artificial Sequence
  chemically synthesized
tggagtctcaattttatcccat

SEQ ID NO: 10063 - DNA, 22 bp, Artificial Sequence
  chemically synthesized
gagtctcaattttatcccatta

SEQ ID NO: 10064 - DNA, 22 bp, Artificial Sequence
  chemically synthesized
aattttatcccattatgctata

SEQ ID NO: 10065 - DNA, 22 bp, Artificial Sequence
  chemically synthesized
tatcccattatgctataatcta

SEQ ID NO: 10066 - DNA, 22 bp, Artificial Sequence
  chemically synthesized
atcccattatgctataatctat

SEQ ID NO: 10067 - DNA, 22 bp, Artificial Sequence
  chemically synthesized
tcccattatgctataatctata

SEQ ID NO: 10068 - DNA, 22 bp, Artificial Sequence
  chemically synthesized
tgctataatctataatcctatc

SEQ ID NO: 10069 - DNA, 22 bp, Artificial Sequence
  chemically synthesized
taatctataatcctatcttttt

SEQ ID NO: 10070 - DNA, 22 bp, Artificial Sequence
  chemically synthesized
taatcctatctttttttttttt

SEQ ID NO: 10071 - DNA, 22 bp, Artificial Sequence
  chemically synthesized
tctttttttttttttgacagag

SEQ ID NO: 10072 - DNA, 22 bp, Artificial Sequence
  chemically synthesized
tttttttttttgacagagcctc

SEQ ID NO: 10073 - DNA, 22 bp, Artificial Sequence
  chemically synthesized
ttttttttttgacagagcctca

SEQ ID NO: 10074 - DNA, 22 bp, Artificial Sequence
  chemically synthesized
tttttttttgacagagcctcac

SEQ ID NO: 10075 - DNA, 22 bp, Artificial Sequence
  chemically synthesized
ttttttttgacagagcctcact

SEQ ID NO: 10076 - DNA, 22 bp, Artificial Sequence
  chemically synthesized
tttttttgacagagcctcactc

SEQ ID NO: 10077 - DNA, 22 bp, Artificial Sequence
  chemically synthesized
ttttttgacagagcctcactct

SEQ ID NO: 10078 - DNA, 22 bp, Artificial Sequence
  chemically synthesized
tttttgacagagcctcactcta

SEQ ID NO: 10079 - DNA, 22 bp, Artificial Sequence
  chemically synthesized
ttttgacagagcctcactctat

SEQ ID NO: 10080 - DNA, 22 bp, Artificial Sequence
  chemically synthesized
tttgacagagcctcactctatt

SEQ ID NO: 10081 - DNA, 22 bp, Artificial Sequence
  chemically synthesized
ttgacagagcctcactctattg

SEQ ID NO: 10082 - DNA, 22 bp, Artificial Sequence
  chemically synthesized
tgacagagcctcactctattgc

SEQ ID NO: 10083 - DNA, 22 bp, Artificial Sequence
  chemically synthesized
gacagagcctcactctattgcc

SEQ ID NO: 10084 - DNA, 22 bp, Artificial Sequence
  chemically synthesized
acagagcctcactctattgccc

SEQ ID NO: 10085 - DNA, 22 bp, Artificial Sequence
  chemically synthesized
actctattgcccaggttggagt

SEQ ID NO: 10086 - DNA, 22 bp, Artificial Sequence
  chemically synthesized
tattgcccaggttggagtgcag

SEQ ID NO: 10087 - DNA, 22 bp, Artificial Sequence
  chemically synthesized
ttgcccaggttggagtgcagtg

SEQ ID NO: 10088 - DNA, 22 bp, Artificial Sequence
  chemically synthesized
cccaggttggagtgcagtggcc

SEQ ID NO: 10089 - DNA, 22 bp, Artificial Sequence
  chemically synthesized
gagtgcagtggcccaatcccgg

SEQ ID NO: 10090 - DNA, 22 bp, Artificial Sequence
  chemically synthesized
gctcctcctcccaggttcaagc

SEQ ID NO: 10091 - DNA, 22 bp, Artificial Sequence
  chemically synthesized
ctcctcccaggttcaagcaatt

SEQ ID NO: 10092 - DNA, 22 bp, Artificial Sequence
  chemically synthesized
ctcccaggttcaagcaattctc

SEQ ID NO: 10093 - DNA, 22 bp, Artificial Sequence
  chemically synthesized
ccaggttcaagcaattctcctg

SEQ ID NO: 10094 - DNA, 22 bp, Artificial Sequence
  chemically synthesized
aagcaattctcctgcctcagcc

SEQ ID NO: 10095 - DNA, 22 bp, Artificial Sequence
  chemically synthesized
tcctgcctcagcctcccaagca

SEQ ID NO: 10096 - DNA, 22 bp, Artificial Sequence
  chemically synthesized
ctgcctcagcctcccaagcagc

SEQ ID NO: 10097 - DNA, 22 bp, Artificial Sequence
  chemically synthesized
cctcagcctcccaagcagctgg

SEQ ID NO: 10098 - DNA, 22 bp, Artificial Sequence
  chemically synthesized
agcctcccaagcagctgggatt

SEQ ID NO: 10099 - DNA, 22 bp, Artificial Sequence
  chemically synthesized
ccaagcagctgggattacaggt

SEQ ID NO: 10100 - DNA, 22 bp, Artificial Sequence
  chemically synthesized
ggattacaggtacctgccacca

SEQ ID NO: 10101 - DNA, 22 bp, Artificial Sequence
  chemically synthesized
caggtacctgccaccatgcctg

SEQ ID NO: 10102 - DNA, 22 bp, Artificial Sequence
  chemically synthesized
ccaccatgcctggttaattttt

SEQ ID NO: 10103 - DNA, 22 bp, Artificial Sequence
  chemically synthesized
gttaatttttgtatttttagta

SEQ ID NO: 10104 - DNA, 22 bp, Artificial Sequence
  chemically synthesized
atttttgtatttttagtagaga

SEQ ID NO: 10105 - DNA, 22 bp, Artificial Sequence
  chemically synthesized
ttgtatttttagtagagacggg

SEQ ID NO: 10106 - DNA, 22 bp, Artificial Sequence
  chemically synthesized
tgtatttttagtagagacgggg

SEQ ID NO: 10107 - DNA, 22 bp, Artificial Sequence
  chemically synthesized
gtatttttagtagagacggggt

SEQ ID NO: 10108 - DNA, 22 bp, Artificial Sequence
  chemically synthesized
tatttttagtagagacggggtt

SEQ ID NO: 10109 - DNA, 22 bp, Artificial Sequence
  chemically synthesized
ttagtagagacggggtttcacc

SEQ ID NO: 10110 - DNA, 22 bp, Artificial Sequence
  chemically synthesized
tagtagagacggggtttcacca

SEQ ID NO: 10111 - DNA, 22 bp, Artificial Sequence
  chemically synthesized
agtagagacggggtttcaccat

SEQ ID NO: 10112 - DNA, 22 bp, Artificial Sequence
  chemically synthesized
gtagagacggggtttcaccatg

SEQ ID NO: 10113 - DNA, 22 bp, Artificial Sequence
  chemically synthesized
caccatgttggtcaggctggtc

SEQ ID NO: 10114 - DNA, 22 bp, Artificial Sequence
  chemically synthesized
accatgttggtcaggctggtct

SEQ ID NO: 10115 - DNA, 22 bp, Artificial Sequence
  chemically synthesized
gtcaggctggtctggaactcct

SEQ ID NO: 10116 - DNA, 22 bp, Artificial Sequence
  chemically synthesized
gtctggaactcctgacctcagg

SEQ ID NO: 10117 - DNA, 22 bp, Artificial Sequence
  chemically synthesized
gaactcctgacctcaggtgatc

SEQ ID NO: 10118 - DNA, 22 bp, Artificial Sequence
  chemically synthesized
ctgacctcaggtgatctgccca

SEQ ID NO: 10119 - DNA, 22 bp, Artificial Sequence
  chemically synthesized
acctcaggtgatctgcccacct

SEQ ID NO: 10120 - DNA, 22 bp, Artificial Sequence
  chemically synthesized
aggtgatctgcccacctcagcc

SEQ ID NO: 10121 - DNA, 22 bp, Artificial Sequence
  chemically synthesized
cccacctcagcctcccaaagtg

SEQ ID NO: 10122 - DNA, 20 bp, Artificial Sequence
  chemically synthesized
tggcgatatctaggtagcca

SEQ ID NO: 10123 - DNA, 20 bp, Artificial Sequence
  chemically synthesized
ggcgatatctaggtagccac

SEQ ID NO: 10124 - DNA, 20 bp, Artificial Sequence
  chemically synthesized
cgatatctaggtagccacag

SEQ ID NO: 10125 - DNA, 20 bp, Artificial Sequence
  chemically synthesized
gatatctaggtagccacagg

SEQ ID NO: 10126 - DNA, 20 bp, Artificial Sequence
  chemically synthesized
atctaggtagccacaggagg

SEQ ID NO: 10127 - DNA, 20 bp, Artificial Sequence
  chemically synthesized
ccacaggaggcggccacgtg

SEQ ID NO: 10128 - DNA, 20 bp, Artificial Sequence
  chemically synthesized
caggaggcggccacgtgcag

SEQ ID NO: 10129 - DNA, 20 bp, Artificial Sequence
  chemically synthesized
cggccacgtgcagtggcgtc

SEQ ID NO: 10130 - DNA, 20 bp, Artificial Sequence
  chemically synthesized
tccagccctcgttgtctgcc

SEQ ID NO: 10131 - DNA, 20 bp, Artificial Sequence
  chemically synthesized
ctcgttgtctgcctggttca

SEQ ID NO: 10132 - DNA, 20 bp, Artificial Sequence
  chemically synthesized
gttgtctgcctggttcacag

SEQ ID NO: 10133 - DNA, 20 bp, Artificial Sequence
  chemically synthesized
cagtggcgccctgctccacc

SEQ ID NO: 10134 - DNA, 20 bp, Artificial Sequence
  chemically synthesized
tggcgccctgctccaccaag

SEQ ID NO: 10135 - DNA, 20 bp, Artificial Sequence
  chemically synthesized
accaagaagcgcaccacctc

SEQ ID NO: 10136 - DNA, 20 bp, Artificial Sequence
  chemically synthesized
ccaagaagcgcaccacctcc

SEQ ID NO: 10137 - DNA, 20 bp, Artificial Sequence
  chemically synthesized
cctccaggttctcatcaatg

SEQ ID NO: 10138 - DNA, 20 bp, Artificial Sequence
  chemically synthesized
ctccaggttctcatcaatgc

SEQ ID NO: 10139 - DNA, 20 bp, Artificial Sequence
  chemically synthesized
ggttctcatcaatgcaggcc

SEQ ID NO: 10140 - DNA, 20 bp, Artificial Sequence
  chemically synthesized
gttctcatcaatgcaggcct

SEQ ID NO: 10141 - DNA, 20 bp, Artificial Sequence
  chemically synthesized
ttctcatcaatgcaggcctg

SEQ ID NO: 10142 - DNA, 20 bp, Artificial Sequence
  chemically synthesized
tctcatcaatgcaggcctgg

SEQ ID NO: 10143 - DNA, 20 bp, Artificial Sequence
  chemically synthesized
catcaatgcaggcctggggg

SEQ ID NO: 10144 - DNA, 20 bp, Artificial Sequence
  chemically synthesized
atcaatgcaggcctgggggt

SEQ ID NO: 10145 - DNA, 20 bp, Artificial Sequence
  chemically synthesized
gcaggcctgggggtgggaaa

SEQ ID NO: 10146 - DNA, 20 bp, Artificial Sequence
  chemically synthesized
tgggggtgggaaacagccgt

SEQ ID NO: 10147 - DNA, 20 bp, Artificial Sequence
  chemically synthesized
gccgtcagccgcacctaccc

SEQ ID NO: 10148 - DNA, 20 bp, Artificial Sequence
  chemically synthesized
agccgcacctaccccagcca

SEQ ID NO: 10149 - DNA, 20 bp, Artificial Sequence
  chemically synthesized
ctaccccagccacggtgtcc

SEQ ID NO: 10150 - DNA, 20 bp, Artificial Sequence
  chemically synthesized
cccagccacggtgtcccagc

SEQ ID NO: 10151 - DNA, 20 bp, Artificial Sequence
  chemically synthesized
gccacggtgtcccagcaagt

SEQ ID NO: 10152 - DNA, 20 bp, Artificial Sequence
  chemically synthesized
ccacggtgtcccagcaagtc

SEQ ID NO: 10153 - DNA, 20 bp, Artificial Sequence
  chemically synthesized
gtcccagcaagtcgggactc

SEQ ID NO: 10154 - DNA, 20 bp, Artificial Sequence
  chemically synthesized
cccagcaagtcgggactcca

SEQ ID NO: 10155 - DNA, 20 bp, Artificial Sequence
  chemically synthesized
ccagcaagtcgggactccag

SEQ ID NO: 10156 - DNA, 20 bp, Artificial Sequence
  chemically synthesized
cagcaagtcgggactccaga

SEQ ID NO: 10157 - DNA, 20 bp, Artificial Sequence
  chemically synthesized
gcaagtcgggactccagagg

SEQ ID NO: 10158 - DNA, 20 bp, Artificial Sequence
  chemically synthesized
tccagagggagccacgaaaa

SEQ ID NO: 10159 - DNA, 20 bp, Artificial Sequence
  chemically synthesized
gggagccacgaaaacagatc

SEQ ID NO: 10160 - DNA, 20 bp, Artificial Sequence
  chemically synthesized
ggagccacgaaaacagatcc

SEQ ID NO: 10161 - DNA, 20 bp, Artificial Sequence
  chemically synthesized
gagccacgaaaacagatcca

SEQ ID NO: 10162 - DNA, 20 bp, Artificial Sequence
  chemically synthesized
cgaaaacagatccagggaca

SEQ ID NO: 10163 - DNA, 20 bp, Artificial Sequence
  chemically synthesized
cagatccagggacacggtgc

SEQ ID NO: 10164 - DNA, 20 bp, Artificial Sequence
  chemically synthesized
agatccagggacacggtgct

SEQ ID NO: 10165 - DNA, 20 bp, Artificial Sequence
  chemically synthesized
ccagggacacggtgctagga

SEQ ID NO: 10166 - DNA, 20 bp, Artificial Sequence
  chemically synthesized
gggacacggtgctaggacag

SEQ ID NO: 10167 - DNA, 20 bp, Artificial Sequence
  chemically synthesized
ggacacggtgctaggacagt

SEQ ID NO: 10168 - DNA, 20 bp, Artificial Sequence
  chemically synthesized
gacacggtgctaggacagtg

SEQ ID NO: 10169 - DNA, 20 bp, Artificial Sequence
  chemically synthesized
cagtggggaaaatgacccaa

SEQ ID NO: 10170 - DNA, 20 bp, Artificial Sequence
  chemically synthesized
gaaaatgacccaacagcctc

SEQ ID NO: 10171 - DNA, 20 bp, Artificial Sequence
  chemically synthesized
acccaacagcctctggccac

SEQ ID NO: 10172 - DNA, 20 bp, Artificial Sequence
  chemically synthesized
cctctggccactggctgttt

SEQ ID NO: 10173 - DNA, 20 bp, Artificial Sequence
  chemically synthesized
ctggctgtttaagatacgcc

SEQ ID NO: 10174 - DNA, 20 bp, Artificial Sequence
  chemically synthesized
ttaagatacgcctggttgcc

SEQ ID NO: 10175 - DNA, 20 bp, Artificial Sequence
  chemically synthesized
agatacgcctggttgcccag

SEQ ID NO: 10176 - DNA, 20 bp, Artificial Sequence
  chemically synthesized
acgcctggttgcccagtggt

SEQ ID NO: 10177 - DNA, 20 bp, Artificial Sequence
  chemically synthesized
cgcctggttgcccagtggtc

SEQ ID NO: 10178 - DNA, 20 bp, Artificial Sequence
  chemically synthesized
tggttgcccagtggtcaggc

SEQ ID NO: 10179 - DNA, 20 bp, Artificial Sequence
  chemically synthesized
tgcccagtggtcaggccggc

SEQ ID NO: 10180 - DNA, 20 bp, Artificial Sequence
  chemically synthesized
gcccagtggtcaggccggcc

SEQ ID NO: 10181 - DNA, 20 bp, Artificial Sequence
  chemically synthesized
ggtcaggccggccaggcctt

SEQ ID NO: 10182 - DNA, 20 bp, Artificial Sequence
  chemically synthesized
ccggccaggccttcagtgct

SEQ ID NO: 10183 - DNA, 20 bp, Artificial Sequence
  chemically synthesized
gccaggccttcagtgctcag

SEQ ID NO: 10184 - DNA, 20 bp, Artificial Sequence
  chemically synthesized
gtgctcagtggaaaccacga

SEQ ID NO: 10185 - DNA, 20 bp, Artificial Sequence
  chemically synthesized
tgctcagtggaaaccacgaa

SEQ ID NO: 10186 - DNA, 20 bp, Artificial Sequence
  chemically synthesized
ggaaaccacgaaaggactcc

SEQ ID NO: 10187 - DNA, 20 bp, Artificial Sequence
  chemically synthesized
gactcctggctatctgcaaa

SEQ ID NO: 10188 - DNA, 20 bp, Artificial Sequence
  chemically synthesized
actcctggctatctgcaaac

SEQ ID NO: 10189 - DNA, 20 bp, Artificial Sequence
  chemically synthesized
cctggctatctgcaaacagg

SEQ ID NO: 10190 - DNA, 20 bp, Artificial Sequence
  chemically synthesized
atctgcaaacaggaagtgaa

SEQ ID NO: 10191 - DNA, 20 bp, Artificial Sequence
  chemically synthesized
tctgcaaacaggaagtgaac

SEQ ID NO: 10192 - DNA, 20 bp, Artificial Sequence
  chemically synthesized
ctgcaaacaggaagtgaacg

SEQ ID NO: 10193 - DNA, 20 bp, Artificial Sequence
  chemically synthesized
caaacaggaagtgaacgggg

SEQ ID NO: 10194 - DNA, 20 bp, Artificial Sequence
  chemically synthesized
aaacaggaagtgaacgggga

SEQ ID NO: 10195 - DNA, 20 bp, Artificial Sequence
  chemically synthesized
aacaggaagtgaacggggaa

SEQ ID NO: 10196 - DNA, 20 bp, Artificial Sequence
  chemically synthesized
caggaagtgaacggggaagg

SEQ ID NO: 10197 - DNA, 20 bp, Artificial Sequence
  chemically synthesized
aggaagtgaacggggaaggg

SEQ ID NO: 10198 - DNA, 20 bp, Artificial Sequence
  chemically synthesized
ggaagtgaacggggaaggga

SEQ ID NO: 10199 - DNA, 20 bp, Artificial Sequence
  chemically synthesized
gaagtgaacggggaagggag

SEQ ID NO: 10200 - DNA, 20 bp, Artificial Sequence
  chemically synthesized
aagtgaacggggaagggagg

SEQ ID NO: 10201 - DNA, 20 bp, Artificial Sequence
  chemically synthesized
aagggagggggcttctcatc

SEQ ID NO: 10202 - DNA, 20 bp, Artificial Sequence
  chemically synthesized
agggagggggcttctcatct

SEQ ID NO: 10203 - DNA, 20 bp, Artificial Sequence
  chemically synthesized
gggggcttctcatctgggtg

SEQ ID NO: 10204 - DNA, 20 bp, Artificial Sequence
  chemically synthesized
ggggcttctcatctgggtgc

SEQ ID NO: 10205 - DNA, 20 bp, Artificial Sequence
  chemically synthesized
ctgggtgcgggaaccccaca

SEQ ID NO: 10206 - DNA, 20 bp, Artificial Sequence
  chemically synthesized
gaaccccacatggtacctgt

SEQ ID NO: 10207 - DNA, 20 bp, Artificial Sequence
  chemically synthesized
cacatggtacctgttagaca

SEQ ID NO: 10208 - DNA, 20 bp, Artificial Sequence
  chemically synthesized
aaaacccccgtcaccaccca

SEQ ID NO: 10209 - DNA, 20 bp, Artificial Sequence
  chemically synthesized
aaacccccgtcaccacccac

SEQ ID NO: 10210 - DNA, 20 bp, Artificial Sequence
  chemically synthesized
cccccgtcaccacccacagg

SEQ ID NO: 10211 - DNA, 20 bp, Artificial Sequence
  chemically synthesized
ccacccacaggtggcgcttc

SEQ ID NO: 10212 - DNA, 20 bp, Artificial Sequence
  chemically synthesized
caggtggcgcttccagtgct

SEQ ID NO: 10213 - DNA, 20 bp, Artificial Sequence
  chemically synthesized
ggcgcttccagtgctcagac

SEQ ID NO: 10214 - DNA, 20 bp, Artificial Sequence
  chemically synthesized
gcgcttccagtgctcagact

SEQ ID NO: 10215 - DNA, 20 bp, Artificial Sequence
  chemically synthesized
cgcttccagtgctcagacta

SEQ ID NO: 10216 - DNA, 20 bp, Artificial Sequence
  chemically synthesized
ttccagtgctcagactaggg

SEQ ID NO: 10217 - DNA, 20 bp, Artificial Sequence
  chemically synthesized
ccagtgctcagactagggaa

SEQ ID NO: 10218 - DNA, 20 bp, Artificial Sequence
  chemically synthesized
cagtgctcagactagggaag

SEQ ID NO: 10219 - DNA, 20 bp, Artificial Sequence
  chemically synthesized
tcagactagggaagaggttc

SEQ ID NO: 10220 - DNA, 20 bp, Artificial Sequence
  chemically synthesized
ggttccagcccctcctcctt

SEQ ID NO: 10221 - DNA, 20 bp, Artificial Sequence
  chemically synthesized
ttccagcccctcctccttca

SEQ ID NO: 10222 - DNA, 20 bp, Artificial Sequence
  chemically synthesized
agcccctcctccttcagagc

SEQ ID NO: 10223 - DNA, 20 bp, Artificial Sequence
  chemically synthesized
gcccctcctccttcagagcc

SEQ ID NO: 10224 - DNA, 20 bp, Artificial Sequence
  chemically synthesized
ccctcctccttcagagccag

SEQ ID NO: 10225 - DNA, 20 bp, Artificial Sequence
  chemically synthesized
tccttcagagccaggagtcc

SEQ ID NO: 10226 - DNA, 20 bp, Artificial Sequence
  chemically synthesized
gagccaggagtcctggcccc

SEQ ID NO: 10227 - DNA, 20 bp, Artificial Sequence
  chemically synthesized
agcccctcctgccttaaacc

SEQ ID NO: 10228 - DNA, 20 bp, Artificial Sequence
  chemically synthesized
cctcctgccttaaacccagc

SEQ ID NO: 10229 - DNA, 20 bp, Artificial Sequence
  chemically synthesized
ctcctgccttaaacccagcc

SEQ ID NO: 10230 - DNA, 20 bp, Artificial Sequence
  chemically synthesized
aaacccagccaggtccttcc

SEQ ID NO: 10231 - DNA, 20 bp, Artificial Sequence
  chemically synthesized
aacccagccaggtccttcca

SEQ ID NO: 10232 - DNA, 20 bp, Artificial Sequence
  chemically synthesized
acccagccaggtccttccaa

SEQ ID NO: 10233 - DNA, 20 bp, Artificial Sequence
  chemically synthesized
gccaggtccttccaagggtc

SEQ ID NO: 10234 - DNA, 20 bp, Artificial Sequence
  chemically synthesized
gtccttccaagggtcaagct

SEQ ID NO: 10235 - DNA, 20 bp, Artificial Sequence
  chemically synthesized
gtcaagctcggaaaccaccc

SEQ ID NO: 10236 - DNA, 20 bp, Artificial Sequence
  chemically synthesized
aagctcggaaaccaccccag

SEQ ID NO: 10237 - DNA, 20 bp, Artificial Sequence
  chemically synthesized
ccaccccagcagatactctg

SEQ ID NO: 10238 - DNA, 20 bp, Artificial Sequence
  chemically synthesized
caccccagcagatactctgc

SEQ ID NO: 10239 - DNA, 20 bp, Artificial Sequence
  chemically synthesized
gcagatactctgcaggaacg

SEQ ID NO: 10240 - DNA, 20 bp, Artificial Sequence
  chemically synthesized
actctgcaggaacgaagccg

SEQ ID NO: 10241 - DNA, 20 bp, Artificial Sequence
  chemically synthesized
ctctgcaggaacgaagccgt

SEQ ID NO: 10242 - DNA, 20 bp, Artificial Sequence
  chemically synthesized
caggaacgaagccgtgggcc

SEQ ID NO: 10243 - DNA, 20 bp, Artificial Sequence
  chemically synthesized
aggaacgaagccgtgggccc

SEQ ID NO: 10244 - DNA, 20 bp, Artificial Sequence
  chemically synthesized
ggaacgaagccgtgggccca

SEQ ID NO: 10245 - DNA, 20 bp, Artificial Sequence
  chemically synthesized
gccgtgggcccagggctatg

SEQ ID NO: 10246 - DNA, 20 bp, Artificial Sequence
  chemically synthesized
ccgtgggcccagggctatgc

SEQ ID NO: 10247 - DNA, 20 bp, Artificial Sequence
  chemically synthesized
cgtgggcccagggctatgca

SEQ ID NO: 10248 - DNA, 20 bp, Artificial Sequence
  chemically synthesized
gggcccagggctatgcaggg

SEQ ID NO: 10249 - DNA, 20 bp, Artificial Sequence
  chemically synthesized
gcccagggctatgcagggtg

SEQ ID NO: 10250 - DNA, 20 bp, Artificial Sequence
  chemically synthesized
cccagggctatgcagggtgg

SEQ ID NO: 10251 - DNA, 20 bp, Artificial Sequence
  chemically synthesized
agggctatgcagggtggagg

SEQ ID NO: 10252 - DNA, 20 bp, Artificial Sequence
  chemically synthesized
gggctatgcagggtggagga

SEQ ID NO: 10253 - DNA, 20 bp, Artificial Sequence
  chemically synthesized
ggaggaaggccaccctgtgc

SEQ ID NO: 10254 - DNA, 20 bp, Artificial Sequence
  chemically synthesized
gaggaaggccaccctgtgct

SEQ ID NO: 10255 - DNA, 20 bp, Artificial Sequence
  chemically synthesized
aaggccaccctgtgctggga

SEQ ID NO: 10256 - DNA, 20 bp, Artificial Sequence
  chemically synthesized
accctgtgctgggacagact

SEQ ID NO: 10257 - DNA, 20 bp, Artificial Sequence
  chemically synthesized
ccctgtgctgggacagactc

SEQ ID NO: 10258 - DNA, 20 bp, Artificial Sequence
  chemically synthesized
cctgtgctgggacagactca

SEQ ID NO: 10259 - DNA, 20 bp, Artificial Sequence
  chemically synthesized
ctgtgctgggacagactcag

SEQ ID NO: 10260 - DNA, 20 bp, Artificial Sequence
  chemically synthesized
ctgggacagactcaggggcc

SEQ ID NO: 10261 - DNA, 20 bp, Artificial Sequence
  chemically synthesized
tgggacagactcaggggcct

SEQ ID NO: 10262 - DNA, 20 bp, Artificial Sequence
  chemically synthesized
gacagactcaggggcctggg

SEQ ID NO: 10263 - DNA, 20 bp, Artificial Sequence
  chemically synthesized
acagactcaggggcctgggc

SEQ ID NO: 10264 - DNA, 20 bp, Artificial Sequence
  chemically synthesized
aggggcctgggcgggactcc

SEQ ID NO: 10265 - DNA, 20 bp, Artificial Sequence
  chemically synthesized
gggcctgggcgggactccca

SEQ ID NO: 10266 - DNA, 20 bp, Artificial Sequence
  chemically synthesized
ggcctgggcgggactcccag

SEQ ID NO: 10267 - DNA, 20 bp, Artificial Sequence
  chemically synthesized
gcctgggcgggactcccaga

SEQ ID NO: 10268 - DNA, 20 bp, Artificial Sequence
  chemically synthesized
cctgggcgggactcccagag

SEQ ID NO: 10269 - DNA, 20 bp, Artificial Sequence
  chemically synthesized
ggcgggactcccagaggggt

SEQ ID NO: 10270 - DNA, 20 bp, Artificial Sequence
  chemically synthesized
ggactcccagaggggtgaga

SEQ ID NO: 10271 - DNA, 20 bp, Artificial Sequence
  chemically synthesized
cagctgcacacctgtgtgcc

SEQ ID NO: 10272 - DNA, 20 bp, Artificial Sequence
  chemically synthesized
agctgcacacctgtgtgcct

SEQ ID NO: 10273 - DNA, 20 bp, Artificial Sequence
  chemically synthesized
acacctgtgtgcctgggccc

SEQ ID NO: 10274 - DNA, 20 bp, Artificial Sequence
  chemically synthesized
cacctgtgtgcctgggcccc

SEQ ID NO: 10275 - DNA, 20 bp, Artificial Sequence
  chemically synthesized
ggccccaggctgtcacactc

SEQ ID NO: 10276 - DNA, 20 bp, Artificial Sequence
  chemically synthesized
ctgtcacactccagttcact

SEQ ID NO: 10277 - DNA, 20 bp, Artificial Sequence
  chemically synthesized
tgtcacactccagttcactg

SEQ ID NO: 10278 - DNA, 20 bp, Artificial Sequence
  chemically synthesized
tcactgaggccccctctgca

SEQ ID NO: 10279 - DNA, 20 bp, Artificial Sequence
  chemically synthesized
cactgaggccccctctgcac

SEQ ID NO: 10280 - DNA, 20 bp, Artificial Sequence
  chemically synthesized
actgaggccccctctgcacg

SEQ ID NO: 10281 - DNA, 20 bp, Artificial Sequence
  chemically synthesized
cccctctgcacggggccctg

SEQ ID NO: 10282 - DNA, 20 bp, Artificial Sequence
  chemically synthesized
tctgcacggggccctgcagc

SEQ ID NO: 10283 - DNA, 20 bp, Artificial Sequence
  chemically synthesized
ctgcacggggccctgcagcc

SEQ ID NO: 10284 - DNA, 20 bp, Artificial Sequence
  chemically synthesized
tgcacggggccctgcagcca

SEQ ID NO: 10285 - DNA, 20 bp, Artificial Sequence
  chemically synthesized
gcacggggccctgcagccag

SEQ ID NO: 10286 - DNA, 20 bp, Artificial Sequence
  chemically synthesized
cctgcagccaggggctgaca

SEQ ID NO: 10287 - DNA, 20 bp, Artificial Sequence
  chemically synthesized
ctgcagccaggggctgacac

SEQ ID NO: 10288 - DNA, 20 bp, Artificial Sequence
  chemically synthesized
accgtttctcattcttccct

SEQ ID NO: 10289 - DNA, 20 bp, Artificial Sequence
  chemically synthesized
ccgtttctcattcttccctt

SEQ ID NO: 10290 - DNA, 20 bp, Artificial Sequence
  chemically synthesized
cgtttctcattcttccctta

SEQ ID NO: 10291 - DNA, 20 bp, Artificial Sequence
  chemically synthesized
gtttctcattcttcccttag

SEQ ID NO: 10292 - DNA, 20 bp, Artificial Sequence
  chemically synthesized
tcccttaggggtccaaaact

SEQ ID NO: 10293 - DNA, 20 bp, Artificial Sequence
  chemically synthesized
cccttaggggtccaaaactt

SEQ ID NO: 10294 - DNA, 20 bp, Artificial Sequence
  chemically synthesized
ccttaggggtccaaaacttg

SEQ ID NO: 10295 - DNA, 20 bp, Artificial Sequence
  chemically synthesized
cttaggggtccaaaacttgg

SEQ ID NO: 10296 - DNA, 20 bp, Artificial Sequence
  chemically synthesized
ttaggggtccaaaacttggg

SEQ ID NO: 10297 - DNA, 20 bp, Artificial Sequence
  chemically synthesized
tccaaaacttggggggacaa

SEQ ID NO: 10298 - DNA, 20 bp, Artificial Sequence
  chemically synthesized
acttggggggacaaaagccg

SEQ ID NO: 10299 - DNA, 20 bp, Artificial Sequence
  chemically synthesized
gggggacaaaagccgaagtc

SEQ ID NO: 10300 - DNA, 20 bp, Artificial Sequence
  chemically synthesized
ggggacaaaagccgaagtcc

SEQ ID NO: 10301 - DNA, 20 bp, Artificial Sequence
  chemically synthesized
gggacaaaagccgaagtcca

SEQ ID NO: 10302 - DNA, 20 bp, Artificial Sequence
  chemically synthesized
ggacaaaagccgaagtccag

SEQ ID NO: 10303 - DNA, 20 bp, Artificial Sequence
  chemically synthesized
gacaaaagccgaagtccagg

SEQ ID NO: 10304 - DNA, 20 bp, Artificial Sequence
  chemically synthesized
aaagccgaagtccagggggt

SEQ ID NO: 10305 - DNA, 20 bp, Artificial Sequence
  chemically synthesized
agccgaagtccagggggtcg

SEQ ID NO: 10306 - DNA, 20 bp, Artificial Sequence
  chemically synthesized
gccgaagtccagggggtcgg

SEQ ID NO: 10307 - DNA, 20 bp, Artificial Sequence
  chemically synthesized
cgaagtccagggggtcggag

SEQ ID NO: 10308 - DNA, 20 bp, Artificial Sequence
  chemically synthesized
gaagtccagggggtcggagg

SEQ ID NO: 10309 - DNA, 20 bp, Artificial Sequence
  chemically synthesized
aagtccagggggtcggagga

SEQ ID NO: 10310 - DNA, 20 bp, Artificial Sequence
  chemically synthesized
gtcggaggagggacttgccc

SEQ ID NO: 10311 - DNA, 20 bp, Artificial Sequence
  chemically synthesized
tcggaggagggacttgcccc

SEQ ID NO: 10312 - DNA, 20 bp, Artificial Sequence
  chemically synthesized
gggacttgccccaggccttg

SEQ ID NO: 10313 - DNA, 20 bp, Artificial Sequence
  chemically synthesized
gccccaggccttgtggacac

SEQ ID NO: 10314 - DNA, 20 bp, Artificial Sequence
  chemically synthesized
ccccaggccttgtggacact

SEQ ID NO: 10315 - DNA, 20 bp, Artificial Sequence
  chemically synthesized
caggccttgtggacactggg

SEQ ID NO: 10316 - DNA, 20 bp, Artificial Sequence
  chemically synthesized
aggccttgtggacactgggt

SEQ ID NO: 10317 - DNA, 20 bp, Artificial Sequence
  chemically synthesized
tgtggacactgggtgggctc

SEQ ID NO: 10318 - DNA, 20 bp, Artificial Sequence
  chemically synthesized
gtggacactgggtgggctcc

SEQ ID NO: 10319 - DNA, 20 bp, Artificial Sequence
  chemically synthesized
gtgggctccgggacctgaac

SEQ ID NO: 10320 - DNA, 20 bp, Artificial Sequence
  chemically synthesized
gggctccgggacctgaactg

SEQ ID NO: 10321 - DNA, 20 bp, Artificial Sequence
  chemically synthesized
ccgggacctgaactggagct

SEQ ID NO: 10322 - DNA, 20 bp, Artificial Sequence
  chemically synthesized
cgggacctgaactggagctg

SEQ ID NO: 10323 - DNA, 20 bp, Artificial Sequence
  chemically synthesized
gacctgaactggagctgagg

SEQ ID NO: 10324 - DNA, 20 bp, Artificial Sequence
  chemically synthesized
acctgaactggagctgagga

SEQ ID NO: 10325 - DNA, 20 bp, Artificial Sequence
  chemically synthesized
ctgaactggagctgaggaag

SEQ ID NO: 10326 - DNA, 20 bp, Artificial Sequence
  chemically synthesized
ctggagctgaggaaggagtg

SEQ ID NO: 10327 - DNA, 20 bp, Artificial Sequence
  chemically synthesized
aaggagtgaagctaaactcc

SEQ ID NO: 10328 - DNA, 20 bp, Artificial Sequence
  chemically synthesized
aagctaaactcctagatcca

SEQ ID NO: 10329 - DNA, 20 bp, Artificial Sequence
  chemically synthesized
agctaaactcctagatccac

SEQ ID NO: 10330 - DNA, 20 bp, Artificial Sequence
  chemically synthesized
cacgggataaattacccccc

SEQ ID NO: 10331 - DNA, 20 bp, Artificial Sequence
  chemically synthesized
ccaagtccctcacctctcca

SEQ ID NO: 10332 - DNA, 20 bp, Artificial Sequence
  chemically synthesized
cctctccaaagctgcccatc

SEQ ID NO: 10333 - DNA, 20 bp, Artificial Sequence
  chemically synthesized
tctccaaagctgcccatctg

SEQ ID NO: 10334 - DNA, 20 bp, Artificial Sequence
  chemically synthesized
ctccaaagctgcccatctgg

SEQ ID NO: 10335 - DNA, 20 bp, Artificial Sequence
  chemically synthesized
ccaaagctgcccatctggag

SEQ ID NO: 10336 - DNA, 20 bp, Artificial Sequence
  chemically synthesized
caaagctgcccatctggagg

SEQ ID NO: 10337 - DNA, 20 bp, Artificial Sequence
  chemically synthesized
agctgcccatctggaggagg

SEQ ID NO: 10338 - DNA, 20 bp, Artificial Sequence
  chemically synthesized
gctgcccatctggaggaggc

SEQ ID NO: 10339 - DNA, 20 bp, Artificial Sequence
  chemically synthesized
tgcccatctggaggaggcgg

SEQ ID NO: 10340 - DNA, 20 bp, Artificial Sequence
  chemically synthesized
gcccatctggaggaggcggg

SEQ ID NO: 10341 - DNA, 20 bp, Artificial Sequence
  chemically synthesized
cccatctggaggaggcggga

SEQ ID NO: 10342 - DNA, 20 bp, Artificial Sequence
  chemically synthesized
catctggaggaggcgggagg

SEQ ID NO: 10343 - DNA, 20 bp, Artificial Sequence
  chemically synthesized
aggaggcgggagggagctac

SEQ ID NO: 10344 - DNA, 20 bp, Artificial Sequence
  chemically synthesized
ggaggcgggagggagctacg

SEQ ID NO: 10345 - DNA, 20 bp, Artificial Sequence
  chemically synthesized
gaggcgggagggagctacga

SEQ ID NO: 10346 - DNA, 20 bp, Artificial Sequence
  chemically synthesized
gggagggagctacgagggcc

SEQ ID NO: 10347 - DNA, 20 bp, Artificial Sequence
  chemically synthesized
gagggagctacgagggccaa

SEQ ID NO: 10348 - DNA, 20 bp, Artificial Sequence
  chemically synthesized
gctacgagggccaagagcat

SEQ ID NO: 10349 - DNA, 20 bp, Artificial Sequence
  chemically synthesized
ctacgagggccaagagcatg

SEQ ID NO: 10350 - DNA, 20 bp, Artificial Sequence
  chemically synthesized
gggccaagagcatgaggtca

SEQ ID NO: 10351 - DNA, 20 bp, Artificial Sequence
  chemically synthesized
agcatgaggtcatggaaact

SEQ ID NO: 10352 - DNA, 20 bp, Artificial Sequence
  chemically synthesized
gcatgaggtcatggaaactc

SEQ ID NO: 10353 - DNA, 20 bp, Artificial Sequence
  chemically synthesized
tcatggaaactcgggctgtg

SEQ ID NO: 10354 - DNA, 20 bp, Artificial Sequence
  chemically synthesized
catggaaactcgggctgtga

SEQ ID NO: 10355 - DNA, 20 bp, Artificial Sequence
  chemically synthesized
atggaaactcgggctgtgaa

SEQ ID NO: 10356 - DNA, 20 bp, Artificial Sequence
  chemically synthesized
tggaaactcgggctgtgaag

SEQ ID NO: 10357 - DNA, 20 bp, Artificial Sequence
  chemically synthesized
tgaaggggccgcacgtgccc

SEQ ID NO: 10358 - DNA, 20 bp, Artificial Sequence
  chemically synthesized
gaaggggccgcacgtgccct

SEQ ID NO: 10359 - DNA, 20 bp, Artificial Sequence
  chemically synthesized
ggccgcacgtgccctgggaa

SEQ ID NO: 10360 - DNA, 20 bp, Artificial Sequence
  chemically synthesized
gccgcacgtgccctgggaac

SEQ ID NO: 10361 - DNA, 20 bp, Artificial Sequence
  chemically synthesized
ccctgggaacgggatgaact

SEQ ID NO: 10362 - DNA, 20 bp, Artificial Sequence
  chemically synthesized
tcggctcgtttatttccacc

SEQ ID NO: 10363 - DNA, 20 bp, Artificial Sequence
  chemically synthesized
ttatttccacccagttgtca

SEQ ID NO: 10364 - DNA, 20 bp, Artificial Sequence
  chemically synthesized
ccacccagttgtcatggcga

SEQ ID NO: 10365 - DNA, 20 bp, Artificial Sequence
  chemically synthesized
cacccagttgtcatggcgat

SEQ ID NO: 10366 - DNA, 20 bp, Artificial Sequence
  chemically synthesized
acccagttgtcatggcgata

SEQ ID NO: 10367 - DNA, 20 bp, Artificial Sequence
  chemically synthesized
cccagttgtcatggcgatag

SEQ ID NO: 10368 - DNA, 20 bp, Artificial Sequence
  chemically synthesized
cagttgtcatggcgataggg

SEQ ID NO: 10369 - DNA, 20 bp, Artificial Sequence
  chemically synthesized
agttgtcatggcgatagggg

SEQ ID NO: 10370 - DNA, 20 bp, Artificial Sequence
  chemically synthesized
gttgtcatggcgatagggga

SEQ ID NO: 10371 - DNA, 20 bp, Artificial Sequence
  chemically synthesized
ttgtcatggcgataggggag

SEQ ID NO: 10372 - DNA, 20 bp, Artificial Sequence
  chemically synthesized
tgtcatggcgataggggagg

SEQ ID NO: 10373 - DNA, 20 bp, Artificial Sequence
  chemically synthesized
gtcatggcgataggggaggg

SEQ ID NO: 10374 - DNA, 20 bp, Artificial Sequence
  chemically synthesized
tggcgataggggaggggggc

SEQ ID NO: 10375 - DNA, 20 bp, Artificial Sequence
  chemically synthesized
ggcgataggggaggggggca

SEQ ID NO: 10376 - DNA, 20 bp, Artificial Sequence
  chemically synthesized
cgataggggaggggggcaag

SEQ ID NO: 10377 - DNA, 20 bp, Artificial Sequence
  chemically synthesized
ataggggaggggggcaagga

SEQ ID NO: 10378 - DNA, 20 bp, Artificial Sequence
  chemically synthesized
gaggggggcaaggagagcaa

SEQ ID NO: 10379 - DNA, 20 bp, Artificial Sequence
  chemically synthesized
aggggggcaaggagagcaat

SEQ ID NO: 10380 - DNA, 20 bp, Artificial Sequence
  chemically synthesized
gcaatgggcctttccctttc

SEQ ID NO: 10381 - DNA, 20 bp, Artificial Sequence
  chemically synthesized
caatgggcctttccctttca

SEQ ID NO: 10382 - DNA, 20 bp, Artificial Sequence
  chemically synthesized
ttccctttcaaggacctgcc

SEQ ID NO: 10383 - DNA, 20 bp, Artificial Sequence
  chemically synthesized
tttcaaggacctgcccagta

SEQ ID NO: 10384 - DNA, 20 bp, Artificial Sequence
  chemically synthesized
ttcaaggacctgcccagtac

SEQ ID NO: 10385 - DNA, 20 bp, Artificial Sequence
  chemically synthesized
cagtacaggcatccctgtga

SEQ ID NO: 10386 - DNA, 20 bp, Artificial Sequence
  chemically synthesized
catccctgtgaaagatgcct

SEQ ID NO: 10387 - DNA, 20 bp, Artificial Sequence
  chemically synthesized
atccctgtgaaagatgcctg

SEQ ID NO: 10388 - DNA, 20 bp, Artificial Sequence
  chemically synthesized
tgtgaaagatgcctgaggcc

SEQ ID NO: 10389 - DNA, 20 bp, Artificial Sequence
  chemically synthesized
gtgaaagatgcctgaggcct

SEQ ID NO: 10390 - DNA, 20 bp, Artificial Sequence
  chemically synthesized
gatgcctgaggcctgggcac

SEQ ID NO: 10391 - DNA, 20 bp, Artificial Sequence
  chemically synthesized
atgcctgaggcctgggcacc

SEQ ID NO: 10392 - DNA, 20 bp, Artificial Sequence
  chemically synthesized
tgcctgaggcctgggcacca

SEQ ID NO: 10393 - DNA, 20 bp, Artificial Sequence
  chemically synthesized
ggcctgggcaccagggactc

SEQ ID NO: 10394 - DNA, 20 bp, Artificial Sequence
  chemically synthesized
cctgggcaccagggactcca

SEQ ID NO: 10395 - DNA, 20 bp, Artificial Sequence
  chemically synthesized
gcaccagggactccagagtc

SEQ ID NO: 10396 - DNA, 20 bp, Artificial Sequence
  chemically synthesized
caccagggactccagagtcc

SEQ ID NO: 10397 - DNA, 20 bp, Artificial Sequence
  chemically synthesized
caacccctccccattcaacc

SEQ ID NO: 10398 - DNA, 20 bp, Artificial Sequence
  chemically synthesized
aacccctccccattcaaccc

SEQ ID NO: 10399 - DNA, 20 bp, Artificial Sequence
  chemically synthesized
cccctccccattcaacccag

SEQ ID NO: 10400 - DNA, 20 bp, Artificial Sequence
  chemically synthesized
ccctccccattcaacccagg

SEQ ID NO: 10401 - DNA, 20 bp, Artificial Sequence
  chemically synthesized
ccccattcaacccaggaggc

SEQ ID NO: 10402 - DNA, 20 bp, Artificial Sequence
  chemically synthesized
cccattcaacccaggaggcc

SEQ ID NO: 10403 - DNA, 20 bp, Artificial Sequence
  chemically synthesized
caacccaggaggccaggccc

SEQ ID NO: 10404 - DNA, 20 bp, Artificial Sequence
  chemically synthesized
ggccccagcccttccgccct

SEQ ID NO: 10405 - DNA, 20 bp, Artificial Sequence
  chemically synthesized
agcccttccgccctcagatg

SEQ ID NO: 10406 - DNA, 20 bp, Artificial Sequence
  chemically synthesized
gcccttccgccctcagatga

SEQ ID NO: 10407 - DNA, 20 bp, Artificial Sequence
  chemically synthesized
ccttccgccctcagatgaag

SEQ ID NO: 10408 - DNA, 20 bp, Artificial Sequence
  chemically synthesized
cgccctcagatgaaggagtc

SEQ ID NO: 10409 - DNA, 20 bp, Artificial Sequence
  chemically synthesized
gccctcagatgaaggagtcc

SEQ ID NO: 10410 - DNA, 20 bp, Artificial Sequence
  chemically synthesized
gatgaaggagtccaggcccc

SEQ ID NO: 10411 - DNA, 20 bp, Artificial Sequence
  chemically synthesized
gcccccagcctctccccatt

SEQ ID NO: 10412 - DNA, 20 bp, Artificial Sequence
  chemically synthesized
agcctctccccattcagacc

SEQ ID NO: 10413 - DNA, 20 bp, Artificial Sequence
  chemically synthesized
gcctctccccattcagaccc

SEQ ID NO: 10414 - DNA, 20 bp, Artificial Sequence
  chemically synthesized
cctctccccattcagaccca

SEQ ID NO: 10415 - DNA, 20 bp, Artificial Sequence
  chemically synthesized
ctctccccattcagacccag

SEQ ID NO: 10416 - DNA, 20 bp, Artificial Sequence
  chemically synthesized
cccattcagacccaggggtc

SEQ ID NO: 10417 - DNA, 20 bp, Artificial Sequence
  chemically synthesized
ccattcagacccaggggtcc

SEQ ID NO: 10418 - DNA, 20 bp, Artificial Sequence
  chemically synthesized
cagacccaggggtccaggcc

SEQ ID NO: 10419 - DNA, 20 bp, Artificial Sequence
  chemically synthesized
aggcccagccccgcctccct

SEQ ID NO: 10420 - DNA, 20 bp, Artificial Sequence
  chemically synthesized
agccccgcctccctaagacc

SEQ ID NO: 10421 - DNA, 20 bp, Artificial Sequence
  chemically synthesized
cccgcctccctaagacccag

SEQ ID NO: 10422 - DNA, 20 bp, Artificial Sequence
  chemically synthesized
ctccctaagacccagaagtc

SEQ ID NO: 10423 - DNA, 20 bp, Artificial Sequence
  chemically synthesized
tccctaagacccagaagtcc

SEQ ID NO: 10424 - DNA, 20 bp, Artificial Sequence
  chemically synthesized
gacccagaagtccaggcccc

SEQ ID NO: 10425 - DNA, 20 bp, Artificial Sequence
  chemically synthesized
gcccccagcccctcctccct

SEQ ID NO: 10426 - DNA, 20 bp, Artificial Sequence
  chemically synthesized
ccctcctccctcagacccac

SEQ ID NO: 10427 - DNA, 20 bp, Artificial Sequence
  chemically synthesized
ctccctcagacccacgagtc

SEQ ID NO: 10428 - DNA, 20 bp, Artificial Sequence
  chemically synthesized
tccctcagacccacgagtcc

SEQ ID NO: 10429 - DNA, 20 bp, Artificial Sequence
  chemically synthesized
agacccacgagtccaggccc

SEQ ID NO: 10430 - DNA, 20 bp, Artificial Sequence
  chemically synthesized
ggccccagcccctcctccct

SEQ ID NO: 10431 - DNA, 20 bp, Artificial Sequence
  chemically synthesized
agcccctcctccctcggacc

SEQ ID NO: 10432 - DNA, 20 bp, Artificial Sequence
  chemically synthesized
gcccctcctccctcggaccc

SEQ ID NO: 10433 - DNA, 20 bp, Artificial Sequence
  chemically synthesized
ccctcctccctcggacccag

SEQ ID NO: 10434 - DNA, 20 bp, Artificial Sequence
  chemically synthesized
ctccctcggacccaggagtc

SEQ ID NO: 10435 - DNA, 20 bp, Artificial Sequence
  chemically synthesized
tccctcggacccaggagtcc

SEQ ID NO: 10436 - DNA, 20 bp, Artificial Sequence
  chemically synthesized
gacccaggagtccaggcccc

SEQ ID NO: 10437 - DNA, 20 bp, Artificial Sequence
  chemically synthesized
gcccccagtccctccaccct

SEQ ID NO: 10438 - DNA, 20 bp, Artificial Sequence
  chemically synthesized
agtccctccaccctcagacc

SEQ ID NO: 10439 - DNA, 20 bp, Artificial Sequence
  chemically synthesized
gtccctccaccctcagaccc

SEQ ID NO: 10440 - DNA, 20 bp, Artificial Sequence
  chemically synthesized
ccctccaccctcagacccag

SEQ ID NO: 10441 - DNA, 20 bp, Artificial Sequence
  chemically synthesized
caccctcagacccaggagtc

SEQ ID NO: 10442 - DNA, 20 bp, Artificial Sequence
  chemically synthesized
accctcagacccaggagtcc

SEQ ID NO: 10443 - DNA, 20 bp, Artificial Sequence
  chemically synthesized
agacccaggagtccaggccc

SEQ ID NO: 10444 - DNA, 20 bp, Artificial Sequence
  chemically synthesized
ggccccagcccctcctccct

SEQ ID NO: 10445 - DNA, 20 bp, Artificial Sequence
  chemically synthesized
agcccctcctccctcggacc

SEQ ID NO: 10446 - DNA, 20 bp, Artificial Sequence
  chemically synthesized
gcccctcctccctcggaccc

SEQ ID NO: 10447 - DNA, 20 bp, Artificial Sequence
  chemically synthesized
ccctcctccctcggacccag

SEQ ID NO: 10448 - DNA, 20 bp, Artificial Sequence
  chemically synthesized
ctccctcggacccaggagtc

SEQ ID NO: 10449 - DNA, 20 bp, Artificial Sequence
  chemically synthesized
tccctcggacccaggagtcc

SEQ ID NO: 10450 - DNA, 20 bp, Artificial Sequence
  chemically synthesized
ggacccaggagtccaggccc

SEQ ID NO: 10451 - DNA, 20 bp, Artificial Sequence
  chemically synthesized
agcccctcctctctcaaacc

SEQ ID NO: 10452 - DNA, 20 bp, Artificial Sequence
  chemically synthesized
gcccctcctctctcaaaccc

SEQ ID NO: 10453 - DNA, 20 bp, Artificial Sequence
  chemically synthesized
ccctcctctctcaaacccag

SEQ ID NO: 10454 - DNA, 20 bp, Artificial Sequence
  chemically synthesized
ctctctcaaacccaggagcc

SEQ ID NO: 10455 - DNA, 20 bp, Artificial Sequence
  chemically synthesized
tctctcaaacccaggagccc

SEQ ID NO: 10456 - DNA, 20 bp, Artificial Sequence
  chemically synthesized
aacccaggagcccaggcccc

SEQ ID NO: 10457 - DNA, 20 bp, Artificial Sequence
  chemically synthesized
gcccccagctcttctctgtt

SEQ ID NO: 10458 - DNA, 20 bp, Artificial Sequence
  chemically synthesized
gctcttctctgttcagccct

SEQ ID NO: 10459 - DNA, 20 bp, Artificial Sequence
  chemically synthesized
ctgttcagccctaagaatcc

SEQ ID NO: 10460 - DNA, 20 bp, Artificial Sequence
  chemically synthesized
agccctaagaatcctggctc

SEQ ID NO: 10461 - DNA, 20 bp, Artificial Sequence
  chemically synthesized
ggctccagcccctcctactc

SEQ ID NO: 10462 - DNA, 20 bp, Artificial Sequence
  chemically synthesized
tactctagcccccaaccccc

SEQ ID NO: 10463 - DNA, 20 bp, Artificial Sequence
  chemically synthesized
cccccaaccccctagccact

SEQ ID NO: 10464 - DNA, 20 bp, Artificial Sequence
  chemically synthesized
ccccaaccccctagccacta

SEQ ID NO: 10465 - DNA, 20 bp, Artificial Sequence
  chemically synthesized
cccctagccactaaggcaat

SEQ ID NO: 10466 - DNA, 20 bp, Artificial Sequence
  chemically synthesized
ccctagccactaaggcaatt

SEQ ID NO: 10467 - DNA, 20 bp, Artificial Sequence
  chemically synthesized
cctagccactaaggcaattg

SEQ ID NO: 10468 - DNA, 20 bp, Artificial Sequence
  chemically synthesized
ccactaaggcaattggggtg

SEQ ID NO: 10469 - DNA, 20 bp, Artificial Sequence
  chemically synthesized
cactaaggcaattggggtgc

SEQ ID NO: 10470 - DNA, 20 bp, Artificial Sequence
  chemically synthesized
aggcaattggggtgcaggaa

SEQ ID NO: 10471 - DNA, 20 bp, Artificial Sequence
  chemically synthesized
ggcaattggggtgcaggaat

SEQ ID NO: 10472 - DNA, 20 bp, Artificial Sequence
  chemically synthesized
gcaattggggtgcaggaatg

SEQ ID NO: 10473 - DNA, 20 bp, Artificial Sequence
  chemically synthesized
caattggggtgcaggaatgg

SEQ ID NO: 10474 - DNA, 20 bp, Artificial Sequence
  chemically synthesized
ttggggtgcaggaatggggg

SEQ ID NO: 10475 - DNA, 20 bp, Artificial Sequence
  chemically synthesized
tggggtgcaggaatgggggc

SEQ ID NO: 10476 - DNA, 20 bp, Artificial Sequence
  chemically synthesized
ggggtgcaggaatgggggca

SEQ ID NO: 10477 - DNA, 20 bp, Artificial Sequence
  chemically synthesized
caggaatgggggcagggtac

SEQ ID NO: 10478 - DNA, 20 bp, Artificial Sequence
  chemically synthesized
ggcagggtaccagcctcacc

SEQ ID NO: 10479 - DNA, 20 bp, Artificial Sequence
  chemically synthesized
agggtaccagcctcaccaag

SEQ ID NO: 10480 - DNA, 20 bp, Artificial Sequence
  chemically synthesized
aagtggttgataaacccacg

SEQ ID NO: 10481 - DNA, 20 bp, Artificial Sequence
  chemically synthesized
agtggttgataaacccacgt

SEQ ID NO: 10482 - DNA, 20 bp, Artificial Sequence
  chemically synthesized
gtggttgataaacccacgtg

SEQ ID NO: 10483 - DNA, 20 bp, Artificial Sequence
  chemically synthesized
aaacccacgtggggtaccct

SEQ ID NO: 10484 - DNA, 20 bp, Artificial Sequence
  chemically synthesized
cgtggggtaccctaagaact

SEQ ID NO: 10485 - DNA, 20 bp, Artificial Sequence
  chemically synthesized
gtggggtaccctaagaactt

SEQ ID NO: 10486 - DNA, 20 bp, Artificial Sequence
  chemically synthesized
gtaccctaagaacttgggaa

SEQ ID NO: 10487 - DNA, 20 bp, Artificial Sequence
  chemically synthesized
taagaacttgggaacagcca

SEQ ID NO: 10488 - DNA, 20 bp, Artificial Sequence
  chemically synthesized
gaacttgggaacagccacag

SEQ ID NO: 10489 - DNA, 20 bp, Artificial Sequence
  chemically synthesized
aacttgggaacagccacagc

SEQ ID NO: 10490 - DNA, 20 bp, Artificial Sequence
  chemically synthesized
acttgggaacagccacagca

SEQ ID NO: 10491 - DNA, 20 bp, Artificial Sequence
  chemically synthesized
cttgggaacagccacagcag

SEQ ID NO: 10492 - DNA, 20 bp, Artificial Sequence
  chemically synthesized
ttgggaacagccacagcagg

SEQ ID NO: 10493 - DNA, 20 bp, Artificial Sequence
  chemically synthesized
tgggaacagccacagcaggg

SEQ ID NO: 10494 - DNA, 20 bp, Artificial Sequence
  chemically synthesized
cacagcaggggggcgatgct

SEQ ID NO: 10495 - DNA, 20 bp, Artificial Sequence
  chemically synthesized
acagcaggggggcgatgctt

SEQ ID NO: 10496 - DNA, 20 bp, Artificial Sequence
  chemically synthesized
cagcaggggggcgatgcttg

SEQ ID NO: 10497 - DNA, 20 bp, Artificial Sequence
  chemically synthesized
gcgatgcttggggacctgcc

SEQ ID NO: 10498 - DNA, 20 bp, Artificial Sequence
  chemically synthesized
gatgcttggggacctgcctg

SEQ ID NO: 10499 - DNA, 20 bp, Artificial Sequence
  chemically synthesized
gcttggggacctgcctggag

SEQ ID NO: 10500 - DNA, 20 bp, Artificial Sequence
  chemically synthesized
cttggggacctgcctggaga

SEQ ID NO: 10501 - DNA, 20 bp, Artificial Sequence
  chemically synthesized
gacctgcctggagaaggatg

SEQ ID NO: 10502 - DNA, 20 bp, Artificial Sequence
  chemically synthesized
acctgcctggagaaggatgc

SEQ ID NO: 10503 - DNA, 20 bp, Artificial Sequence
  chemically synthesized
cctggagaaggatgcaggac

SEQ ID NO: 10504 - DNA, 20 bp, Artificial Sequence
  chemically synthesized
aggatgcaggacgagaaaca

SEQ ID NO: 10505 - DNA, 20 bp, Artificial Sequence
  chemically synthesized
caggacgagaaacacagccc

SEQ ID NO: 10506 - DNA, 20 bp, Artificial Sequence
  chemically synthesized
aggacgagaaacacagcccc

SEQ ID NO: 10507 - DNA, 20 bp, Artificial Sequence
  chemically synthesized
acgagaaacacagccccagg

SEQ ID NO: 10508 - DNA, 20 bp, Artificial Sequence
  chemically synthesized
gagaaacacagccccaggtg

SEQ ID NO: 10509 - DNA, 20 bp, Artificial Sequence
  chemically synthesized
acagccccaggtggagaaac

SEQ ID NO: 10510 - DNA, 20 bp, Artificial Sequence
  chemically synthesized
ccccaggtggagaaactggc

SEQ ID NO: 10511 - DNA, 20 bp, Artificial Sequence
  chemically synthesized
cccaggtggagaaactggcc

SEQ ID NO: 10512 - DNA, 20 bp, Artificial Sequence
  chemically synthesized
ggagaaactggccgggaatc

SEQ ID NO: 10513 - DNA, 20 bp, Artificial Sequence
  chemically synthesized
agaaactggccgggaatcaa

SEQ ID NO: 10514 - DNA, 20 bp, Artificial Sequence
  chemically synthesized
gccgggaatcaagagtcacc

SEQ ID NO: 10515 - DNA, 20 bp, Artificial Sequence
  chemically synthesized
cgggaatcaagagtcaccca

SEQ ID NO: 10516 - DNA, 20 bp, Artificial Sequence
  chemically synthesized
aatcaagagtcacccagaga

SEQ ID NO: 10517 - DNA, 20 bp, Artificial Sequence
  chemically synthesized
accaaccatccctgttttcc

SEQ ID NO: 10518 - DNA, 20 bp, Artificial Sequence
  chemically synthesized
ccaaccatccctgttttcct

SEQ ID NO: 10519 - DNA, 20 bp, Artificial Sequence
  chemically synthesized
atccctgttttcctaggact

SEQ ID NO: 10520 - DNA, 20 bp, Artificial Sequence
  chemically synthesized
tccctgttttcctaggactg

SEQ ID NO: 10521 - DNA, 20 bp, Artificial Sequence
  chemically synthesized
ccctgttttcctaggactga

SEQ ID NO: 10522 - DNA, 20 bp, Artificial Sequence
  chemically synthesized
tttcctaggactgagggttt

SEQ ID NO: 10523 - DNA, 20 bp, Artificial Sequence
  chemically synthesized
gagggtttcagtgctaaaac

SEQ ID NO: 10524 - DNA, 20 bp, Artificial Sequence
  chemically synthesized
agggtttcagtgctaaaact

SEQ ID NO: 10525 - DNA, 20 bp, Artificial Sequence
  chemically synthesized
gtgctaaaactaggctgtcc

SEQ ID NO: 10526 - DNA, 20 bp, Artificial Sequence
  chemically synthesized
tgctaaaactaggctgtcct

SEQ ID NO: 10527 - DNA, 20 bp, Artificial Sequence
  chemically synthesized
actaggctgtcctgggcaaa

SEQ ID NO: 10528 - DNA, 20 bp, Artificial Sequence
  chemically synthesized
ctgtcctgggcaaacagcat

SEQ ID NO: 10529 - DNA, 20 bp, Artificial Sequence
  chemically synthesized
cctgggcaaacagcataagc

SEQ ID NO: 10530 - DNA, 20 bp, Artificial Sequence
  chemically synthesized
taagctggtcaccccacacc

SEQ ID NO: 10531 - DNA, 20 bp, Artificial Sequence
  chemically synthesized
acccagacctgacccaaacc

SEQ ID NO: 10532 - DNA, 20 bp, Artificial Sequence
  chemically synthesized
aacccagctcccctgcttct

SEQ ID NO: 10533 - DNA, 20 bp, Artificial Sequence
  chemically synthesized
gcttcttggccacgtaacct

SEQ ID NO: 10534 - DNA, 20 bp, Artificial Sequence
  chemically synthesized
tcttggccacgtaacctgag

SEQ ID NO: 10535 - DNA, 20 bp, Artificial Sequence
  chemically synthesized
cttggccacgtaacctgaga

SEQ ID NO: 10536 - DNA, 20 bp, Artificial Sequence
  chemically synthesized
ttggccacgtaacctgagaa

SEQ ID NO: 10537 - DNA, 20 bp, Artificial Sequence
  chemically synthesized
aatccctcctctctgaaccc

SEQ ID NO: 10538 - DNA, 20 bp, Artificial Sequence
  chemically synthesized
cccagcccaccccaatgctc

SEQ ID NO: 10539 - DNA, 20 bp, Artificial Sequence
  chemically synthesized
ccagcccaccccaatgctcc

SEQ ID NO: 10540 - DNA, 20 bp, Artificial Sequence
  chemically synthesized
ccccaatgctccaggcctcc

SEQ ID NO: 10541 - DNA, 20 bp, Artificial Sequence
  chemically synthesized
cccaatgctccaggcctcct

SEQ ID NO: 10542 - DNA, 20 bp, Artificial Sequence
  chemically synthesized
aggcctcctgggataccccg

SEQ ID NO: 10543 - DNA, 20 bp, Artificial Sequence
  chemically synthesized
gcctcctgggataccccgaa

SEQ ID NO: 10544 - DNA, 20 bp, Artificial Sequence
  chemically synthesized
cctgggataccccgaagagt

SEQ ID NO: 10545 - DNA, 20 bp, Artificial Sequence
  chemically synthesized
ccccgaagagtgagtttgcc

SEQ ID NO: 10546 - DNA, 20 bp, Artificial Sequence
  chemically synthesized
cgaagagtgagtttgccaag

SEQ ID NO: 10547 - DNA, 20 bp, Artificial Sequence
  chemically synthesized
tttgccaagcagtcacccca

SEQ ID NO: 10548 - DNA, 20 bp, Artificial Sequence
  chemically synthesized
ccaagcagtcaccccacagt

SEQ ID NO: 10549 - DNA, 20 bp, Artificial Sequence
  chemically synthesized
aagcagtcaccccacagttg

SEQ ID NO: 10550 - DNA, 20 bp, Artificial Sequence
  chemically synthesized
agcagtcaccccacagttgg

SEQ ID NO: 10551 - DNA, 20 bp, Artificial Sequence
  chemically synthesized
cagtcaccccacagttggag

SEQ ID NO: 10552 - DNA, 20 bp, Artificial Sequence
  chemically synthesized
ttggaggagaatccacccaa

SEQ ID NO: 10553 - DNA, 20 bp, Artificial Sequence
  chemically synthesized
tggaggagaatccacccaaa

SEQ ID NO: 10554 - DNA, 20 bp, Artificial Sequence
  chemically synthesized
aggagaatccacccaaaagg

SEQ ID NO: 10555 - DNA, 20 bp, Artificial Sequence
  chemically synthesized
aatccacccaaaaggcagcc

SEQ ID NO: 10556 - DNA, 20 bp, Artificial Sequence
  chemically synthesized
ccacccaaaaggcagcctgg

SEQ ID NO: 10557 - DNA, 20 bp, Artificial Sequence
  chemically synthesized
ccaaaaggcagcctggtaga

SEQ ID NO: 10558 - DNA, 20 bp, Artificial Sequence
  chemically synthesized
caaaaggcagcctggtagac

SEQ ID NO: 10559 - DNA, 20 bp, Artificial Sequence
  chemically synthesized
aaaaggcagcctggtagaca

SEQ ID NO: 10560 - DNA, 20 bp, Artificial Sequence
  chemically synthesized
ggcagcctggtagacagggc

SEQ ID NO: 10561 - DNA, 20 bp, Artificial Sequence
  chemically synthesized
gcagcctggtagacagggct

SEQ ID NO: 10562 - DNA, 20 bp, Artificial Sequence
  chemically synthesized
cagcctggtagacagggctg

SEQ ID NO: 10563 - DNA, 20 bp, Artificial Sequence
  chemically synthesized
cctggtagacagggctgggg

SEQ ID NO: 10564 - DNA, 20 bp, Artificial Sequence
  chemically synthesized
agggctggggtggcctctcg

SEQ ID NO: 10565 - DNA, 20 bp, Artificial Sequence
  chemically synthesized
gggctggggtggcctctcgt

SEQ ID NO: 10566 - DNA, 20 bp, Artificial Sequence
  chemically synthesized
ggctggggtggcctctcgtg

SEQ ID NO: 10567 - DNA, 20 bp, Artificial Sequence
  chemically synthesized
gggtggcctctcgtggggtc

SEQ ID NO: 10568 - DNA, 20 bp, Artificial Sequence
  chemically synthesized
ggtggcctctcgtggggtcc

SEQ ID NO: 10569 - DNA, 20 bp, Artificial Sequence
  chemically synthesized
cctctcgtggggtccaggcc

SEQ ID NO: 10570 - DNA, 20 bp, Artificial Sequence
  chemically synthesized
ctcgtggggtccaggccaag

SEQ ID NO: 10571 - DNA, 20 bp, Artificial Sequence
  chemically synthesized
tcgtggggtccaggccaagt

SEQ ID NO: 10572 - DNA, 20 bp, Artificial Sequence
  chemically synthesized
tggggtccaggccaagtagg

SEQ ID NO: 10573 - DNA, 20 bp, Artificial Sequence
  chemically synthesized
tccaggccaagtaggtggcc

SEQ ID NO: 10574 - DNA, 20 bp, Artificial Sequence
  chemically synthesized
ccaggccaagtaggtggcct

SEQ ID NO: 10575 - DNA, 20 bp, Artificial Sequence
  chemically synthesized
caggccaagtaggtggcctg

SEQ ID NO: 10576 - DNA, 20 bp, Artificial Sequence
  chemically synthesized
agtaggtggcctggggcctc

SEQ ID NO: 10577 - DNA, 20 bp, Artificial Sequence
  chemically synthesized
gtaggtggcctggggcctct

SEQ ID NO: 10578 - DNA, 20 bp, Artificial Sequence
  chemically synthesized
taggtggcctggggcctctg

SEQ ID NO: 10579 - DNA, 20 bp, Artificial Sequence
  chemically synthesized
aggtggcctggggcctctgg

SEQ ID NO: 10580 - DNA, 20 bp, Artificial Sequence
  chemically synthesized
cctggggcctctgggggatg

SEQ ID NO: 10581 - DNA, 20 bp, Artificial Sequence
  chemically synthesized
ctggggcctctgggggatgc

SEQ ID NO: 10582 - DNA, 20 bp, Artificial Sequence
  chemically synthesized
tggggcctctgggggatgca

SEQ ID NO: 10583 - DNA, 20 bp, Artificial Sequence
  chemically synthesized
ggggcctctgggggatgcag

SEQ ID NO: 10584 - DNA, 20 bp, Artificial Sequence
  chemically synthesized
gcctctgggggatgcagggg

SEQ ID NO: 10585 - DNA, 20 bp, Artificial Sequence
  chemically synthesized
cctctgggggatgcagggga

SEQ ID NO: 10586 - DNA, 20 bp, Artificial Sequence
  chemically synthesized
ctctgggggatgcaggggaa

SEQ ID NO: 10587 - DNA, 20 bp, Artificial Sequence
  chemically synthesized
tctgggggatgcaggggaag

SEQ ID NO: 10588 - DNA, 20 bp, Artificial Sequence
  chemically synthesized
ctgggggatgcaggggaagg

SEQ ID NO: 10589 - DNA, 20 bp, Artificial Sequence
  chemically synthesized
gatgcaggggaagggggatg

SEQ ID NO: 10590 - DNA, 20 bp, Artificial Sequence
  chemically synthesized
atgcaggggaagggggatgc

SEQ ID NO: 10591 - DNA, 20 bp, Artificial Sequence
  chemically synthesized
tgcaggggaagggggatgca

SEQ ID NO: 10592 - DNA, 20 bp, Artificial Sequence
  chemically synthesized
gcaggggaagggggatgcag

SEQ ID NO: 10593 - DNA, 20 bp, Artificial Sequence
  chemically synthesized
ggaagggggatgcaggggaa

SEQ ID NO: 10594 - DNA, 20 bp, Artificial Sequence
  chemically synthesized
gaagggggatgcaggggaac

SEQ ID NO: 10595 - DNA, 20 bp, Artificial Sequence
  chemically synthesized
aagggggatgcaggggaacg

SEQ ID NO: 10596 - DNA, 20 bp, Artificial Sequence
  chemically synthesized
gatgcaggggaacggggatg

SEQ ID NO: 10597 - DNA, 20 bp, Artificial Sequence
  chemically synthesized
atgcaggggaacggggatgc

SEQ ID NO: 10598 - DNA, 20 bp, Artificial Sequence
  chemically synthesized
tgcaggggaacggggatgca

SEQ ID NO: 10599 - DNA, 20 bp, Artificial Sequence
  chemically synthesized
gcaggggaacggggatgcag

SEQ ID NO: 10600 - DNA, 20 bp, Artificial Sequence
  chemically synthesized
ggaacggggatgcaggggaa

SEQ ID NO: 10601 - DNA, 20 bp, Artificial Sequence
  chemically synthesized
gaacggggatgcaggggaac

SEQ ID NO: 10602 - DNA, 20 bp, Artificial Sequence
  chemically synthesized
aacggggatgcaggggaacg

SEQ ID NO: 10603 - DNA, 20 bp, Artificial Sequence
  chemically synthesized
ggatgcaggggaacggggct

SEQ ID NO: 10604 - DNA, 20 bp, Artificial Sequence
  chemically synthesized
ggggaacggggctcagtctg

SEQ ID NO: 10605 - DNA, 20 bp, Artificial Sequence
  chemically synthesized
ggaacggggctcagtctgaa

SEQ ID NO: 10606 - DNA, 20 bp, Artificial Sequence
  chemically synthesized
acggggctcagtctgaagag

SEQ ID NO: 10607 - DNA, 20 bp, Artificial Sequence
  chemically synthesized
ggggctcagtctgaagagca

SEQ ID NO: 10608 - DNA, 20 bp, Artificial Sequence
  chemically synthesized
ctcagtctgaagagcagagc

SEQ ID NO: 10609 - DNA, 20 bp, Artificial Sequence
  chemically synthesized
tcagtctgaagagcagagcc

SEQ ID NO: 10610 - DNA, 20 bp, Artificial Sequence
  chemically synthesized
agcagagccaggaacccctg

SEQ ID NO: 10611 - DNA, 20 bp, Artificial Sequence
  chemically synthesized
gcagagccaggaacccctgt

SEQ ID NO: 10612 - DNA, 20 bp, Artificial Sequence
  chemically synthesized
cagagccaggaacccctgta

SEQ ID NO: 10613 - DNA, 20 bp, Artificial Sequence
  chemically synthesized
agccaggaacccctgtaggg

SEQ ID NO: 10614 - DNA, 20 bp, Artificial Sequence
  chemically synthesized
gccaggaacccctgtaggga

SEQ ID NO: 10615 - DNA, 20 bp, Artificial Sequence
  chemically synthesized
ccaggaacccctgtagggaa

SEQ ID NO: 10616 - DNA, 20 bp, Artificial Sequence
  chemically synthesized
caggaacccctgtagggaag

SEQ ID NO: 10617 - DNA, 20 bp, Artificial Sequence
  chemically synthesized
gaacccctgtagggaagggg

SEQ ID NO: 10618 - DNA, 20 bp, Artificial Sequence
  chemically synthesized
aacccctgtagggaaggggc

SEQ ID NO: 10619 - DNA, 20 bp, Artificial Sequence
  chemically synthesized
cccctgtagggaaggggcag

SEQ ID NO: 10620 - DNA, 20 bp, Artificial Sequence
  chemically synthesized
cctgtagggaaggggcagga

SEQ ID NO: 10621 - DNA, 20 bp, Artificial Sequence
  chemically synthesized
tagggaaggggcaggagagc

SEQ ID NO: 10622 - DNA, 20 bp, Artificial Sequence
  chemically synthesized
agggaaggggcaggagagcc

SEQ ID NO: 10623 - DNA, 20 bp, Artificial Sequence
  chemically synthesized
gggaaggggcaggagagcca

SEQ ID NO: 10624 - DNA, 20 bp, Artificial Sequence
  chemically synthesized
ggaaggggcaggagagccag

SEQ ID NO: 10625 - DNA, 20 bp, Artificial Sequence
  chemically synthesized
ggcaggagagccaggggcat

SEQ ID NO: 10626 - DNA, 20 bp, Artificial Sequence
  chemically synthesized
ggagagccaggggcatgaga

SEQ ID NO: 10627 - DNA, 20 bp, Artificial Sequence
  chemically synthesized
gagccaggggcatgagatgg

SEQ ID NO: 10628 - DNA, 20 bp, Artificial Sequence
  chemically synthesized
aggggcatgagatggtggac

SEQ ID NO: 10629 - DNA, 20 bp, Artificial Sequence
  chemically synthesized
ggggcatgagatggtggacg

SEQ ID NO: 10630 - DNA, 20 bp, Artificial Sequence
  chemically synthesized
gcatgagatggtggacgagg

SEQ ID NO: 10631 - DNA, 20 bp, Artificial Sequence
  chemically synthesized
catgagatggtggacgagga

SEQ ID NO: 10632 - DNA, 20 bp, Artificial Sequence
  chemically synthesized
atgagatggtggacgaggaa

SEQ ID NO: 10633 - DNA, 20 bp, Artificial Sequence
  chemically synthesized
tgagatggtggacgaggaag

SEQ ID NO: 10634 - DNA, 20 bp, Artificial Sequence
  chemically synthesized
gagatggtggacgaggaagg

SEQ ID NO: 10635 - DNA, 20 bp, Artificial Sequence
  chemically synthesized
tggtggacgaggaaggggga

SEQ ID NO: 10636 - DNA, 20 bp, Artificial Sequence
  chemically synthesized
ggtggacgaggaagggggac

SEQ ID NO: 10637 - DNA, 20 bp, Artificial Sequence
  chemically synthesized
gtggacgaggaagggggaca

SEQ ID NO: 10638 - DNA, 20 bp, Artificial Sequence
  chemically synthesized
gacgaggaagggggacaggg

SEQ ID NO: 10639 - DNA, 20 bp, Artificial Sequence
  chemically synthesized
gaagggggacagggaagcct

SEQ ID NO: 10640 - DNA, 20 bp, Artificial Sequence
  chemically synthesized
ggaagcctgagcgcctctcc

SEQ ID NO: 10641 - DNA, 20 bp, Artificial Sequence
  chemically synthesized
gaagcctgagcgcctctcct

SEQ ID NO: 10642 - DNA, 20 bp, Artificial Sequence
  chemically synthesized
gcgcctctcctgggcttgcc

SEQ ID NO: 10643 - DNA, 20 bp, Artificial Sequence
  chemically synthesized
cgcctctcctgggcttgcca

SEQ ID NO: 10644 - DNA, 20 bp, Artificial Sequence
  chemically synthesized
gcttgccaaggactcaaacc

SEQ ID NO: 10645 - DNA, 20 bp, Artificial Sequence
  chemically synthesized
tgccaaggactcaaacccag

SEQ ID NO: 10646 - DNA, 20 bp, Artificial Sequence
  chemically synthesized
aggactcaaacccagaagcc

SEQ ID NO: 10647 - DNA, 20 bp, Artificial Sequence
  chemically synthesized
gactcaaacccagaagccca

SEQ ID NO: 10648 - DNA, 20 bp, Artificial Sequence
  chemically synthesized
tcaaacccagaagcccagag

SEQ ID NO: 10649 - DNA, 20 bp, Artificial Sequence
  chemically synthesized
caaacccagaagcccagagc

SEQ ID NO: 10650 - DNA, 20 bp, Artificial Sequence
  chemically synthesized
aaacccagaagcccagagca

SEQ ID NO: 10651 - DNA, 20 bp, Artificial Sequence
  chemically synthesized
agaagcccagagcagggcct

SEQ ID NO: 10652 - DNA, 20 bp, Artificial Sequence
  chemically synthesized
gaagcccagagcagggcctt

SEQ ID NO: 10653 - DNA, 20 bp, Artificial Sequence
  chemically synthesized
aagcccagagcagggcctta

SEQ ID NO: 10654 - DNA, 20 bp, Artificial Sequence
  chemically synthesized
cccagagcagggccttaggg

SEQ ID NO: 10655 - DNA, 20 bp, Artificial Sequence
  chemically synthesized
agagcagggccttagggaag

SEQ ID NO: 10656 - DNA, 20 bp, Artificial Sequence
  chemically synthesized
gagcagggccttagggaagc

SEQ ID NO: 10657 - DNA, 20 bp, Artificial Sequence
  chemically synthesized
agggaagcgggaccctgctc

SEQ ID NO: 10658 - DNA, 20 bp, Artificial Sequence
  chemically synthesized
gggaagcgggaccctgctct

SEQ ID NO: 10659 - DNA, 20 bp, Artificial Sequence
  chemically synthesized
aagcgggaccctgctctggg

SEQ ID NO: 10660 - DNA, 20 bp, Artificial Sequence
  chemically synthesized
gcgggaccctgctctgggcg

SEQ ID NO: 10661 - DNA, 20 bp, Artificial Sequence
  chemically synthesized
cgggaccctgctctgggcgg

SEQ ID NO: 10662 - DNA, 20 bp, Artificial Sequence
  chemically synthesized
ctgggcggaggaatatgtcc

SEQ ID NO: 10663 - DNA, 20 bp, Artificial Sequence
  chemically synthesized
gcggaggaatatgtcccaga

SEQ ID NO: 10664 - DNA, 20 bp, Artificial Sequence
  chemically synthesized
gaatatgtcccagatagcac

SEQ ID NO: 10665 - DNA, 20 bp, Artificial Sequence
  chemically synthesized
aatatgtcccagatagcact

SEQ ID NO: 10666 - DNA, 20 bp, Artificial Sequence
  chemically synthesized
atatgtcccagatagcactg

SEQ ID NO: 10667 - DNA, 20 bp, Artificial Sequence
  chemically synthesized
gatagcactggggactcttt

SEQ ID NO: 10668 - DNA, 20 bp, Artificial Sequence
  chemically synthesized
atagcactggggactcttta

SEQ ID NO: 10669 - DNA, 20 bp, Artificial Sequence
  chemically synthesized
cactggggactctttaagga

SEQ ID NO: 10670 - DNA, 20 bp, Artificial Sequence
  chemically synthesized
tggggactctttaaggaaag

SEQ ID NO: 10671 - DNA, 20 bp, Artificial Sequence
  chemically synthesized
ggggactctttaaggaaaga

SEQ ID NO: 10672 - DNA, 20 bp, Artificial Sequence
  chemically synthesized
actctttaaggaaagaagga

SEQ ID NO: 10673 - DNA, 20 bp, Artificial Sequence
  chemically synthesized
tctttaaggaaagaaggatg

SEQ ID NO: 10674 - DNA, 20 bp, Artificial Sequence
  chemically synthesized
taaggaaagaaggatggaga

SEQ ID NO: 10675 - DNA, 20 bp, Artificial Sequence
  chemically synthesized
aggaaagaaggatggagaaa

SEQ ID NO: 10676 - DNA, 20 bp, Artificial Sequence
  chemically synthesized
aagaaggatggagaaagaga

SEQ ID NO: 10677 - DNA, 20 bp, Artificial Sequence
  chemically synthesized
agaaggatggagaaagagaa

SEQ ID NO: 10678 - DNA, 20 bp, Artificial Sequence
  chemically synthesized
gaaggatggagaaagagaaa

SEQ ID NO: 10679 - DNA, 20 bp, Artificial Sequence
  chemically synthesized
aggatggagaaagagaaagg

SEQ ID NO: 10680 - DNA, 20 bp, Artificial Sequence
  chemically synthesized
atggagaaagagaaagggag

SEQ ID NO: 10681 - DNA, 20 bp, Artificial Sequence
  chemically synthesized
ggagaaagagaaagggagta

SEQ ID NO: 10682 - DNA, 20 bp, Artificial Sequence
  chemically synthesized
gagaaagagaaagggagtag

SEQ ID NO: 10683 - DNA, 20 bp, Artificial Sequence
  chemically synthesized
aaagagaaagggagtagagg

SEQ ID NO: 10684 - DNA, 20 bp, Artificial Sequence
  chemically synthesized
gagtagaggcggccacgacc

SEQ ID NO: 10685 - DNA, 20 bp, Artificial Sequence
  chemically synthesized
gccacgacctggtgaacacc

SEQ ID NO: 10686 - DNA, 20 bp, Artificial Sequence
  chemically synthesized
ccacgacctggtgaacacct

SEQ ID NO: 10687 - DNA, 20 bp, Artificial Sequence
  chemically synthesized
taggacgcaccattctcaca

SEQ ID NO: 10688 - DNA, 20 bp, Artificial Sequence
  chemically synthesized
aggacgcaccattctcacaa

SEQ ID NO: 10689 - DNA, 20 bp, Artificial Sequence
  chemically synthesized
ggacgcaccattctcacaaa

SEQ ID NO: 10690 - DNA, 20 bp, Artificial Sequence
  chemically synthesized
acgcaccattctcacaaagg

SEQ ID NO: 10691 - DNA, 20 bp, Artificial Sequence
  chemically synthesized
cacaaagggagttttccaca

SEQ ID NO: 10692 - DNA, 20 bp, Artificial Sequence
  chemically synthesized
ggacacccccctcctcacca

SEQ ID NO: 10693 - DNA, 20 bp, Artificial Sequence
  chemically synthesized
cctcctcaccacagccctgc

SEQ ID NO: 10694 - DNA, 20 bp, Artificial Sequence
  chemically synthesized
ctcctcaccacagccctgcc

SEQ ID NO: 10695 - DNA, 20 bp, Artificial Sequence
  chemically synthesized
tcaccacagccctgccagga

SEQ ID NO: 10696 - DNA, 20 bp, Artificial Sequence
  chemically synthesized
caccacagccctgccaggac

SEQ ID NO: 10697 - DNA, 20 bp, Artificial Sequence
  chemically synthesized
accacagccctgccaggacg

SEQ ID NO: 10698 - DNA, 20 bp, Artificial Sequence
  chemically synthesized
cagccctgccaggacggggc

SEQ ID NO: 10699 - DNA, 20 bp, Artificial Sequence
  chemically synthesized
gccaggacggggctggctac

SEQ ID NO: 10700 - DNA, 20 bp, Artificial Sequence
  chemically synthesized
tggctactggccttatctca

SEQ ID NO: 10701 - DNA, 20 bp, Artificial Sequence
  chemically synthesized
ggctactggccttatctcac

SEQ ID NO: 10702 - DNA, 20 bp, Artificial Sequence
  chemically synthesized
tcacaggtaaaactgacgca

SEQ ID NO: 10703 - DNA, 20 bp, Artificial Sequence
  chemically synthesized
acaggtaaaactgacgcacg

SEQ ID NO: 10704 - DNA, 20 bp, Artificial Sequence
  chemically synthesized
caggtaaaactgacgcacgg

SEQ ID NO: 10705 - DNA, 20 bp, Artificial Sequence
  chemically synthesized
cacggaggaacaatataaat

SEQ ID NO: 10706 - DNA, 20 bp, Artificial Sequence
  chemically synthesized
acggaggaacaatataaatt

SEQ ID NO: 10707 - DNA, 20 bp, Artificial Sequence
  chemically synthesized
cggaggaacaatataaattg

SEQ ID NO: 10708 - DNA, 20 bp, Artificial Sequence
  chemically synthesized
gaacaatataaattggggac

SEQ ID NO: 10709 - DNA, 20 bp, Artificial Sequence
  chemically synthesized
aatataaattggggactaga

SEQ ID NO: 10710 - DNA, 20 bp, Artificial Sequence
  chemically synthesized
atataaattggggactagaa

SEQ ID NO: 10711 - DNA, 20 bp, Artificial Sequence
  chemically synthesized
aattggggactagaaaggtg

SEQ ID NO: 10712 - DNA, 20 bp, Artificial Sequence
  chemically synthesized
ttggggactagaaaggtgaa

SEQ ID NO: 10713 - DNA, 20 bp, Artificial Sequence
  chemically synthesized
actagaaaggtgaagagcca

SEQ ID NO: 10714 - DNA, 20 bp, Artificial Sequence
  chemically synthesized
gaaaggtgaagagccaaagt

SEQ ID NO: 10715 - DNA, 20 bp, Artificial Sequence
  chemically synthesized
gaagagccaaagttagaact

SEQ ID NO: 10716 - DNA, 20 bp, Artificial Sequence
  chemically synthesized
aagagccaaagttagaactc

SEQ ID NO: 10717 - DNA, 20 bp, Artificial Sequence
  chemically synthesized
ttccaaactgcttctcctct

SEQ ID NO: 10718 - DNA, 20 bp, Artificial Sequence
  chemically synthesized
tccaaactgcttctcctctt

SEQ ID NO: 10719 - DNA, 20 bp, Artificial Sequence
  chemically synthesized
aaactgcttctcctcttggg

SEQ ID NO: 10720 - DNA, 20 bp, Artificial Sequence
  chemically synthesized
cttctcctcttgggaagtgt

SEQ ID NO: 10721 - DNA, 20 bp, Artificial Sequence
  chemically synthesized
ttctcctcttgggaagtgta

SEQ ID NO: 10722 - DNA, 20 bp, Artificial Sequence
  chemically synthesized
tcctcttgggaagtgtaagg

SEQ ID NO: 10723 - DNA, 20 bp, Artificial Sequence
  chemically synthesized
tgggaagtgtaaggaagctg

SEQ ID NO: 10724 - DNA, 20 bp, Artificial Sequence
  chemically synthesized
gtgtaaggaagctgcagcac

SEQ ID NO: 10725 - DNA, 20 bp, Artificial Sequence
  chemically synthesized
tgtaaggaagctgcagcacc

SEQ ID NO: 10726 - DNA, 20 bp, Artificial Sequence
  chemically synthesized
ggaagctgcagcaccaggat

SEQ ID NO: 10727 - DNA, 20 bp, Artificial Sequence
  chemically synthesized
ccaggatcagtgaaacgcac

SEQ ID NO: 10728 - DNA, 20 bp, Artificial Sequence
  chemically synthesized
gatcagtgaaacgcaccaga

SEQ ID NO: 10729 - DNA, 20 bp, Artificial Sequence
  chemically synthesized
aacgcaccagacggccgcgt

SEQ ID NO: 10730 - DNA, 20 bp, Artificial Sequence
  chemically synthesized
cgcaccagacggccgcgtca

SEQ ID NO: 10731 - DNA, 20 bp, Artificial Sequence
  chemically synthesized
accagacggccgcgtcagag

SEQ ID NO: 10732 - DNA, 20 bp, Artificial Sequence
  chemically synthesized
acggccgcgtcagagcagct

SEQ ID NO: 10733 - DNA, 20 bp, Artificial Sequence
  chemically synthesized
cggccgcgtcagagcagctc

SEQ ID NO: 10734 - DNA, 20 bp, Artificial Sequence
  chemically synthesized
cgtcagagcagctcaggttc

SEQ ID NO: 10735 - DNA, 20 bp, Artificial Sequence
  chemically synthesized
gtcagagcagctcaggttct

SEQ ID NO: 10736 - DNA, 20 bp, Artificial Sequence
  chemically synthesized
cagagcagctcaggttctgg

SEQ ID NO: 10737 - DNA, 20 bp, Artificial Sequence
  chemically synthesized
gagcagctcaggttctggga

SEQ ID NO: 10738 - DNA, 20 bp, Artificial Sequence
  chemically synthesized
agcagctcaggttctgggag

SEQ ID NO: 10739 - DNA, 20 bp, Artificial Sequence
  chemically synthesized
gcagctcaggttctgggaga

SEQ ID NO: 10740 - DNA, 20 bp, Artificial Sequence
  chemically synthesized
gctcaggttctgggagaggg

SEQ ID NO: 10741 - DNA, 20 bp, Artificial Sequence
  chemically synthesized
ggttctgggagagggtagcg

SEQ ID NO: 10742 - DNA, 20 bp, Artificial Sequence
  chemically synthesized
gttctgggagagggtagcgc

SEQ ID NO: 10743 - DNA, 20 bp, Artificial Sequence
  chemically synthesized
ttctgggagagggtagcgca

SEQ ID NO: 10744 - DNA, 20 bp, Artificial Sequence
  chemically synthesized
tgggagagggtagcgcaggg

SEQ ID NO: 10745 - DNA, 20 bp, Artificial Sequence
  chemically synthesized
ggtagcgcagggtggccact

SEQ ID NO: 10746 - DNA, 20 bp, Artificial Sequence
  chemically synthesized
gcagggtggccactgagaac

SEQ ID NO: 10747 - DNA, 20 bp, Artificial Sequence
  chemically synthesized
cagggtggccactgagaacc

SEQ ID NO: 10748 - DNA, 20 bp, Artificial Sequence
  chemically synthesized
ggtggccactgagaaccggg

SEQ ID NO: 10749 - DNA, 20 bp, Artificial Sequence
  chemically synthesized
gtggccactgagaaccgggc

SEQ ID NO: 10750 - DNA, 20 bp, Artificial Sequence
  chemically synthesized
cttccctcccaccccctgcc

SEQ ID NO: 10751 - DNA, 20 bp, Artificial Sequence
  chemically synthesized
ccctgccaagctctccctcc

SEQ ID NO: 10752 - DNA, 20 bp, Artificial Sequence
  chemically synthesized
cctgccaagctctccctccc

SEQ ID NO: 10753 - DNA, 20 bp, Artificial Sequence
  chemically synthesized
ctccctcccaggatcctctc

SEQ ID NO: 10754 - DNA, 20 bp, Artificial Sequence
  chemically synthesized
atcctctctggctccatcgt

SEQ ID NO: 10755 - DNA, 20 bp, Artificial Sequence
  chemically synthesized
gctccatcgtaagcaaacct

SEQ ID NO: 10756 - DNA, 20 bp, Artificial Sequence
  chemically synthesized
tccatcgtaagcaaacctta

SEQ ID NO: 10757 - DNA, 20 bp, Artificial Sequence
  chemically synthesized
ccatcgtaagcaaaccttag

SEQ ID NO: 10758 - DNA, 20 bp, Artificial Sequence
  chemically synthesized
taagcaaaccttagaggttc

SEQ ID NO: 10759 - DNA, 20 bp, Artificial Sequence
  chemically synthesized
caaaccttagaggttctggc

SEQ ID NO: 10760 - DNA, 20 bp, Artificial Sequence
  chemically synthesized
aaaccttagaggttctggca

SEQ ID NO: 10761 - DNA, 20 bp, Artificial Sequence
  chemically synthesized
accttagaggttctggcaag

SEQ ID NO: 10762 - DNA, 20 bp, Artificial Sequence
  chemically synthesized
cttagaggttctggcaagga

SEQ ID NO: 10763 - DNA, 20 bp, Artificial Sequence
  chemically synthesized
tagaggttctggcaaggaga

SEQ ID NO: 10764 - DNA, 20 bp, Artificial Sequence
  chemically synthesized
ggttctggcaaggagagaga

SEQ ID NO: 10765 - DNA, 20 bp, Artificial Sequence
  chemically synthesized
ggcaaggagagagatggctc

SEQ ID NO: 10766 - DNA, 20 bp, Artificial Sequence
  chemically synthesized
gcaaggagagagatggctcc

SEQ ID NO: 10767 - DNA, 20 bp, Artificial Sequence
  chemically synthesized
agagagatggctccaggaaa

SEQ ID NO: 10768 - DNA, 20 bp, Artificial Sequence
  chemically synthesized
gagagatggctccaggaaat

SEQ ID NO: 10769 - DNA, 20 bp, Artificial Sequence
  chemically synthesized
agagatggctccaggaaatg

SEQ ID NO: 10770 - DNA, 20 bp, Artificial Sequence
  chemically synthesized
gagatggctccaggaaatgg

SEQ ID NO: 10771 - DNA, 20 bp, Artificial Sequence
  chemically synthesized
aggaaatgggggtgtgtcac

SEQ ID NO: 10772 - DNA, 20 bp, Artificial Sequence
  chemically synthesized
atgggggtgtgtcaccagat

SEQ ID NO: 10773 - DNA, 20 bp, Artificial Sequence
  chemically synthesized
tgggggtgtgtcaccagata

SEQ ID NO: 10774 - DNA, 20 bp, Artificial Sequence
  chemically synthesized
cagataaggaatctgcctaa

SEQ ID NO: 10775 - DNA, 20 bp, Artificial Sequence
  chemically synthesized
agataaggaatctgcctaac

SEQ ID NO: 10776 - DNA, 20 bp, Artificial Sequence
  chemically synthesized
ataaggaatctgcctaacag

SEQ ID NO: 10777 - DNA, 20 bp, Artificial Sequence
  chemically synthesized
taaggaatctgcctaacagg

SEQ ID NO: 10778 - DNA, 20 bp, Artificial Sequence
  chemically synthesized
ggaatctgcctaacaggagg

SEQ ID NO: 10779 - DNA, 20 bp, Artificial Sequence
  chemically synthesized
gaatctgcctaacaggaggt

SEQ ID NO: 10780 - DNA, 20 bp, Artificial Sequence
  chemically synthesized
aatctgcctaacaggaggtg

SEQ ID NO: 10781 - DNA, 20 bp, Artificial Sequence
  chemically synthesized
atctgcctaacaggaggtgg

SEQ ID NO: 10782 - DNA, 20 bp, Artificial Sequence
  chemically synthesized
gcctaacaggaggtgggggt

SEQ ID NO: 10783 - DNA, 20 bp, Artificial Sequence
  chemically synthesized
gtgggggttagacccaatat

SEQ ID NO: 10784 - DNA, 20 bp, Artificial Sequence
  chemically synthesized
tgggggttagacccaatatc

SEQ ID NO: 10785 - DNA, 20 bp, Artificial Sequence
  chemically synthesized
ggggttagacccaatatcag

SEQ ID NO: 10786 - DNA, 20 bp, Artificial Sequence
  chemically synthesized
tagacccaatatcaggagac

SEQ ID NO: 10787 - DNA, 20 bp, Artificial Sequence
  chemically synthesized
agacccaatatcaggagact

SEQ ID NO: 10788 - DNA, 20 bp, Artificial Sequence
  chemically synthesized
cccaatatcaggagactagg

SEQ ID NO: 10789 - DNA, 20 bp, Artificial Sequence
  chemically synthesized
ccaatatcaggagactagga

SEQ ID NO: 10790 - DNA, 20 bp, Artificial Sequence
  chemically synthesized
aatatcaggagactaggaag

SEQ ID NO: 10791 - DNA, 20 bp, Artificial Sequence
  chemically synthesized
atatcaggagactaggaagg

SEQ ID NO: 10792 - DNA, 20 bp, Artificial Sequence
  chemically synthesized
atcaggagactaggaaggag

SEQ ID NO: 10793 - DNA, 20 bp, Artificial Sequence
  chemically synthesized
tcaggagactaggaaggagg

SEQ ID NO: 10794 - DNA, 20 bp, Artificial Sequence
  chemically synthesized
gactaggaaggaggaggcct

SEQ ID NO: 10795 - DNA, 20 bp, Artificial Sequence
  chemically synthesized
actaggaaggaggaggccta

SEQ ID NO: 10796 - DNA, 20 bp, Artificial Sequence
  chemically synthesized
ggaaggaggaggcctaagga

SEQ ID NO: 10797 - DNA, 20 bp, Artificial Sequence
  chemically synthesized
gaaggaggaggcctaaggat

SEQ ID NO: 10798 - DNA, 20 bp, Artificial Sequence
  chemically synthesized
aaggaggaggcctaaggatg

SEQ ID NO: 10799 - DNA, 20 bp, Artificial Sequence
  chemically synthesized
tctgtcaccaatcctgtccc

SEQ ID NO: 10800 - DNA, 20 bp, Artificial Sequence
  chemically synthesized
gtcaccaatcctgtccctag

SEQ ID NO: 10801 - DNA, 20 bp, Artificial Sequence
  chemically synthesized
tgtccctagtggccccactg

SEQ ID NO: 10802 - DNA, 20 bp, Artificial Sequence
  chemically synthesized
gtccctagtggccccactgt

SEQ ID NO: 10803 - DNA, 20 bp, Artificial Sequence
  chemically synthesized
tccctagtggccccactgtg

SEQ ID NO: 10804 - DNA, 20 bp, Artificial Sequence
  chemically synthesized
ctagtggccccactgtgggg

SEQ ID NO: 10805 - DNA, 20 bp, Artificial Sequence
  chemically synthesized
agtggccccactgtggggtg

SEQ ID NO: 10806 - DNA, 20 bp, Artificial Sequence
  chemically synthesized
gtggccccactgtggggtgg

SEQ ID NO: 10807 - DNA, 20 bp, Artificial Sequence
  chemically synthesized
tggccccactgtggggtgga

SEQ ID NO: 10808 - DNA, 20 bp, Artificial Sequence
  chemically synthesized
ggccccactgtggggtggag

SEQ ID NO: 10809 - DNA, 20 bp, Artificial Sequence
  chemically synthesized
ccactgtggggtggagggga

SEQ ID NO: 10810 - DNA, 20 bp, Artificial Sequence
  chemically synthesized
ggggtggaggggacagataa

SEQ ID NO: 10811 - DNA, 20 bp, Artificial Sequence
  chemically synthesized
aggggacagataaaagtacc

SEQ ID NO: 10812 - DNA, 20 bp, Artificial Sequence
  chemically synthesized
cagataaaagtacccagaac

SEQ ID NO: 10813 - DNA, 20 bp, Artificial Sequence
  chemically synthesized
gataaaagtacccagaacca

SEQ ID NO: 10814 - DNA, 20 bp, Artificial Sequence
  chemically synthesized
agaaccagagccacattaac

SEQ ID NO: 10815 - DNA, 20 bp, Artificial Sequence
  chemically synthesized
agagccacattaaccggccc

SEQ ID NO: 10816 - DNA, 20 bp, Artificial Sequence
  chemically synthesized
gagccacattaaccggccct

SEQ ID NO: 10817 - DNA, 20 bp, Artificial Sequence
  chemically synthesized
ttaaccggccctgggaatat

SEQ ID NO: 10818 - DNA, 20 bp, Artificial Sequence
  chemically synthesized
taaccggccctgggaatata

SEQ ID NO: 10819 - DNA, 20 bp, Artificial Sequence
  chemically synthesized
ccggccctgggaatataagg

SEQ ID NO: 10820 - DNA, 20 bp, Artificial Sequence
  chemically synthesized
ctgggaatataaggtggtcc

SEQ ID NO: 10821 - DNA, 20 bp, Artificial Sequence
  chemically synthesized
aatataaggtggtcccagct

SEQ ID NO: 10822 - DNA, 20 bp, Artificial Sequence
  chemically synthesized
atataaggtggtcccagctc

SEQ ID NO: 10823 - DNA, 20 bp, Artificial Sequence
  chemically synthesized
tataaggtggtcccagctcg

SEQ ID NO: 10824 - DNA, 20 bp, Artificial Sequence
  chemically synthesized
gtggtcccagctcggggaca

SEQ ID NO: 10825 - DNA, 20 bp, Artificial Sequence
  chemically synthesized
tggtcccagctcggggacac

SEQ ID NO: 10826 - DNA, 20 bp, Artificial Sequence
  chemically synthesized
gctcggggacacaggatccc

SEQ ID NO: 10827 - DNA, 20 bp, Artificial Sequence
  chemically synthesized
tcggggacacaggatccctg

SEQ ID NO: 10828 - DNA, 20 bp, Artificial Sequence
  chemically synthesized
cggggacacaggatccctgg

SEQ ID NO: 10829 - DNA, 20 bp, Artificial Sequence
  chemically synthesized
ggacacaggatccctggagg

SEQ ID NO: 10830 - DNA, 20 bp, Artificial Sequence
  chemically synthesized
gcagcaaacatgctgtcctg

SEQ ID NO: 10831 - DNA, 20 bp, Artificial Sequence
  chemically synthesized
gcaaacatgctgtcctgaag

SEQ ID NO: 10832 - DNA, 20 bp, Artificial Sequence
  chemically synthesized
atgctgtcctgaagtggaca

SEQ ID NO: 10833 - DNA, 20 bp, Artificial Sequence
  chemically synthesized
tgctgtcctgaagtggacat

SEQ ID NO: 10834 - DNA, 20 bp, Artificial Sequence
  chemically synthesized
gctgtcctgaagtggacata

SEQ ID NO: 10835 - DNA, 20 bp, Artificial Sequence
  chemically synthesized
ctgtcctgaagtggacatag

SEQ ID NO: 10836 - DNA, 20 bp, Artificial Sequence
  chemically synthesized
ctgaagtggacataggggcc

SEQ ID NO: 10837 - DNA, 20 bp, Artificial Sequence
  chemically synthesized
tgaagtggacataggggccc

SEQ ID NO: 10838 - DNA, 20 bp, Artificial Sequence
  chemically synthesized
gtggacataggggcccgggt

SEQ ID NO: 10839 - DNA, 20 bp, Artificial Sequence
  chemically synthesized
ggacataggggcccgggttg

SEQ ID NO: 10840 - DNA, 20 bp, Artificial Sequence
  chemically synthesized
gacataggggcccgggttgg

SEQ ID NO: 10841 - DNA, 20 bp, Artificial Sequence
  chemically synthesized
ataggggcccgggttggagg

SEQ ID NO: 10842 - DNA, 20 bp, Artificial Sequence
  chemically synthesized
ggggcccgggttggaggaag

SEQ ID NO: 10843 - DNA, 20 bp, Artificial Sequence
  chemically synthesized
ccgggttggaggaagaagac

SEQ ID NO: 10844 - DNA, 20 bp, Artificial Sequence
  chemically synthesized
ttggaggaagaagactagct

SEQ ID NO: 10845 - DNA, 20 bp, Artificial Sequence
  chemically synthesized
aagaagactagctgagctct

SEQ ID NO: 10846 - DNA, 20 bp, Artificial Sequence
  chemically synthesized
tagctgagctctcggacccc

SEQ ID NO: 10847 - DNA, 20 bp, Artificial Sequence
  chemically synthesized
ctgagctctcggacccctgg

SEQ ID NO: 10848 - DNA, 20 bp, Artificial Sequence
  chemically synthesized
acccctggaagatgccatga

SEQ ID NO: 10849 - DNA, 20 bp, Artificial Sequence
  chemically synthesized
cccctggaagatgccatgac

SEQ ID NO: 10850 - DNA, 20 bp, Artificial Sequence
  chemically synthesized
ccctggaagatgccatgaca

SEQ ID NO: 10851 - DNA, 20 bp, Artificial Sequence
  chemically synthesized
cctggaagatgccatgacag

SEQ ID NO: 10852 - DNA, 20 bp, Artificial Sequence
  chemically synthesized
ctggaagatgccatgacagg

SEQ ID NO: 10853 - DNA, 20 bp, Artificial Sequence
  chemically synthesized
aagatgccatgacagggggc

SEQ ID NO: 10854 - DNA, 20 bp, Artificial Sequence
  chemically synthesized
atgccatgacagggggctgg

SEQ ID NO: 10855 - DNA, 20 bp, Artificial Sequence
  chemically synthesized
gccatgacagggggctggaa

SEQ ID NO: 10856 - DNA, 20 bp, Artificial Sequence
  chemically synthesized
tgacagggggctggaagagc

SEQ ID NO: 10857 - DNA, 20 bp, Artificial Sequence
  chemically synthesized
gggggctggaagagctagca

SEQ ID NO: 10858 - DNA, 20 bp, Artificial Sequence
  chemically synthesized
ctggaagagctagcacagac

SEQ ID NO: 10859 - DNA, 20 bp, Artificial Sequence
  chemically synthesized
ggaagagctagcacagacta

SEQ ID NO: 10860 - DNA, 20 bp, Artificial Sequence
  chemically synthesized
aagagctagcacagactaga

SEQ ID NO: 10861 - DNA, 20 bp, Artificial Sequence
  chemically synthesized
agagctagcacagactagag

SEQ ID NO: 10862 - DNA, 20 bp, Artificial Sequence
  chemically synthesized
ctagcacagactagagaggt

SEQ ID NO: 10863 - DNA, 20 bp, Artificial Sequence
  chemically synthesized
tagcacagactagagaggta

SEQ ID NO: 10864 - DNA, 20 bp, Artificial Sequence
  chemically synthesized
agcacagactagagaggtaa

SEQ ID NO: 10865 - DNA, 20 bp, Artificial Sequence
  chemically synthesized
gcacagactagagaggtaag

SEQ ID NO: 10866 - DNA, 20 bp, Artificial Sequence
  chemically synthesized
cacagactagagaggtaagg

SEQ ID NO: 10867 - DNA, 20 bp, Artificial Sequence
  chemically synthesized
acagactagagaggtaaggg

SEQ ID NO: 10868 - DNA, 20 bp, Artificial Sequence
  chemically synthesized
gactagagaggtaagggggg

SEQ ID NO: 10869 - DNA, 20 bp, Artificial Sequence
  chemically synthesized
actagagaggtaaggggggt

SEQ ID NO: 10870 - DNA, 20 bp, Artificial Sequence
  chemically synthesized
ctagagaggtaaggggggta

SEQ ID NO: 10871 - DNA, 20 bp, Artificial Sequence
  chemically synthesized
tagagaggtaaggggggtag

SEQ ID NO: 10872 - DNA, 20 bp, Artificial Sequence
  chemically synthesized
gagaggtaaggggggtaggg

SEQ ID NO: 10873 - DNA, 20 bp, Artificial Sequence
  chemically synthesized
taggggagctgcccaaatga

SEQ ID NO: 10874 - DNA, 20 bp, Artificial Sequence
  chemically synthesized
aggggagctgcccaaatgaa

SEQ ID NO: 10875 - DNA, 20 bp, Artificial Sequence
  chemically synthesized
gggagctgcccaaatgaaag

SEQ ID NO: 10876 - DNA, 20 bp, Artificial Sequence
  chemically synthesized
gctgcccaaatgaaaggagt

SEQ ID NO: 10877 - DNA, 20 bp, Artificial Sequence
  chemically synthesized
tgcccaaatgaaaggagtga

SEQ ID NO: 10878 - DNA, 20 bp, Artificial Sequence
  chemically synthesized
gcccaaatgaaaggagtgag

SEQ ID NO: 10879 - DNA, 20 bp, Artificial Sequence
  chemically synthesized
tgagaggtgacccgaatcca

SEQ ID NO: 10880 - DNA, 20 bp, Artificial Sequence
  chemically synthesized
gagaggtgacccgaatccac

SEQ ID NO: 10881 - DNA, 20 bp, Artificial Sequence
  chemically synthesized
gaggtgacccgaatccacag

SEQ ID NO: 10882 - DNA, 20 bp, Artificial Sequence
  chemically synthesized
gacccgaatccacaggagaa

SEQ ID NO: 10883 - DNA, 20 bp, Artificial Sequence
  chemically synthesized
acccgaatccacaggagaac

SEQ ID NO: 10884 - DNA, 20 bp, Artificial Sequence
  chemically synthesized
cccgaatccacaggagaacg

SEQ ID NO: 10885 - DNA, 20 bp, Artificial Sequence
  chemically synthesized
ccacaggagaacggggtgtc

SEQ ID NO: 10886 - DNA, 20 bp, Artificial Sequence
  chemically synthesized
cacaggagaacggggtgtcc

SEQ ID NO: 10887 - DNA, 20 bp, Artificial Sequence
  chemically synthesized
gagaacggggtgtccaggca

SEQ ID NO: 10888 - DNA, 20 bp, Artificial Sequence
  chemically synthesized
acggggtgtccaggcaaaga

SEQ ID NO: 10889 - DNA, 20 bp, Artificial Sequence
  chemically synthesized
ggtgtccaggcaaagaaagc

SEQ ID NO: 10890 - DNA, 20 bp, Artificial Sequence
  chemically synthesized
tgtccaggcaaagaaagcaa

SEQ ID NO: 10891 - DNA, 20 bp, Artificial Sequence
  chemically synthesized
gtccaggcaaagaaagcaag

SEQ ID NO: 10892 - DNA, 20 bp, Artificial Sequence
  chemically synthesized
aggcaaagaaagcaagagga

SEQ ID NO: 10893 - DNA, 20 bp, Artificial Sequence
  chemically synthesized
gcaaagaaagcaagaggatg

SEQ ID NO: 10894 - DNA, 20 bp, Artificial Sequence
  chemically synthesized
aaagaaagcaagaggatgga

SEQ ID NO: 10895 - DNA, 20 bp, Artificial Sequence
  chemically synthesized
aagaaagcaagaggatggag

SEQ ID NO: 10896 - DNA, 20 bp, Artificial Sequence
  chemically synthesized
aaagcaagaggatggagagg

SEQ ID NO: 10897 - DNA, 20 bp, Artificial Sequence
  chemically synthesized
agaggatggagaggtggcta

SEQ ID NO: 10898 - DNA, 20 bp, Artificial Sequence
  chemically synthesized
gatggagaggtggctaaagc

SEQ ID NO: 10899 - DNA, 20 bp, Artificial Sequence
  chemically synthesized
atggagaggtggctaaagcc

SEQ ID NO: 10900 - DNA, 20 bp, Artificial Sequence
  chemically synthesized
tggagaggtggctaaagcca

SEQ ID NO: 10901 - DNA, 20 bp, Artificial Sequence
  chemically synthesized
gagaggtggctaaagccagg

SEQ ID NO: 10902 - DNA, 20 bp, Artificial Sequence
  chemically synthesized
ggtggctaaagccagggaga

SEQ ID NO: 10903 - DNA, 20 bp, Artificial Sequence
  chemically synthesized
gtggctaaagccagggagac

SEQ ID NO: 10904 - DNA, 20 bp, Artificial Sequence
  chemically synthesized
tggctaaagccagggagacg

SEQ ID NO: 10905 - DNA, 20 bp, Artificial Sequence
  chemically synthesized
gccagggagacggggtactt

SEQ ID NO: 10906 - DNA, 20 bp, Artificial Sequence
  chemically synthesized
ccagggagacggggtacttt

SEQ ID NO: 10907 - DNA, 20 bp, Artificial Sequence
  chemically synthesized
cagggagacggggtactttg

SEQ ID NO: 10908 - DNA, 20 bp, Artificial Sequence
  chemically synthesized
cggggtactttggggttgtc

SEQ ID NO: 10909 - DNA, 20 bp, Artificial Sequence
  chemically synthesized
tttggggttgtccagaaaaa

SEQ ID NO: 10910 - DNA, 20 bp, Artificial Sequence
  chemically synthesized
ccagaaaaacggtgatgatg

SEQ ID NO: 10911 - DNA, 20 bp, Artificial Sequence
  chemically synthesized
cagaaaaacggtgatgatgc

SEQ ID NO: 10912 - DNA, 20 bp, Artificial Sequence
  chemically synthesized
cggtgatgatgcaggcctac

SEQ ID NO: 10913 - DNA, 20 bp, Artificial Sequence
  chemically synthesized
tgatgatgcaggcctacaag

SEQ ID NO: 10914 - DNA, 20 bp, Artificial Sequence
  chemically synthesized
gatgatgcaggcctacaaga

SEQ ID NO: 10915 - DNA, 20 bp, Artificial Sequence
  chemically synthesized
atgatgcaggcctacaagaa

SEQ ID NO: 10916 - DNA, 20 bp, Artificial Sequence
  chemically synthesized
tgatgcaggcctacaagaag

SEQ ID NO: 10917 - DNA, 20 bp, Artificial Sequence
  chemically synthesized
atgcaggcctacaagaaggg

SEQ ID NO: 10918 - DNA, 20 bp, Artificial Sequence
  chemically synthesized
tgcaggcctacaagaagggg

SEQ ID NO: 10919 - DNA, 20 bp, Artificial Sequence
  chemically synthesized
aggcctacaagaaggggagg

SEQ ID NO: 10920 - DNA, 20 bp, Artificial Sequence
  chemically synthesized
ggcctacaagaaggggaggc

SEQ ID NO: 10921 - DNA, 20 bp, Artificial Sequence
  chemically synthesized
aagaaggggaggcgggacgc

SEQ ID NO: 10922 - DNA, 20 bp, Artificial Sequence
  chemically synthesized
agaaggggaggcgggacgca

SEQ ID NO: 10923 - DNA, 20 bp, Artificial Sequence
  chemically synthesized
gaaggggaggcgggacgcaa

SEQ ID NO: 10924 - DNA, 20 bp, Artificial Sequence
  chemically synthesized
aggggaggcgggacgcaagg

SEQ ID NO: 10925 - DNA, 20 bp, Artificial Sequence
  chemically synthesized
gacgcaagggagacatccgt

SEQ ID NO: 10926 - DNA, 20 bp, Artificial Sequence
  chemically synthesized
cgcaagggagacatccgtcg

SEQ ID NO: 10927 - DNA, 20 bp, Artificial Sequence
  chemically synthesized
aagggagacatccgtcggag

SEQ ID NO: 10928 - DNA, 20 bp, Artificial Sequence
  chemically synthesized
agggagacatccgtcggaga

SEQ ID NO: 10929 - DNA, 20 bp, Artificial Sequence
  chemically synthesized
ccgtcggagaaggccatcct

SEQ ID NO: 10930 - DNA, 20 bp, Artificial Sequence
  chemically synthesized
agaaggccatcctaagaaac

SEQ ID NO: 10931 - DNA, 20 bp, Artificial Sequence
  chemically synthesized
aaggccatcctaagaaacga

SEQ ID NO: 10932 - DNA, 20 bp, Artificial Sequence
  chemically synthesized
ccatcctaagaaacgagaga

SEQ ID NO: 10933 - DNA, 20 bp, Artificial Sequence
  chemically synthesized
ctaagaaacgagagatggca

SEQ ID NO: 10934 - DNA, 20 bp, Artificial Sequence
  chemically synthesized
taagaaacgagagatggcac

SEQ ID NO: 10935 - DNA, 20 bp, Artificial Sequence
  chemically synthesized
acgagagatggcacaggccc

SEQ ID NO: 10936 - DNA, 20 bp, Artificial Sequence
  chemically synthesized
agagatggcacaggccccag

SEQ ID NO: 10937 - DNA, 20 bp, Artificial Sequence
  chemically synthesized
gagatggcacaggccccaga

SEQ ID NO: 10938 - DNA, 20 bp, Artificial Sequence
  chemically synthesized
gatggcacaggccccagaag

SEQ ID NO: 10939 - DNA, 20 bp, Artificial Sequence
  chemically synthesized
ggcacaggccccagaaggag

SEQ ID NO: 10940 - DNA, 20 bp, Artificial Sequence
  chemically synthesized
gcacaggccccagaaggaga

SEQ ID NO: 10941 - DNA, 20 bp, Artificial Sequence
  chemically synthesized
ggccccagaaggagaaggaa

SEQ ID NO: 10942 - DNA, 20 bp, Artificial Sequence
  chemically synthesized
gccccagaaggagaaggaaa

SEQ ID NO: 10943 - DNA, 20 bp, Artificial Sequence
  chemically synthesized
ccccagaaggagaaggaaaa

SEQ ID NO: 10944 - DNA, 20 bp, Artificial Sequence
  chemically synthesized
aggagaaggaaaagggaacc

SEQ ID NO: 10945 - DNA, 20 bp, Artificial Sequence
  chemically synthesized
gaaggaaaagggaacccagc

SEQ ID NO: 10946 - DNA, 20 bp, Artificial Sequence
  chemically synthesized
aaaagggaacccagcgagtg

SEQ ID NO: 10947 - DNA, 20 bp, Artificial Sequence
  chemically synthesized
gggaacccagcgagtgaaga

SEQ ID NO: 10948 - DNA, 20 bp, Artificial Sequence
  chemically synthesized
cccagcgagtgaagacggca

SEQ ID NO: 10949 - DNA, 20 bp, Artificial Sequence
  chemically synthesized
ccagcgagtgaagacggcat

SEQ ID NO: 10950 - DNA, 20 bp, Artificial Sequence
  chemically synthesized
cagcgagtgaagacggcatg

SEQ ID NO: 10951 - DNA, 20 bp, Artificial Sequence
  chemically synthesized
gagtgaagacggcatggggt

SEQ ID NO: 10952 - DNA, 20 bp, Artificial Sequence
  chemically synthesized
agtgaagacggcatggggtt

SEQ ID NO: 10953 - DNA, 20 bp, Artificial Sequence
  chemically synthesized
aagacggcatggggttgggt

SEQ ID NO: 10954 - DNA, 20 bp, Artificial Sequence
  chemically synthesized
agacggcatggggttgggtg

SEQ ID NO: 10955 - DNA, 20 bp, Artificial Sequence
  chemically synthesized
gacggcatggggttgggtga

SEQ ID NO: 10956 - DNA, 20 bp, Artificial Sequence
  chemically synthesized
cggcatggggttgggtgagg

SEQ ID NO: 10957 - DNA, 20 bp, Artificial Sequence
  chemically synthesized
ggcatggggttgggtgaggg

SEQ ID NO: 10958 - DNA, 20 bp, Artificial Sequence
  chemically synthesized
catggggttgggtgagggag

SEQ ID NO: 10959 - DNA, 20 bp, Artificial Sequence
  chemically synthesized
tggggttgggtgagggagga

SEQ ID NO: 10960 - DNA, 20 bp, Artificial Sequence
  chemically synthesized
ggtgagggaggagagatgcc

SEQ ID NO: 10961 - DNA, 20 bp, Artificial Sequence
  chemically synthesized
tgagggaggagagatgcccg

SEQ ID NO: 10962 - DNA, 20 bp, Artificial Sequence
  chemically synthesized
agggaggagagatgcccgga

SEQ ID NO: 10963 - DNA, 20 bp, Artificial Sequence
  chemically synthesized
gggaggagagatgcccggag

SEQ ID NO: 10964 - DNA, 20 bp, Artificial Sequence
  chemically synthesized
agagatgcccggagaggacc

SEQ ID NO: 10965 - DNA, 20 bp, Artificial Sequence
  chemically synthesized
gcccggagaggacccagaca

SEQ ID NO: 10966 - DNA, 20 bp, Artificial Sequence
  chemically synthesized
cccggagaggacccagacac

SEQ ID NO: 10967 - DNA, 20 bp, Artificial Sequence
  chemically synthesized
ccggagaggacccagacacg

SEQ ID NO: 10968 - DNA, 20 bp, Artificial Sequence
  chemically synthesized
ggagaggacccagacacggg

SEQ ID NO: 10969 - DNA, 20 bp, Artificial Sequence
  chemically synthesized
gagaggacccagacacgggg

SEQ ID NO: 10970 - DNA, 20 bp, Artificial Sequence
  chemically synthesized
agacacggggaggatccgct

SEQ ID NO: 10971 - DNA, 20 bp, Artificial Sequence
  chemically synthesized
acacggggaggatccgctca

SEQ ID NO: 10972 - DNA, 20 bp, Artificial Sequence
  chemically synthesized
cacggggaggatccgctcag

SEQ ID NO: 10973 - DNA, 20 bp, Artificial Sequence
  chemically synthesized
tccgctcagaggacatcacg

SEQ ID NO: 10974 - DNA, 20 bp, Artificial Sequence
  chemically synthesized
tcagaggacatcacgtggtg

SEQ ID NO: 10975 - DNA, 20 bp, Artificial Sequence
  chemically synthesized
acatcacgtggtgcagcgcc

SEQ ID NO: 10976 - DNA, 20 bp, Artificial Sequence
  chemically synthesized
tcacgtggtgcagcgccgag

SEQ ID NO: 10977 - DNA, 20 bp, Artificial Sequence
  chemically synthesized
cacgtggtgcagcgccgaga

SEQ ID NO: 10978 - DNA, 20 bp, Artificial Sequence
  chemically synthesized
gtggtgcagcgccgagaagg

SEQ ID NO: 10979 - DNA, 20 bp, Artificial Sequence
  chemically synthesized
gcgccgagaaggaagtgctc

SEQ ID NO: 10980 - DNA, 20 bp, Artificial Sequence
  chemically synthesized
cgagaaggaagtgctccgga

SEQ ID NO: 10981 - DNA, 20 bp, Artificial Sequence
  chemically synthesized
agaaggaagtgctccggaaa

SEQ ID NO: 10982 - DNA, 20 bp, Artificial Sequence
  chemically synthesized
tgctccggaaagagcatcct

SEQ ID NO: 10983 - DNA, 20 bp, Artificial Sequence
  chemically synthesized
gctccggaaagagcatcctt

SEQ ID NO: 10984 - DNA, 20 bp, Artificial Sequence
  chemically synthesized
ccggaaagagcatccttggg

SEQ ID NO: 10985 - DNA, 20 bp, Artificial Sequence
  chemically synthesized
agcatccttgggcagcaaca

SEQ ID NO: 10986 - DNA, 20 bp, Artificial Sequence
  chemically synthesized
atccttgggcagcaacacag

SEQ ID NO: 10987 - DNA, 20 bp, Artificial Sequence
  chemically synthesized
ccttgggcagcaacacagca

SEQ ID NO: 10988 - DNA, 20 bp, Artificial Sequence
  chemically synthesized
ttgggcagcaacacagcaga

SEQ ID NO: 10989 - DNA, 20 bp, Artificial Sequence
  chemically synthesized
gcagcaacacagcagagagc

SEQ ID NO: 10990 - DNA, 20 bp, Artificial Sequence
  chemically synthesized
cagcaacacagcagagagca

SEQ ID NO: 10991 - DNA, 20 bp, Artificial Sequence
  chemically synthesized
agcaacacagcagagagcaa

SEQ ID NO: 10992 - DNA, 20 bp, Artificial Sequence
  chemically synthesized
gcaacacagcagagagcaag

SEQ ID NO: 10993 - DNA, 20 bp, Artificial Sequence
  chemically synthesized
acacagcagagagcaagggg

SEQ ID NO: 10994 - DNA, 20 bp, Artificial Sequence
  chemically synthesized
acagcagagagcaaggggaa

SEQ ID NO: 10995 - DNA, 20 bp, Artificial Sequence
  chemically synthesized
cagcagagagcaaggggaag

SEQ ID NO: 10996 - DNA, 20 bp, Artificial Sequence
  chemically synthesized
agcagagagcaaggggaaga

SEQ ID NO: 10997 - DNA, 20 bp, Artificial Sequence
  chemically synthesized
cagagagcaaggggaagagg

SEQ ID NO: 10998 - DNA, 20 bp, Artificial Sequence
  chemically synthesized
agagcaaggggaagagggag

SEQ ID NO: 10999 - DNA, 20 bp, Artificial Sequence
  chemically synthesized
agcaaggggaagagggagtg

SEQ ID NO: 11000 - DNA, 20 bp, Artificial Sequence
  chemically synthesized
gcaaggggaagagggagtgg

SEQ ID NO: 11001 - DNA, 20 bp, Artificial Sequence
  chemically synthesized
aggggaagagggagtggagg

SEQ ID NO: 11002 - DNA, 20 bp, Artificial Sequence
  chemically synthesized
gaagagggagtggaggaaga

SEQ ID NO: 11003 - DNA, 20 bp, Artificial Sequence
  chemically synthesized
gtggaggaagacggaacctg

SEQ ID NO: 11004 - DNA, 20 bp, Artificial Sequence
  chemically synthesized
tggaggaagacggaacctga

SEQ ID NO: 11005 - DNA, 20 bp, Artificial Sequence
  chemically synthesized
gaggaagacggaacctgaag

SEQ ID NO: 11006 - DNA, 20 bp, Artificial Sequence
  chemically synthesized
aggaagacggaacctgaagg

SEQ ID NO: 11007 - DNA, 20 bp, Artificial Sequence
  chemically synthesized
aagacggaacctgaaggagg

SEQ ID NO: 11008 - DNA, 20 bp, Artificial Sequence
  chemically synthesized
acggaacctgaaggaggcgg

SEQ ID NO: 11009 - DNA, 20 bp, Artificial Sequence
  chemically synthesized
cggaacctgaaggaggcggc

SEQ ID NO: 11010 - DNA, 20 bp, Artificial Sequence
  chemically synthesized
ggaacctgaaggaggcggca

SEQ ID NO: 11011 - DNA, 20 bp, Artificial Sequence
  chemically synthesized
acctgaaggaggcggcaggg

SEQ ID NO: 11012 - DNA, 20 bp, Artificial Sequence
  chemically synthesized
cctgaaggaggcggcaggga

SEQ ID NO: 11013 - DNA, 20 bp, Artificial Sequence
  chemically synthesized
ggaggcggcagggaaggatc

SEQ ID NO: 11014 - DNA, 20 bp, Artificial Sequence
  chemically synthesized
gaggcggcagggaaggatct

SEQ ID NO: 11015 - DNA, 20 bp, Artificial Sequence
  chemically synthesized
cggcagggaaggatctgggc

SEQ ID NO: 11016 - DNA, 20 bp, Artificial Sequence
  chemically synthesized
ggaaggatctgggccagccg

SEQ ID NO: 11017 - DNA, 20 bp, Artificial Sequence
  chemically synthesized
aaggatctgggccagccgta

SEQ ID NO: 11018 - DNA, 20 bp, Artificial Sequence
  chemically synthesized
aggatctgggccagccgtag

SEQ ID NO: 11019 - DNA, 20 bp, Artificial Sequence
  chemically synthesized
ggccagccgtagaggtgacc

SEQ ID NO: 11020 - DNA, 20 bp, Artificial Sequence
  chemically synthesized
gccagccgtagaggtgaccc

SEQ ID NO: 11021 - DNA, 20 bp, Artificial Sequence
  chemically synthesized
gtagaggtgacccaggccac

SEQ ID NO: 11022 - DNA, 20 bp, Artificial Sequence
  chemically synthesized
gtgacccaggccacaagctg

SEQ ID NO: 11023 - DNA, 20 bp, Artificial Sequence
  chemically synthesized
cccaggccacaagctgcaga

SEQ ID NO: 11024 - DNA, 20 bp, Artificial Sequence
  chemically synthesized
ggccacaagctgcagacaga

SEQ ID NO: 11025 - DNA, 20 bp, Artificial Sequence
  chemically synthesized
cacaagctgcagacagaaag

SEQ ID NO: 11026 - DNA, 20 bp, Artificial Sequence
  chemically synthesized
gctgcagacagaaagcggca

SEQ ID NO: 11027 - DNA, 20 bp, Artificial Sequence
  chemically synthesized
ctgcagacagaaagcggcac

SEQ ID NO: 11028 - DNA, 20 bp, Artificial Sequence
  chemically synthesized
gacagaaagcggcacaggcc

SEQ ID NO: 11029 - DNA, 20 bp, Artificial Sequence
  chemically synthesized
acagaaagcggcacaggccc

SEQ ID NO: 11030 - DNA, 20 bp, Artificial Sequence
  chemically synthesized
cagaaagcggcacaggccca

SEQ ID NO: 11031 - DNA, 20 bp, Artificial Sequence
  chemically synthesized
agaaagcggcacaggcccag

SEQ ID NO: 11032 - DNA, 20 bp, Artificial Sequence
  chemically synthesized
aaagcggcacaggcccaggg

SEQ ID NO: 11033 - DNA, 20 bp, Artificial Sequence
  chemically synthesized
agcggcacaggcccagggga

SEQ ID NO: 11034 - DNA, 20 bp, Artificial Sequence
  chemically synthesized
caggcccaggggagagaatg

SEQ ID NO: 11035 - DNA, 20 bp, Artificial Sequence
  chemically synthesized
aggcccaggggagagaatgc

SEQ ID NO: 11036 - DNA, 20 bp, Artificial Sequence
  chemically synthesized
ccaggggagagaatgcaggt

SEQ ID NO: 11037 - DNA, 20 bp, Artificial Sequence
  chemically synthesized
aggggagagaatgcaggtca

SEQ ID NO: 11038 - DNA, 20 bp, Artificial Sequence
  chemically synthesized
gagagaatgcaggtcagaga

SEQ ID NO: 11039 - DNA, 20 bp, Artificial Sequence
  chemically synthesized
agaatgcaggtcagagaaag

SEQ ID NO: 11040 - DNA, 20 bp, Artificial Sequence
  chemically synthesized
gaatgcaggtcagagaaagc

SEQ ID NO: 11041 - DNA, 20 bp, Artificial Sequence
  chemically synthesized
cagagaaagcaggacctgcc

SEQ ID NO: 11042 - DNA, 20 bp, Artificial Sequence
  chemically synthesized
agagaaagcaggacctgcct

SEQ ID NO: 11043 - DNA, 20 bp, Artificial Sequence
  chemically synthesized
gaaagcaggacctgcctggg

SEQ ID NO: 11044 - DNA, 20 bp, Artificial Sequence
  chemically synthesized
aaagcaggacctgcctggga

SEQ ID NO: 11045 - DNA, 20 bp, Artificial Sequence
  chemically synthesized
aagcaggacctgcctgggaa

SEQ ID NO: 11046 - DNA, 20 bp, Artificial Sequence
  chemically synthesized
agcaggacctgcctgggaag

SEQ ID NO: 11047 - DNA, 20 bp, Artificial Sequence
  chemically synthesized
acctgcctgggaaggggaaa

SEQ ID NO: 11048 - DNA, 20 bp, Artificial Sequence
  chemically synthesized
tgcctgggaaggggaaacag

SEQ ID NO: 11049 - DNA, 20 bp, Artificial Sequence
  chemically synthesized
gcctgggaaggggaaacagt

SEQ ID NO: 11050 - DNA, 20 bp, Artificial Sequence
  chemically synthesized
gggaaggggaaacagtgggc

SEQ ID NO: 11051 - DNA, 20 bp, Artificial Sequence
  chemically synthesized
gaaggggaaacagtgggcca

SEQ ID NO: 11052 - DNA, 20 bp, Artificial Sequence
  chemically synthesized
aaggggaaacagtgggccag

SEQ ID NO: 11053 - DNA, 20 bp, Artificial Sequence
  chemically synthesized
gggaaacagtgggccagagg

SEQ ID NO: 11054 - DNA, 20 bp, Artificial Sequence
  chemically synthesized
acagtgggccagaggcggcg

SEQ ID NO: 11055 - DNA, 20 bp, Artificial Sequence
  chemically synthesized
gtgggccagaggcggcgcag

SEQ ID NO: 11056 - DNA, 20 bp, Artificial Sequence
  chemically synthesized
gccagaggcggcgcagaagc

SEQ ID NO: 11057 - DNA, 20 bp, Artificial Sequence
  chemically synthesized
agaggcggcgcagaagccag

SEQ ID NO: 11058 - DNA, 20 bp, Artificial Sequence
  chemically synthesized
aggcggcgcagaagccagta

SEQ ID NO: 11059 - DNA, 20 bp, Artificial Sequence
  chemically synthesized
gcagaagccagtagagctca

SEQ ID NO: 11060 - DNA, 20 bp, Artificial Sequence
  chemically synthesized
gaagccagtagagctcaaag

SEQ ID NO: 11061 - DNA, 20 bp, Artificial Sequence
  chemically synthesized
cagtagagctcaaagtggtc

SEQ ID NO: 11062 - DNA, 20 bp, Artificial Sequence
  chemically synthesized
agctcaaagtggtccggact

SEQ ID NO: 11063 - DNA, 20 bp, Artificial Sequence
  chemically synthesized
gctcaaagtggtccggactc

SEQ ID NO: 11064 - DNA, 20 bp, Artificial Sequence
  chemically synthesized
tcaaagtggtccggactcag

SEQ ID NO: 11065 - DNA, 20 bp, Artificial Sequence
  chemically synthesized
aaagtggtccggactcagga

SEQ ID NO: 11066 - DNA, 20 bp, Artificial Sequence
  chemically synthesized
agtggtccggactcaggaga

SEQ ID NO: 11067 - DNA, 20 bp, Artificial Sequence
  chemically synthesized
gtccggactcaggagagaga

SEQ ID NO: 11068 - DNA, 20 bp, Artificial Sequence
  chemically synthesized
cggactcaggagagagacgg

SEQ ID NO: 11069 - DNA, 20 bp, Artificial Sequence
  chemically synthesized
caggagagagacggcagcgt

SEQ ID NO: 11070 - DNA, 20 bp, Artificial Sequence
  chemically synthesized
ggagagagacggcagcgtta

SEQ ID NO: 11071 - DNA, 20 bp, Artificial Sequence
  chemically synthesized
gagagagacggcagcgttag

SEQ ID NO: 11072 - DNA, 20 bp, Artificial Sequence
  chemically synthesized
agagagacggcagcgttaga

SEQ ID NO: 11073 - DNA, 20 bp, Artificial Sequence
  chemically synthesized
gagacggcagcgttagaggg

SEQ ID NO: 11074 - DNA, 20 bp, Artificial Sequence
  chemically synthesized
gacggcagcgttagagggca

SEQ ID NO: 11075 - DNA, 20 bp, Artificial Sequence
  chemically synthesized
agcgttagagggcagagttc

SEQ ID NO: 11076 - DNA, 20 bp, Artificial Sequence
  chemically synthesized
gttagagggcagagttccgg

SEQ ID NO: 11077 - DNA, 20 bp, Artificial Sequence
  chemically synthesized
agggcagagttccggcggca

SEQ ID NO: 11078 - DNA, 20 bp, Artificial Sequence
  chemically synthesized
cagagttccggcggcacagc

SEQ ID NO: 11079 - DNA, 20 bp, Artificial Sequence
  chemically synthesized
agagttccggcggcacagca

SEQ ID NO: 11080 - DNA, 20 bp, Artificial Sequence
  chemically synthesized
gagttccggcggcacagcaa

SEQ ID NO: 11081 - DNA, 20 bp, Artificial Sequence
  chemically synthesized
ggcggcacagcaagggcact

SEQ ID NO: 11082 - DNA, 20 bp, Artificial Sequence
  chemically synthesized
gcggcacagcaagggcactc

SEQ ID NO: 11083 - DNA, 20 bp, Artificial Sequence
  chemically synthesized
cggcacagcaagggcactcg

SEQ ID NO: 11084 - DNA, 20 bp, Artificial Sequence
  chemically synthesized
ggcacagcaagggcactcgg

SEQ ID NO: 11085 - DNA, 20 bp, Artificial Sequence
  chemically synthesized
cagcaagggcactcgggggc

SEQ ID NO: 11086 - DNA, 20 bp, Artificial Sequence
  chemically synthesized
gcaagggcactcgggggcga

SEQ ID NO: 11087 - DNA, 20 bp, Artificial Sequence
  chemically synthesized
caagggcactcgggggcgag

SEQ ID NO: 11088 - DNA, 20 bp, Artificial Sequence
  chemically synthesized
agggcactcgggggcgagag

SEQ ID NO: 11089 - DNA, 20 bp, Artificial Sequence
  chemically synthesized
gggcactcgggggcgagagg

SEQ ID NO: 11090 - DNA, 20 bp, Artificial Sequence
  chemically synthesized
ggcactcgggggcgagagga

SEQ ID NO: 11091 - DNA, 20 bp, Artificial Sequence
  chemically synthesized
actcgggggcgagaggaggg

SEQ ID NO: 11092 - DNA, 20 bp, Artificial Sequence
  chemically synthesized
ggcgagaggagggcagcgca

SEQ ID NO: 11093 - DNA, 20 bp, Artificial Sequence
  chemically synthesized
agggcagcgcaaagtgacaa

SEQ ID NO: 11094 - DNA, 20 bp, Artificial Sequence
  chemically synthesized
cagcgcaaagtgacaatggc

SEQ ID NO: 11095 - DNA, 20 bp, Artificial Sequence
  chemically synthesized
agcgcaaagtgacaatggcc

SEQ ID NO: 11096 - DNA, 20 bp, Artificial Sequence
  chemically synthesized
gcgcaaagtgacaatggcca

SEQ ID NO: 11097 - DNA, 20 bp, Artificial Sequence
  chemically synthesized
aaagtgacaatggccagggc

SEQ ID NO: 11098 - DNA, 20 bp, Artificial Sequence
  chemically synthesized
aagtgacaatggccagggcc

SEQ ID NO: 11099 - DNA, 20 bp, Artificial Sequence
  chemically synthesized
tgacaatggccagggccagg

SEQ ID NO: 11100 - DNA, 20 bp, Artificial Sequence
  chemically synthesized
aatggccagggccaggcaga

SEQ ID NO: 11101 - DNA, 20 bp, Artificial Sequence
  chemically synthesized
ccagggccaggcagatagac

SEQ ID NO: 11102 - DNA, 20 bp, Artificial Sequence
  chemically synthesized
ccaggcagatagaccagact

SEQ ID NO: 11103 - DNA, 20 bp, Artificial Sequence
  chemically synthesized
agatagaccagactgagcta

SEQ ID NO: 11104 - DNA, 20 bp, Artificial Sequence
  chemically synthesized
gatagaccagactgagctat

SEQ ID NO: 11105 - DNA, 20 bp, Artificial Sequence
  chemically synthesized
tagaccagactgagctatgg

SEQ ID NO: 11106 - DNA, 20 bp, Artificial Sequence
  chemically synthesized
ccagactgagctatgggagc

SEQ ID NO: 11107 - DNA, 20 bp, Artificial Sequence
  chemically synthesized
ctgagctatgggagctggct

SEQ ID NO: 11108 - DNA, 20 bp, Artificial Sequence
  chemically synthesized
tgagctatgggagctggctc

SEQ ID NO: 11109 - DNA, 20 bp, Artificial Sequence
  chemically synthesized
tatgggagctggctcaggtt

SEQ ID NO: 11110 - DNA, 20 bp, Artificial Sequence
  chemically synthesized
atgggagctggctcaggttc

SEQ ID NO: 11111 - DNA, 20 bp, Artificial Sequence
  chemically synthesized
gggagctggctcaggttcag

SEQ ID NO: 11112 - DNA, 20 bp, Artificial Sequence
  chemically synthesized
gagctggctcaggttcagga

SEQ ID NO: 11113 - DNA, 20 bp, Artificial Sequence
  chemically synthesized
agctggctcaggttcaggag

SEQ ID NO: 11114 - DNA, 20 bp, Artificial Sequence
  chemically synthesized
gctggctcaggttcaggaga

SEQ ID NO: 11115 - DNA, 20 bp, Artificial Sequence
  chemically synthesized
ggctcaggttcaggagaggg

SEQ ID NO: 11116 - DNA, 20 bp, Artificial Sequence
  chemically synthesized
gctcaggttcaggagagggc

SEQ ID NO: 11117 - DNA, 20 bp, Artificial Sequence
  chemically synthesized
ctcaggttcaggagagggca

SEQ ID NO: 11118 - DNA, 20 bp, Artificial Sequence
  chemically synthesized
aggttcaggagagggcaggg

SEQ ID NO: 11119 - DNA, 20 bp, Artificial Sequence
  chemically synthesized
ggttcaggagagggcagggc

SEQ ID NO: 11120 - DNA, 20 bp, Artificial Sequence
  chemically synthesized
gttcaggagagggcagggca

SEQ ID NO: 11121 - DNA, 20 bp, Artificial Sequence
  chemically synthesized
caggagagggcagggcaggg

SEQ ID NO: 11122 - DNA, 20 bp, Artificial Sequence
  chemically synthesized
aggagagggcagggcaggga

SEQ ID NO: 11123 - DNA, 20 bp, Artificial Sequence
  chemically synthesized
gagagggcagggcagggaag

SEQ ID NO: 11124 - DNA, 20 bp, Artificial Sequence
  chemically synthesized
gcagggcagggaaggagaca

SEQ ID NO: 11125 - DNA, 20 bp, Artificial Sequence
  chemically synthesized
gcagggaaggagacaaagtc

SEQ ID NO: 11126 - DNA, 20 bp, Artificial Sequence
  chemically synthesized
cagggaaggagacaaagtcc

SEQ ID NO: 11127 - DNA, 20 bp, Artificial Sequence
  chemically synthesized
aaggagacaaagtccaggac

SEQ ID NO: 11128 - DNA, 20 bp, Artificial Sequence
  chemically synthesized
agacaaagtccaggaccggc

SEQ ID NO: 11129 - DNA, 20 bp, Artificial Sequence
  chemically synthesized
acaaagtccaggaccggctg

SEQ ID NO: 11130 - DNA, 20 bp, Artificial Sequence
  chemically synthesized
caaagtccaggaccggctgg

SEQ ID NO: 11131 - DNA, 20 bp, Artificial Sequence
  chemically synthesized
aaagtccaggaccggctgga

SEQ ID NO: 11132 - DNA, 20 bp, Artificial Sequence
  chemically synthesized
aagtccaggaccggctggag

SEQ ID NO: 11133 - DNA, 20 bp, Artificial Sequence
  chemically synthesized
cggctggaggggctcaacat

SEQ ID NO: 11134 - DNA, 20 bp, Artificial Sequence
  chemically synthesized
ctggaggggctcaacatcgg

SEQ ID NO: 11135 - DNA, 20 bp, Artificial Sequence
  chemically synthesized
ggaggggctcaacatcggaa

SEQ ID NO: 11136 - DNA, 20 bp, Artificial Sequence
  chemically synthesized
gaggggctcaacatcggaag

SEQ ID NO: 11137 - DNA, 20 bp, Artificial Sequence
  chemically synthesized
aggggctcaacatcggaaga

SEQ ID NO: 11138 - DNA, 20 bp, Artificial Sequence
  chemically synthesized
ggggctcaacatcggaagag

SEQ ID NO: 11139 - DNA, 20 bp, Artificial Sequence
  chemically synthesized
gctcaacatcggaagagggg

SEQ ID NO: 11140 - DNA, 20 bp, Artificial Sequence
  chemically synthesized
acatcggaagaggggaagtc

SEQ ID NO: 11141 - DNA, 20 bp, Artificial Sequence
  chemically synthesized
catcggaagaggggaagtcg

SEQ ID NO: 11142 - DNA, 20 bp, Artificial Sequence
  chemically synthesized
atcggaagaggggaagtcga

SEQ ID NO: 11143 - DNA, 20 bp, Artificial Sequence
  chemically synthesized
cggaagaggggaagtcgagg

SEQ ID NO: 11144 - DNA, 20 bp, Artificial Sequence
  chemically synthesized
ggaagaggggaagtcgaggg

SEQ ID NO: 11145 - DNA, 20 bp, Artificial Sequence
  chemically synthesized
gaagaggggaagtcgaggga

SEQ ID NO: 11146 - DNA, 20 bp, Artificial Sequence
  chemically synthesized
aggggaagtcgagggaggga

SEQ ID NO: 11147 - DNA, 20 bp, Artificial Sequence
  chemically synthesized
gaagtcgagggagggatggt

SEQ ID NO: 11148 - DNA, 20 bp, Artificial Sequence
  chemically synthesized
aagtcgagggagggatggta

SEQ ID NO: 11149 - DNA, 20 bp, Artificial Sequence
  chemically synthesized
gtcgagggagggatggtaag

SEQ ID NO: 11150 - DNA, 20 bp, Artificial Sequence
  chemically synthesized
tcgagggagggatggtaagg

SEQ ID NO: 11151 - DNA, 20 bp, Artificial Sequence
  chemically synthesized
ggatggtaaggaggactgca

SEQ ID NO: 11152 - DNA, 20 bp, Artificial Sequence
  chemically synthesized
gatggtaaggaggactgcat

SEQ ID NO: 11153 - DNA, 20 bp, Artificial Sequence
  chemically synthesized
gtaaggaggactgcatgggt

SEQ ID NO: 11154 - DNA, 20 bp, Artificial Sequence
  chemically synthesized
gaggactgcatgggtcagca

SEQ ID NO: 11155 - DNA, 20 bp, Artificial Sequence
  chemically synthesized
aggactgcatgggtcagcac

SEQ ID NO: 11156 - DNA, 20 bp, Artificial Sequence
  chemically synthesized
tgggtcagcacaggctgcca

SEQ ID NO: 11157 - DNA, 20 bp, Artificial Sequence
  chemically synthesized
tcagcacaggctgccaaagc

SEQ ID NO: 11158 - DNA, 20 bp, Artificial Sequence
  chemically synthesized
cagcacaggctgccaaagcc

SEQ ID NO: 11159 - DNA, 20 bp, Artificial Sequence
  chemically synthesized
agcacaggctgccaaagcca

SEQ ID NO: 11160 - DNA, 20 bp, Artificial Sequence
  chemically synthesized
caggctgccaaagccagggc

SEQ ID NO: 11161 - DNA, 20 bp, Artificial Sequence
  chemically synthesized
gccaaagccagggccagtta

SEQ ID NO: 11162 - DNA, 20 bp, Artificial Sequence
  chemically synthesized
cagttaaagcgactccaatg

SEQ ID NO: 11163 - DNA, 20 bp, Artificial Sequence
  chemically synthesized
ttaaagcgactccaatgcgg

SEQ ID NO: 11164 - DNA, 20 bp, Artificial Sequence
  chemically synthesized
aaagcgactccaatgcggaa

SEQ ID NO: 11165 - DNA, 20 bp, Artificial Sequence
  chemically synthesized
agcgactccaatgcggaaga

SEQ ID NO: 11166 - DNA, 20 bp, Artificial Sequence
  chemically synthesized
gactccaatgcggaagagag

SEQ ID NO: 11167 - DNA, 20 bp, Artificial Sequence
  chemically synthesized
actccaatgcggaagagagt

SEQ ID NO: 11168 - DNA, 20 bp, Artificial Sequence
  chemically synthesized
atgcggaagagagtaggtcg

SEQ ID NO: 11169 - DNA, 20 bp, Artificial Sequence
  chemically synthesized
tgcggaagagagtaggtcga

SEQ ID NO: 11170 - DNA, 20 bp, Artificial Sequence
  chemically synthesized
gcggaagagagtaggtcgaa

SEQ ID NO: 11171 - DNA, 20 bp, Artificial Sequence
  chemically synthesized
cggaagagagtaggtcgaag

SEQ ID NO: 11172 - DNA, 20 bp, Artificial Sequence
  chemically synthesized
gagagtaggtcgaaggggaa

SEQ ID NO: 11173 - DNA, 20 bp, Artificial Sequence
  chemically synthesized
gtaggtcgaaggggaatggt

SEQ ID NO: 11174 - DNA, 20 bp, Artificial Sequence
  chemically synthesized
taggtcgaaggggaatggta

SEQ ID NO: 11175 - DNA, 20 bp, Artificial Sequence
  chemically synthesized
ggtcgaaggggaatggtaag

SEQ ID NO: 11176 - DNA, 20 bp, Artificial Sequence
  chemically synthesized
gtcgaaggggaatggtaagg

SEQ ID NO: 11177 - DNA, 20 bp, Artificial Sequence
  chemically synthesized
aggggaatggtaaggaggcc

SEQ ID NO: 11178 - DNA, 20 bp, Artificial Sequence
  chemically synthesized
ggggaatggtaaggaggcct

SEQ ID NO: 11179 - DNA, 20 bp, Artificial Sequence
  chemically synthesized
gggaatggtaaggaggcctg

SEQ ID NO: 11180 - DNA, 20 bp, Artificial Sequence
  chemically synthesized
aatggtaaggaggcctgggg

SEQ ID NO: 11181 - DNA, 20 bp, Artificial Sequence
  chemically synthesized
tggtaaggaggcctggggca

SEQ ID NO: 11182 - DNA, 20 bp, Artificial Sequence
  chemically synthesized
taaggaggcctggggcagag

SEQ ID NO: 11183 - DNA, 20 bp, Artificial Sequence
  chemically synthesized
gaggcctggggcagagtggt

SEQ ID NO: 11184 - DNA, 20 bp, Artificial Sequence
  chemically synthesized
ctggggcagagtggtcagca

SEQ ID NO: 11185 - DNA, 20 bp, Artificial Sequence
  chemically synthesized
ggggcagagtggtcagcaca

SEQ ID NO: 11186 - DNA, 20 bp, Artificial Sequence
  chemically synthesized
gcagagtggtcagcacagag

SEQ ID NO: 11187 - DNA, 20 bp, Artificial Sequence
  chemically synthesized
gtggtcagcacagagtggct

SEQ ID NO: 11188 - DNA, 20 bp, Artificial Sequence
  chemically synthesized
cagcacagagtggctaagcc

SEQ ID NO: 11189 - DNA, 20 bp, Artificial Sequence
  chemically synthesized
agcacagagtggctaagccc

SEQ ID NO: 11190 - DNA, 20 bp, Artificial Sequence
  chemically synthesized
gcacagagtggctaagccca

SEQ ID NO: 11191 - DNA, 20 bp, Artificial Sequence
  chemically synthesized
agagtggctaagcccagggc

SEQ ID NO: 11192 - DNA, 20 bp, Artificial Sequence
  chemically synthesized
gctaagcccagggccagttg

SEQ ID NO: 11193 - DNA, 20 bp, Artificial Sequence
  chemically synthesized
aagcccagggccagttgaag

SEQ ID NO: 11194 - DNA, 20 bp, Artificial Sequence
  chemically synthesized
cagttgaagcggctccaatt

SEQ ID NO: 11195 - DNA, 20 bp, Artificial Sequence
  chemically synthesized
ttgaagcggctccaattcgg

SEQ ID NO: 11196 - DNA, 20 bp, Artificial Sequence
  chemically synthesized
aagcggctccaattcggaag

SEQ ID NO: 11197 - DNA, 20 bp, Artificial Sequence
  chemically synthesized
agcggctccaattcggaagt

SEQ ID NO: 11198 - DNA, 20 bp, Artificial Sequence
  chemically synthesized
gcggctccaattcggaagtg

SEQ ID NO: 11199 - DNA, 20 bp, Artificial Sequence
  chemically synthesized
gctccaattcggaagtgggg

SEQ ID NO: 11200 - DNA, 20 bp, Artificial Sequence
  chemically synthesized
attcggaagtggggtggtcg

SEQ ID NO: 11201 - DNA, 20 bp, Artificial Sequence
  chemically synthesized
ttcggaagtggggtggtcga

SEQ ID NO: 11202 - DNA, 20 bp, Artificial Sequence
  chemically synthesized
tcggaagtggggtggtcgaa

SEQ ID NO: 11203 - DNA, 20 bp, Artificial Sequence
  chemically synthesized
cggaagtggggtggtcgaag

SEQ ID NO: 11204 - DNA, 20 bp, Artificial Sequence
  chemically synthesized
gtggggtggtcgaaggggaa

SEQ ID NO: 11205 - DNA, 20 bp, Artificial Sequence
  chemically synthesized
ggtggtcgaaggggaatggt

SEQ ID NO: 11206 - DNA, 20 bp, Artificial Sequence
  chemically synthesized
gtggtcgaaggggaatggta

SEQ ID NO: 11207 - DNA, 20 bp, Artificial Sequence
  chemically synthesized
tggtcgaaggggaatggtaa

SEQ ID NO: 11208 - DNA, 20 bp, Artificial Sequence
  chemically synthesized
ggtcgaaggggaatggtaag

SEQ ID NO: 11209 - DNA, 20 bp, Artificial Sequence
  chemically synthesized
gtcgaaggggaatggtaagg

SEQ ID NO: 11210 - DNA, 20 bp, Artificial Sequence
  chemically synthesized
aggggaatggtaagggggac

SEQ ID NO: 11211 - DNA, 20 bp, Artificial Sequence
  chemically synthesized
ggggaatggtaagggggact

SEQ ID NO: 11212 - DNA, 20 bp, Artificial Sequence
  chemically synthesized
aatggtaagggggactggga

SEQ ID NO: 11213 - DNA, 20 bp, Artificial Sequence
  chemically synthesized
atggtaagggggactgggac

SEQ ID NO: 11214 - DNA, 20 bp, Artificial Sequence
  chemically synthesized
tggtaagggggactgggacg

SEQ ID NO: 11215 - DNA, 20 bp, Artificial Sequence
  chemically synthesized
gggggactgggacggggtgt

SEQ ID NO: 11216 - DNA, 20 bp, Artificial Sequence
  chemically synthesized
actgggacggggtgtcagca

SEQ ID NO: 11217 - DNA, 20 bp, Artificial Sequence
  chemically synthesized
ctgggacggggtgtcagcat

SEQ ID NO: 11218 - DNA, 20 bp, Artificial Sequence
  chemically synthesized
tgggacggggtgtcagcata

SEQ ID NO: 11219 - DNA, 20 bp, Artificial Sequence
  chemically synthesized
gacggggtgtcagcataggg

SEQ ID NO: 11220 - DNA, 20 bp, Artificial Sequence
  chemically synthesized
ggtgtcagcatagggtggca

SEQ ID NO: 11221 - DNA, 20 bp, Artificial Sequence
  chemically synthesized
cagcatagggtggcaaagcc

SEQ ID NO: 11222 - DNA, 20 bp, Artificial Sequence
  chemically synthesized
agcatagggtggcaaagccc

SEQ ID NO: 11223 - DNA, 20 bp, Artificial Sequence
  chemically synthesized
gcatagggtggcaaagccca

SEQ ID NO: 11224 - DNA, 20 bp, Artificial Sequence
  chemically synthesized
agggtggcaaagcccagggc

SEQ ID NO: 11225 - DNA, 20 bp, Artificial Sequence
  chemically synthesized
gggtggcaaagcccagggcc

SEQ ID NO: 11226 - DNA, 20 bp, Artificial Sequence
  chemically synthesized
aagcccagggccaggaacga

SEQ ID NO: 11227 - DNA, 20 bp, Artificial Sequence
  chemically synthesized
agcccagggccaggaacgac

SEQ ID NO: 11228 - DNA, 20 bp, Artificial Sequence
  chemically synthesized
gcccagggccaggaacgacg

SEQ ID NO: 11229 - DNA, 20 bp, Artificial Sequence
  chemically synthesized
cagggccaggaacgacgggg

SEQ ID NO: 11230 - DNA, 20 bp, Artificial Sequence
  chemically synthesized
caggaacgacggggcggatc

SEQ ID NO: 11231 - DNA, 20 bp, Artificial Sequence
  chemically synthesized
acgacggggcggatcgagac

SEQ ID NO: 11232 - DNA, 20 bp, Artificial Sequence
  chemically synthesized
gggcggatcgagactggcaa

SEQ ID NO: 11233 - DNA, 20 bp, Artificial Sequence
  chemically synthesized
ggcggatcgagactggcaac

SEQ ID NO: 11234 - DNA, 20 bp, Artificial Sequence
  chemically synthesized
gcggatcgagactggcaacg

SEQ ID NO: 11235 - DNA, 20 bp, Artificial Sequence
  chemically synthesized
gatcgagactggcaacgggg

SEQ ID NO: 11236 - DNA, 20 bp, Artificial Sequence
  chemically synthesized
atcgagactggcaacgggga

SEQ ID NO: 11237 - DNA, 20 bp, Artificial Sequence
  chemically synthesized
cgagactggcaacggggaag

SEQ ID NO: 11238 - DNA, 20 bp, Artificial Sequence
  chemically synthesized
gagactggcaacggggaagg

SEQ ID NO: 11239 - DNA, 20 bp, Artificial Sequence
  chemically synthesized
aacggggaaggaggatgccc

SEQ ID NO: 11240 - DNA, 20 bp, Artificial Sequence
  chemically synthesized
acggggaaggaggatgcccc

SEQ ID NO: 11241 - DNA, 20 bp, Artificial Sequence
  chemically synthesized
gggaaggaggatgccccagg

SEQ ID NO: 11242 - DNA, 20 bp, Artificial Sequence
  chemically synthesized
ggaggatgccccaggtggcg

SEQ ID NO: 11243 - DNA, 20 bp, Artificial Sequence
  chemically synthesized
ggatgccccaggtggcgcag

SEQ ID NO: 11244 - DNA, 20 bp, Artificial Sequence
  chemically synthesized
atgccccaggtggcgcagca

SEQ ID NO: 11245 - DNA, 20 bp, Artificial Sequence
  chemically synthesized
tgccccaggtggcgcagcag

SEQ ID NO: 11246 - DNA, 20 bp, Artificial Sequence
  chemically synthesized
gccccaggtggcgcagcaga

SEQ ID NO: 11247 - DNA, 20 bp, Artificial Sequence
  chemically synthesized
ccaggtggcgcagcagaggg

SEQ ID NO: 11248 - DNA, 20 bp, Artificial Sequence
  chemically synthesized
ggcgcagcagagggtggacc

SEQ ID NO: 11249 - DNA, 20 bp, Artificial Sequence
  chemically synthesized
gcagagggtggacctggccc

SEQ ID NO: 11250 - DNA, 20 bp, Artificial Sequence
  chemically synthesized
cagagggtggacctggcccc

SEQ ID NO: 11251 - DNA, 20 bp, Artificial Sequence
  chemically synthesized
gagggtggacctggccccgg

SEQ ID NO: 11252 - DNA, 20 bp, Artificial Sequence
  chemically synthesized
gacctggccccgggagacgc

SEQ ID NO: 11253 - DNA, 20 bp, Artificial Sequence
  chemically synthesized
acctggccccgggagacgcc

SEQ ID NO: 11254 - DNA, 20 bp, Artificial Sequence
  chemically synthesized
tggccccgggagacgccggg

SEQ ID NO: 11255 - DNA, 20 bp, Artificial Sequence
  chemically synthesized
ggccccgggagacgccgggc

SEQ ID NO: 11256 - DNA, 20 bp, Artificial Sequence
  chemically synthesized
gccccgggagacgccgggcg

SEQ ID NO: 11257 - DNA, 20 bp, Artificial Sequence
  chemically synthesized
ccccgggagacgccgggcgg

SEQ ID NO: 11258 - DNA, 20 bp, Artificial Sequence
  chemically synthesized
cccgggagacgccgggcggg

SEQ ID NO: 11259 - DNA, 20 bp, Artificial Sequence
  chemically synthesized
ccgggcggggggcgctgacc

SEQ ID NO: 11260 - DNA, 20 bp, Artificial Sequence
  chemically synthesized
cggggggcgctgacctggtg

SEQ ID NO: 11261 - DNA, 20 bp, Artificial Sequence
  chemically synthesized
ggggggcgctgacctggtgc

SEQ ID NO: 11262 - DNA, 20 bp, Artificial Sequence
  chemically synthesized
gggggcgctgacctggtgca

SEQ ID NO: 11263 - DNA, 20 bp, Artificial Sequence
  chemically synthesized
gtgcagggcgctgataccgt

SEQ ID NO: 11264 - DNA, 20 bp, Artificial Sequence
  chemically synthesized
ggcgctgataccgtcggcgt

SEQ ID NO: 11265 - DNA, 20 bp, Artificial Sequence
  chemically synthesized
gctgataccgtcggcgttgg

SEQ ID NO: 11266 - DNA, 20 bp, Artificial Sequence
  chemically synthesized
tgataccgtcggcgttggtg

SEQ ID NO: 11267 - DNA, 20 bp, Artificial Sequence
  chemically synthesized
ccgtcggcgttggtggagtc

SEQ ID NO: 11268 - DNA, 20 bp, Artificial Sequence
  chemically synthesized
ggcgttggtggagtccagca

SEQ ID NO: 11269 - DNA, 20 bp, Artificial Sequence
  chemically synthesized
tggtggagtccagcacggcg

SEQ ID NO: 11270 - DNA, 20 bp, Artificial Sequence
  chemically synthesized
ggtggagtccagcacggcgc

SEQ ID NO: 11271 - DNA, 20 bp, Artificial Sequence
  chemically synthesized
ggagtccagcacggcgcggg

SEQ ID NO: 11272 - DNA, 20 bp, Artificial Sequence
  chemically synthesized
gagtccagcacggcgcgggc

SEQ ID NO: 11273 - DNA, 20 bp, Artificial Sequence
  chemically synthesized
tccagcacggcgcgggcggg

SEQ ID NO: 11274 - DNA, 20 bp, Artificial Sequence
  chemically synthesized
agcacggcgcgggcgggcgg

SEQ ID NO: 11275 - DNA, 20 bp, Artificial Sequence
  chemically synthesized
ggcgcgggcgggcggcggcg

SEQ ID NO: 11276 - DNA, 20 bp, Artificial Sequence
  chemically synthesized
gcgggcgggcggcggcgcgg

SEQ ID NO: 11277 - DNA, 20 bp, Artificial Sequence
  chemically synthesized
cgggcgggcggcggcgcggc

SEQ ID NO: 11278 - DNA, 20 bp, Artificial Sequence
  chemically synthesized
gggcgggcggcggcgcggcg

SEQ ID NO: 11279 - DNA, 20 bp, Artificial Sequence
  chemically synthesized
ggcggcggcgcggcggggtc

SEQ ID NO: 11280 - DNA, 20 bp, Artificial Sequence
  chemically synthesized
cggcgcggcggggtcgagct

SEQ ID NO: 11281 - DNA, 20 bp, Artificial Sequence
  chemically synthesized
ggcggggtcgagctcggcgc

SEQ ID NO: 11282 - DNA, 20 bp, Artificial Sequence
  chemically synthesized
gcggggtcgagctcggcgcc

SEQ ID NO: 11283 - DNA, 20 bp, Artificial Sequence
  chemically synthesized
cggggtcgagctcggcgccg

SEQ ID NO: 11284 - DNA, 20 bp, Artificial Sequence
  chemically synthesized
gtcgagctcggcgccggggc

SEQ ID NO: 11285 - DNA, 20 bp, Artificial Sequence
  chemically synthesized
tcgagctcggcgccggggcc

SEQ ID NO: 11286 - DNA, 20 bp, Artificial Sequence
  chemically synthesized
cgagctcggcgccggggcca

SEQ ID NO: 11287 - DNA, 20 bp, Artificial Sequence
  chemically synthesized
ctcggcgccggggccagggt

SEQ ID NO: 11288 - DNA, 20 bp, Artificial Sequence
  chemically synthesized
ggcgccggggccagggtcgg

SEQ ID NO: 11289 - DNA, 20 bp, Artificial Sequence
  chemically synthesized
gggccagggtcggcggcgcg

SEQ ID NO: 11290 - DNA, 20 bp, Artificial Sequence
  chemically synthesized
gggtcggcggcgcgcagcat

SEQ ID NO: 11291 - DNA, 20 bp, Artificial Sequence
  chemically synthesized
agcatcagacgcgcctcgtc

SEQ ID NO: 11292 - DNA, 20 bp, Artificial Sequence
  chemically synthesized
gcatcagacgcgcctcgtcc

SEQ ID NO: 11293 - DNA, 20 bp, Artificial Sequence
  chemically synthesized
cgtccaggtcgccgcccgca

SEQ ID NO: 11294 - DNA, 20 bp, Artificial Sequence
  chemically synthesized
gtccaggtcgccgcccgcac

SEQ ID NO: 11295 - DNA, 20 bp, Artificial Sequence
  chemically synthesized
tcgccgcccgcacaggccgc

SEQ ID NO: 11296 - DNA, 20 bp, Artificial Sequence
  chemically synthesized
cgccgcccgcacaggccgcc

SEQ ID NO: 11297 - DNA, 20 bp, Artificial Sequence
  chemically synthesized
cgcacaggccgccaggaact

SEQ ID NO: 11298 - DNA, 20 bp, Artificial Sequence
  chemically synthesized
acaggccgccaggaactcgg

SEQ ID NO: 11299 - DNA, 20 bp, Artificial Sequence
  chemically synthesized
ggaactcggcggcgcgctcg

SEQ ID NO: 11300 - DNA, 20 bp, Artificial Sequence
  chemically synthesized
actcggcggcgcgctcgaag

SEQ ID NO: 11301 - DNA, 20 bp, Artificial Sequence
  chemically synthesized
ggcggcgcgctcgaagcgga

SEQ ID NO: 11302 - DNA, 20 bp, Artificial Sequence
  chemically synthesized
cgcgctcgaagcggacggtg

SEQ ID NO: 11303 - DNA, 20 bp, Artificial Sequence
  chemically synthesized
gcgctcgaagcggacggtgc

SEQ ID NO: 11304 - DNA, 20 bp, Artificial Sequence
  chemically synthesized
cgaagcggacggtgcgggcg

SEQ ID NO: 11305 - DNA, 20 bp, Artificial Sequence
  chemically synthesized
ggtgcgggcgcggcgctctc

SEQ ID NO: 11306 - DNA, 20 bp, Artificial Sequence
  chemically synthesized
gtgcgggcgcggcgctctcc

SEQ ID NO: 11307 - DNA, 20 bp, Artificial Sequence
  chemically synthesized
tgcgggcgcggcgctctccg

SEQ ID NO: 11308 - DNA, 20 bp, Artificial Sequence
  chemically synthesized
ggcgcggcgctctccggggc

SEQ ID NO: 11309 - DNA, 20 bp, Artificial Sequence
  chemically synthesized
gcgcggcgctctccggggcc

SEQ ID NO: 11310 - DNA, 20 bp, Artificial Sequence
  chemically synthesized
gcgctctccggggccaggct

SEQ ID NO: 11311 - DNA, 20 bp, Artificial Sequence
  chemically synthesized
gcccgcgccccccactgccg

SEQ ID NO: 11312 - DNA, 20 bp, Artificial Sequence
  chemically synthesized
gctgctcccgtcgccgctcc

SEQ ID NO: 11313 - DNA, 20 bp, Artificial Sequence
  chemically synthesized
ctgctcccgtcgccgctccc

SEQ ID NO: 11314 - DNA, 20 bp, Artificial Sequence
  chemically synthesized
ctcccgtcgccgctcccggg

SEQ ID NO: 11315 - DNA, 20 bp, Artificial Sequence
  chemically synthesized
gcagccgccgccgccgcccc

SEQ ID NO: 11316 - DNA, 20 bp, Artificial Sequence
  chemically synthesized
cagccgccgccgccgccccc

SEQ ID NO: 11317 - DNA, 20 bp, Artificial Sequence
  chemically synthesized
cgccgccgccgcccccgggc

SEQ ID NO: 11318 - DNA, 20 bp, Artificial Sequence
  chemically synthesized
gccgcccccgggccagccgc

SEQ ID NO: 11319 - DNA, 20 bp, Artificial Sequence
  chemically synthesized
ccgcccccgggccagccgcc

SEQ ID NO: 11320 - DNA, 20 bp, Artificial Sequence
  chemically synthesized
agccgccgggccatcctctc

SEQ ID NO: 11321 - DNA, 20 bp, Artificial Sequence
  chemically synthesized
catcgcaccgcccgcccgcc

SEQ ID NO: 11322 - DNA, 20 bp, Artificial Sequence
  chemically synthesized
gcaccgcccgcccgcccagc

SEQ ID NO: 11323 - DNA, 20 bp, Artificial Sequence
  chemically synthesized
cgcccgcccgcccagcgagc

SEQ ID NO: 11324 - DNA, 20 bp, Artificial Sequence
  chemically synthesized
cgcccgcccagcgagcgagc

SEQ ID NO: 11325 - DNA, 20 bp, Artificial Sequence
  chemically synthesized
ccagcgagcgagcgagcgcc

SEQ ID NO: 11326 - DNA, 20 bp, Artificial Sequence
  chemically synthesized
tggtggcggcggttggggct

SEQ ID NO: 11327 - DNA, 20 bp, Artificial Sequence
  chemically synthesized
ctcggcgctcgctcgctcgc

SEQ ID NO: 11328 - DNA, 20 bp, Artificial Sequence
  chemically synthesized
tcggcgctcgctcgctcgct

SEQ ID NO: 11329 - DNA, 20 bp, Artificial Sequence
  chemically synthesized
gcgctcgctcgctcgctggg

SEQ ID NO: 11330 - DNA, 20 bp, Artificial Sequence
  chemically synthesized
cgctcgctcgctcgctgggc

SEQ ID NO: 11331 - DNA, 20 bp, Artificial Sequence
  chemically synthesized
tcgctcgctcgctgggcggg

SEQ ID NO: 11332 - DNA, 20 bp, Artificial Sequence
  chemically synthesized
cgctcgctcgctgggcgggc

SEQ ID NO: 11333 - DNA, 20 bp, Artificial Sequence
  chemically synthesized
tcgctcgctgggcgggcggg

SEQ ID NO: 11334 - DNA, 20 bp, Artificial Sequence
  chemically synthesized
cgggcgggcggtgcgatgtc

SEQ ID NO: 11335 - DNA, 20 bp, Artificial Sequence
  chemically synthesized
ggcgggcggtgcgatgtccg

SEQ ID NO: 11336 - DNA, 20 bp, Artificial Sequence
  chemically synthesized
cgggcggtgcgatgtccgga

SEQ ID NO: 11337 - DNA, 20 bp, Artificial Sequence
  chemically synthesized
gggcggtgcgatgtccggag

SEQ ID NO: 11338 - DNA, 20 bp, Artificial Sequence
  chemically synthesized
ggtgcgatgtccggagagga

SEQ ID NO: 11339 - DNA, 20 bp, Artificial Sequence
  chemically synthesized
gatgtccggagaggatggcc

SEQ ID NO: 11340 - DNA, 20 bp, Artificial Sequence
  chemically synthesized
gtccggagaggatggcccgg

SEQ ID NO: 11341 - DNA, 20 bp, Artificial Sequence
  chemically synthesized
ggagaggatggcccggcggc

SEQ ID NO: 11342 - DNA, 20 bp, Artificial Sequence
  chemically synthesized
ggatggcccggcggctggcc

SEQ ID NO: 11343 - DNA, 20 bp, Artificial Sequence
  chemically synthesized
gatggcccggcggctggccc

SEQ ID NO: 11344 - DNA, 20 bp, Artificial Sequence
  chemically synthesized
atggcccggcggctggcccg

SEQ ID NO: 11345 - DNA, 20 bp, Artificial Sequence
  chemically synthesized
tggcccggcggctggcccgg

SEQ ID NO: 11346 - DNA, 20 bp, Artificial Sequence
  chemically synthesized
cccggcggctggcccggggg

SEQ ID NO: 11347 - DNA, 20 bp, Artificial Sequence
  chemically synthesized
ggcggctggcccgggggcgg

SEQ ID NO: 11348 - DNA, 20 bp, Artificial Sequence
  chemically synthesized
ggctggcccgggggcggcgg

SEQ ID NO: 11349 - DNA, 20 bp, Artificial Sequence
  chemically synthesized
tggcccgggggcggcggcgg

SEQ ID NO: 11350 - DNA, 20 bp, Artificial Sequence
  chemically synthesized
gggcggcggcggcggctgcc

SEQ ID NO: 11351 - DNA, 20 bp, Artificial Sequence
  chemically synthesized
ggcggcggcggcggctgccc

SEQ ID NO: 11352 - DNA, 20 bp, Artificial Sequence
  chemically synthesized
cggcggcggcggctgcccgg

SEQ ID NO: 11353 - DNA, 20 bp, Artificial Sequence
  chemically synthesized
cggcggcggctgcccgggag

SEQ ID NO: 11354 - DNA, 20 bp, Artificial Sequence
  chemically synthesized
cggctgcccgggagcggcga

SEQ ID NO: 11355 - DNA, 20 bp, Artificial Sequence
  chemically synthesized
ggctgcccgggagcggcgac

SEQ ID NO: 11356 - DNA, 20 bp, Artificial Sequence
  chemically synthesized
ctgcccgggagcggcgacgg

SEQ ID NO: 11357 - DNA, 20 bp, Artificial Sequence
  chemically synthesized
cccgggagcggcgacgggag

SEQ ID NO: 11358 - DNA, 20 bp, Artificial Sequence
  chemically synthesized
agcggcgacgggagcagctg

SEQ ID NO: 11359 - DNA, 20 bp, Artificial Sequence
  chemically synthesized
ggcgacgggagcagctgcgg

SEQ ID NO: 11360 - DNA, 20 bp, Artificial Sequence
  chemically synthesized
gacgggagcagctgcggcag

SEQ ID NO: 11361 - DNA, 20 bp, Artificial Sequence
  chemically synthesized
acgggagcagctgcggcagt

SEQ ID NO: 11362 - DNA, 20 bp, Artificial Sequence
  chemically synthesized
cgggagcagctgcggcagtg

SEQ ID NO: 11363 - DNA, 20 bp, Artificial Sequence
  chemically synthesized
gggagcagctgcggcagtgg

SEQ ID NO: 11364 - DNA, 20 bp, Artificial Sequence
  chemically synthesized
ggagcagctgcggcagtggg

SEQ ID NO: 11365 - DNA, 20 bp, Artificial Sequence
  chemically synthesized
agctgcggcagtggggggcg

SEQ ID NO: 11366 - DNA, 20 bp, Artificial Sequence
  chemically synthesized
gctgcggcagtggggggcgc

SEQ ID NO: 11367 - DNA, 20 bp, Artificial Sequence
  chemically synthesized
gcggcagtggggggcgcggg

SEQ ID NO: 11368 - DNA, 20 bp, Artificial Sequence
  chemically synthesized
cggcagtggggggcgcgggc

SEQ ID NO: 11369 - DNA, 20 bp, Artificial Sequence
  chemically synthesized
ggggggcgcgggcgggcgcc

SEQ ID NO: 11370 - DNA, 20 bp, Artificial Sequence
  chemically synthesized
gcgcgggcgggcgccgagcc

SEQ ID NO: 11371 - DNA, 20 bp, Artificial Sequence
  chemically synthesized
gcgggcgccgagcctggccc

SEQ ID NO: 11372 - DNA, 20 bp, Artificial Sequence
  chemically synthesized
gggcgccgagcctggccccg

SEQ ID NO: 11373 - DNA, 20 bp, Artificial Sequence
  chemically synthesized
gcgccgagcctggccccgga

SEQ ID NO: 11374 - DNA, 20 bp, Artificial Sequence
  chemically synthesized
gcgcccgcaccgtccgcttc

SEQ ID NO: 11375 - DNA, 20 bp, Artificial Sequence
  chemically synthesized
tccgcttcgagcgcgccgcc

SEQ ID NO: 11376 - DNA, 20 bp, Artificial Sequence
  chemically synthesized
cgagcgcgccgccgagttcc

SEQ ID NO: 11377 - DNA, 20 bp, Artificial Sequence
  chemically synthesized
gcgcgccgccgagttcctgg

SEQ ID NO: 11378 - DNA, 20 bp, Artificial Sequence
  chemically synthesized
cgagttcctggcggcctgtg

SEQ ID NO: 11379 - DNA, 20 bp, Artificial Sequence
  chemically synthesized
gagttcctggcggcctgtgc

SEQ ID NO: 11380 - DNA, 20 bp, Artificial Sequence
  chemically synthesized
ttcctggcggcctgtgcggg

SEQ ID NO: 11381 - DNA, 20 bp, Artificial Sequence
  chemically synthesized
ggcctgtgcgggcggcgacc

SEQ ID NO: 11382 - DNA, 20 bp, Artificial Sequence
  chemically synthesized
gtgcgggcggcgacctggac

SEQ ID NO: 11383 - DNA, 20 bp, Artificial Sequence
  chemically synthesized
tgcgggcggcgacctggacg

SEQ ID NO: 11384 - DNA, 20 bp, Artificial Sequence
  chemically synthesized
atgctgcgcgccgccgaccc

SEQ ID NO: 11385 - DNA, 20 bp, Artificial Sequence
  chemically synthesized
cgcgccgccgaccctggccc

SEQ ID NO: 11386 - DNA, 20 bp, Artificial Sequence
  chemically synthesized
ccgaccctggccccggcgcc

SEQ ID NO: 11387 - DNA, 20 bp, Artificial Sequence
  chemically synthesized
gccgcccgcccgcgccgtgc

SEQ ID NO: 11388 - DNA, 20 bp, Artificial Sequence
  chemically synthesized
ctggactccaccaacgccga

SEQ ID NO: 11389 - DNA, 20 bp, Artificial Sequence
  chemically synthesized
tccaccaacgccgacggtat

SEQ ID NO: 11390 - DNA, 20 bp, Artificial Sequence
  chemically synthesized
acggtatcagcgccctgcac

SEQ ID NO: 11391 - DNA, 20 bp, Artificial Sequence
  chemically synthesized
cggtatcagcgccctgcacc

SEQ ID NO: 11392 - DNA, 20 bp, Artificial Sequence
  chemically synthesized
atcagcgccctgcaccaggt

SEQ ID NO: 11393 - DNA, 20 bp, Artificial Sequence
  chemically synthesized
ccaggtcagcgccccccgcc

SEQ ID NO: 11394 - DNA, 20 bp, Artificial Sequence
  chemically synthesized
gccccccgcccggcgtctcc

SEQ ID NO: 11395 - DNA, 20 bp, Artificial Sequence
  chemically synthesized
ccccccgcccggcgtctccc

SEQ ID NO: 11396 - DNA, 20 bp, Artificial Sequence
  chemically synthesized
cccccgcccggcgtctcccg

SEQ ID NO: 11397 - DNA, 20 bp, Artificial Sequence
  chemically synthesized
cgcccggcgtctcccggggc

SEQ ID NO: 11398 - DNA, 20 bp, Artificial Sequence
  chemically synthesized
gcccggcgtctcccggggcc

SEQ ID NO: 11399 - DNA, 20 bp, Artificial Sequence
  chemically synthesized
ccaccctctgctgcgccacc

SEQ ID NO: 11400 - DNA, 20 bp, Artificial Sequence
  chemically synthesized
caccctctgctgcgccacct

SEQ ID NO: 11401 - DNA, 20 bp, Artificial Sequence
  chemically synthesized
accctctgctgcgccacctg

SEQ ID NO: 11402 - DNA, 20 bp, Artificial Sequence
  chemically synthesized
gcatcctccttccccgttgc

SEQ ID NO: 11403 - DNA, 20 bp, Artificial Sequence
  chemically synthesized
tcgatccgccccgtcgttcc

SEQ ID NO: 11404 - DNA, 20 bp, Artificial Sequence
  chemically synthesized
cgccccgtcgttcctggccc

SEQ ID NO: 11405 - DNA, 20 bp, Artificial Sequence
  chemically synthesized
gccccgtcgttcctggccct

SEQ ID NO: 11406 - DNA, 20 bp, Artificial Sequence
  chemically synthesized
cctatgctgacaccccgtcc

SEQ ID NO: 11407 - DNA, 20 bp, Artificial Sequence
  chemically synthesized
cgaccaccccacttccgaat

SEQ ID NO: 11408 - DNA, 20 bp, Artificial Sequence
  chemically synthesized
accaccccacttccgaattg

SEQ ID NO: 11409 - DNA, 20 bp, Artificial Sequence
  chemically synthesized
cgaattggagccgcttcaac

SEQ ID NO: 11410 - DNA, 20 bp, Artificial Sequence
  chemically synthesized
ggagccgcttcaactggccc

SEQ ID NO: 11411 - DNA, 20 bp, Artificial Sequence
  chemically synthesized
gagccgcttcaactggccct

SEQ ID NO: 11412 - DNA, 20 bp, Artificial Sequence
  chemically synthesized
gcttcaactggccctgggct

SEQ ID NO: 11413 - DNA, 20 bp, Artificial Sequence
  chemically synthesized
ctgtgctgaccactctgccc

SEQ ID NO: 11414 - DNA, 20 bp, Artificial Sequence
  chemically synthesized
tgtgctgaccactctgcccc

SEQ ID NO: 11415 - DNA, 20 bp, Artificial Sequence
  chemically synthesized
cgacctactctcttccgcat

SEQ ID NO: 11416 - DNA, 20 bp, Artificial Sequence
  chemically synthesized
acctactctcttccgcattg

SEQ ID NO: 11417 - DNA, 20 bp, Artificial Sequence
  chemically synthesized
cgcattggagtcgctttaac

SEQ ID NO: 11418 - DNA, 20 bp, Artificial Sequence
  chemically synthesized
ggagtcgctttaactggccc

SEQ ID NO: 11419 - DNA, 20 bp, Artificial Sequence
  chemically synthesized
gctttaactggccctggctt

SEQ ID NO: 11420 - DNA, 20 bp, Artificial Sequence
  chemically synthesized
ttaactggccctggctttgg

SEQ ID NO: 11421 - DNA, 20 bp, Artificial Sequence
  chemically synthesized
gcagcctgtgctgacccatg

SEQ ID NO: 11422 - DNA, 20 bp, Artificial Sequence
  chemically synthesized
acttcccctcttccgatgtt

SEQ ID NO: 11423 - DNA, 20 bp, Artificial Sequence
  chemically synthesized
cttccgatgttgagcccctc

SEQ ID NO: 11424 - DNA, 20 bp, Artificial Sequence
  chemically synthesized
cgatgttgagcccctccagc

SEQ ID NO: 11425 - DNA, 20 bp, Artificial Sequence
  chemically synthesized
tgagcccctccagccggtcc

SEQ ID NO: 11426 - DNA, 20 bp, Artificial Sequence
  chemically synthesized
ccctgccctctcctgaacct

SEQ ID NO: 11427 - DNA, 20 bp, Artificial Sequence
  chemically synthesized
gccctctcctgaacctgagc

SEQ ID NO: 11428 - DNA, 20 bp, Artificial Sequence
  chemically synthesized
tgaacctgagccagctccca

SEQ ID NO: 11429 - DNA, 20 bp, Artificial Sequence
  chemically synthesized
ctgagccagctcccatagct

SEQ ID NO: 11430 - DNA, 20 bp, Artificial Sequence
  chemically synthesized
ccagctcccatagctcagtc

SEQ ID NO: 11431 - DNA, 20 bp, Artificial Sequence
  chemically synthesized
ctcagtctggtctatctgcc

SEQ ID NO: 11432 - DNA, 20 bp, Artificial Sequence
  chemically synthesized
ctggtctatctgcctggccc

SEQ ID NO: 11433 - DNA, 20 bp, Artificial Sequence
  chemically synthesized
gctgccctcctctcgccccc

SEQ ID NO: 11434 - DNA, 20 bp, Artificial Sequence
  chemically synthesized
gagtgcccttgctgtgccgc

SEQ ID NO: 11435 - DNA, 20 bp, Artificial Sequence
  chemically synthesized
aacgctgccgtctctctcct

SEQ ID NO: 11436 - DNA, 20 bp, Artificial Sequence
  chemically synthesized
tgccgtctctctcctgagtc

SEQ ID NO: 11437 - DNA, 20 bp, Artificial Sequence
  chemically synthesized
tcctgagtccggaccacttt

SEQ ID NO: 11438 - DNA, 20 bp, Artificial Sequence
  chemically synthesized
cggaccactttgagctctac

SEQ ID NO: 11439 - DNA, 20 bp, Artificial Sequence
  chemically synthesized
actggcttctgcgccgcctc

SEQ ID NO: 11440 - DNA, 20 bp, Artificial Sequence
  chemically synthesized
ggcccactgtttccccttcc

SEQ ID NO: 11441 - DNA, 20 bp, Artificial Sequence
  chemically synthesized
gcccactgtttccccttccc

SEQ ID NO: 11442 - DNA, 20 bp, Artificial Sequence
  chemically synthesized
cactgtttccccttcccagg

SEQ ID NO: 11443 - DNA, 20 bp, Artificial Sequence
  chemically synthesized
actgtttccccttcccaggc

SEQ ID NO: 11444 - DNA, 20 bp, Artificial Sequence
  chemically synthesized
ctgacctgcattctctcccc

SEQ ID NO: 11445 - DNA, 20 bp, Artificial Sequence
  chemically synthesized
tgacctgcattctctcccct

SEQ ID NO: 11446 - DNA, 20 bp, Artificial Sequence
  chemically synthesized
cctgtgccgctttctgtctg

SEQ ID NO: 11447 - DNA, 20 bp, Artificial Sequence
  chemically synthesized
cgctttctgtctgcagcttg

SEQ ID NO: 11448 - DNA, 20 bp, Artificial Sequence
  chemically synthesized
tctgtctgcagcttgtggcc

SEQ ID NO: 11449 - DNA, 20 bp, Artificial Sequence
  chemically synthesized
ctgtctgcagcttgtggcct

SEQ ID NO: 11450 - DNA, 20 bp, Artificial Sequence
  chemically synthesized
tgtggcctgggtcacctcta

SEQ ID NO: 11451 - DNA, 20 bp, Artificial Sequence
  chemically synthesized
gcctgggtcacctctacggc

SEQ ID NO: 11452 - DNA, 20 bp, Artificial Sequence
  chemically synthesized
ggtcacctctacggctggcc

SEQ ID NO: 11453 - DNA, 20 bp, Artificial Sequence
  chemically synthesized
tccttccctgccgcctcctt

SEQ ID NO: 11454 - DNA, 20 bp, Artificial Sequence
  chemically synthesized
ccttccctgccgcctccttc

SEQ ID NO: 11455 - DNA, 20 bp, Artificial Sequence
  chemically synthesized
tctctgctgtgttgctgccc

SEQ ID NO: 11456 - DNA, 20 bp, Artificial Sequence
  chemically synthesized
ctctgctgtgttgctgccca

SEQ ID NO: 11457 - DNA, 20 bp, Artificial Sequence
  chemically synthesized
ctgcccaaggatgctctttc

SEQ ID NO: 11458 - DNA, 20 bp, Artificial Sequence
  chemically synthesized
gcccaaggatgctctttccg

SEQ ID NO: 11459 - DNA, 20 bp, Artificial Sequence
  chemically synthesized
tttccggagcacttccttct

SEQ ID NO: 11460 - DNA, 20 bp, Artificial Sequence
  chemically synthesized
tgcaccacgtgatgtcctct

SEQ ID NO: 11461 - DNA, 20 bp, Artificial Sequence
  chemically synthesized
accacgtgatgtcctctgag

SEQ ID NO: 11462 - DNA, 20 bp, Artificial Sequence
  chemically synthesized
gagcggatcctccccgtgtc

SEQ ID NO: 11463 - DNA, 20 bp, Artificial Sequence
  chemically synthesized
agcggatcctccccgtgtct

SEQ ID NO: 11464 - DNA, 20 bp, Artificial Sequence
  chemically synthesized
ccccgtgtctgggtcctctc

SEQ ID NO: 11465 - DNA, 20 bp, Artificial Sequence
  chemically synthesized
cccgtgtctgggtcctctcc

SEQ ID NO: 11466 - DNA, 20 bp, Artificial Sequence
  chemically synthesized
cccatgccgtcttcactcgc

SEQ ID NO: 11467 - DNA, 20 bp, Artificial Sequence
  chemically synthesized
ccatgccgtcttcactcgct

SEQ ID NO: 11468 - DNA, 20 bp, Artificial Sequence
  chemically synthesized
ttcccttttccttctccttc

SEQ ID NO: 11469 - DNA, 20 bp, Artificial Sequence
  chemically synthesized
tcccttttccttctccttct

SEQ ID NO: 11470 - DNA, 20 bp, Artificial Sequence
  chemically synthesized
cccttttccttctccttctg

SEQ ID NO: 11471 - DNA, 20 bp, Artificial Sequence
  chemically synthesized
ctgtgccatctctcgtttct

SEQ ID NO: 11472 - DNA, 20 bp, Artificial Sequence
  chemically synthesized
tgtgccatctctcgtttctt

SEQ ID NO: 11473 - DNA, 20 bp, Artificial Sequence
  chemically synthesized
ccatctctcgtttcttagga

SEQ ID NO: 11474 - DNA, 20 bp, Artificial Sequence
  chemically synthesized
cttaggatggccttctccga

SEQ ID NO: 11475 - DNA, 20 bp, Artificial Sequence
  chemically synthesized
cgtcccgcctccccttcttg

SEQ ID NO: 11476 - DNA, 20 bp, Artificial Sequence
  chemically synthesized
gtcccgcctccccttcttgt

SEQ ID NO: 11477 - DNA, 20 bp, Artificial Sequence
  chemically synthesized
ctgcatcatcaccgtttttc

SEQ ID NO: 11478 - DNA, 20 bp, Artificial Sequence
  chemically synthesized
cgtttttctggacaacccca

SEQ ID NO: 11479 - DNA, 20 bp, Artificial Sequence
  chemically synthesized
cccaaagtaccccgtctccc

SEQ ID NO: 11480 - DNA, 20 bp, Artificial Sequence
  chemically synthesized
gtaccccgtctccctggctt

SEQ ID NO: 11481 - DNA, 20 bp, Artificial Sequence
  chemically synthesized
atcctcttgctttctttgcc

SEQ ID NO: 11482 - DNA, 20 bp, Artificial Sequence
  chemically synthesized
ctggacaccccgttctcctg

SEQ ID NO: 11483 - DNA, 20 bp, Artificial Sequence
  chemically synthesized
accccgttctcctgtggatt

SEQ ID NO: 11484 - DNA, 20 bp, Artificial Sequence
  chemically synthesized
ccccgttctcctgtggattc

SEQ ID NO: 11485 - DNA, 20 bp, Artificial Sequence
  chemically synthesized
cacctctcactcctttcatt

SEQ ID NO: 11486 - DNA, 20 bp, Artificial Sequence
  chemically synthesized
acctctcactcctttcattt

SEQ ID NO: 11487 - DNA, 20 bp, Artificial Sequence
  chemically synthesized
tctcactcctttcatttggg

SEQ ID NO: 11488 - DNA, 20 bp, Artificial Sequence
  chemically synthesized
ccctaccccccttacctctc

SEQ ID NO: 11489 - DNA, 20 bp, Artificial Sequence
  chemically synthesized
cttacctctctagtctgtgc

SEQ ID NO: 11490 - DNA, 20 bp, Artificial Sequence
  chemically synthesized
ctagtctgtgctagctcttc

SEQ ID NO: 11491 - DNA, 20 bp, Artificial Sequence
  chemically synthesized
gctcttccagccccctgtca

SEQ ID NO: 11492 - DNA, 20 bp, Artificial Sequence
  chemically synthesized
ccccctgtcatggcatcttc

SEQ ID NO: 11493 - DNA, 20 bp, Artificial Sequence
  chemically synthesized
cccctgtcatggcatcttcc

SEQ ID NO: 11494 - DNA, 20 bp, Artificial Sequence
  chemically synthesized
ccctgtcatggcatcttcca

SEQ ID NO: 11495 - DNA, 20 bp, Artificial Sequence
  chemically synthesized
cctgtcatggcatcttccag

SEQ ID NO: 11496 - DNA, 20 bp, Artificial Sequence
  chemically synthesized
atggcatcttccaggggtcc

SEQ ID NO: 11497 - DNA, 20 bp, Artificial Sequence
  chemically synthesized
ggcatcttccaggggtccga

SEQ ID NO: 11498 - DNA, 20 bp, Artificial Sequence
  chemically synthesized
cttccaggggtccgagagct

SEQ ID NO: 11499 - DNA, 20 bp, Artificial Sequence
  chemically synthesized
caggggtccgagagctcagc

SEQ ID NO: 11500 - DNA, 20 bp, Artificial Sequence
  chemically synthesized
ctagtcttcttcctccaacc

SEQ ID NO: 11501 - DNA, 20 bp, Artificial Sequence
  chemically synthesized
tagtcttcttcctccaaccc

SEQ ID NO: 11502 - DNA, 20 bp, Artificial Sequence
  chemically synthesized
ccgggcccctatgtccactt

SEQ ID NO: 11503 - DNA, 20 bp, Artificial Sequence
  chemically synthesized
cgggcccctatgtccacttc

SEQ ID NO: 11504 - DNA, 20 bp, Artificial Sequence
  chemically synthesized
cccctatgtccacttcagga

SEQ ID NO: 11505 - DNA, 20 bp, Artificial Sequence
  chemically synthesized
gacagcatgtttgctgcctc

SEQ ID NO: 11506 - DNA, 20 bp, Artificial Sequence
  chemically synthesized
acagcatgtttgctgcctcc

SEQ ID NO: 11507 - DNA, 20 bp, Artificial Sequence
  chemically synthesized
cagcatgtttgctgcctcca

SEQ ID NO: 11508 - DNA, 20 bp, Artificial Sequence
  chemically synthesized
tccagggatcctgtgtcccc

SEQ ID NO: 11509 - DNA, 20 bp, Artificial Sequence
  chemically synthesized
gggatcctgtgtccccgagc

SEQ ID NO: 11510 - DNA, 20 bp, Artificial Sequence
  chemically synthesized
ggatcctgtgtccccgagct

SEQ ID NO: 11511 - DNA, 20 bp, Artificial Sequence
  chemically synthesized
ctgggaccaccttatattcc

SEQ ID NO: 11512 - DNA, 20 bp, Artificial Sequence
  chemically synthesized
tgggaccaccttatattccc

SEQ ID NO: 11513 - DNA, 20 bp, Artificial Sequence
  chemically synthesized
gggaccaccttatattccca

SEQ ID NO: 11514 - DNA, 20 bp, Artificial Sequence
  chemically synthesized
ccaccttatattcccagggc

SEQ ID NO: 11515 - DNA, 20 bp, Artificial Sequence
  chemically synthesized
attcccagggccggttaatg

SEQ ID NO: 11516 - DNA, 20 bp, Artificial Sequence
  chemically synthesized
agggccggttaatgtggctc

SEQ ID NO: 11517 - DNA, 20 bp, Artificial Sequence
  chemically synthesized
ggttaatgtggctctggttc

SEQ ID NO: 11518 - DNA, 20 bp, Artificial Sequence
  chemically synthesized
gttaatgtggctctggttct

SEQ ID NO: 11519 - DNA, 20 bp, Artificial Sequence
  chemically synthesized
tatctgtcccctccacccca

SEQ ID NO: 11520 - DNA, 20 bp, Artificial Sequence
  chemically synthesized
ctgtcccctccaccccacag

SEQ ID NO: 11521 - DNA, 20 bp, Artificial Sequence
  chemically synthesized
tgtcccctccaccccacagt

SEQ ID NO: 11522 - DNA, 20 bp, Artificial Sequence
  chemically synthesized
gtcccctccaccccacagtg

SEQ ID NO: 11523 - DNA, 20 bp, Artificial Sequence
  chemically synthesized
ccaccccacagtggggccac

SEQ ID NO: 11524 - DNA, 20 bp, Artificial Sequence
  chemically synthesized
caccccacagtggggccact

SEQ ID NO: 11525 - DNA, 20 bp, Artificial Sequence
  chemically synthesized
accccacagtggggccacta

SEQ ID NO: 11526 - DNA, 20 bp, Artificial Sequence
  chemically synthesized
cacagtggggccactaggga

SEQ ID NO: 11527 - DNA, 20 bp, Artificial Sequence
  chemically synthesized
acagtggggccactagggac

SEQ ID NO: 11528 - DNA, 20 bp, Artificial Sequence
  chemically synthesized
ggggccactagggacaggat

SEQ ID NO: 11529 - DNA, 20 bp, Artificial Sequence
  chemically synthesized
actagggacaggattggtga

SEQ ID NO: 11530 - DNA, 20 bp, Artificial Sequence
  chemically synthesized
ggacaggattggtgacagaa

SEQ ID NO: 11531 - DNA, 20 bp, Artificial Sequence
  chemically synthesized
tgacagaaaagccccatcct

SEQ ID NO: 11532 - DNA, 20 bp, Artificial Sequence
  chemically synthesized
gacagaaaagccccatcctt

SEQ ID NO: 11533 - DNA, 20 bp, Artificial Sequence
  chemically synthesized
tccttaggcctcctccttcc

SEQ ID NO: 11534 - DNA, 20 bp, Artificial Sequence
  chemically synthesized
ccttcctagtctcctgatat

SEQ ID NO: 11535 - DNA, 20 bp, Artificial Sequence
  chemically synthesized
cttcctagtctcctgatatt

SEQ ID NO: 11536 - DNA, 20 bp, Artificial Sequence
  chemically synthesized
gtctaacccccacctcctgt

SEQ ID NO: 11537 - DNA, 20 bp, Artificial Sequence
  chemically synthesized
tctaacccccacctcctgtt

SEQ ID NO: 11538 - DNA, 20 bp, Artificial Sequence
  chemically synthesized
aacccccacctcctgttagg

SEQ ID NO: 11539 - DNA, 20 bp, Artificial Sequence
  chemically synthesized
tgttaggcagattccttatc

SEQ ID NO: 11540 - DNA, 20 bp, Artificial Sequence
  chemically synthesized
ggtgacacacccccatttcc

SEQ ID NO: 11541 - DNA, 20 bp, Artificial Sequence
  chemically synthesized
tgacacacccccatttcctg

SEQ ID NO: 11542 - DNA, 20 bp, Artificial Sequence
  chemically synthesized
ggagccatctctctccttgc

SEQ ID NO: 11543 - DNA, 20 bp, Artificial Sequence
  chemically synthesized
ctctccttgccagaacctct

SEQ ID NO: 11544 - DNA, 20 bp, Artificial Sequence
  chemically synthesized
tctccttgccagaacctcta

SEQ ID NO: 11545 - DNA, 20 bp, Artificial Sequence
  chemically synthesized
cctctaaggtttgcttacga

SEQ ID NO: 11546 - DNA, 20 bp, Artificial Sequence
  chemically synthesized
tctaaggtttgcttacgatg

SEQ ID NO: 11547 - DNA, 20 bp, Artificial Sequence
  chemically synthesized
aggtttgcttacgatggagc

SEQ ID NO: 11548 - DNA, 20 bp, Artificial Sequence
  chemically synthesized
gtttgcttacgatggagcca

SEQ ID NO: 11549 - DNA, 20 bp, Artificial Sequence
  chemically synthesized
ttgcttacgatggagccaga

SEQ ID NO: 11550 - DNA, 20 bp, Artificial Sequence
  chemically synthesized
tgcttacgatggagccagag

SEQ ID NO: 11551 - DNA, 20 bp, Artificial Sequence
  chemically synthesized
gatggagccagagaggatcc

SEQ ID NO: 11552 - DNA, 20 bp, Artificial Sequence
  chemically synthesized
atggagccagagaggatcct

SEQ ID NO: 11553 - DNA, 20 bp, Artificial Sequence
  chemically synthesized
ggagccagagaggatcctgg

SEQ ID NO: 11554 - DNA, 20 bp, Artificial Sequence
  chemically synthesized
gagccagagaggatcctggg

SEQ ID NO: 11555 - DNA, 20 bp, Artificial Sequence
  chemically synthesized
agccagagaggatcctggga

SEQ ID NO: 11556 - DNA, 20 bp, Artificial Sequence
  chemically synthesized
ccagagaggatcctgggagg

SEQ ID NO: 11557 - DNA, 20 bp, Artificial Sequence
  chemically synthesized
agagaggatcctgggaggga

SEQ ID NO: 11558 - DNA, 20 bp, Artificial Sequence
  chemically synthesized
ggatcctgggagggagagct

SEQ ID NO: 11559 - DNA, 20 bp, Artificial Sequence
  chemically synthesized
tcctgggagggagagcttgg

SEQ ID NO: 11560 - DNA, 20 bp, Artificial Sequence
  chemically synthesized
cctgggagggagagcttggc

SEQ ID NO: 11561 - DNA, 20 bp, Artificial Sequence
  chemically synthesized
ctgggagggagagcttggca

SEQ ID NO: 11562 - DNA, 20 bp, Artificial Sequence
  chemically synthesized
tgggagggagagcttggcag

SEQ ID NO: 11563 - DNA, 20 bp, Artificial Sequence
  chemically synthesized
gggagggagagcttggcagg

SEQ ID NO: 11564 - DNA, 20 bp, Artificial Sequence
  chemically synthesized
agggagagcttggcaggggg

SEQ ID NO: 11565 - DNA, 20 bp, Artificial Sequence
  chemically synthesized
gggagagcttggcagggggt

SEQ ID NO: 11566 - DNA, 20 bp, Artificial Sequence
  chemically synthesized
gagagcttggcagggggtgg

SEQ ID NO: 11567 - DNA, 20 bp, Artificial Sequence
  chemically synthesized
agagcttggcagggggtggg

SEQ ID NO: 11568 - DNA, 20 bp, Artificial Sequence
  chemically synthesized
gagcttggcagggggtggga

SEQ ID NO: 11569 - DNA, 20 bp, Artificial Sequence
  chemically synthesized
cttggcagggggtgggaggg

SEQ ID NO: 11570 - DNA, 20 bp, Artificial Sequence
  chemically synthesized
ttggcagggggtgggaggga

SEQ ID NO: 11571 - DNA, 20 bp, Artificial Sequence
  chemically synthesized
tggcagggggtgggagggaa

SEQ ID NO: 11572 - DNA, 20 bp, Artificial Sequence
  chemically synthesized
ggcagggggtgggagggaag

SEQ ID NO: 11573 - DNA, 20 bp, Artificial Sequence
  chemically synthesized
gcagggggtgggagggaagg

SEQ ID NO: 11574 - DNA, 20 bp, Artificial Sequence
  chemically synthesized
cagggggtgggagggaaggg

SEQ ID NO: 11575 - DNA, 20 bp, Artificial Sequence
  chemically synthesized
agggggtgggagggaagggg

SEQ ID NO: 11576 - DNA, 20 bp, Artificial Sequence
  chemically synthesized
ggggggatgcgtgacctgcc

SEQ ID NO: 11577 - DNA, 20 bp, Artificial Sequence
  chemically synthesized
tgcgtgacctgcccggttct

SEQ ID NO: 11578 - DNA, 20 bp, Artificial Sequence
  chemically synthesized
gtgacctgcccggttctcag

SEQ ID NO: 11579 - DNA, 20 bp, Artificial Sequence
  chemically synthesized
caccctgcgctaccctctcc

SEQ ID NO: 11580 - DNA, 20 bp, Artificial Sequence
  chemically synthesized
gctaccctctcccagaacct

SEQ ID NO: 11581 - DNA, 20 bp, Artificial Sequence
  chemically synthesized
gaacctgagctgctctgacg

SEQ ID NO: 11582 - DNA, 20 bp, Artificial Sequence
  chemically synthesized
gctgctctgacgcggccgtc

SEQ ID NO: 11583 - DNA, 20 bp, Artificial Sequence
  chemically synthesized
ctggtgcgtttcactgatcc

SEQ ID NO: 11584 - DNA, 20 bp, Artificial Sequence
  chemically synthesized
tttcactgatcctggtgctg

SEQ ID NO: 11585 - DNA, 20 bp, Artificial Sequence
  chemically synthesized
gcagcttccttacacttccc

SEQ ID NO: 11586 - DNA, 20 bp, Artificial Sequence
  chemically synthesized
agcttccttacacttcccaa

SEQ ID NO: 11587 - DNA, 20 bp, Artificial Sequence
  chemically synthesized
gcttccttacacttcccaag

SEQ ID NO: 11588 - DNA, 20 bp, Artificial Sequence
  chemically synthesized
ttccttacacttcccaagag

SEQ ID NO: 11589 - DNA, 20 bp, Artificial Sequence
  chemically synthesized
cttacacttcccaagaggag

SEQ ID NO: 11590 - DNA, 20 bp, Artificial Sequence
  chemically synthesized
acacttcccaagaggagaag

SEQ ID NO: 11591 - DNA, 20 bp, Artificial Sequence
  chemically synthesized
tcccaagaggagaagcagtt

SEQ ID NO: 11592 - DNA, 20 bp, Artificial Sequence
  chemically synthesized
gcagtttggaaaaacaaaat

SEQ ID NO: 11593 - DNA, 20 bp, Artificial Sequence
  chemically synthesized
tggaaaaacaaaatcagaat

SEQ ID NO: 11594 - DNA, 20 bp, Artificial Sequence
  chemically synthesized
aaaacaaaatcagaataagt

SEQ ID NO: 11595 - DNA, 20 bp, Artificial Sequence
  chemically synthesized
aatcagaataagttggtcct

SEQ ID NO: 11596 - DNA, 20 bp, Artificial Sequence
  chemically synthesized
ttggtcctgagttctaactt

SEQ ID NO: 11597 - DNA, 20 bp, Artificial Sequence
  chemically synthesized
actttggctcttcacctttc

SEQ ID NO: 11598 - DNA, 20 bp, Artificial Sequence
  chemically synthesized
tatattgttcctccgtgcgt

SEQ ID NO: 11599 - DNA, 20 bp, Artificial Sequence
  chemically synthesized
cgtgcgtcagttttacctgt

SEQ ID NO: 11600 - DNA, 20 bp, Artificial Sequence
  chemically synthesized
gtcagttttacctgtgagat

SEQ ID NO: 11601 - DNA, 20 bp, Artificial Sequence
  chemically synthesized
tcagttttacctgtgagata

SEQ ID NO: 11602 - DNA, 20 bp, Artificial Sequence
  chemically synthesized
ttttacctgtgagataaggc

SEQ ID NO: 11603 - DNA, 20 bp, Artificial Sequence
  chemically synthesized
tacctgtgagataaggccag

SEQ ID NO: 11604 - DNA, 20 bp, Artificial Sequence
  chemically synthesized
tgtgagataaggccagtagc

SEQ ID NO: 11605 - DNA, 20 bp, Artificial Sequence
  chemically synthesized
gccagtagccagccccgtcc

SEQ ID NO: 11606 - DNA, 20 bp, Artificial Sequence
  chemically synthesized
agtagccagccccgtcctgg

SEQ ID NO: 11607 - DNA, 20 bp, Artificial Sequence
  chemically synthesized
gtagccagccccgtcctggc

SEQ ID NO: 11608 - DNA, 20 bp, Artificial Sequence
  chemically synthesized
tagccagccccgtcctggca

SEQ ID NO: 11609 - DNA, 20 bp, Artificial Sequence
  chemically synthesized
gccccgtcctggcagggctg

SEQ ID NO: 11610 - DNA, 20 bp, Artificial Sequence
  chemically synthesized
cgtcctggcagggctgtggt

SEQ ID NO: 11611 - DNA, 20 bp, Artificial Sequence
  chemically synthesized
gtcctggcagggctgtggtg

SEQ ID NO: 11612 - DNA, 20 bp, Artificial Sequence
  chemically synthesized
cctggcagggctgtggtgag

SEQ ID NO: 11613 - DNA, 20 bp, Artificial Sequence
  chemically synthesized
ctggcagggctgtggtgagg

SEQ ID NO: 11614 - DNA, 20 bp, Artificial Sequence
  chemically synthesized
tggcagggctgtggtgagga

SEQ ID NO: 11615 - DNA, 20 bp, Artificial Sequence
  chemically synthesized
ggcagggctgtggtgaggag

SEQ ID NO: 11616 - DNA, 20 bp, Artificial Sequence
  chemically synthesized
gcagggctgtggtgaggagg

SEQ ID NO: 11617 - DNA, 20 bp, Artificial Sequence
  chemically synthesized
cagggctgtggtgaggaggg

SEQ ID NO: 11618 - DNA, 20 bp, Artificial Sequence
  chemically synthesized
tgaggaggggggtgtccgtg

SEQ ID NO: 11619 - DNA, 20 bp, Artificial Sequence
  chemically synthesized
gtgtggaaaactccctttgt

SEQ ID NO: 11620 - DNA, 20 bp, Artificial Sequence
  chemically synthesized
gaaaactccctttgtgagaa

SEQ ID NO: 11621 - DNA, 20 bp, Artificial Sequence
  chemically synthesized
tttgtgagaatggtgcgtcc

SEQ ID NO: 11622 - DNA, 20 bp, Artificial Sequence
  chemically synthesized
ttgtgagaatggtgcgtcct

SEQ ID NO: 11623 - DNA, 20 bp, Artificial Sequence
  chemically synthesized
ggtgcgtcctaggtgttcac

SEQ ID NO: 11624 - DNA, 20 bp, Artificial Sequence
  chemically synthesized
gtgcgtcctaggtgttcacc

SEQ ID NO: 11625 - DNA, 20 bp, Artificial Sequence
  chemically synthesized
cctaggtgttcaccaggtcg

SEQ ID NO: 11626 - DNA, 20 bp, Artificial Sequence
  chemically synthesized
tctccatccttctttcctta

SEQ ID NO: 11627 - DNA, 20 bp, Artificial Sequence
  chemically synthesized
tccatccttctttccttaaa

SEQ ID NO: 11628 - DNA, 20 bp, Artificial Sequence
  chemically synthesized
ttctttccttaaagagtccc

SEQ ID NO: 11629 - DNA, 20 bp, Artificial Sequence
  chemically synthesized
aaagagtccccagtgctatc

SEQ ID NO: 11630 - DNA, 20 bp, Artificial Sequence
  chemically synthesized
aagagtccccagtgctatct

SEQ ID NO: 11631 - DNA, 20 bp, Artificial Sequence
  chemically synthesized
ctgggacatattcctccgcc

SEQ ID NO: 11632 - DNA, 20 bp, Artificial Sequence
  chemically synthesized
gggacatattcctccgccca

SEQ ID NO: 11633 - DNA, 20 bp, Artificial Sequence
  chemically synthesized
acatattcctccgcccagag

SEQ ID NO: 11634 - DNA, 20 bp, Artificial Sequence
  chemically synthesized
catattcctccgcccagagc

SEQ ID NO: 11635 - DNA, 20 bp, Artificial Sequence
  chemically synthesized
atattcctccgcccagagca

SEQ ID NO: 11636 - DNA, 20 bp, Artificial Sequence
  chemically synthesized
gagcagggtcccgcttccct

SEQ ID NO: 11637 - DNA, 20 bp, Artificial Sequence
  chemically synthesized
agcagggtcccgcttcccta

SEQ ID NO: 11638 - DNA, 20 bp, Artificial Sequence
  chemically synthesized
gcttccctaaggccctgctc

SEQ ID NO: 11639 - DNA, 20 bp, Artificial Sequence
  chemically synthesized
cttccctaaggccctgctct

SEQ ID NO: 11640 - DNA, 20 bp, Artificial Sequence
  chemically synthesized
aaggccctgctctgggcttc

SEQ ID NO: 11641 - DNA, 20 bp, Artificial Sequence
  chemically synthesized
aggccctgctctgggcttct

SEQ ID NO: 11642 - DNA, 20 bp, Artificial Sequence
  chemically synthesized
tgctctgggcttctgggttt

SEQ ID NO: 11643 - DNA, 20 bp, Artificial Sequence
  chemically synthesized
ggcttctgggtttgagtcct

SEQ ID NO: 11644 - DNA, 20 bp, Artificial Sequence
  chemically synthesized
tctgggtttgagtccttggc

SEQ ID NO: 11645 - DNA, 20 bp, Artificial Sequence
  chemically synthesized
gtttgagtccttggcaagcc

SEQ ID NO: 11646 - DNA, 20 bp, Artificial Sequence
  chemically synthesized
tttgagtccttggcaagccc

SEQ ID NO: 11647 - DNA, 20 bp, Artificial Sequence
  chemically synthesized
tgagtccttggcaagcccag

SEQ ID NO: 11648 - DNA, 20 bp, Artificial Sequence
  chemically synthesized
agtccttggcaagcccagga

SEQ ID NO: 11649 - DNA, 20 bp, Artificial Sequence
  chemically synthesized
gtccttggcaagcccaggag

SEQ ID NO: 11650 - DNA, 20 bp, Artificial Sequence
  chemically synthesized
gcaagcccaggagaggcgct

SEQ ID NO: 11651 - DNA, 20 bp, Artificial Sequence
  chemically synthesized
caagcccaggagaggcgctc

SEQ ID NO: 11652 - DNA, 20 bp, Artificial Sequence
  chemically synthesized
cgtccaccatctcatgcccc

SEQ ID NO: 11653 - DNA, 20 bp, Artificial Sequence
  chemically synthesized
gctctcctgccccttcccta

SEQ ID NO: 11654 - DNA, 20 bp, Artificial Sequence
  chemically synthesized
ctctcctgccccttccctac

SEQ ID NO: 11655 - DNA, 20 bp, Artificial Sequence
  chemically synthesized
tctcctgccccttccctaca

SEQ ID NO: 11656 - DNA, 20 bp, Artificial Sequence
  chemically synthesized
ctcctgccccttccctacag

SEQ ID NO: 11657 - DNA, 20 bp, Artificial Sequence
  chemically synthesized
cccttccctacaggggttcc

SEQ ID NO: 11658 - DNA, 20 bp, Artificial Sequence
  chemically synthesized
gggttcctggctctgctctt

SEQ ID NO: 11659 - DNA, 20 bp, Artificial Sequence
  chemically synthesized
ctggctctgctcttcagact

SEQ ID NO: 11660 - DNA, 20 bp, Artificial Sequence
  chemically synthesized
cccccttcccctgcatcccc

SEQ ID NO: 11661 - DNA, 20 bp, Artificial Sequence
  chemically synthesized
cccttcccctgcatccccca

SEQ ID NO: 11662 - DNA, 20 bp, Artificial Sequence
  chemically synthesized
ccttcccctgcatcccccag

SEQ ID NO: 11663 - DNA, 20 bp, Artificial Sequence
  chemically synthesized
cctgcatcccccagaggccc

SEQ ID NO: 11664 - DNA, 20 bp, Artificial Sequence
  chemically synthesized
ctgcatcccccagaggcccc

SEQ ID NO: 11665 - DNA, 20 bp, Artificial Sequence
  chemically synthesized
gaggccccaggccacctact

SEQ ID NO: 11666 - DNA, 20 bp, Artificial Sequence
  chemically synthesized
cccaggccacctacttggcc

SEQ ID NO: 11667 - DNA, 20 bp, Artificial Sequence
  chemically synthesized
ctacttggcctggaccccac

SEQ ID NO: 11668 - DNA, 20 bp, Artificial Sequence
  chemically synthesized
acttggcctggaccccacga

SEQ ID NO: 11669 - DNA, 20 bp, Artificial Sequence
  chemically synthesized
cttggcctggaccccacgag

SEQ ID NO: 11670 - DNA, 20 bp, Artificial Sequence
  chemically synthesized
gaccccacgagaggccaccc

SEQ ID NO: 11671 - DNA, 20 bp, Artificial Sequence
  chemically synthesized
gccaccccagccctgtctac

SEQ ID NO: 11672 - DNA, 20 bp, Artificial Sequence
  chemically synthesized
ccaccccagccctgtctacc

SEQ ID NO: 11673 - DNA, 20 bp, Artificial Sequence
  chemically synthesized
ctgtctaccaggctgccttt

SEQ ID NO: 11674 - DNA, 20 bp, Artificial Sequence
  chemically synthesized
tgtctaccaggctgcctttt

SEQ ID NO: 11675 - DNA, 20 bp, Artificial Sequence
  chemically synthesized
ctaccaggctgccttttggg

SEQ ID NO: 11676 - DNA, 20 bp, Artificial Sequence
  chemically synthesized
ggtggattctcctccaactg

SEQ ID NO: 11677 - DNA, 20 bp, Artificial Sequence
  chemically synthesized
gtggattctcctccaactgt

SEQ ID NO: 11678 - DNA, 20 bp, Artificial Sequence
  chemically synthesized
tggattctcctccaactgtg

SEQ ID NO: 11679 - DNA, 20 bp, Artificial Sequence
  chemically synthesized
ccaactgtggggtgactgct

SEQ ID NO: 11680 - DNA, 20 bp, Artificial Sequence
  chemically synthesized
tgcttggcaaactcactctt

SEQ ID NO: 11681 - DNA, 20 bp, Artificial Sequence
  chemically synthesized
gcttggcaaactcactcttc

SEQ ID NO: 11682 - DNA, 20 bp, Artificial Sequence
  chemically synthesized
cttggcaaactcactcttcg

SEQ ID NO: 11683 - DNA, 20 bp, Artificial Sequence
  chemically synthesized
actcactcttcggggtatcc

SEQ ID NO: 11684 - DNA, 20 bp, Artificial Sequence
  chemically synthesized
ctcactcttcggggtatccc

SEQ ID NO: 11685 - DNA, 20 bp, Artificial Sequence
  chemically synthesized
cactcttcggggtatcccag

SEQ ID NO: 11686 - DNA, 20 bp, Artificial Sequence
  chemically synthesized
actcttcggggtatcccagg

SEQ ID NO: 11687 - DNA, 20 bp, Artificial Sequence
  chemically synthesized
tcggggtatcccaggaggcc

SEQ ID NO: 11688 - DNA, 20 bp, Artificial Sequence
  chemically synthesized
ggggtatcccaggaggcctg

SEQ ID NO: 11689 - DNA, 20 bp, Artificial Sequence
  chemically synthesized
tcccaggaggcctggagcat

SEQ ID NO: 11690 - DNA, 20 bp, Artificial Sequence
  chemically synthesized
cccaggaggcctggagcatt

SEQ ID NO: 11691 - DNA, 20 bp, Artificial Sequence
  chemically synthesized
ccaggaggcctggagcattg

SEQ ID NO: 11692 - DNA, 20 bp, Artificial Sequence
  chemically synthesized
ggaggcctggagcattgggg

SEQ ID NO: 11693 - DNA, 20 bp, Artificial Sequence
  chemically synthesized
gaggcctggagcattggggt

SEQ ID NO: 11694 - DNA, 20 bp, Artificial Sequence
  chemically synthesized
cctggagcattggggtgggc

SEQ ID NO: 11695 - DNA, 20 bp, Artificial Sequence
  chemically synthesized
ctggagcattggggtgggct

SEQ ID NO: 11696 - DNA, 20 bp, Artificial Sequence
  chemically synthesized
tggagcattggggtgggctg

SEQ ID NO: 11697 - DNA, 20 bp, Artificial Sequence
  chemically synthesized
cattggggtgggctggggtt

SEQ ID NO: 11698 - DNA, 20 bp, Artificial Sequence
  chemically synthesized
ttggggtgggctggggttca

SEQ ID NO: 11699 - DNA, 20 bp, Artificial Sequence
  chemically synthesized
ggggtgggctggggttcaga

SEQ ID NO: 11700 - DNA, 20 bp, Artificial Sequence
  chemically synthesized
gggtgggctggggttcagag

SEQ ID NO: 11701 - DNA, 20 bp, Artificial Sequence
  chemically synthesized
gtgggctggggttcagagag

SEQ ID NO: 11702 - DNA, 20 bp, Artificial Sequence
  chemically synthesized
tgggctggggttcagagagg

SEQ ID NO: 11703 - DNA, 20 bp, Artificial Sequence
  chemically synthesized
gggctggggttcagagagga

SEQ ID NO: 11704 - DNA, 20 bp, Artificial Sequence
  chemically synthesized
gagaggagggattcccttct

SEQ ID NO: 11705 - DNA, 20 bp, Artificial Sequence
  chemically synthesized
agaggagggattcccttctc

SEQ ID NO: 11706 - DNA, 20 bp, Artificial Sequence
  chemically synthesized
gattcccttctcaggttacg

SEQ ID NO: 11707 - DNA, 20 bp, Artificial Sequence
  chemically synthesized
ccttctcaggttacgtggcc

SEQ ID NO: 11708 - DNA, 20 bp, Artificial Sequence
  chemically synthesized
tctcaggttacgtggccaag

SEQ ID NO: 11709 - DNA, 20 bp, Artificial Sequence
  chemically synthesized
caggttacgtggccaagaag

SEQ ID NO: 11710 - DNA, 20 bp, Artificial Sequence
  chemically synthesized
aggttacgtggccaagaagc

SEQ ID NO: 11711 - DNA, 20 bp, Artificial Sequence
  chemically synthesized
ggttacgtggccaagaagca

SEQ ID NO: 11712 - DNA, 20 bp, Artificial Sequence
  chemically synthesized
gttacgtggccaagaagcag

SEQ ID NO: 11713 - DNA, 20 bp, Artificial Sequence
  chemically synthesized
tacgtggccaagaagcaggg

SEQ ID NO: 11714 - DNA, 20 bp, Artificial Sequence
  chemically synthesized
tggccaagaagcaggggagc

SEQ ID NO: 11715 - DNA, 20 bp, Artificial Sequence
  chemically synthesized
ggccaagaagcaggggagct

SEQ ID NO: 11716 - DNA, 20 bp, Artificial Sequence
  chemically synthesized
agaagcaggggagctgggtt

SEQ ID NO: 11717 - DNA, 20 bp, Artificial Sequence
  chemically synthesized
gaagcaggggagctgggttt

SEQ ID NO: 11718 - DNA, 20 bp, Artificial Sequence
  chemically synthesized
caggggagctgggtttgggt

SEQ ID NO: 11719 - DNA, 20 bp, Artificial Sequence
  chemically synthesized
aggggagctgggtttgggtc

SEQ ID NO: 11720 - DNA, 20 bp, Artificial Sequence
  chemically synthesized
agctgggtttgggtcaggtc

SEQ ID NO: 11721 - DNA, 20 bp, Artificial Sequence
  chemically synthesized
gctgggtttgggtcaggtct

SEQ ID NO: 11722 - DNA, 20 bp, Artificial Sequence
  chemically synthesized
gtttgggtcaggtctgggtg

SEQ ID NO: 11723 - DNA, 20 bp, Artificial Sequence
  chemically synthesized
tttgggtcaggtctgggtgt

SEQ ID NO: 11724 - DNA, 20 bp, Artificial Sequence
  chemically synthesized
ttgggtcaggtctgggtgtg

SEQ ID NO: 11725 - DNA, 20 bp, Artificial Sequence
  chemically synthesized
aggtctgggtgtggggtgac

SEQ ID NO: 11726 - DNA, 20 bp, Artificial Sequence
  chemically synthesized
accagcttatgctgtttgcc

SEQ ID NO: 11727 - DNA, 20 bp, Artificial Sequence
  chemically synthesized
ccagcttatgctgtttgccc

SEQ ID NO: 11728 - DNA, 20 bp, Artificial Sequence
  chemically synthesized
cttatgctgtttgcccagga

SEQ ID NO: 11729 - DNA, 20 bp, Artificial Sequence
  chemically synthesized
gctgtttgcccaggacagcc

SEQ ID NO: 11730 - DNA, 20 bp, Artificial Sequence
  chemically synthesized
tgcccaggacagcctagttt

SEQ ID NO: 11731 - DNA, 20 bp, Artificial Sequence
  chemically synthesized
agttttagcactgaaaccct

SEQ ID NO: 11732 - DNA, 20 bp, Artificial Sequence
  chemically synthesized
agcactgaaaccctcagtcc

SEQ ID NO: 11733 - DNA, 20 bp, Artificial Sequence
  chemically synthesized
gcactgaaaccctcagtcct

SEQ ID NO: 11734 - DNA, 20 bp, Artificial Sequence
  chemically synthesized
aaccctcagtcctaggaaaa

SEQ ID NO: 11735 - DNA, 20 bp, Artificial Sequence
  chemically synthesized
accctcagtcctaggaaaac

SEQ ID NO: 11736 - DNA, 20 bp, Artificial Sequence
  chemically synthesized
ccctcagtcctaggaaaaca

SEQ ID NO: 11737 - DNA, 20 bp, Artificial Sequence
  chemically synthesized
cagtcctaggaaaacaggga

SEQ ID NO: 11738 - DNA, 20 bp, Artificial Sequence
  chemically synthesized
cctaggaaaacagggatggt

SEQ ID NO: 11739 - DNA, 20 bp, Artificial Sequence
  chemically synthesized
ggatggttggtcactgtctc

SEQ ID NO: 11740 - DNA, 20 bp, Artificial Sequence
  chemically synthesized
gatggttggtcactgtctct

SEQ ID NO: 11741 - DNA, 20 bp, Artificial Sequence
  chemically synthesized
tctgggtgactcttgattcc

SEQ ID NO: 11742 - DNA, 20 bp, Artificial Sequence
  chemically synthesized
ggtgactcttgattcccggc

SEQ ID NO: 11743 - DNA, 20 bp, Artificial Sequence
  chemically synthesized
tcccggccagtttctccacc

SEQ ID NO: 11744 - DNA, 20 bp, Artificial Sequence
  chemically synthesized
cccggccagtttctccacct

SEQ ID NO: 11745 - DNA, 20 bp, Artificial Sequence
  chemically synthesized
ccggccagtttctccacctg

SEQ ID NO: 11746 - DNA, 20 bp, Artificial Sequence
  chemically synthesized
tctcgtcctgcatccttctc

SEQ ID NO: 11747 - DNA, 20 bp, Artificial Sequence
  chemically synthesized
ctcgtcctgcatccttctcc

SEQ ID NO: 11748 - DNA, 20 bp, Artificial Sequence
  chemically synthesized
gtcctgcatccttctccagg

SEQ ID NO: 11749 - DNA, 20 bp, Artificial Sequence
  chemically synthesized
tcctgcatccttctccaggc

SEQ ID NO: 11750 - DNA, 20 bp, Artificial Sequence
  chemically synthesized
ccttctccaggcaggtcccc

SEQ ID NO: 11751 - DNA, 20 bp, Artificial Sequence
  chemically synthesized
caagcatcgcccccctgctg

SEQ ID NO: 11752 - DNA, 20 bp, Artificial Sequence
  chemically synthesized
cccctgctgtggctgttccc

SEQ ID NO: 11753 - DNA, 20 bp, Artificial Sequence
  chemically synthesized
tgtggctgttcccaagttct

SEQ ID NO: 11754 - DNA, 20 bp, Artificial Sequence
  chemically synthesized
gtggctgttcccaagttctt

SEQ ID NO: 11755 - DNA, 20 bp, Artificial Sequence
  chemically synthesized
tggctgttcccaagttctta

SEQ ID NO: 11756 - DNA, 20 bp, Artificial Sequence
  chemically synthesized
agttcttagggtaccccacg

SEQ ID NO: 11757 - DNA, 20 bp, Artificial Sequence
  chemically synthesized
gttcttagggtaccccacgt

SEQ ID NO: 11758 - DNA, 20 bp, Artificial Sequence
  chemically synthesized
acgtgggtttatcaaccact

SEQ ID NO: 11759 - DNA, 20 bp, Artificial Sequence
  chemically synthesized
gggtttatcaaccacttggt

SEQ ID NO: 11760 - DNA, 20 bp, Artificial Sequence
  chemically synthesized
ggtttatcaaccacttggtg

SEQ ID NO: 11761 - DNA, 20 bp, Artificial Sequence
  chemically synthesized
tatcaaccacttggtgaggc

SEQ ID NO: 11762 - DNA, 20 bp, Artificial Sequence
  chemically synthesized
ttcctgcaccccaattgcct

SEQ ID NO: 11763 - DNA, 20 bp, Artificial Sequence
  chemically synthesized
ctgcaccccaattgccttag

SEQ ID NO: 11764 - DNA, 20 bp, Artificial Sequence
  chemically synthesized
accccaattgccttagtggc

SEQ ID NO: 11765 - DNA, 20 bp, Artificial Sequence
  chemically synthesized
ccccaattgccttagtggct

SEQ ID NO: 11766 - DNA, 20 bp, Artificial Sequence
  chemically synthesized
cccaattgccttagtggcta

SEQ ID NO: 11767 - DNA, 20 bp, Artificial Sequence
  chemically synthesized
ccaattgccttagtggctag

SEQ ID NO: 11768 - DNA, 20 bp, Artificial Sequence
  chemically synthesized
caattgccttagtggctagg

SEQ ID NO: 11769 - DNA, 20 bp, Artificial Sequence
  chemically synthesized
tgccttagtggctagggggt

SEQ ID NO: 11770 - DNA, 20 bp, Artificial Sequence
  chemically synthesized
gccttagtggctagggggtt

SEQ ID NO: 11771 - DNA, 20 bp, Artificial Sequence
  chemically synthesized
ccttagtggctagggggttg

SEQ ID NO: 11772 - DNA, 20 bp, Artificial Sequence
  chemically synthesized
cttagtggctagggggttgg

SEQ ID NO: 11773 - DNA, 20 bp, Artificial Sequence
  chemically synthesized
gtggctagggggttgggggc

SEQ ID NO: 11774 - DNA, 20 bp, Artificial Sequence
  chemically synthesized
ggctagggggttgggggcta

SEQ ID NO: 11775 - DNA, 20 bp, Artificial Sequence
  chemically synthesized
tagggggttgggggctagag

SEQ ID NO: 11776 - DNA, 20 bp, Artificial Sequence
  chemically synthesized
agggggttgggggctagagt

SEQ ID NO: 11777 - DNA, 20 bp, Artificial Sequence
  chemically synthesized
ggggttgggggctagagtag

SEQ ID NO: 11778 - DNA, 20 bp, Artificial Sequence
  chemically synthesized
gggttgggggctagagtagg

SEQ ID NO: 11779 - DNA, 20 bp, Artificial Sequence
  chemically synthesized
ggttgggggctagagtagga

SEQ ID NO: 11780 - DNA, 20 bp, Artificial Sequence
  chemically synthesized
gttgggggctagagtaggag

SEQ ID NO: 11781 - DNA, 20 bp, Artificial Sequence
  chemically synthesized
ggggctagagtaggaggggc

SEQ ID NO: 11782 - DNA, 20 bp, Artificial Sequence
  chemically synthesized
ggctagagtaggaggggctg

SEQ ID NO: 11783 - DNA, 20 bp, Artificial Sequence
  chemically synthesized
agagtaggaggggctggagc

SEQ ID NO: 11784 - DNA, 20 bp, Artificial Sequence
  chemically synthesized
gagtaggaggggctggagcc

SEQ ID NO: 11785 - DNA, 20 bp, Artificial Sequence
  chemically synthesized
ggggctggagccaggattct

SEQ ID NO: 11786 - DNA, 20 bp, Artificial Sequence
  chemically synthesized
gggctggagccaggattctt

SEQ ID NO: 11787 - DNA, 20 bp, Artificial Sequence
  chemically synthesized
ggctggagccaggattctta

SEQ ID NO: 11788 - DNA, 20 bp, Artificial Sequence
  chemically synthesized
ccaggattcttagggctgaa

SEQ ID NO: 11789 - DNA, 20 bp, Artificial Sequence
  chemically synthesized
aggattcttagggctgaaca

SEQ ID NO: 11790 - DNA, 20 bp, Artificial Sequence
  chemically synthesized
attcttagggctgaacagag

SEQ ID NO: 11791 - DNA, 20 bp, Artificial Sequence
  chemically synthesized
tcttagggctgaacagagaa

SEQ ID NO: 11792 - DNA, 20 bp, Artificial Sequence
  chemically synthesized
agggctgaacagagaagagc

SEQ ID NO: 11793 - DNA, 20 bp, Artificial Sequence
  chemically synthesized
gggctgaacagagaagagct

SEQ ID NO: 11794 - DNA, 20 bp, Artificial Sequence
  chemically synthesized
ggctgaacagagaagagctg

SEQ ID NO: 11795 - DNA, 20 bp, Artificial Sequence
  chemically synthesized
gctgaacagagaagagctgg

SEQ ID NO: 11796 - DNA, 20 bp, Artificial Sequence
  chemically synthesized
acagagaagagctgggggcc

SEQ ID NO: 11797 - DNA, 20 bp, Artificial Sequence
  chemically synthesized
cagagaagagctgggggcct

SEQ ID NO: 11798 - DNA, 20 bp, Artificial Sequence
  chemically synthesized
gagctgggggcctgggctcc

SEQ ID NO: 11799 - DNA, 20 bp, Artificial Sequence
  chemically synthesized
agctgggggcctgggctcct

SEQ ID NO: 11800 - DNA, 20 bp, Artificial Sequence
  chemically synthesized
gggcctgggctcctgggttt

SEQ ID NO: 11801 - DNA, 20 bp, Artificial Sequence
  chemically synthesized
gcctgggctcctgggtttga

SEQ ID NO: 11802 - DNA, 20 bp, Artificial Sequence
  chemically synthesized
ctgggctcctgggtttgaga

SEQ ID NO: 11803 - DNA, 20 bp, Artificial Sequence
  chemically synthesized
tgggctcctgggtttgagag

SEQ ID NO: 11804 - DNA, 20 bp, Artificial Sequence
  chemically synthesized
ggctcctgggtttgagagag

SEQ ID NO: 11805 - DNA, 20 bp, Artificial Sequence
  chemically synthesized
gctcctgggtttgagagagg

SEQ ID NO: 11806 - DNA, 20 bp, Artificial Sequence
  chemically synthesized
ctcctgggtttgagagagga

SEQ ID NO: 11807 - DNA, 20 bp, Artificial Sequence
  chemically synthesized
tcctgggtttgagagaggag

SEQ ID NO: 11808 - DNA, 20 bp, Artificial Sequence
  chemically synthesized
gggtttgagagaggaggggc

SEQ ID NO: 11809 - DNA, 20 bp, Artificial Sequence
  chemically synthesized
ggtttgagagaggaggggct

SEQ ID NO: 11810 - DNA, 20 bp, Artificial Sequence
  chemically synthesized
gtttgagagaggaggggctg

SEQ ID NO: 11811 - DNA, 20 bp, Artificial Sequence
  chemically synthesized
agagaggaggggctggggcc

SEQ ID NO: 11812 - DNA, 20 bp, Artificial Sequence
  chemically synthesized
ggggctggggcctggactcc

SEQ ID NO: 11813 - DNA, 20 bp, Artificial Sequence
  chemically synthesized
gggctggggcctggactcct

SEQ ID NO: 11814 - DNA, 20 bp, Artificial Sequence
  chemically synthesized
gggcctggactcctgggtcc

SEQ ID NO: 11815 - DNA, 20 bp, Artificial Sequence
  chemically synthesized
ggcctggactcctgggtccg

SEQ ID NO: 11816 - DNA, 20 bp, Artificial Sequence
  chemically synthesized
gcctggactcctgggtccga

SEQ ID NO: 11817 - DNA, 20 bp, Artificial Sequence
  chemically synthesized
ctggactcctgggtccgagg

SEQ ID NO: 11818 - DNA, 20 bp, Artificial Sequence
  chemically synthesized
tggactcctgggtccgaggg

SEQ ID NO: 11819 - DNA, 20 bp, Artificial Sequence
  chemically synthesized
gactcctgggtccgagggag

SEQ ID NO: 11820 - DNA, 20 bp, Artificial Sequence
  chemically synthesized
actcctgggtccgagggagg

SEQ ID NO: 11821 - DNA, 20 bp, Artificial Sequence
  chemically synthesized
ctcctgggtccgagggagga

SEQ ID NO: 11822 - DNA, 20 bp, Artificial Sequence
  chemically synthesized
tcctgggtccgagggaggag

SEQ ID NO: 11823 - DNA, 20 bp, Artificial Sequence
  chemically synthesized
gggtccgagggaggaggggc

SEQ ID NO: 11824 - DNA, 20 bp, Artificial Sequence
  chemically synthesized
ggtccgagggaggaggggct

SEQ ID NO: 11825 - DNA, 20 bp, Artificial Sequence
  chemically synthesized
gtccgagggaggaggggctg

SEQ ID NO: 11826 - DNA, 20 bp, Artificial Sequence
  chemically synthesized
agggaggaggggctggggcc

SEQ ID NO: 11827 - DNA, 20 bp, Artificial Sequence
  chemically synthesized
ggggctggggcctggactcc

SEQ ID NO: 11828 - DNA, 20 bp, Artificial Sequence
  chemically synthesized
gggctggggcctggactcct

SEQ ID NO: 11829 - DNA, 20 bp, Artificial Sequence
  chemically synthesized
gggcctggactcctgggtct

SEQ ID NO: 11830 - DNA, 20 bp, Artificial Sequence
  chemically synthesized
ggcctggactcctgggtctg

SEQ ID NO: 11831 - DNA, 20 bp, Artificial Sequence
  chemically synthesized
gcctggactcctgggtctga

SEQ ID NO: 11832 - DNA, 20 bp, Artificial Sequence
  chemically synthesized
tggactcctgggtctgaggg

SEQ ID NO: 11833 - DNA, 20 bp, Artificial Sequence
  chemically synthesized
gactcctgggtctgagggtg

SEQ ID NO: 11834 - DNA, 20 bp, Artificial Sequence
  chemically synthesized
actcctgggtctgagggtgg

SEQ ID NO: 11835 - DNA, 20 bp, Artificial Sequence
  chemically synthesized
ctcctgggtctgagggtgga

SEQ ID NO: 11836 - DNA, 20 bp, Artificial Sequence
  chemically synthesized
gggtctgagggtggagggac

SEQ ID NO: 11837 - DNA, 20 bp, Artificial Sequence
  chemically synthesized
ggtctgagggtggagggact

SEQ ID NO: 11838 - DNA, 20 bp, Artificial Sequence
  chemically synthesized
gtctgagggtggagggactg

SEQ ID NO: 11839 - DNA, 20 bp, Artificial Sequence
  chemically synthesized
tctgagggtggagggactgg

SEQ ID NO: 11840 - DNA, 20 bp, Artificial Sequence
  chemically synthesized
gggtggagggactgggggcc

SEQ ID NO: 11841 - DNA, 20 bp, Artificial Sequence
  chemically synthesized
ggactgggggcctggactcc

SEQ ID NO: 11842 - DNA, 20 bp, Artificial Sequence
  chemically synthesized
gactgggggcctggactcct

SEQ ID NO: 11843 - DNA, 20 bp, Artificial Sequence
  chemically synthesized
gggcctggactcctgggtcc

SEQ ID NO: 11844 - DNA, 20 bp, Artificial Sequence
  chemically synthesized
ggcctggactcctgggtccg

SEQ ID NO: 11845 - DNA, 20 bp, Artificial Sequence
  chemically synthesized
gcctggactcctgggtccga

SEQ ID NO: 11846 - DNA, 20 bp, Artificial Sequence
  chemically synthesized
ctggactcctgggtccgagg

SEQ ID NO: 11847 - DNA, 20 bp, Artificial Sequence
  chemically synthesized
tggactcctgggtccgaggg

SEQ ID NO: 11848 - DNA, 20 bp, Artificial Sequence
  chemically synthesized
gactcctgggtccgagggag

SEQ ID NO: 11849 - DNA, 20 bp, Artificial Sequence
  chemically synthesized
actcctgggtccgagggagg

SEQ ID NO: 11850 - DNA, 20 bp, Artificial Sequence
  chemically synthesized
ctcctgggtccgagggagga

SEQ ID NO: 11851 - DNA, 20 bp, Artificial Sequence
  chemically synthesized
tcctgggtccgagggaggag

SEQ ID NO: 11852 - DNA, 20 bp, Artificial Sequence
  chemically synthesized
gggtccgagggaggaggggc

SEQ ID NO: 11853 - DNA, 20 bp, Artificial Sequence
  chemically synthesized
ggtccgagggaggaggggct

SEQ ID NO: 11854 - DNA, 20 bp, Artificial Sequence
  chemically synthesized
gtccgagggaggaggggctg

SEQ ID NO: 11855 - DNA, 20 bp, Artificial Sequence
  chemically synthesized
agggaggaggggctggggcc

SEQ ID NO: 11856 - DNA, 20 bp, Artificial Sequence
  chemically synthesized
ggggctggggcctggactcg

SEQ ID NO: 11857 - DNA, 20 bp, Artificial Sequence
  chemically synthesized
gggctggggcctggactcgt

SEQ ID NO: 11858 - DNA, 20 bp, Artificial Sequence
  chemically synthesized
gggcctggactcgtgggtct

SEQ ID NO: 11859 - DNA, 20 bp, Artificial Sequence
  chemically synthesized
ggcctggactcgtgggtctg

SEQ ID NO: 11860 - DNA, 20 bp, Artificial Sequence
  chemically synthesized
gcctggactcgtgggtctga

SEQ ID NO: 11861 - DNA, 20 bp, Artificial Sequence
  chemically synthesized
ctggactcgtgggtctgagg

SEQ ID NO: 11862 - DNA, 20 bp, Artificial Sequence
  chemically synthesized
tggactcgtgggtctgaggg

SEQ ID NO: 11863 - DNA, 20 bp, Artificial Sequence
  chemically synthesized
gactcgtgggtctgagggag

SEQ ID NO: 11864 - DNA, 20 bp, Artificial Sequence
  chemically synthesized
actcgtgggtctgagggagg

SEQ ID NO: 11865 - DNA, 20 bp, Artificial Sequence
  chemically synthesized
ctcgtgggtctgagggagga

SEQ ID NO: 11866 - DNA, 20 bp, Artificial Sequence
  chemically synthesized
tcgtgggtctgagggaggag

SEQ ID NO: 11867 - DNA, 20 bp, Artificial Sequence
  chemically synthesized
gggtctgagggaggaggggc

SEQ ID NO: 11868 - DNA, 20 bp, Artificial Sequence
  chemically synthesized
ggtctgagggaggaggggct

SEQ ID NO: 11869 - DNA, 20 bp, Artificial Sequence
  chemically synthesized
gtctgagggaggaggggctg

SEQ ID NO: 11870 - DNA, 20 bp, Artificial Sequence
  chemically synthesized
tctgagggaggaggggctgg

SEQ ID NO: 11871 - DNA, 20 bp, Artificial Sequence
  chemically synthesized
gggaggaggggctgggggcc

SEQ ID NO: 11872 - DNA, 20 bp, Artificial Sequence
  chemically synthesized
gggctgggggcctggacttc

SEQ ID NO: 11873 - DNA, 20 bp, Artificial Sequence
  chemically synthesized
ggctgggggcctggacttct

SEQ ID NO: 11874 - DNA, 20 bp, Artificial Sequence
  chemically synthesized
gggcctggacttctgggtct

SEQ ID NO: 11875 - DNA, 20 bp, Artificial Sequence
  chemically synthesized
ggcctggacttctgggtctt

SEQ ID NO: 11876 - DNA, 20 bp, Artificial Sequence
  chemically synthesized
gcctggacttctgggtctta

SEQ ID NO: 11877 - DNA, 20 bp, Artificial Sequence
  chemically synthesized
ctggacttctgggtcttagg

SEQ ID NO: 11878 - DNA, 20 bp, Artificial Sequence
  chemically synthesized
tggacttctgggtcttaggg

SEQ ID NO: 11879 - DNA, 20 bp, Artificial Sequence
  chemically synthesized
acttctgggtcttagggagg

SEQ ID NO: 11880 - DNA, 20 bp, Artificial Sequence
  chemically synthesized
cttctgggtcttagggaggc

SEQ ID NO: 11881 - DNA, 20 bp, Artificial Sequence
  chemically synthesized
ttctgggtcttagggaggcg

SEQ ID NO: 11882 - DNA, 20 bp, Artificial Sequence
  chemically synthesized
gggtcttagggaggcggggc

SEQ ID NO: 11883 - DNA, 20 bp, Artificial Sequence
  chemically synthesized
ggtcttagggaggcggggct

SEQ ID NO: 11884 - DNA, 20 bp, Artificial Sequence
  chemically synthesized
tagggaggcggggctgggcc

SEQ ID NO: 11885 - DNA, 20 bp, Artificial Sequence
  chemically synthesized
cggggctgggcctggacccc

SEQ ID NO: 11886 - DNA, 20 bp, Artificial Sequence
  chemically synthesized
ggggctgggcctggacccct

SEQ ID NO: 11887 - DNA, 20 bp, Artificial Sequence
  chemically synthesized
cctggacccctgggtctgaa

SEQ ID NO: 11888 - DNA, 20 bp, Artificial Sequence
  chemically synthesized
ctggacccctgggtctgaat

SEQ ID NO: 11889 - DNA, 20 bp, Artificial Sequence
  chemically synthesized
tggacccctgggtctgaatg

SEQ ID NO: 11890 - DNA, 20 bp, Artificial Sequence
  chemically synthesized
gacccctgggtctgaatggg

SEQ ID NO: 11891 - DNA, 20 bp, Artificial Sequence
  chemically synthesized
cccctgggtctgaatgggga

SEQ ID NO: 11892 - DNA, 20 bp, Artificial Sequence
  chemically synthesized
ccctgggtctgaatggggag

SEQ ID NO: 11893 - DNA, 20 bp, Artificial Sequence
  chemically synthesized
gggtctgaatggggagaggc

SEQ ID NO: 11894 - DNA, 20 bp, Artificial Sequence
  chemically synthesized
ggtctgaatggggagaggct

SEQ ID NO: 11895 - DNA, 20 bp, Artificial Sequence
  chemically synthesized
gtctgaatggggagaggctg

SEQ ID NO: 11896 - DNA, 20 bp, Artificial Sequence
  chemically synthesized
tctgaatggggagaggctgg

SEQ ID NO: 11897 - DNA, 20 bp, Artificial Sequence
  chemically synthesized
atggggagaggctgggggcc

SEQ ID NO: 11898 - DNA, 20 bp, Artificial Sequence
  chemically synthesized
gggcctggactccttcatct

SEQ ID NO: 11899 - DNA, 20 bp, Artificial Sequence
  chemically synthesized
ggcctggactccttcatctg

SEQ ID NO: 11900 - DNA, 20 bp, Artificial Sequence
  chemically synthesized
gcctggactccttcatctga

SEQ ID NO: 11901 - DNA, 20 bp, Artificial Sequence
  chemically synthesized
tggactccttcatctgaggg

SEQ ID NO: 11902 - DNA, 20 bp, Artificial Sequence
  chemically synthesized
actccttcatctgagggcgg

SEQ ID NO: 11903 - DNA, 20 bp, Artificial Sequence
  chemically synthesized
ctccttcatctgagggcgga

SEQ ID NO: 11904 - DNA, 20 bp, Artificial Sequence
  chemically synthesized
tccttcatctgagggcggaa

SEQ ID NO: 11905 - DNA, 20 bp, Artificial Sequence
  chemically synthesized
tcatctgagggcggaagggc

SEQ ID NO: 11906 - DNA, 20 bp, Artificial Sequence
  chemically synthesized
catctgagggcggaagggct

SEQ ID NO: 11907 - DNA, 20 bp, Artificial Sequence
  chemically synthesized
atctgagggcggaagggctg

SEQ ID NO: 11908 - DNA, 20 bp, Artificial Sequence
  chemically synthesized
agggcggaagggctggggcc

SEQ ID NO: 11909 - DNA, 20 bp, Artificial Sequence
  chemically synthesized
agggctggggcctggcctcc

SEQ ID NO: 11910 - DNA, 20 bp, Artificial Sequence
  chemically synthesized
gggctggggcctggcctcct

SEQ ID NO: 11911 - DNA, 20 bp, Artificial Sequence
  chemically synthesized
gcctggcctcctgggttgaa

SEQ ID NO: 11912 - DNA, 20 bp, Artificial Sequence
  chemically synthesized
cctggcctcctgggttgaat

SEQ ID NO: 11913 - DNA, 20 bp, Artificial Sequence
  chemically synthesized
ctggcctcctgggttgaatg

SEQ ID NO: 11914 - DNA, 20 bp, Artificial Sequence
  chemically synthesized
ggcctcctgggttgaatggg

SEQ ID NO: 11915 - DNA, 20 bp, Artificial Sequence
  chemically synthesized
gcctcctgggttgaatgggg

SEQ ID NO: 11916 - DNA, 20 bp, Artificial Sequence
  chemically synthesized
cctcctgggttgaatgggga

SEQ ID NO: 11917 - DNA, 20 bp, Artificial Sequence
  chemically synthesized
ctcctgggttgaatggggag

SEQ ID NO: 11918 - DNA, 20 bp, Artificial Sequence
  chemically synthesized
tgggttgaatggggaggggt

SEQ ID NO: 11919 - DNA, 20 bp, Artificial Sequence
  chemically synthesized
gggttgaatggggaggggtt

SEQ ID NO: 11920 - DNA, 20 bp, Artificial Sequence
  chemically synthesized
gaatggggaggggttgggcc

SEQ ID NO: 11921 - DNA, 20 bp, Artificial Sequence
  chemically synthesized
gaggggttgggcctggactc

SEQ ID NO: 11922 - DNA, 20 bp, Artificial Sequence
  chemically synthesized
ggggttgggcctggactctg

SEQ ID NO: 11923 - DNA, 20 bp, Artificial Sequence
  chemically synthesized
ggcctggactctggagtccc

SEQ ID NO: 11924 - DNA, 20 bp, Artificial Sequence
  chemically synthesized
actctggagtccctggtgcc

SEQ ID NO: 11925 - DNA, 20 bp, Artificial Sequence
  chemically synthesized
ctctggagtccctggtgccc

SEQ ID NO: 11926 - DNA, 20 bp, Artificial Sequence
  chemically synthesized
agtccctggtgcccaggcct

SEQ ID NO: 11927 - DNA, 20 bp, Artificial Sequence
  chemically synthesized
gtccctggtgcccaggcctc

SEQ ID NO: 11928 - DNA, 20 bp, Artificial Sequence
  chemically synthesized
caggcctcaggcatctttca

SEQ ID NO: 11929 - DNA, 20 bp, Artificial Sequence
  chemically synthesized
aggcctcaggcatctttcac

SEQ ID NO: 11930 - DNA, 20 bp, Artificial Sequence
  chemically synthesized
ggcctcaggcatctttcaca

SEQ ID NO: 11931 - DNA, 20 bp, Artificial Sequence
  chemically synthesized
tttcacagggatgcctgtac

SEQ ID NO: 11932 - DNA, 20 bp, Artificial Sequence
  chemically synthesized
ttcacagggatgcctgtact

SEQ ID NO: 11933 - DNA, 20 bp, Artificial Sequence
  chemically synthesized
acagggatgcctgtactggg

SEQ ID NO: 11934 - DNA, 20 bp, Artificial Sequence
  chemically synthesized
cagggatgcctgtactgggc

SEQ ID NO: 11935 - DNA, 20 bp, Artificial Sequence
  chemically synthesized
tgtactgggcaggtccttga

SEQ ID NO: 11936 - DNA, 20 bp, Artificial Sequence
  chemically synthesized
gtactgggcaggtccttgaa

SEQ ID NO: 11937 - DNA, 20 bp, Artificial Sequence
  chemically synthesized
tactgggcaggtccttgaaa

SEQ ID NO: 11938 - DNA, 20 bp, Artificial Sequence
  chemically synthesized
gggcaggtccttgaaaggga

SEQ ID NO: 11939 - DNA, 20 bp, Artificial Sequence
  chemically synthesized
ggcaggtccttgaaagggaa

SEQ ID NO: 11940 - DNA, 20 bp, Artificial Sequence
  chemically synthesized
tcccctatcgccatgacaac

SEQ ID NO: 11941 - DNA, 20 bp, Artificial Sequence
  chemically synthesized
cccctatcgccatgacaact

SEQ ID NO: 11942 - DNA, 20 bp, Artificial Sequence
  chemically synthesized
ctatcgccatgacaactggg

SEQ ID NO: 11943 - DNA, 20 bp, Artificial Sequence
  chemically synthesized
acaactgggtggaaataaac

SEQ ID NO: 11944 - DNA, 20 bp, Artificial Sequence
  chemically synthesized
tgggtggaaataaacgagcc

SEQ ID NO: 11945 - DNA, 20 bp, Artificial Sequence
  chemically synthesized
agccgagttcatcccgttcc

SEQ ID NO: 11946 - DNA, 20 bp, Artificial Sequence
  chemically synthesized
gccgagttcatcccgttccc

SEQ ID NO: 11947 - DNA, 20 bp, Artificial Sequence
  chemically synthesized
ccgagttcatcccgttccca

SEQ ID NO: 11948 - DNA, 20 bp, Artificial Sequence
  chemically synthesized
tcccgttcccagggcacgtg

SEQ ID NO: 11949 - DNA, 20 bp, Artificial Sequence
  chemically synthesized
gggcacgtgcggccccttca

SEQ ID NO: 11950 - DNA, 20 bp, Artificial Sequence
  chemically synthesized
gtgcggccccttcacagccc

SEQ ID NO: 11951 - DNA, 20 bp, Artificial Sequence
  chemically synthesized
tttccatgacctcatgctct

SEQ ID NO: 11952 - DNA, 20 bp, Artificial Sequence
  chemically synthesized
cctcatgctcttggccctcg

SEQ ID NO: 11953 - DNA, 20 bp, Artificial Sequence
  chemically synthesized
tagctccctcccgcctcctc

SEQ ID NO: 11954 - DNA, 20 bp, Artificial Sequence
  chemically synthesized
tccctcccgcctcctccaga

SEQ ID NO: 11955 - DNA, 20 bp, Artificial Sequence
  chemically synthesized
ccctcccgcctcctccagat

SEQ ID NO: 11956 - DNA, 20 bp, Artificial Sequence
  chemically synthesized
tcccgcctcctccagatggg

SEQ ID NO: 11957 - DNA, 20 bp, Artificial Sequence
  chemically synthesized
ctcctccagatgggcagctt

SEQ ID NO: 11958 - DNA, 20 bp, Artificial Sequence
  chemically synthesized
cctccagatgggcagctttg

SEQ ID NO: 11959 - DNA, 20 bp, Artificial Sequence
  chemically synthesized
tccagatgggcagctttgga

SEQ ID NO: 11960 - DNA, 20 bp, Artificial Sequence
  chemically synthesized
ccagatgggcagctttggag

SEQ ID NO: 11961 - DNA, 20 bp, Artificial Sequence
  chemically synthesized
atgggcagctttggagaggt

SEQ ID NO: 11962 - DNA, 20 bp, Artificial Sequence
  chemically synthesized
tgggcagctttggagaggtg

SEQ ID NO: 11963 - DNA, 20 bp, Artificial Sequence
  chemically synthesized
gggcagctttggagaggtga

SEQ ID NO: 11964 - DNA, 20 bp, Artificial Sequence
  chemically synthesized
ctttggagaggtgagggact

SEQ ID NO: 11965 - DNA, 20 bp, Artificial Sequence
  chemically synthesized
tttggagaggtgagggactt

SEQ ID NO: 11966 - DNA, 20 bp, Artificial Sequence
  chemically synthesized
ttggagaggtgagggacttg

SEQ ID NO: 11967 - DNA, 20 bp, Artificial Sequence
  chemically synthesized
tggagaggtgagggacttgg

SEQ ID NO: 11968 - DNA, 20 bp, Artificial Sequence
  chemically synthesized
ggagaggtgagggacttggg

SEQ ID NO: 11969 - DNA, 20 bp, Artificial Sequence
  chemically synthesized
ttggggggtaatttatcccg

SEQ ID NO: 11970 - DNA, 20 bp, Artificial Sequence
  chemically synthesized
ggtaatttatcccgtggatc

SEQ ID NO: 11971 - DNA, 20 bp, Artificial Sequence
  chemically synthesized
gtaatttatcccgtggatct

SEQ ID NO: 11972 - DNA, 20 bp, Artificial Sequence
  chemically synthesized
aatttatcccgtggatctag

SEQ ID NO: 11973 - DNA, 20 bp, Artificial Sequence
  chemically synthesized
atcccgtggatctaggagtt

SEQ ID NO: 11974 - DNA, 20 bp, Artificial Sequence
  chemically synthesized
gtttagcttcactccttcct

SEQ ID NO: 11975 - DNA, 20 bp, Artificial Sequence
  chemically synthesized
cttcactccttcctcagctc

SEQ ID NO: 11976 - DNA, 20 bp, Artificial Sequence
  chemically synthesized
ctccttcctcagctccagtt

SEQ ID NO: 11977 - DNA, 20 bp, Artificial Sequence
  chemically synthesized
tccttcctcagctccagttc

SEQ ID NO: 11978 - DNA, 20 bp, Artificial Sequence
  chemically synthesized
ctcagctccagttcaggtcc

SEQ ID NO: 11979 - DNA, 20 bp, Artificial Sequence
  chemically synthesized
cagctccagttcaggtcccg

SEQ ID NO: 11980 - DNA, 20 bp, Artificial Sequence
  chemically synthesized
ttcaggtcccggagcccacc

SEQ ID NO: 11981 - DNA, 20 bp, Artificial Sequence
  chemically synthesized
ggagcccacccagtgtccac

SEQ ID NO: 11982 - DNA, 20 bp, Artificial Sequence
  chemically synthesized
gagcccacccagtgtccaca

SEQ ID NO: 11983 - DNA, 20 bp, Artificial Sequence
  chemically synthesized
cacccagtgtccacaaggcc

SEQ ID NO: 11984 - DNA, 20 bp, Artificial Sequence
  chemically synthesized
acccagtgtccacaaggcct

SEQ ID NO: 11985 - DNA, 20 bp, Artificial Sequence
  chemically synthesized
cccagtgtccacaaggcctg

SEQ ID NO: 11986 - DNA, 20 bp, Artificial Sequence
  chemically synthesized
gtgtccacaaggcctggggc

SEQ ID NO: 11987 - DNA, 20 bp, Artificial Sequence
  chemically synthesized
aagtccctcctccgaccccc

SEQ ID NO: 11988 - DNA, 20 bp, Artificial Sequence
  chemically synthesized
tcctccgaccccctggactt

SEQ ID NO: 11989 - DNA, 20 bp, Artificial Sequence
  chemically synthesized
acttcggcttttgtcccccc

SEQ ID NO: 11990 - DNA, 20 bp, Artificial Sequence
  chemically synthesized
gcttttgtccccccaagttt

SEQ ID NO: 11991 - DNA, 20 bp, Artificial Sequence
  chemically synthesized
cccccaagttttggacccct

SEQ ID NO: 11992 - DNA, 20 bp, Artificial Sequence
  chemically synthesized
ccccaagttttggaccccta

SEQ ID NO: 11993 - DNA, 20 bp, Artificial Sequence
  chemically synthesized
cccaagttttggacccctaa

SEQ ID NO: 11994 - DNA, 20 bp, Artificial Sequence
  chemically synthesized
aagttttggacccctaaggg

SEQ ID NO: 11995 - DNA, 20 bp, Artificial Sequence
  chemically synthesized
tggacccctaagggaagaat

SEQ ID NO: 11996 - DNA, 20 bp, Artificial Sequence
  chemically synthesized
cctaagggaagaatgagaaa

SEQ ID NO: 11997 - DNA, 20 bp, Artificial Sequence
  chemically synthesized
aagggaagaatgagaaacgg

SEQ ID NO: 11998 - DNA, 20 bp, Artificial Sequence
  chemically synthesized
tgagaaacggtggcccgtgt

SEQ ID NO: 11999 - DNA, 20 bp, Artificial Sequence
  chemically synthesized
cggtggcccgtgtcagcccc

SEQ ID NO: 12000 - DNA, 20 bp, Artificial Sequence
  chemically synthesized
cccgtgtcagcccctggctg

SEQ ID NO: 12001 - DNA, 20 bp, Artificial Sequence
  chemically synthesized
ccgtgtcagcccctggctgc

SEQ ID NO: 12002 - DNA, 20 bp, Artificial Sequence
  chemically synthesized
cgtgtcagcccctggctgca

SEQ ID NO: 12003 - DNA, 20 bp, Artificial Sequence
  chemically synthesized
cctggctgcagggccccgtg

SEQ ID NO: 12004 - DNA, 20 bp, Artificial Sequence
  chemically synthesized
tggctgcagggccccgtgca

SEQ ID NO: 12005 - DNA, 20 bp, Artificial Sequence
  chemically synthesized
ggctgcagggccccgtgcag

SEQ ID NO: 12006 - DNA, 20 bp, Artificial Sequence
  chemically synthesized
gctgcagggccccgtgcaga

SEQ ID NO: 12007 - DNA, 20 bp, Artificial Sequence
  chemically synthesized
ctgcagggccccgtgcagag

SEQ ID NO: 12008 - DNA, 20 bp, Artificial Sequence
  chemically synthesized
tgcagggccccgtgcagagg

SEQ ID NO: 12009 - DNA, 20 bp, Artificial Sequence
  chemically synthesized
gccccgtgcagagggggcct

SEQ ID NO: 12010 - DNA, 20 bp, Artificial Sequence
  chemically synthesized
cagagggggcctcagtgaac

SEQ ID NO: 12011 - DNA, 20 bp, Artificial Sequence
  chemically synthesized
gagggggcctcagtgaactg

SEQ ID NO: 12012 - DNA, 20 bp, Artificial Sequence
  chemically synthesized
ctcagtgaactggagtgtga

SEQ ID NO: 12013 - DNA, 20 bp, Artificial Sequence
  chemically synthesized
tgaactggagtgtgacagcc

SEQ ID NO: 12014 - DNA, 20 bp, Artificial Sequence
  chemically synthesized
gaactggagtgtgacagcct

SEQ ID NO: 12015 - DNA, 20 bp, Artificial Sequence
  chemically synthesized
aactggagtgtgacagcctg

SEQ ID NO: 12016 - DNA, 20 bp, Artificial Sequence
  chemically synthesized
gagtgtgacagcctggggcc

SEQ ID NO: 12017 - DNA, 20 bp, Artificial Sequence
  chemically synthesized
agtgtgacagcctggggccc

SEQ ID NO: 12018 - DNA, 20 bp, Artificial Sequence
  chemically synthesized
cagcctggggcccaggcaca

SEQ ID NO: 12019 - DNA, 20 bp, Artificial Sequence
  chemically synthesized
agcctggggcccaggcacac

SEQ ID NO: 12020 - DNA, 20 bp, Artificial Sequence
  chemically synthesized
ggcccaggcacacaggtgtg

SEQ ID NO: 12021 - DNA, 20 bp, Artificial Sequence
  chemically synthesized
gtgcagctgtctcacccctc

SEQ ID NO: 12022 - DNA, 20 bp, Artificial Sequence
  chemically synthesized
tgcagctgtctcacccctct

SEQ ID NO: 12023 - DNA, 20 bp, Artificial Sequence
  chemically synthesized
cagctgtctcacccctctgg

SEQ ID NO: 12024 - DNA, 20 bp, Artificial Sequence
  chemically synthesized
acccctctgggagtcccgcc

SEQ ID NO: 12025 - DNA, 20 bp, Artificial Sequence
  chemically synthesized
cccctctgggagtcccgccc

SEQ ID NO: 12026 - DNA, 20 bp, Artificial Sequence
  chemically synthesized
ggagtcccgcccaggcccct

SEQ ID NO: 12027 - DNA, 20 bp, Artificial Sequence
  chemically synthesized
ccaggcccctgagtctgtcc

SEQ ID NO: 12028 - DNA, 20 bp, Artificial Sequence
  chemically synthesized
cccctgagtctgtcccagca

SEQ ID NO: 12029 - DNA, 20 bp, Artificial Sequence
  chemically synthesized
ccctgagtctgtcccagcac

SEQ ID NO: 12030 - DNA, 20 bp, Artificial Sequence
  chemically synthesized
cctgagtctgtcccagcaca

SEQ ID NO: 12031 - DNA, 20 bp, Artificial Sequence
  chemically synthesized
gagtctgtcccagcacaggg

SEQ ID NO: 12032 - DNA, 20 bp, Artificial Sequence
  chemically synthesized
tggccttcctccaccctgca

SEQ ID NO: 12033 - DNA, 20 bp, Artificial Sequence
  chemically synthesized
tcctccaccctgcatagccc

SEQ ID NO: 12034 - DNA, 20 bp, Artificial Sequence
  chemically synthesized
cctccaccctgcatagccct

SEQ ID NO: 12035 - DNA, 20 bp, Artificial Sequence
  chemically synthesized
cctgcatagccctgggccca

SEQ ID NO: 12036 - DNA, 20 bp, Artificial Sequence
  chemically synthesized
ggcccacggcttcgttcctg

SEQ ID NO: 12037 - DNA, 20 bp, Artificial Sequence
  chemically synthesized
cccacggcttcgttcctgca

SEQ ID NO: 12038 - DNA, 20 bp, Artificial Sequence
  chemically synthesized
cgttcctgcagagtatctgc

SEQ ID NO: 12039 - DNA, 20 bp, Artificial Sequence
  chemically synthesized
gttcctgcagagtatctgct

SEQ ID NO: 12040 - DNA, 20 bp, Artificial Sequence
  chemically synthesized
ttcctgcagagtatctgctg

SEQ ID NO: 12041 - DNA, 20 bp, Artificial Sequence
  chemically synthesized
ctgcagagtatctgctgggg

SEQ ID NO: 12042 - DNA, 20 bp, Artificial Sequence
  chemically synthesized
tatctgctggggtggtttcc

SEQ ID NO: 12043 - DNA, 20 bp, Artificial Sequence
  chemically synthesized
tggtttccgagcttgaccct

SEQ ID NO: 12044 - DNA, 20 bp, Artificial Sequence
  chemically synthesized
tttccgagcttgacccttgg

SEQ ID NO: 12045 - DNA, 20 bp, Artificial Sequence
  chemically synthesized
ttccgagcttgacccttgga

SEQ ID NO: 12046 - DNA, 20 bp, Artificial Sequence
  chemically synthesized
gcttgacccttggaaggacc

SEQ ID NO: 12047 - DNA, 20 bp, Artificial Sequence
  chemically synthesized
gacccttggaaggacctggc

SEQ ID NO: 12048 - DNA, 20 bp, Artificial Sequence
  chemically synthesized
acccttggaaggacctggct

SEQ ID NO: 12049 - DNA, 20 bp, Artificial Sequence
  chemically synthesized
ggaaggacctggctgggttt

SEQ ID NO: 12050 - DNA, 20 bp, Artificial Sequence
  chemically synthesized
gaaggacctggctgggttta

SEQ ID NO: 12051 - DNA, 20 bp, Artificial Sequence
  chemically synthesized
ggacctggctgggtttaagg

SEQ ID NO: 12052 - DNA, 20 bp, Artificial Sequence
  chemically synthesized
gacctggctgggtttaaggc

SEQ ID NO: 12053 - DNA, 20 bp, Artificial Sequence
  chemically synthesized
cctggctgggtttaaggcag

SEQ ID NO: 12054 - DNA, 20 bp, Artificial Sequence
  chemically synthesized
ctggctgggtttaaggcagg

SEQ ID NO: 12055 - DNA, 20 bp, Artificial Sequence
  chemically synthesized
tggctgggtttaaggcagga

SEQ ID NO: 12056 - DNA, 20 bp, Artificial Sequence
  chemically synthesized
ggctgggtttaaggcaggag

SEQ ID NO: 12057 - DNA, 20 bp, Artificial Sequence
  chemically synthesized
gggtttaaggcaggaggggc

SEQ ID NO: 12058 - DNA, 20 bp, Artificial Sequence
  chemically synthesized
ggtttaaggcaggaggggct

SEQ ID NO: 12059 - DNA, 20 bp, Artificial Sequence
  chemically synthesized
gtttaaggcaggaggggctg

SEQ ID NO: 12060 - DNA, 20 bp, Artificial Sequence
  chemically synthesized
tttaaggcaggaggggctgg

SEQ ID NO: 12061 - DNA, 20 bp, Artificial Sequence
  chemically synthesized
aggcaggaggggctgggggc

SEQ ID NO: 12062 - DNA, 20 bp, Artificial Sequence
  chemically synthesized
ggcaggaggggctgggggcc

SEQ ID NO: 12063 - DNA, 20 bp, Artificial Sequence
  chemically synthesized
gggctgggggccaggactcc

SEQ ID NO: 12064 - DNA, 20 bp, Artificial Sequence
  chemically synthesized
ggccaggactcctggctctg

SEQ ID NO: 12065 - DNA, 20 bp, Artificial Sequence
  chemically synthesized
gccaggactcctggctctga

SEQ ID NO: 12066 - DNA, 20 bp, Artificial Sequence
  chemically synthesized
caggactcctggctctgaag

SEQ ID NO: 12067 - DNA, 20 bp, Artificial Sequence
  chemically synthesized
aggactcctggctctgaagg

SEQ ID NO: 12068 - DNA, 20 bp, Artificial Sequence
  chemically synthesized
gactcctggctctgaaggag

SEQ ID NO: 12069 - DNA, 20 bp, Artificial Sequence
  chemically synthesized
actcctggctctgaaggagg

SEQ ID NO: 12070 - DNA, 20 bp, Artificial Sequence
  chemically synthesized
ctcctggctctgaaggagga

SEQ ID NO: 12071 - DNA, 20 bp, Artificial Sequence
  chemically synthesized
tcctggctctgaaggaggag

SEQ ID NO: 12072 - DNA, 20 bp, Artificial Sequence
  chemically synthesized
ggctctgaaggaggaggggc

SEQ ID NO: 12073 - DNA, 20 bp, Artificial Sequence
  chemically synthesized
aggggctggaacctcttccc

SEQ ID NO: 12074 - DNA, 20 bp, Artificial Sequence
  chemically synthesized
tggaacctcttccctagtct

SEQ ID NO: 12075 - DNA, 20 bp, Artificial Sequence
  chemically synthesized
ctcttccctagtctgagcac

SEQ ID NO: 12076 - DNA, 20 bp, Artificial Sequence
  chemically synthesized
ttccctagtctgagcactgg

SEQ ID NO: 12077 - DNA, 20 bp, Artificial Sequence
  chemically synthesized
agcactggaagcgccacctg

SEQ ID NO: 12078 - DNA, 20 bp, Artificial Sequence
  chemically synthesized
gcactggaagcgccacctgt

SEQ ID NO: 12079 - DNA, 20 bp, Artificial Sequence
  chemically synthesized
ctggaagcgccacctgtggg

SEQ ID NO: 12080 - DNA, 20 bp, Artificial Sequence
  chemically synthesized
gcgccacctgtgggtggtga

SEQ ID NO: 12081 - DNA, 20 bp, Artificial Sequence
  chemically synthesized
cgccacctgtgggtggtgac

SEQ ID NO: 12082 - DNA, 20 bp, Artificial Sequence
  chemically synthesized
gccacctgtgggtggtgacg

SEQ ID NO: 12083 - DNA, 20 bp, Artificial Sequence
  chemically synthesized
ccacctgtgggtggtgacgg

SEQ ID NO: 12084 - DNA, 20 bp, Artificial Sequence
  chemically synthesized
gggggttttgccgtgtctaa

SEQ ID NO: 12085 - DNA, 20 bp, Artificial Sequence
  chemically synthesized
ggggttttgccgtgtctaac

SEQ ID NO: 12086 - DNA, 20 bp, Artificial Sequence
  chemically synthesized
cgtgtctaacaggtaccatg

SEQ ID NO: 12087 - DNA, 20 bp, Artificial Sequence
  chemically synthesized
gtgtctaacaggtaccatgt

SEQ ID NO: 12088 - DNA, 20 bp, Artificial Sequence
  chemically synthesized
tgtctaacaggtaccatgtg

SEQ ID NO: 12089 - DNA, 20 bp, Artificial Sequence
  chemically synthesized
ccatgtggggttcccgcacc

SEQ ID NO: 12090 - DNA, 20 bp, Artificial Sequence
  chemically synthesized
tggggttcccgcacccagat

SEQ ID NO: 12091 - DNA, 20 bp, Artificial Sequence
  chemically synthesized
ggttcccgcacccagatgag

SEQ ID NO: 12092 - DNA, 20 bp, Artificial Sequence
  chemically synthesized
ccccgttcacttcctgtttg

SEQ ID NO: 12093 - DNA, 20 bp, Artificial Sequence
  chemically synthesized
gttcacttcctgtttgcaga

SEQ ID NO: 12094 - DNA, 20 bp, Artificial Sequence
  chemically synthesized
acttcctgtttgcagatagc

SEQ ID NO: 12095 - DNA, 20 bp, Artificial Sequence
  chemically synthesized
cttcctgtttgcagatagcc

SEQ ID NO: 12096 - DNA, 20 bp, Artificial Sequence
  chemically synthesized
tcctgtttgcagatagccag

SEQ ID NO: 12097 - DNA, 20 bp, Artificial Sequence
  chemically synthesized
gatagccaggagtcctttcg

SEQ ID NO: 12098 - DNA, 20 bp, Artificial Sequence
  chemically synthesized
gtcctttcgtggtttccact

SEQ ID NO: 12099 - DNA, 20 bp, Artificial Sequence
  chemically synthesized
gtggtttccactgagcactg

SEQ ID NO: 12100 - DNA, 20 bp, Artificial Sequence
  chemically synthesized
tggtttccactgagcactga

SEQ ID NO: 12101 - DNA, 20 bp, Artificial Sequence
  chemically synthesized
tccactgagcactgaaggcc

SEQ ID NO: 12102 - DNA, 20 bp, Artificial Sequence
  chemically synthesized
ctgagcactgaaggcctggc

SEQ ID NO: 12103 - DNA, 20 bp, Artificial Sequence
  chemically synthesized
ggcctggccggcctgaccac

SEQ ID NO: 12104 - DNA, 20 bp, Artificial Sequence
  chemically synthesized
gcctggccggcctgaccact

SEQ ID NO: 12105 - DNA, 20 bp, Artificial Sequence
  chemically synthesized
cggcctgaccactgggcaac

SEQ ID NO: 12106 - DNA, 20 bp, Artificial Sequence
  chemically synthesized
ggcctgaccactgggcaacc

SEQ ID NO: 12107 - DNA, 20 bp, Artificial Sequence
  chemically synthesized
gcaaccaggcgtatcttaaa

SEQ ID NO: 12108 - DNA, 20 bp, Artificial Sequence
  chemically synthesized
ccaggcgtatcttaaacagc

SEQ ID NO: 12109 - DNA, 20 bp, Artificial Sequence
  chemically synthesized
ggcgtatcttaaacagccag

SEQ ID NO: 12110 - DNA, 20 bp, Artificial Sequence
  chemically synthesized
tatcttaaacagccagtggc

SEQ ID NO: 12111 - DNA, 20 bp, Artificial Sequence
  chemically synthesized
tcttaaacagccagtggcca

SEQ ID NO: 12112 - DNA, 20 bp, Artificial Sequence
  chemically synthesized
cttaaacagccagtggccag

SEQ ID NO: 12113 - DNA, 20 bp, Artificial Sequence
  chemically synthesized
agccagtggccagaggctgt

SEQ ID NO: 12114 - DNA, 20 bp, Artificial Sequence
  chemically synthesized
gccagtggccagaggctgtt

SEQ ID NO: 12115 - DNA, 20 bp, Artificial Sequence
  chemically synthesized
ggtcattttccccactgtcc

SEQ ID NO: 12116 - DNA, 20 bp, Artificial Sequence
  chemically synthesized
ctgtcctagcaccgtgtccc

SEQ ID NO: 12117 - DNA, 20 bp, Artificial Sequence
  chemically synthesized
tgtccctggatctgttttcg

SEQ ID NO: 12118 - DNA, 20 bp, Artificial Sequence
  chemically synthesized
tctgttttcgtggctccctc

SEQ ID NO: 12119 - DNA, 20 bp, Artificial Sequence
  chemically synthesized
tgttttcgtggctccctctg

SEQ ID NO: 12120 - DNA, 20 bp, Artificial Sequence
  chemically synthesized
cctctggagtcccgacttgc

SEQ ID NO: 12121 - DNA, 20 bp, Artificial Sequence
  chemically synthesized
ctctggagtcccgacttgct

SEQ ID NO: 12122 - DNA, 20 bp, Artificial Sequence
  chemically synthesized
cccgacttgctgggacaccg

SEQ ID NO: 12123 - DNA, 20 bp, Artificial Sequence
  chemically synthesized
acttgctgggacaccgtggc

SEQ ID NO: 12124 - DNA, 20 bp, Artificial Sequence
  chemically synthesized
cttgctgggacaccgtggct

SEQ ID NO: 12125 - DNA, 20 bp, Artificial Sequence
  chemically synthesized
ttgctgggacaccgtggctg

SEQ ID NO: 12126 - DNA, 20 bp, Artificial Sequence
  chemically synthesized
ctgggacaccgtggctgggg

SEQ ID NO: 12127 - DNA, 20 bp, Artificial Sequence
  chemically synthesized
tgggacaccgtggctggggt

SEQ ID NO: 12128 - DNA, 20 bp, Artificial Sequence
  chemically synthesized
caccgtggctggggtaggtg

SEQ ID NO: 12129 - DNA, 20 bp, Artificial Sequence
  chemically synthesized
gctggggtaggtgcggctga

SEQ ID NO: 12130 - DNA, 20 bp, Artificial Sequence
  chemically synthesized
tgacggctgtttcccacccc

SEQ ID NO: 12131 - DNA, 20 bp, Artificial Sequence
  chemically synthesized
gacggctgtttcccaccccc

SEQ ID NO: 12132 - DNA, 20 bp, Artificial Sequence
  chemically synthesized
acccccaggcctgcattgat

SEQ ID NO: 12133 - DNA, 20 bp, Artificial Sequence
  chemically synthesized
ggcctgcattgatgagaacc

SEQ ID NO: 12134 - DNA, 20 bp, Artificial Sequence
  chemically synthesized
cctgcattgatgagaacctg

SEQ ID NO: 12135 - DNA, 20 bp, Artificial Sequence
  chemically synthesized
ctgcattgatgagaacctgg

SEQ ID NO: 12136 - DNA, 20 bp, Artificial Sequence
  chemically synthesized
cattgatgagaacctggagg

SEQ ID NO: 12137 - DNA, 20 bp, Artificial Sequence
  chemically synthesized
cctggaggtggtgcgcttct

SEQ ID NO: 12138 - DNA, 20 bp, Artificial Sequence
  chemically synthesized
ggaggtggtgcgcttcttgg

SEQ ID NO: 12139 - DNA, 20 bp, Artificial Sequence
  chemically synthesized
aggtggtgcgcttcttggtg

SEQ ID NO: 12140 - DNA, 20 bp, Artificial Sequence
  chemically synthesized
tggtgcgcttcttggtggag

SEQ ID NO: 12141 - DNA, 20 bp, Artificial Sequence
  chemically synthesized
ggtgcgcttcttggtggagc

SEQ ID NO: 12142 - DNA, 20 bp, Artificial Sequence
  chemically synthesized
gtgcgcttcttggtggagca

SEQ ID NO: 12143 - DNA, 20 bp, Artificial Sequence
  chemically synthesized
agcagggcgccactgtgaac

SEQ ID NO: 12144 - DNA, 20 bp, Artificial Sequence
  chemically synthesized
gcagggcgccactgtgaacc

SEQ ID NO: 12145 - DNA, 20 bp, Artificial Sequence
  chemically synthesized
gggcgccactgtgaaccagg

SEQ ID NO: 12146 - DNA, 20 bp, Artificial Sequence
  chemically synthesized
ctgtgaaccaggcagacaac

SEQ ID NO: 12147 - DNA, 20 bp, Artificial Sequence
  chemically synthesized
tgtgaaccaggcagacaacg

SEQ ID NO: 12148 - DNA, 20 bp, Artificial Sequence
  chemically synthesized
gtgaaccaggcagacaacga

SEQ ID NO: 12149 - DNA, 20 bp, Artificial Sequence
  chemically synthesized
accaggcagacaacgagggc

SEQ ID NO: 12150 - DNA, 20 bp, Artificial Sequence
  chemically synthesized
gggctggacgccactgcacg

SEQ ID NO: 12151 - DNA, 20 bp, Artificial Sequence
  chemically synthesized
ctgcacgtggccgcctcctg

SEQ ID NO: 12152 - DNA, 20 bp, Artificial Sequence
  chemically synthesized
ggccgcctcctgtggctacc

SEQ ID NO: 12153 - DNA, 20 bp, Artificial Sequence
  chemically synthesized
tgtggctacctagatatcgc

SEQ ID NO: 12154 - DNA, 20 bp, Artificial Sequence
  chemically synthesized
gttctcatcaatgcaggcct

SEQ ID NO: 12155 - DNA, 20 bp, Artificial Sequence
  chemically synthesized
gaagggagggggcttctcat

SEQ ID NO: 12156 - DNA, 20 bp, Artificial Sequence
  chemically synthesized
gcccctcctccttcagagcc

SEQ ID NO: 12157 - DNA, 20 bp, Artificial Sequence
  chemically synthesized
aaacccagccaggtccttcc

SEQ ID NO: 12158 - DNA, 20 bp, Artificial Sequence
  chemically synthesized
gccgtgggcccagggctatg

SEQ ID NO: 12159 - DNA, 20 bp, Artificial Sequence
  chemically synthesized
ggcctgggcgggactcccag

SEQ ID NO: 12160 - DNA, 20 bp, Artificial Sequence
  chemically synthesized
ccgtttctcattcttccctt

SEQ ID NO: 12161 - DNA, 20 bp, Artificial Sequence
  chemically synthesized
gggacaaaagccgaagtcca

SEQ ID NO: 12162 - DNA, 20 bp, Artificial Sequence
  chemically synthesized
tgccccaggccttgtggaca

SEQ ID NO: 12163 - DNA, 20 bp, Artificial Sequence
  chemically synthesized
acctgaactggagctgagga

SEQ ID NO: 12164 - DNA, 20 bp, Artificial Sequence
  chemically synthesized
aagctaaactcctagatcca

SEQ ID NO: 12165 - DNA, 20 bp, Artificial Sequence
  chemically synthesized
ggccgcacgtgccctgggaa

SEQ ID NO: 12166 - DNA, 20 bp, Artificial Sequence
  chemically synthesized
ggcctgggcaccagggactc

SEQ ID NO: 12167 - DNA, 20 bp, Artificial Sequence
  chemically synthesized
gcccttccgccctcagatga

SEQ ID NO: 12168 - DNA, 20 bp, Artificial Sequence
  chemically synthesized
gcctctccccattcagaccc

SEQ ID NO: 12169 - DNA, 20 bp, Artificial Sequence
  chemically synthesized
gcccctcctccctcagaccc

SEQ ID NO: 12170 - DNA, 20 bp, Artificial Sequence
  chemically synthesized
gcccctcctccctcggaccc

SEQ ID NO: 12171 - DNA, 20 bp, Artificial Sequence
  chemically synthesized
gtccctccaccctcagaccc

SEQ ID NO: 12172 - DNA, 20 bp, Artificial Sequence
  chemically synthesized
gcccctcctccctcggaccc

SEQ ID NO: 12173 - DNA, 20 bp, Artificial Sequence
  chemically synthesized
gctcttctctgttcagccct

SEQ ID NO: 12174 - DNA, 20 bp, Artificial Sequence
  chemically synthesized
cccctagccactaaggcaat

SEQ ID NO: 12175 - DNA, 20 bp, Artificial Sequence
  chemically synthesized
cactaaggcaattggggtgc

SEQ ID NO: 12176 - DNA, 20 bp, Artificial Sequence
  chemically synthesized
ttggggtgcaggaatggggg

SEQ ID NO: 12177 - DNA, 20 bp, Artificial Sequence
  chemically synthesized
aagtggttgataaacccacg

SEQ ID NO: 12178 - DNA, 20 bp, Artificial Sequence
  chemically synthesized
gcttggggacctgcctggag

SEQ ID NO: 12179 - DNA, 20 bp, Artificial Sequence
  chemically synthesized
cccaggtggagaaactggcc

SEQ ID NO: 12180 - DNA, 20 bp, Artificial Sequence
  chemically synthesized
ggagaaactggccgggaatc

SEQ ID NO: 12181 - DNA, 20 bp, Artificial Sequence
  chemically synthesized
atccctgttttcctaggact

SEQ ID NO: 12182 - DNA, 20 bp, Artificial Sequence
  chemically synthesized
ttggccacgtaacctgagaa

SEQ ID NO: 12183 - DNA, 20 bp, Artificial Sequence
  chemically synthesized
ccccaatgctccaggcctcc

SEQ ID NO: 12184 - DNA, 20 bp, Artificial Sequence
  chemically synthesized
aggcctcctgggataccccg

SEQ ID NO: 12185 - DNA, 20 bp, Artificial Sequence
  chemically synthesized
ctcctgggataccccgaaga

SEQ ID NO: 12186 - DNA, 20 bp, Artificial Sequence
  chemically synthesized
cagtcaccccacagttggag

SEQ ID NO: 12187 - DNA, 20 bp, Artificial Sequence
  chemically synthesized
ggcagcctggtagacagggc

SEQ ID NO: 12188 - DNA, 20 bp, Artificial Sequence
  chemically synthesized
agggctggggtggcctctcg

SEQ ID NO: 12189 - DNA, 20 bp, Artificial Sequence
  chemically synthesized
taggtggcctggggcctctg

SEQ ID NO: 12190 - DNA, 20 bp, Artificial Sequence
  chemically synthesized
tctgggggatgcaggggaag

SEQ ID NO: 12191 - DNA, 20 bp, Artificial Sequence
  chemically synthesized
gaagggggatgcaggggaac

SEQ ID NO: 12192 - DNA, 20 bp, Artificial Sequence
  chemically synthesized
cgggaccctgctctgggcgg

SEQ ID NO: 12193 - DNA, 20 bp, Artificial Sequence
  chemically synthesized
tggggactctttaaggaaag

SEQ ID NO: 12194 - DNA, 20 bp, Artificial Sequence
  chemically synthesized
gaaggatggagaaagagaaa

SEQ ID NO: 12195 - DNA, 20 bp, Artificial Sequence
  chemically synthesized
ggacgcaccattctcacaaa

SEQ ID NO: 12196 - DNA, 20 bp, Artificial Sequence
  chemically synthesized
gtgtaaggaagctgcagcac

SEQ ID NO: 12197 - DNA, 20 bp, Artificial Sequence
  chemically synthesized
gagcagctcaggttctggga

SEQ ID NO: 12198 - DNA, 20 bp, Artificial Sequence
  chemically synthesized
ggttctgggagagggtagcg

SEQ ID NO: 12199 - DNA, 20 bp, Artificial Sequence
  chemically synthesized
ccctgccaagctctccctcc

SEQ ID NO: 12200 - DNA, 20 bp, Artificial Sequence
  chemically synthesized
gagagatggctccaggaaat

SEQ ID NO: 12201 - DNA, 20 bp, Artificial Sequence
  chemically synthesized
tgggggtgtgtcaccagata

SEQ ID NO: 12202 - DNA, 20 bp, Artificial Sequence
  chemically synthesized
gaatctgcctaacaggaggt

SEQ ID NO: 12203 - DNA, 20 bp, Artificial Sequence
  chemically synthesized
gactaggaaggaggaggcct

SEQ ID NO: 12204 - DNA, 20 bp, Artificial Sequence
  chemically synthesized
tgtccctagtggccccactg

SEQ ID NO: 12205 - DNA, 20 bp, Artificial Sequence
  chemically synthesized
gagccacattaaccggccct

SEQ ID NO: 12206 - DNA, 20 bp, Artificial Sequence
  chemically synthesized
gtggtcccagctcggggaca

SEQ ID NO: 12207 - DNA, 20 bp, Artificial Sequence
  chemically synthesized
cctgaagtggacataggggc

SEQ ID NO: 12208 - DNA, 20 bp, Artificial Sequence
  chemically synthesized
gcacagactagagaggtaag

SEQ ID NO: 12209 - DNA, 20 bp, Artificial Sequence
  chemically synthesized
aggggagctgcccaaatgaa

SEQ ID NO: 12210 - DNA, 20 bp, Artificial Sequence
  chemically synthesized
tgaaaggagtgagaggtgac

SEQ ID NO: 12211 - DNA, 20 bp, Artificial Sequence
  chemically synthesized
gacccgaatccacaggagaa

SEQ ID NO: 12212 - DNA, 20 bp, Artificial Sequence
  chemically synthesized
tgtccaggcaaagaaagcaa

SEQ ID NO: 12213 - DNA, 20 bp, Artificial Sequence
  chemically synthesized
ggtggctaaagccagggaga

SEQ ID NO: 12214 - DNA, 20 bp, Artificial Sequence
  chemically synthesized
gccagggagacggggtactt

SEQ ID NO: 12215 - DNA, 20 bp, Artificial Sequence
  chemically synthesized
gagaaggaaaagggaaccca

SEQ ID NO: 12216 - DNA, 20 bp, Artificial Sequence
  chemically synthesized
cccagcgagtgaagacggca

SEQ ID NO: 12217 - DNA, 20 bp, Artificial Sequence
  chemically synthesized
cgagtgaagacggcatgggg

SEQ ID NO: 12218 - DNA, 20 bp, Artificial Sequence
  chemically synthesized
ggagaggacccagacacggg

SEQ ID NO: 12219 - DNA, 20 bp, Artificial Sequence
  chemically synthesized
agcagagagcaaggggaaga

SEQ ID NO: 12220 - DNA, 20 bp, Artificial Sequence
  chemically synthesized
acctgaaggaggcggcaggg

SEQ ID NO: 12221 - DNA, 20 bp, Artificial Sequence
  chemically synthesized
agcggcacaggcccagggga

SEQ ID NO: 12222 - DNA, 20 bp, Artificial Sequence
  chemically synthesized
gagacggcagcgttagaggg

SEQ ID NO: 12223 - DNA, 20 bp, Artificial Sequence
  chemically synthesized
ggaagaggggaagtcgaggg

SEQ ID NO: 12224 - DNA, 20 bp, Artificial Sequence
  chemically synthesized
gggatggtaaggaggactgc

SEQ ID NO: 12225 - DNA, 20 bp, Artificial Sequence
  chemically synthesized
aaagcgactccaatgcggaa

SEQ ID NO: 12226 - DNA, 20 bp, Artificial Sequence
  chemically synthesized
cggaagagagtaggtcgaag

SEQ ID NO: 12227 - DNA, 20 bp, Artificial Sequence
  chemically synthesized
aatggtaaggaggcctgggg

SEQ ID NO: 12228 - DNA, 20 bp, Artificial Sequence
  chemically synthesized
ctggggcagagtggtcagca

SEQ ID NO: 12229 - DNA, 20 bp, Artificial Sequence
  chemically synthesized
aagcggctccaattcggaag

SEQ ID NO: 12230 - DNA, 20 bp, Artificial Sequence
  chemically synthesized
cggaagtggggtggtcgaag

SEQ ID NO: 12231 - DNA, 20 bp, Artificial Sequence
  chemically synthesized
aatggtaagggggactggga

SEQ ID NO: 12232 - DNA, 20 bp, Artificial Sequence
  chemically synthesized
actgggacggggtgtcagca

SEQ ID NO: 12233 - DNA, 20 bp, Artificial Sequence
  chemically synthesized
ccagggccaggaacgacggg

SEQ ID NO: 12234 - DNA, 20 bp, Artificial Sequence
  chemically synthesized
cgagactggcaacggggaag

SEQ ID NO: 12235 - DNA, 20 bp, Artificial Sequence
  chemically synthesized
atgccccaggtggcgcagca

SEQ ID NO: 12236 - DNA, 20 bp, Artificial Sequence
  chemically synthesized
gctgataccgtcggcgttgg

SEQ ID NO: 12237 - DNA, 20 bp, Artificial Sequence
  chemically synthesized
gcgggcgggcggcggcgcgg

SEQ ID NO: 12238 - DNA, 20 bp, Artificial Sequence
  chemically synthesized
gtcgagctcggcgccggggc

SEQ ID NO: 12239 - DNA, 20 bp, Artificial Sequence
  chemically synthesized
cgggcggtgcgatgtccgga

SEQ ID NO: 12240 - DNA, 20 bp, Artificial Sequence
  chemically synthesized
cgtccgcttcgagcgcgccg

SEQ ID NO: 12241 - DNA, 20 bp, Artificial Sequence
  chemically synthesized
ccccttcgaccaccccactt

SEQ ID NO: 12242 - DNA, 20 bp, Artificial Sequence
  chemically synthesized
cgacctactctcttccgcat

SEQ ID NO: 12243 - DNA, 20 bp, Artificial Sequence
  chemically synthesized
gcgctgccctcctctcgccc

SEQ ID NO: 12244 - DNA, 20 bp, Artificial Sequence
  chemically synthesized
ctaacgctgccgtctctctc

SEQ ID NO: 12245 - DNA, 20 bp, Artificial Sequence
  chemically synthesized
ttctgtctgcagcttgtggc

SEQ ID NO: 12246 - DNA, 20 bp, Artificial Sequence
  chemically synthesized
tctctgctgtgttgctgccc

SEQ ID NO: 12247 - DNA, 20 bp, Artificial Sequence
  chemically synthesized
caccacgtgatgtcctctga

SEQ ID NO: 12248 - DNA, 20 bp, Artificial Sequence
  chemically synthesized
tgagcggatcctccccgtgt

SEQ ID NO: 12249 - DNA, 20 bp, Artificial Sequence
  chemically synthesized
ccccatgccgtcttcactcg

SEQ ID NO: 12250 - DNA, 20 bp, Artificial Sequence
  chemically synthesized
ctgtgccatctctcgtttct

SEQ ID NO: 12251 - DNA, 20 bp, Artificial Sequence
  chemically synthesized
tcttaggatggccttctccg

SEQ ID NO: 12252 - DNA, 20 bp, Artificial Sequence
  chemically synthesized
cctggacaccccgttctcct

SEQ ID NO: 12253 - DNA, 20 bp, Artificial Sequence
  chemically synthesized
caccccgttctcctgtggat

SEQ ID NO: 12254 - DNA, 20 bp, Artificial Sequence
  chemically synthesized
cccctgtcatggcatcttcc

SEQ ID NO: 12255 - DNA, 20 bp, Artificial Sequence
  chemically synthesized
acagcatgtttgctgcctcc

SEQ ID NO: 12256 - DNA, 20 bp, Artificial Sequence
  chemically synthesized
cggttaatgtggctctggtt

SEQ ID NO: 12257 - DNA, 20 bp, Artificial Sequence
  chemically synthesized
cacagtggggccactaggga

SEQ ID NO: 12258 - DNA, 20 bp, Artificial Sequence
  chemically synthesized
tccttcctagtctcctgata

SEQ ID NO: 12259 - DNA, 20 bp, Artificial Sequence
  chemically synthesized
ttgcttacgatggagccaga

SEQ ID NO: 12260 - DNA, 20 bp, Artificial Sequence
  chemically synthesized
ctgggagggagagcttggca

SEQ ID NO: 12261 - DNA, 20 bp, Artificial Sequence
  chemically synthesized
cagggggtgggagggaaggg

SEQ ID NO: 12262 - DNA, 20 bp, Artificial Sequence
  chemically synthesized
gcagtttggaaaaacaaaat

SEQ ID NO: 12263 - DNA, 20 bp, Artificial Sequence
  chemically synthesized
aaaatcagaataagttggtc

SEQ ID NO: 12264 - DNA, 20 bp, Artificial Sequence
  chemically synthesized
ggcagggctgtggtgaggag

SEQ ID NO: 12265 - DNA, 20 bp, Artificial Sequence
  chemically synthesized
gtgtggaaaactccctttgt

SEQ ID NO: 12266 - DNA, 20 bp, Artificial Sequence
  chemically synthesized
tctccatccttctttcctta

SEQ ID NO: 12267 - DNA, 20 bp, Artificial Sequence
  chemically synthesized
acatattcctccgcccagag

SEQ ID NO: 12268 - DNA, 20 bp, Artificial Sequence
  chemically synthesized
taaggccctgctctgggctt

SEQ ID NO: 12269 - DNA, 20 bp, Artificial Sequence
  chemically synthesized
cctgctctgggcttctgggt

SEQ ID NO: 12270 - DNA, 20 bp, Artificial Sequence
  chemically synthesized
ctctcctgccccttccctac

SEQ ID NO: 12271 - DNA, 20 bp, Artificial Sequence
  chemically synthesized
cctgtctaccaggctgcctt

SEQ ID NO: 12272 - DNA, 20 bp, Artificial Sequence
  chemically synthesized
tctaccaggctgccttttgg

SEQ ID NO: 12273 - DNA, 20 bp, Artificial Sequence
  chemically synthesized
ggtggattctcctccaactg

SEQ ID NO: 12274 - DNA, 20 bp, Artificial Sequence
  chemically synthesized
tgcttggcaaactcactctt

SEQ ID NO: 12275 - DNA, 20 bp, Artificial Sequence
  chemically synthesized
tcccaggaggcctggagcat

SEQ ID NO: 12276 - DNA, 20 bp, Artificial Sequence
  chemically synthesized
cctggagcattggggtgggc

SEQ ID NO: 12277 - DNA, 20 bp, Artificial Sequence
  chemically synthesized
tgggctggggttcagagagg

SEQ ID NO: 12278 - DNA, 20 bp, Artificial Sequence
  chemically synthesized
gtggccaagaagcaggggag

SEQ ID NO: 12279 - DNA, 20 bp, Artificial Sequence
  chemically synthesized
aagaagcaggggagctgggt

SEQ ID NO: 12280 - DNA, 20 bp, Artificial Sequence
  chemically synthesized
gagctgggtttgggtcaggt

SEQ ID NO: 12281 - DNA, 20 bp, Artificial Sequence
  chemically synthesized
gtttgggtcaggtctgggtg

SEQ ID NO: 12282 - DNA, 20 bp, Artificial Sequence
  chemically synthesized
accctcagtcctaggaaaac

SEQ ID NO: 12283 - DNA, 20 bp, Artificial Sequence
  chemically synthesized
gggatggttggtcactgtct

SEQ ID NO: 12284 - DNA, 20 bp, Artificial Sequence
  chemically synthesized
tgtggctgttcccaagttct

SEQ ID NO: 12285 - DNA, 20 bp, Artificial Sequence
  chemically synthesized
aagttcttagggtaccccac

SEQ ID NO: 12286 - DNA, 20 bp, Artificial Sequence
  chemically synthesized
cccaattgccttagtggcta

SEQ ID NO: 12287 - DNA, 20 bp, Artificial Sequence
  chemically synthesized
gtggctagggggttgggggc

SEQ ID NO: 12288 - DNA, 20 bp, Artificial Sequence
  chemically synthesized
agagtaggaggggctggagc

SEQ ID NO: 12289 - DNA, 20 bp, Artificial Sequence
  chemically synthesized
agagctgggggcctgggctc

SEQ ID NO: 12290 - DNA, 20 bp, Artificial Sequence
  chemically synthesized
aggggctggggcctggactc

SEQ ID NO: 12291 - DNA, 20 bp, Artificial Sequence
  chemically synthesized
aggggctggggcctggactc

SEQ ID NO: 12292 - DNA, 20 bp, Artificial Sequence
  chemically synthesized
gggcctggactcctgggtct

SEQ ID NO: 12293 - DNA, 20 bp, Artificial Sequence
  chemically synthesized
gggactgggggcctggactc

SEQ ID NO: 12294 - DNA, 20 bp, Artificial Sequence
  chemically synthesized
aggggctggggcctggactc

SEQ ID NO: 12295 - DNA, 20 bp, Artificial Sequence
  chemically synthesized
ggggctgggggcctggactt

SEQ ID NO: 12296 - DNA, 20 bp, Artificial Sequence
  chemically synthesized
gcggggctgggcctggaccc

SEQ ID NO: 12297 - DNA, 20 bp, Artificial Sequence
  chemically synthesized
ctgggcctggacccctgggt

SEQ ID NO: 12298 - DNA, 20 bp, Artificial Sequence
  chemically synthesized
aagggctggggcctggcctc

SEQ ID NO: 12299 - DNA, 20 bp, Artificial Sequence
  chemically synthesized
ctggggcctggcctcctggg

SEQ ID NO: 12300 - DNA, 20 bp, Artificial Sequence
  chemically synthesized
gcctcctgggttgaatgggg

SEQ ID NO: 12301 - DNA, 20 bp, Artificial Sequence
  chemically synthesized
gaggggttgggcctggactc

SEQ ID NO: 12302 - DNA, 20 bp, Artificial Sequence
  chemically synthesized
aggcctcaggcatctttcac

SEQ ID NO: 12303 - DNA, 20 bp, Artificial Sequence
  chemically synthesized
ctcccctatcgccatgacaa

SEQ ID NO: 12304 - DNA, 20 bp, Artificial Sequence
  chemically synthesized
actgggtggaaataaacgag

SEQ ID NO: 12305 - DNA, 20 bp, Artificial Sequence
  chemically synthesized
acgtgcggccccttcacagc

SEQ ID NO: 12306 - DNA, 20 bp, Artificial Sequence
  chemically synthesized
ttggagaggtgagggacttg

SEQ ID NO: 12307 - DNA, 20 bp, Artificial Sequence
  chemically synthesized
cttggggggtaatttatccc

SEQ ID NO: 12308 - DNA, 20 bp, Artificial Sequence
  chemically synthesized
gtaatttatcccgtggatct

SEQ ID NO: 12309 - DNA, 20 bp, Artificial Sequence
  chemically synthesized
aagttttggacccctaaggg

SEQ ID NO: 12310 - DNA, 20 bp, Artificial Sequence
  chemically synthesized
cagagggggcctcagtgaac

SEQ ID NO: 12311 - DNA, 20 bp, Artificial Sequence
  chemically synthesized
tgcagctgtctcacccctct

SEQ ID NO: 12312 - DNA, 20 bp, Artificial Sequence
  chemically synthesized
tgggagtcccgcccaggccc

SEQ ID NO: 12313 - DNA, 20 bp, Artificial Sequence
  chemically synthesized
cccctgagtctgtcccagca

SEQ ID NO: 12314 - DNA, 20 bp, Artificial Sequence
  chemically synthesized
ggcccacggcttcgttcctg

SEQ ID NO: 12315 - DNA, 20 bp, Artificial Sequence
  chemically synthesized
cgttcctgcagagtatctgc

SEQ ID NO: 12316 - DNA, 20 bp, Artificial Sequence
  chemically synthesized
tgacccttggaaggacctgg

SEQ ID NO: 12317 - DNA, 20 bp, Artificial Sequence
  chemically synthesized
gagcactggaagcgccacct

SEQ ID NO: 12318 - DNA, 20 bp, Artificial Sequence
  chemically synthesized
cgccacctgtgggtggtgac

SEQ ID NO: 12319 - DNA, 20 bp, Artificial Sequence
  chemically synthesized
cgtgtctaacaggtaccatg

SEQ ID NO: 12320 - DNA, 20 bp, Artificial Sequence
  chemically synthesized
cttcctgtttgcagatagcc

SEQ ID NO: 12321 - DNA, 20 bp, Artificial Sequence
  chemically synthesized
cagccagtggccagaggctg

SEQ ID NO: 12322 - DNA, 20 bp, Artificial Sequence
  chemically synthesized
actgtcctagcaccgtgtcc

SEQ ID NO: 12323 - DNA, 20 bp, Artificial Sequence
  chemically synthesized
tctgttttcgtggctccctc

SEQ ID NO: 12324 - DNA, 20 bp, Artificial Sequence
  chemically synthesized
acttgctgggacaccgtggc

SEQ ID NO: 12325 - DNA, 20 bp, Artificial Sequence
  chemically synthesized
agctcttctctgttcagccc

SEQ ID NO: 12326 - DNA, 20 bp, Artificial Sequence
  chemically synthesized
gcctggagaaggatgcagga

SEQ ID NO: 12327 - DNA, 20 bp, Artificial Sequence
  chemically synthesized
cgagaaacacagccccaggt

SEQ ID NO: 12328 - DNA, 20 bp, Artificial Sequence
  chemically synthesized
gcagtcaccccacagttgga

SEQ ID NO: 12329 - DNA, 20 bp, Artificial Sequence
  chemically synthesized
ctctttaaggaaagaaggat

SEQ ID NO: 12330 - DNA, 20 bp, Artificial Sequence
  chemically synthesized
aaggaaagaaggatggagaa

SEQ ID NO: 12331 - DNA, 20 bp, Artificial Sequence
  chemically synthesized
ggaacaatataaattgggga

SEQ ID NO: 12332 - DNA, 20 bp, Artificial Sequence
  chemically synthesized
ggagaacggggtgtccaggc

SEQ ID NO: 12333 - DNA, 20 bp, Artificial Sequence
  chemically synthesized
acggggtactttggggttgt

SEQ ID NO: 12334 - DNA, 20 bp, Artificial Sequence
  chemically synthesized
tccgtcggagaaggccatcc

SEQ ID NO: 12335 - DNA, 20 bp, Artificial Sequence
  chemically synthesized
acccaggccacaagctgcag

SEQ ID NO: 12336 - DNA, 20 bp, Artificial Sequence
  chemically synthesized
aagcggcacaggcccagggg

SEQ ID NO: 12337 - DNA, 20 bp, Artificial Sequence
  chemically synthesized
caggggagagaatgcaggtc

SEQ ID NO: 12338 - DNA, 20 bp, Artificial Sequence
  chemically synthesized
cactagggacaggattggtg

SEQ ID NO: 12339 - DNA, 20 bp, Artificial Sequence
  chemically synthesized
agcagtttggaaaaacaaaa

SEQ ID NO: 12340 - DNA, 20 bp, Artificial Sequence
  chemically synthesized
cgtgtggaaaactccctttg

SEQ ID NO: 12341 - DNA, 20 bp, Artificial Sequence
  chemically synthesized
caagttttggacccctaagg

SEQ ID NO: 12342 - DNA, 20 bp, Artificial Sequence
  chemically synthesized
ttggacccctaagggaagaa

SEQ ID NO: 12343 - DNA, 20 bp, Artificial Sequence
  chemically synthesized
gggactccagagggagccac

SEQ ID NO: 12344 - DNA, 20 bp, Artificial Sequence
  chemically synthesized
atggtacctgttagacacgg

SEQ ID NO: 12345 - DNA, 20 bp, Artificial Sequence
  chemically synthesized
tcattcttcccttaggggtc

SEQ ID NO: 12346 - DNA, 20 bp, Artificial Sequence
  chemically synthesized
aggactgagggtttcagtgc

SEQ ID NO: 12347 - DNA, 20 bp, Artificial Sequence
  chemically synthesized
tactggccttatctcacagg

SEQ ID NO: 12348 - DNA, 20 bp, Artificial Sequence
  chemically synthesized
ggtactttggggttgtccag

SEQ ID NO: 12349 - DNA, 20 bp, Artificial Sequence
  chemically synthesized
caagaggagaagcagtttgg

SEQ ID NO: 12350 - DNA, 20 bp, Artificial Sequence
  chemically synthesized
aggaggggggtgtccgtgtg

SEQ ID NO: 12351 - DNA, 20 bp, Artificial Sequence
  chemically synthesized
actgaaaccctcagtcctag

SEQ ID NO: 12352 - DNA, 20 bp, Artificial Sequence
  chemically synthesized
cccaacagcctctggccact

SEQ ID NO: 12353 - DNA, 20 bp, Artificial Sequence
  chemically synthesized
ggaagtgaacggggaaggga

SEQ ID NO: 12354 - DNA, 20 bp, Artificial Sequence
  chemically synthesized
cccccgtcaccacccacagg

SEQ ID NO: 12355 - DNA, 20 bp, Artificial Sequence
  chemically synthesized
agccaggggctgacacgggc

SEQ ID NO: 12356 - DNA, 20 bp, Artificial Sequence
  chemically synthesized
ctgggaacgggatgaactcg

SEQ ID NO: 12357 - DNA, 20 bp, Artificial Sequence
  chemically synthesized
gaacagccacagcagggggg

SEQ ID NO: 12358 - DNA, 20 bp, Artificial Sequence
  chemically synthesized
cagagacagtgaccaaccat

SEQ ID NO: 12359 - DNA, 20 bp, Artificial Sequence
  chemically synthesized
atccctgttttcctaggact

SEQ ID NO: 12360 - DNA, 20 bp, Artificial Sequence
  chemically synthesized
acctgacccaaacccagctc

SEQ ID NO: 12361 - DNA, 20 bp, Artificial Sequence
  chemically synthesized
ctcctgggataccccgaaga

SEQ ID NO: 12362 - DNA, 20 bp, Artificial Sequence
  chemically synthesized
gggaagcctgagcgcctctc

SEQ ID NO: 12363 - DNA, 20 bp, Artificial Sequence
  chemically synthesized
ggacgcaccattctcacaaa

SEQ ID NO: 12364 - DNA, 20 bp, Artificial Sequence
  chemically synthesized
tagaactcaggaccaactta

SEQ ID NO: 12365 - DNA, 20 bp, Artificial Sequence
  chemically synthesized
tcaggaccaacttattctga

SEQ ID NO: 12366 - DNA, 20 bp, Artificial Sequence
  chemically synthesized
attctgattttgtttttcca

SEQ ID NO: 12367 - DNA, 20 bp, Artificial Sequence
  chemically synthesized
ggaaggaggaggcctaagga

SEQ ID NO: 12368 - DNA, 20 bp, Artificial Sequence
  chemically synthesized
gagagcgccgcgcccgcacc

SEQ ID NO: 12369 - DNA, 20 bp, Artificial Sequence
  chemically synthesized
ccgccccgtcgttcctggcc

SEQ ID NO: 12370 - DNA, 20 bp, Artificial Sequence
  chemically synthesized
ccaccccacttccgaattgg

SEQ ID NO: 12371 - DNA, 20 bp, Artificial Sequence
  chemically synthesized
tggagccgcttcaactggcc

SEQ ID NO: 12372 - DNA, 20 bp, Artificial Sequence
  chemically synthesized
cctactctcttccgcattgg

SEQ ID NO: 12373 - DNA, 20 bp, Artificial Sequence
  chemically synthesized
ttggagtcgctttaactggc

SEQ ID NO: 12374 - DNA, 20 bp, Artificial Sequence
  chemically synthesized
tccggaccactttgagctct

SEQ ID NO: 12375 - DNA, 20 bp, Artificial Sequence
  chemically synthesized
cttctgcgccgcctctggcc

SEQ ID NO: 12376 - DNA, 20 bp, Artificial Sequence
  chemically synthesized
gtttccccttcccaggcagg

SEQ ID NO: 12377 - DNA, 20 bp, Artificial Sequence
  chemically synthesized
cattctctcccctgggcctg

SEQ ID NO: 12378 - DNA, 20 bp, Artificial Sequence
  chemically synthesized
ggcctgtgccgctttctgtc

SEQ ID NO: 12379 - DNA, 20 bp, Artificial Sequence
  chemically synthesized
cttctggggcctgtgccatc

SEQ ID NO: 12380 - DNA, 20 bp, Artificial Sequence
  chemically synthesized
ttcttgtaggcctgcatcat

SEQ ID NO: 12381 - DNA, 20 bp, Artificial Sequence
  chemically synthesized
accccaaagtaccccgtctc

SEQ ID NO: 12382 - DNA, 20 bp, Artificial Sequence
  chemically synthesized
ctttagccacctctccatcc

SEQ ID NO: 12383 - DNA, 20 bp, Artificial Sequence
  chemically synthesized
gcctggacaccccgttctcc

SEQ ID NO: 12384 - DNA, 20 bp, Artificial Sequence
  chemically synthesized
cctatgtccacttcaggaca

SEQ ID NO: 12385 - DNA, 20 bp, Artificial Sequence
  chemically synthesized
ccacagtggggccactaggg

SEQ ID NO: 12386 - DNA, 20 bp, Artificial Sequence
  chemically synthesized
ctaacccccacctcctgtta

SEQ ID NO: 12387 - DNA, 20 bp, Artificial Sequence
  chemically synthesized
tctctccttgccagaacctc

SEQ ID NO: 12388 - DNA, 20 bp, Artificial Sequence
  chemically synthesized
tccttgccagaacctctaag

SEQ ID NO: 12389 - DNA, 20 bp, Artificial Sequence
  chemically synthesized
ccagagaggatcctgggagg

SEQ ID NO: 12390 - DNA, 20 bp, Artificial Sequence
  chemically synthesized
tgctctgacgcggccgtctg

SEQ ID NO: 12391 - DNA, 20 bp, Artificial Sequence
  chemically synthesized
cgtttcactgatcctggtgc

SEQ ID NO: 12392 - DNA, 20 bp, Artificial Sequence
  chemically synthesized
ttacacttcccaagaggaga

SEQ ID NO: 12393 - DNA, 20 bp, Artificial Sequence
  chemically synthesized
tttatattgttcctccgtgc

SEQ ID NO: 12394 - DNA, 20 bp, Artificial Sequence
  chemically synthesized
ttcctccgcccagagcaggg

SEQ ID NO: 12395 - DNA, 20 bp, Artificial Sequence
  chemically synthesized
cgcttccctaaggccctgct

SEQ ID NO: 12396 - DNA, 20 bp, Artificial Sequence
  chemically synthesized
taaggccctgctctgggctt

SEQ ID NO: 12397 - DNA, 20 bp, Artificial Sequence
  chemically synthesized
ggcaagcccaggagaggcgc

SEQ ID NO: 12398 - DNA, 20 bp, Artificial Sequence
  chemically synthesized
gtctaccaggctgccttttg

SEQ ID NO: 12399 - DNA, 20 bp, Artificial Sequence
  chemically synthesized
ttctcctccaactgtggggt

SEQ ID NO: 12400 - DNA, 20 bp, Artificial Sequence
  chemically synthesized
gtgggctggggttcagagag

SEQ ID NO: 12401 - DNA, 20 bp, Artificial Sequence
  chemically synthesized
gtggccaagaagcaggggag

SEQ ID NO: 12402 - DNA, 20 bp, Artificial Sequence
  chemically synthesized
tcaggtctgggtgtggggtg

SEQ ID NO: 12403 - DNA, 20 bp, Artificial Sequence
  chemically synthesized
ggtgtggggtgaccagctta

SEQ ID NO: 12404 - DNA, 20 bp, Artificial Sequence
  chemically synthesized
atgctgtttgcccaggacag

SEQ ID NO: 12405 - DNA, 20 bp, Artificial Sequence
  chemically synthesized
ggtcactgtctctgggtgac

SEQ ID NO: 12406 - DNA, 20 bp, Artificial Sequence
  chemically synthesized
tgggtgactcttgattcccg

SEQ ID NO: 12407 - DNA, 20 bp, Artificial Sequence
  chemically synthesized
gccagtttctccacctgggg

SEQ ID NO: 12408 - DNA, 20 bp, Artificial Sequence
  chemically synthesized
aagttcttagggtaccccac

SEQ ID NO: 12409 - DNA, 20 bp, Artificial Sequence
  chemically synthesized
tagagtaggaggggctggag

SEQ ID NO: 12410 - DNA, 20 bp, Artificial Sequence
  chemically synthesized
agagctgggggcctgggctc

SEQ ID NO: 12411 - DNA, 20 bp, Artificial Sequence
  chemically synthesized
acgtgcggccccttcacagc

SEQ ID NO: 12412 - DNA, 20 bp, Artificial Sequence
  chemically synthesized
cctcccgcctcctccagatg

SEQ ID NO: 12413 - DNA, 20 bp, Artificial Sequence
  chemically synthesized
gtaatttatcccgtggatct

SEQ ID NO: 12414 - DNA, 20 bp, Artificial Sequence
  chemically synthesized
ttatcccgtggatctaggag

SEQ ID NO: 12415 - DNA, 20 bp, Artificial Sequence
  chemically synthesized
cctcctccgaccccctggac

SEQ ID NO: 12416 - DNA, 20 bp, Artificial Sequence
  chemically synthesized
ggacttcggcttttgtcccc

SEQ ID NO: 12417 - DNA, 20 bp, Artificial Sequence
  chemically synthesized
accctgcatagccctgggcc

SEQ ID NO: 12418 - DNA, 20 bp, Artificial Sequence
  chemically synthesized
tcctgcagagtatctgctgg

SEQ ID NO: 12419 - DNA, 20 bp, Artificial Sequence
  chemically synthesized
agtatctgctggggtggttt

SEQ ID NO: 12420 - DNA, 20 bp, Artificial Sequence
  chemically synthesized
tgacccttggaaggacctgg

SEQ ID NO: 12421 - DNA, 20 bp, Artificial Sequence
  chemically synthesized
cgccacctgtgggtggtgac

SEQ ID NO: 12422 - DNA, 20 bp, Artificial Sequence
  chemically synthesized
ccctcccttccccgttcact

SEQ ID NO: 12423 - DNA, 20 bp, Artificial Sequence
  chemically synthesized
cagatagccaggagtccttt

SEQ ID NO: 12424 - DNA, 20 bp, Artificial Sequence
  chemically synthesized
tcctagcaccgtgtccctgg

SEQ ID NO: 12425 - DNA, 20 bp, Artificial Sequence
  chemically synthesized
ctggggtaggtgcggctgac

SEQ ID NO: 12426 - DNA, 20 bp, Artificial Sequence
  chemically synthesized
ttgatgagaacctggaggtg

SEQ ID NO: 12427 - DNA, 22 bp, Artificial Sequence
  chemically synthesized
gcgatatctaggtagccacagg

SEQ ID NO: 12428 - DNA, 22 bp, Artificial Sequence
  chemically synthesized
ggtagccacaggaggcggccac

SEQ ID NO: 12429 - DNA, 22 bp, Artificial Sequence
  chemically synthesized
gttgtctgcctggttcacagtg

SEQ ID NO: 12430 - DNA, 22 bp, Artificial Sequence
  chemically synthesized
tctgcctggttcacagtggcgc

SEQ ID NO: 12431 - DNA, 22 bp, Artificial Sequence
  chemically synthesized
cctggttcacagtggcgccctg

SEQ ID NO: 12432 - DNA, 22 bp, Artificial Sequence
  chemically synthesized
gttcacagtggcgccctgctcc

SEQ ID NO: 12433 - DNA, 22 bp, Artificial Sequence
  chemically synthesized
acagtggcgccctgctccacca

SEQ ID NO: 12434 - DNA, 22 bp, Artificial Sequence
  chemically synthesized
ctccaccaagaagcgcaccacc

SEQ ID NO: 12435 - DNA, 22 bp, Artificial Sequence
  chemically synthesized
caccaagaagcgcaccacctcc

SEQ ID NO: 12436 - DNA, 22 bp, Artificial Sequence
  chemically synthesized
caggttctcatcaatgcaggcc

SEQ ID NO: 12437 - DNA, 22 bp, Artificial Sequence
  chemically synthesized
tcatcaatgcaggcctgggggt

SEQ ID NO: 12438 - DNA, 22 bp, Artificial Sequence
  chemically synthesized
atcaatgcaggcctgggggtgg

SEQ ID NO: 12439 - DNA, 22 bp, Artificial Sequence
  chemically synthesized
ggggtgggaaacagccgtcagc

SEQ ID NO: 12440 - DNA, 22 bp, Artificial Sequence
  chemically synthesized
ccccagccacggtgtcccagca

SEQ ID NO: 12441 - DNA, 22 bp, Artificial Sequence
  chemically synthesized
cagagggagccacgaaaacaga

SEQ ID NO: 12442 - DNA, 22 bp, Artificial Sequence
  chemically synthesized
ggacagtggggaaaatgaccca

SEQ ID NO: 12443 - DNA, 22 bp, Artificial Sequence
  chemically synthesized
tggccactggctgtttaagata

SEQ ID NO: 12444 - DNA, 22 bp, Artificial Sequence
  chemically synthesized
gccactggctgtttaagatacg

SEQ ID NO: 12445 - DNA, 22 bp, Artificial Sequence
  chemically synthesized
gctgtttaagatacgcctggtt

SEQ ID NO: 12446 - DNA, 22 bp, Artificial Sequence
  chemically synthesized
tttaagatacgcctggttgccc

SEQ ID NO: 12447 - DNA, 22 bp, Artificial Sequence
  chemically synthesized
aagatacgcctggttgcccagt

SEQ ID NO: 12448 - DNA, 22 bp, Artificial Sequence
  chemically synthesized
agatacgcctggttgcccagtg

SEQ ID NO: 12449 - DNA, 22 bp, Artificial Sequence
  chemically synthesized
gttgcccagtggtcaggccggc

SEQ ID NO: 12450 - DNA, 22 bp, Artificial Sequence
  chemically synthesized
cccagtggtcaggccggccagg

SEQ ID NO: 12451 - DNA, 22 bp, Artificial Sequence
  chemically synthesized
cagtgctcagtggaaaccacga

SEQ ID NO: 12452 - DNA, 22 bp, Artificial Sequence
  chemically synthesized
agtgctcagtggaaaccacgaa

SEQ ID NO: 12453 - DNA, 22 bp, Artificial Sequence
  chemically synthesized
agtggaaaccacgaaaggactc

SEQ ID NO: 12454 - DNA, 22 bp, Artificial Sequence
  chemically synthesized
ctggctatctgcaaacaggaag

SEQ ID NO: 12455 - DNA, 22 bp, Artificial Sequence
  chemically synthesized
gctatctgcaaacaggaagtga

SEQ ID NO: 12456 - DNA, 22 bp, Artificial Sequence
  chemically synthesized
tctgcaaacaggaagtgaacgg

SEQ ID NO: 12457 - DNA, 22 bp, Artificial Sequence
  chemically synthesized
caaacaggaagtgaacggggaa

SEQ ID NO: 12458 - DNA, 22 bp, Artificial Sequence
  chemically synthesized
ctcatctgggtgcgggaacccc

SEQ ID NO: 12459 - DNA, 22 bp, Artificial Sequence
  chemically synthesized
tcatctgggtgcgggaacccca

SEQ ID NO: 12460 - DNA, 22 bp, Artificial Sequence
  chemically synthesized
atctgggtgcgggaaccccaca

SEQ ID NO: 12461 - DNA, 22 bp, Artificial Sequence
  chemically synthesized
ggtgcgggaaccccacatggta

SEQ ID NO: 12462 - DNA, 22 bp, Artificial Sequence
  chemically synthesized
ttagacacggcaaaacccccgt

SEQ ID NO: 12463 - DNA, 22 bp, Artificial Sequence
  chemically synthesized
gacacggcaaaacccccgtcac

SEQ ID NO: 12464 - DNA, 22 bp, Artificial Sequence
  chemically synthesized
ccagtgctcagactagggaaga

SEQ ID NO: 12465 - DNA, 22 bp, Artificial Sequence
  chemically synthesized
cagtgctcagactagggaagag

SEQ ID NO: 12466 - DNA, 22 bp, Artificial Sequence
  chemically synthesized
agactagggaagaggttccagc

SEQ ID NO: 12467 - DNA, 22 bp, Artificial Sequence
  chemically synthesized
gggaagaggttccagcccctcc

SEQ ID NO: 12468 - DNA, 22 bp, Artificial Sequence
  chemically synthesized
cagcccctcctccttcagagcc

SEQ ID NO: 12469 - DNA, 22 bp, Artificial Sequence
  chemically synthesized
ctccttcagagccaggagtcct

SEQ ID NO: 12470 - DNA, 22 bp, Artificial Sequence
  chemically synthesized
cttcagagccaggagtcctggc

SEQ ID NO: 12471 - DNA, 22 bp, Artificial Sequence
  chemically synthesized
cagagccaggagtcctggcccc

SEQ ID NO: 12472 - DNA, 22 bp, Artificial Sequence
  chemically synthesized
agagccaggagtcctggccccc

SEQ ID NO: 12473 - DNA, 22 bp, Artificial Sequence
  chemically synthesized
gcccccagcccctcctgcctta

SEQ ID NO: 12474 - DNA, 22 bp, Artificial Sequence
  chemically synthesized
ctgccttaaacccagccaggtc

SEQ ID NO: 12475 - DNA, 22 bp, Artificial Sequence
  chemically synthesized
ccttaaacccagccaggtcctt

SEQ ID NO: 12476 - DNA, 22 bp, Artificial Sequence
  chemically synthesized
aaacccagccaggtccttccaa

SEQ ID NO: 12477 - DNA, 22 bp, Artificial Sequence
  chemically synthesized
aacccagccaggtccttccaag

SEQ ID NO: 12478 - DNA, 22 bp, Artificial Sequence
  chemically synthesized
ccaagggtcaagctcggaaacc

SEQ ID NO: 12479 - DNA, 22 bp, Artificial Sequence
  chemically synthesized
caagggtcaagctcggaaacca

SEQ ID NO: 12480 - DNA, 22 bp, Artificial Sequence
  chemically synthesized
ggaaaccaccccagcagatact

SEQ ID NO: 12481 - DNA, 22 bp, Artificial Sequence
  chemically synthesized
tgcaggaacgaagccgtgggcc

SEQ ID NO: 12482 - DNA, 22 bp, Artificial Sequence
  chemically synthesized
caggaacgaagccgtgggccca

SEQ ID NO: 12483 - DNA, 22 bp, Artificial Sequence
  chemically synthesized
tgcagggtggaggaaggccacc

SEQ ID NO: 12484 - DNA, 22 bp, Artificial Sequence
  chemically synthesized
tgctgggacagactcaggggcc

SEQ ID NO: 12485 - DNA, 22 bp, Artificial Sequence
  chemically synthesized
ggacagactcaggggcctgggc

SEQ ID NO: 12486 - DNA, 22 bp, Artificial Sequence
  chemically synthesized
aggggcctgggcgggactccca

SEQ ID NO: 12487 - DNA, 22 bp, Artificial Sequence
  chemically synthesized
ggcgggactcccagaggggtga

SEQ ID NO: 12488 - DNA, 22 bp, Artificial Sequence
  chemically synthesized
ccagaggggtgagacagctgca

SEQ ID NO: 12489 - DNA, 22 bp, Artificial Sequence
  chemically synthesized
cacacctgtgtgcctgggcccc

SEQ ID NO: 12490 - DNA, 22 bp, Artificial Sequence
  chemically synthesized
tgtgcctgggccccaggctgtc

SEQ ID NO: 12491 - DNA, 22 bp, Artificial Sequence
  chemically synthesized
ggccccaggctgtcacactcca

SEQ ID NO: 12492 - DNA, 22 bp, Artificial Sequence
  chemically synthesized
tcacactccagttcactgaggc

SEQ ID NO: 12493 - DNA, 22 bp, Artificial Sequence
  chemically synthesized
cagttcactgaggccccctctg

SEQ ID NO: 12494 - DNA, 22 bp, Artificial Sequence
  chemically synthesized
actgaggccccctctgcacggg

SEQ ID NO: 12495 - DNA, 22 bp, Artificial Sequence
  chemically synthesized
aggccccctctgcacggggccc

SEQ ID NO: 12496 - DNA, 22 bp, Artificial Sequence
  chemically synthesized
tgcacggggccctgcagccagg

SEQ ID NO: 12497 - DNA, 22 bp, Artificial Sequence
  chemically synthesized
cacggggccctgcagccagggg

SEQ ID NO: 12498 - DNA, 22 bp, Artificial Sequence
  chemically synthesized
cagccaggggctgacacgggcc

SEQ ID NO: 12499 - DNA, 22 bp, Artificial Sequence
  chemically synthesized
acacgggccaccgtttctcatt

SEQ ID NO: 12500 - DNA, 22 bp, Artificial Sequence
  chemically synthesized
ctcattcttcccttaggggtcc

SEQ ID NO: 12501 - DNA, 22 bp, Artificial Sequence
  chemically synthesized
tcattcttcccttaggggtcca

SEQ ID NO: 12502 - DNA, 22 bp, Artificial Sequence
  chemically synthesized
attcttcccttaggggtccaaa

SEQ ID NO: 12503 - DNA, 22 bp, Artificial Sequence
  chemically synthesized
ttcccttaggggtccaaaactt

SEQ ID NO: 12504 - DNA, 22 bp, Artificial Sequence
  chemically synthesized
cccttaggggtccaaaacttgg

SEQ ID NO: 12505 - DNA, 22 bp, Artificial Sequence
  chemically synthesized
ccttaggggtccaaaacttggg

SEQ ID NO: 12506 - DNA, 22 bp, Artificial Sequence
  chemically synthesized
aggggtccaaaacttgggggga

SEQ ID NO: 12507 - DNA, 22 bp, Artificial Sequence
  chemically synthesized
ggggtccaaaacttggggggac

SEQ ID NO: 12508 - DNA, 22 bp, Artificial Sequence
  chemically synthesized
ggggggacaaaagccgaagtcc

SEQ ID NO: 12509 - DNA, 22 bp, Artificial Sequence
  chemically synthesized
gggggacaaaagccgaagtcca

SEQ ID NO: 12510 - DNA, 22 bp, Artificial Sequence
  chemically synthesized
gccccaggccttgtggacactg

SEQ ID NO: 12511 - DNA, 22 bp, Artificial Sequence
  chemically synthesized
ccccaggccttgtggacactgg

SEQ ID NO: 12512 - DNA, 22 bp, Artificial Sequence
  chemically synthesized
gtggacactgggtgggctccgg

SEQ ID NO: 12513 - DNA, 22 bp, Artificial Sequence
  chemically synthesized
tggacactgggtgggctccggg

SEQ ID NO: 12514 - DNA, 22 bp, Artificial Sequence
  chemically synthesized
ggtgggctccgggacctgaact

SEQ ID NO: 12515 - DNA, 22 bp, Artificial Sequence
  chemically synthesized
cgggacctgaactggagctgag

SEQ ID NO: 12516 - DNA, 22 bp, Artificial Sequence
  chemically synthesized
aactggagctgaggaaggagtg

SEQ ID NO: 12517 - DNA, 22 bp, Artificial Sequence
  chemically synthesized
gagctgaggaaggagtgaagct

SEQ ID NO: 12518 - DNA, 22 bp, Artificial Sequence
  chemically synthesized
aggaaggagtgaagctaaactc

SEQ ID NO: 12519 - DNA, 22 bp, Artificial Sequence
  chemically synthesized
aactcctagatccacgggataa

SEQ ID NO: 12520 - DNA, 22 bp, Artificial Sequence
  chemically synthesized
ctagatccacgggataaattac

SEQ ID NO: 12521 - DNA, 22 bp, Artificial Sequence
  chemically synthesized
gatccacgggataaattacccc

SEQ ID NO: 12522 - DNA, 22 bp, Artificial Sequence
  chemically synthesized
ccccccaagtccctcacctctc

SEQ ID NO: 12523 - DNA, 22 bp, Artificial Sequence
  chemically synthesized
acctctccaaagctgcccatct

SEQ ID NO: 12524 - DNA, 22 bp, Artificial Sequence
  chemically synthesized
tccaaagctgcccatctggagg

SEQ ID NO: 12525 - DNA, 22 bp, Artificial Sequence
  chemically synthesized
caaagctgcccatctggaggag

SEQ ID NO: 12526 - DNA, 22 bp, Artificial Sequence
  chemically synthesized
cccatctggaggaggcgggagg

SEQ ID NO: 12527 - DNA, 22 bp, Artificial Sequence
  chemically synthesized
gaggaggcgggagggagctacg

SEQ ID NO: 12528 - DNA, 22 bp, Artificial Sequence
  chemically synthesized
cgagggccaagagcatgaggtc

SEQ ID NO: 12529 - DNA, 22 bp, Artificial Sequence
  chemically synthesized
gggctgtgaaggggccgcacgt

SEQ ID NO: 12530 - DNA, 22 bp, Artificial Sequence
  chemically synthesized
tgaaggggccgcacgtgccctg

SEQ ID NO: 12531 - DNA, 22 bp, Artificial Sequence
  chemically synthesized
ggaacgggatgaactcggctcg

SEQ ID NO: 12532 - DNA, 22 bp, Artificial Sequence
  chemically synthesized
ggctcgtttatttccacccagt

SEQ ID NO: 12533 - DNA, 22 bp, Artificial Sequence
  chemically synthesized
gtttatttccacccagttgtca

SEQ ID NO: 12534 - DNA, 22 bp, Artificial Sequence
  chemically synthesized
atttccacccagttgtcatggc

SEQ ID NO: 12535 - DNA, 22 bp, Artificial Sequence
  chemically synthesized
tttccacccagttgtcatggcg

SEQ ID NO: 12536 - DNA, 22 bp, Artificial Sequence
  chemically synthesized
ccacccagttgtcatggcgata

SEQ ID NO: 12537 - DNA, 22 bp, Artificial Sequence
  chemically synthesized
cacccagttgtcatggcgatag

SEQ ID NO: 12538 - DNA, 22 bp, Artificial Sequence
  chemically synthesized
tcatggcgataggggagggggg

SEQ ID NO: 12539 - DNA, 22 bp, Artificial Sequence
  chemically synthesized
tccctttcaaggacctgcccag

SEQ ID NO: 12540 - DNA, 22 bp, Artificial Sequence
  chemically synthesized
ccctttcaaggacctgcccagt

SEQ ID NO: 12541 - DNA, 22 bp, Artificial Sequence
  chemically synthesized
cctttcaaggacctgcccagta

SEQ ID NO: 12542 - DNA, 22 bp, Artificial Sequence
  chemically synthesized
tcaaggacctgcccagtacagg

SEQ ID NO: 12543 - DNA, 22 bp, Artificial Sequence
  chemically synthesized
caaggacctgcccagtacaggc

SEQ ID NO: 12544 - DNA, 22 bp, Artificial Sequence
  chemically synthesized
aaggacctgcccagtacaggca

SEQ ID NO: 12545 - DNA, 22 bp, Artificial Sequence
  chemically synthesized
cccagtacaggcatccctgtga

SEQ ID NO: 12546 - DNA, 22 bp, Artificial Sequence
  chemically synthesized
tgaaagatgcctgaggcctggg

SEQ ID NO: 12547 - DNA, 22 bp, Artificial Sequence
  chemically synthesized
aggcctgggcaccagggactcc

SEQ ID NO: 12548 - DNA, 22 bp, Artificial Sequence
  chemically synthesized
ggcaccagggactccagagtcc

SEQ ID NO: 12549 - DNA, 22 bp, Artificial Sequence
  chemically synthesized
cagagtccaggcccaacccctc

SEQ ID NO: 12550 - DNA, 22 bp, Artificial Sequence
  chemically synthesized
cccattcaacccaggaggccag

SEQ ID NO: 12551 - DNA, 22 bp, Artificial Sequence
  chemically synthesized
aacccaggaggccaggccccag

SEQ ID NO: 12552 - DNA, 22 bp, Artificial Sequence
  chemically synthesized
ccgccctcagatgaaggagtcc

SEQ ID NO: 12553 - DNA, 22 bp, Artificial Sequence
  chemically synthesized
cgccctcagatgaaggagtcca

SEQ ID NO: 12554 - DNA, 22 bp, Artificial Sequence
  chemically synthesized
agatgaaggagtccaggccccc

SEQ ID NO: 12555 - DNA, 22 bp, Artificial Sequence
  chemically synthesized
tccccattcagacccaggggtc

SEQ ID NO: 12556 - DNA, 22 bp, Artificial Sequence
  chemically synthesized
cccattcagacccaggggtcca

SEQ ID NO: 12557 - DNA, 22 bp, Artificial Sequence
  chemically synthesized
agacccaggggtccaggcccag

SEQ ID NO: 12558 - DNA, 22 bp, Artificial Sequence
  chemically synthesized
cctaagacccagaagtccaggc

SEQ ID NO: 12559 - DNA, 22 bp, Artificial Sequence
  chemically synthesized
agacccagaagtccaggccccc

SEQ ID NO: 12560 - DNA, 22 bp, Artificial Sequence
  chemically synthesized
ctccctcagacccacgagtcca

SEQ ID NO: 12561 - DNA, 22 bp, Artificial Sequence
  chemically synthesized
cctcagacccacgagtccaggc

SEQ ID NO: 12562 - DNA, 22 bp, Artificial Sequence
  chemically synthesized
agacccacgagtccaggcccca

SEQ ID NO: 12563 - DNA, 22 bp, Artificial Sequence
  chemically synthesized
ctccctcggacccaggagtcca

SEQ ID NO: 12564 - DNA, 22 bp, Artificial Sequence
  chemically synthesized
cctcggacccaggagtccaggc

SEQ ID NO: 12565 - DNA, 22 bp, Artificial Sequence
  chemically synthesized
ggacccaggagtccaggccccc

SEQ ID NO: 12566 - DNA, 22 bp, Artificial Sequence
  chemically synthesized
caccctcagacccaggagtcca

SEQ ID NO: 12567 - DNA, 22 bp, Artificial Sequence
  chemically synthesized
agacccaggagtccaggcccca

SEQ ID NO: 12568 - DNA, 22 bp, Artificial Sequence
  chemically synthesized
ctccctcggacccaggagtcca

SEQ ID NO: 12569 - DNA, 22 bp, Artificial Sequence
  chemically synthesized
cctcggacccaggagtccaggc

SEQ ID NO: 12570 - DNA, 22 bp, Artificial Sequence
  chemically synthesized
ggacccaggagtccaggcccca

SEQ ID NO: 12571 - DNA, 22 bp, Artificial Sequence
  chemically synthesized
ctctctcaaacccaggagccca

SEQ ID NO: 12572 - DNA, 22 bp, Artificial Sequence
  chemically synthesized
tctcaaacccaggagcccaggc

SEQ ID NO: 12573 - DNA, 22 bp, Artificial Sequence
  chemically synthesized
tcaaacccaggagcccaggccc

SEQ ID NO: 12574 - DNA, 22 bp, Artificial Sequence
  chemically synthesized
aaacccaggagcccaggccccc

SEQ ID NO: 12575 - DNA, 22 bp, Artificial Sequence
  chemically synthesized
ttctctgttcagccctaagaat

SEQ ID NO: 12576 - DNA, 22 bp, Artificial Sequence
  chemically synthesized
ctctgttcagccctaagaatcc

SEQ ID NO: 12577 - DNA, 22 bp, Artificial Sequence
  chemically synthesized
tctgttcagccctaagaatcct

SEQ ID NO: 12578 - DNA, 22 bp, Artificial Sequence
  chemically synthesized
tgttcagccctaagaatcctgg

SEQ ID NO: 12579 - DNA, 22 bp, Artificial Sequence
  chemically synthesized
ttcagccctaagaatcctggct

SEQ ID NO: 12580 - DNA, 22 bp, Artificial Sequence
  chemically synthesized
agccctaagaatcctggctcca

SEQ ID NO: 12581 - DNA, 22 bp, Artificial Sequence
  chemically synthesized
agaatcctggctccagcccctc

SEQ ID NO: 12582 - DNA, 22 bp, Artificial Sequence
  chemically synthesized
gctccagcccctcctactctag

SEQ ID NO: 12583 - DNA, 22 bp, Artificial Sequence
  chemically synthesized
cagcccctcctactctagcccc

SEQ ID NO: 12584 - DNA, 22 bp, Artificial Sequence
  chemically synthesized
ctactctagcccccaaccccct

SEQ ID NO: 12585 - DNA, 22 bp, Artificial Sequence
  chemically synthesized
ctctagcccccaaccccctagc

SEQ ID NO: 12586 - DNA, 22 bp, Artificial Sequence
  chemically synthesized
tagcccccaaccccctagccac

SEQ ID NO: 12587 - DNA, 22 bp, Artificial Sequence
  chemically synthesized
gcccccaaccccctagccacta

SEQ ID NO: 12588 - DNA, 22 bp, Artificial Sequence
  chemically synthesized
gccactaaggcaattggggtgc

SEQ ID NO: 12589 - DNA, 22 bp, Artificial Sequence
  chemically synthesized
aggcaattggggtgcaggaatg

SEQ ID NO: 12590 - DNA, 22 bp, Artificial Sequence
  chemically synthesized
gggtgcaggaatgggggcaggg

SEQ ID NO: 12591 - DNA, 22 bp, Artificial Sequence
  chemically synthesized
accaagtggttgataaacccac

SEQ ID NO: 12592 - DNA, 22 bp, Artificial Sequence
  chemically synthesized
ataaacccacgtggggtaccct

SEQ ID NO: 12593 - DNA, 22 bp, Artificial Sequence
  chemically synthesized
agaacttgggaacagccacagc

SEQ ID NO: 12594 - DNA, 22 bp, Artificial Sequence
  chemically synthesized
gggaacagccacagcagggggg

SEQ ID NO: 12595 - DNA, 22 bp, Artificial Sequence
  chemically synthesized
ggaacagccacagcaggggggc

SEQ ID NO: 12596 - DNA, 22 bp, Artificial Sequence
  chemically synthesized
ggggacctgcctggagaaggat

SEQ ID NO: 12597 - DNA, 22 bp, Artificial Sequence
  chemically synthesized
gggacctgcctggagaaggatg

SEQ ID NO: 12598 - DNA, 22 bp, Artificial Sequence
  chemically synthesized
cctggagaaggatgcaggacga

SEQ ID NO: 12599 - DNA, 22 bp, Artificial Sequence
  chemically synthesized
gagaaggatgcaggacgagaaa

SEQ ID NO: 12600 - DNA, 22 bp, Artificial Sequence
  chemically synthesized
gccgggaatcaagagtcaccca

SEQ ID NO: 12601 - DNA, 22 bp, Artificial Sequence
  chemically synthesized
ttttcctaggactgagggtttc

SEQ ID NO: 12602 - DNA, 22 bp, Artificial Sequence
  chemically synthesized
tcctaggactgagggtttcagt

SEQ ID NO: 12603 - DNA, 22 bp, Artificial Sequence
  chemically synthesized
cctaggactgagggtttcagtg

SEQ ID NO: 12604 - DNA, 22 bp, Artificial Sequence
  chemically synthesized
ctaggactgagggtttcagtgc

SEQ ID NO: 12605 - DNA, 22 bp, Artificial Sequence
  chemically synthesized
ggactgagggtttcagtgctaa

SEQ ID NO: 12606 - DNA, 22 bp, Artificial Sequence
  chemically synthesized
agggtttcagtgctaaaactag

SEQ ID NO: 12607 - DNA, 22 bp, Artificial Sequence
  chemically synthesized
cagtgctaaaactaggctgtcc

SEQ ID NO: 12608 - DNA, 22 bp, Artificial Sequence
  chemically synthesized
agtgctaaaactaggctgtcct

SEQ ID NO: 12609 - DNA, 22 bp, Artificial Sequence
  chemically synthesized
aaactaggctgtcctgggcaaa

SEQ ID NO: 12610 - DNA, 22 bp, Artificial Sequence
  chemically synthesized
ggctgtcctgggcaaacagcat

SEQ ID NO: 12611 - DNA, 22 bp, Artificial Sequence
  chemically synthesized
tcctgggcaaacagcataagct

SEQ ID NO: 12612 - DNA, 22 bp, Artificial Sequence
  chemically synthesized
ggcaaacagcataagctggtca

SEQ ID NO: 12613 - DNA, 22 bp, Artificial Sequence
  chemically synthesized
gtcaccccacacccagacctga

SEQ ID NO: 12614 - DNA, 22 bp, Artificial Sequence
  chemically synthesized
acccaaacccagctcccctgct

SEQ ID NO: 12615 - DNA, 22 bp, Artificial Sequence
  chemically synthesized
ccctgcttcttggccacgtaac

SEQ ID NO: 12616 - DNA, 22 bp, Artificial Sequence
  chemically synthesized
cttcttggccacgtaacctgag

SEQ ID NO: 12617 - DNA, 22 bp, Artificial Sequence
  chemically synthesized
cttggccacgtaacctgagaag

SEQ ID NO: 12618 - DNA, 22 bp, Artificial Sequence
  chemically synthesized
ttggccacgtaacctgagaagg

SEQ ID NO: 12619 - DNA, 22 bp, Artificial Sequence
  chemically synthesized
ggccacgtaacctgagaaggga

SEQ ID NO: 12620 - DNA, 22 bp, Artificial Sequence
  chemically synthesized
gccacgtaacctgagaagggaa

SEQ ID NO: 12621 - DNA, 22 bp, Artificial Sequence
  chemically synthesized
agaagggaatccctcctctctg

SEQ ID NO: 12622 - DNA, 22 bp, Artificial Sequence
  chemically synthesized
ctctctgaaccccagcccaccc

SEQ ID NO: 12623 - DNA, 22 bp, Artificial Sequence
  chemically synthesized
tctgaaccccagcccaccccaa

SEQ ID NO: 12624 - DNA, 22 bp, Artificial Sequence
  chemically synthesized
tgaaccccagcccaccccaatg

SEQ ID NO: 12625 - DNA, 22 bp, Artificial Sequence
  chemically synthesized
aaccccagcccaccccaatgct

SEQ ID NO: 12626 - DNA, 22 bp, Artificial Sequence
  chemically synthesized
caggcctcctgggataccccga

SEQ ID NO: 12627 - DNA, 22 bp, Artificial Sequence
  chemically synthesized
ctgggataccccgaagagtgag

SEQ ID NO: 12628 - DNA, 22 bp, Artificial Sequence
  chemically synthesized
ggataccccgaagagtgagttt

SEQ ID NO: 12629 - DNA, 22 bp, Artificial Sequence
  chemically synthesized
gccaagcagtcaccccacagtt

SEQ ID NO: 12630 - DNA, 22 bp, Artificial Sequence
  chemically synthesized
ccaagcagtcaccccacagttg

SEQ ID NO: 12631 - DNA, 22 bp, Artificial Sequence
  chemically synthesized
gaggagaatccacccaaaaggc

SEQ ID NO: 12632 - DNA, 22 bp, Artificial Sequence
  chemically synthesized
gtagacagggctggggtggcct

SEQ ID NO: 12633 - DNA, 22 bp, Artificial Sequence
  chemically synthesized
gggtggcctctcgtggggtcca

SEQ ID NO: 12634 - DNA, 22 bp, Artificial Sequence
  chemically synthesized
tcgtggggtccaggccaagtag

SEQ ID NO: 12635 - DNA, 22 bp, Artificial Sequence
  chemically synthesized
gtggggtccaggccaagtaggt

SEQ ID NO: 12636 - DNA, 22 bp, Artificial Sequence
  chemically synthesized
gggcctctgggggatgcagggg

SEQ ID NO: 12637 - DNA, 22 bp, Artificial Sequence
  chemically synthesized
tgggggatgcaggggaaggggg

SEQ ID NO: 12638 - DNA, 22 bp, Artificial Sequence
  chemically synthesized
ggggatgcaggggaagggggat

SEQ ID NO: 12639 - DNA, 22 bp, Artificial Sequence
  chemically synthesized
agtctgaagagcagagccagga

SEQ ID NO: 12640 - DNA, 22 bp, Artificial Sequence
  chemically synthesized
aagagcagagccaggaacccct

SEQ ID NO: 12641 - DNA, 22 bp, Artificial Sequence
  chemically synthesized
tagggaaggggcaggagagcca

SEQ ID NO: 12642 - DNA, 22 bp, Artificial Sequence
  chemically synthesized
agcgcctctcctgggcttgcca

SEQ ID NO: 12643 - DNA, 22 bp, Artificial Sequence
  chemically synthesized
tcctgggcttgccaaggactca

SEQ ID NO: 12644 - DNA, 22 bp, Artificial Sequence
  chemically synthesized
ctgggcttgccaaggactcaaa

SEQ ID NO: 12645 - DNA, 22 bp, Artificial Sequence
  chemically synthesized
ggcttgccaaggactcaaaccc

SEQ ID NO: 12646 - DNA, 22 bp, Artificial Sequence
  chemically synthesized
gccaaggactcaaacccagaag

SEQ ID NO: 12647 - DNA, 22 bp, Artificial Sequence
  chemically synthesized
ccaaggactcaaacccagaagc

SEQ ID NO: 12648 - DNA, 22 bp, Artificial Sequence
  chemically synthesized
aaacccagaagcccagagcagg

SEQ ID NO: 12649 - DNA, 22 bp, Artificial Sequence
  chemically synthesized
agggaagcgggaccctgctctg

SEQ ID NO: 12650 - DNA, 22 bp, Artificial Sequence
  chemically synthesized
gggaagcgggaccctgctctgg

SEQ ID NO: 12651 - DNA, 22 bp, Artificial Sequence
  chemically synthesized
ctctgggcggaggaatatgtcc

SEQ ID NO: 12652 - DNA, 22 bp, Artificial Sequence
  chemically synthesized
tgggcggaggaatatgtcccag

SEQ ID NO: 12653 - DNA, 22 bp, Artificial Sequence
  chemically synthesized
ggcggaggaatatgtcccagat

SEQ ID NO: 12654 - DNA, 22 bp, Artificial Sequence
  chemically synthesized
gggactctttaaggaaagaagg

SEQ ID NO: 12655 - DNA, 22 bp, Artificial Sequence
  chemically synthesized
tttaaggaaagaaggatggaga

SEQ ID NO: 12656 - DNA, 22 bp, Artificial Sequence
  chemically synthesized
taaggaaagaaggatggagaaa

SEQ ID NO: 12657 - DNA, 22 bp, Artificial Sequence
  chemically synthesized
aaggaaagaaggatggagaaag

SEQ ID NO: 12658 - DNA, 22 bp, Artificial Sequence
  chemically synthesized
aggaaagaaggatggagaaaga

SEQ ID NO: 12659 - DNA, 22 bp, Artificial Sequence
  chemically synthesized
gtgaacacctaggacgcaccat

SEQ ID NO: 12660 - DNA, 22 bp, Artificial Sequence
  chemically synthesized
ggacgcaccattctcacaaagg

SEQ ID NO: 12661 - DNA, 22 bp, Artificial Sequence
  chemically synthesized
tcacaaagggagttttccacac

SEQ ID NO: 12662 - DNA, 22 bp, Artificial Sequence
  chemically synthesized
acaaagggagttttccacacgg

SEQ ID NO: 12663 - DNA, 22 bp, Artificial Sequence
  chemically synthesized
tccacacggacacccccctcct

SEQ ID NO: 12664 - DNA, 22 bp, Artificial Sequence
  chemically synthesized
ccacacggacacccccctcctc

SEQ ID NO: 12665 - DNA, 22 bp, Artificial Sequence
  chemically synthesized
cacacggacacccccctcctca

SEQ ID NO: 12666 - DNA, 22 bp, Artificial Sequence
  chemically synthesized
ctcaccacagccctgccaggac

SEQ ID NO: 12667 - DNA, 22 bp, Artificial Sequence
  chemically synthesized
accacagccctgccaggacggg

SEQ ID NO: 12668 - DNA, 22 bp, Artificial Sequence
  chemically synthesized
ccaggacggggctggctactgg

SEQ ID NO: 12669 - DNA, 22 bp, Artificial Sequence
  chemically synthesized
gctactggccttatctcacagg

SEQ ID NO: 12670 - DNA, 22 bp, Artificial Sequence
  chemically synthesized
ctggccttatctcacaggtaaa

SEQ ID NO: 12671 - DNA, 22 bp, Artificial Sequence
  chemically synthesized
gccttatctcacaggtaaaact

SEQ ID NO: 12672 - DNA, 22 bp, Artificial Sequence
  chemically synthesized
atctcacaggtaaaactgacgc

SEQ ID NO: 12673 - DNA, 22 bp, Artificial Sequence
  chemically synthesized
tctcacaggtaaaactgacgca

SEQ ID NO: 12674 - DNA, 22 bp, Artificial Sequence
  chemically synthesized
acaggtaaaactgacgcacgga

SEQ ID NO: 12675 - DNA, 22 bp, Artificial Sequence
  chemically synthesized
acgcacggaggaacaatataaa

SEQ ID NO: 12676 - DNA, 22 bp, Artificial Sequence
  chemically synthesized
gggactagaaaggtgaagagcc

SEQ ID NO: 12677 - DNA, 22 bp, Artificial Sequence
  chemically synthesized
gaaaggtgaagagccaaagtta

SEQ ID NO: 12678 - DNA, 22 bp, Artificial Sequence
  chemically synthesized
gaactcaggaccaacttattct

SEQ ID NO: 12679 - DNA, 22 bp, Artificial Sequence
  chemically synthesized
aggaccaacttattctgatttt

SEQ ID NO: 12680 - DNA, 22 bp, Artificial Sequence
  chemically synthesized
attctgattttgtttttccaaa

SEQ ID NO: 12681 - DNA, 22 bp, Artificial Sequence
  chemically synthesized
ttctgattttgtttttccaaac

SEQ ID NO: 12682 - DNA, 22 bp, Artificial Sequence
  chemically synthesized
tgattttgtttttccaaactgc

SEQ ID NO: 12683 - DNA, 22 bp, Artificial Sequence
  chemically synthesized
attttgtttttccaaactgctt

SEQ ID NO: 12684 - DNA, 22 bp, Artificial Sequence
  chemically synthesized
tgtttttccaaactgcttctcc

SEQ ID NO: 12685 - DNA, 22 bp, Artificial Sequence
  chemically synthesized
gtttttccaaactgcttctcct

SEQ ID NO: 12686 - DNA, 22 bp, Artificial Sequence
  chemically synthesized
tttttccaaactgcttctcctc

SEQ ID NO: 12687 - DNA, 22 bp, Artificial Sequence
  chemically synthesized
ttccaaactgcttctcctcttg

SEQ ID NO: 12688 - DNA, 22 bp, Artificial Sequence
  chemically synthesized
tccaaactgcttctcctcttgg

SEQ ID NO: 12689 - DNA, 22 bp, Artificial Sequence
  chemically synthesized
ccaaactgcttctcctcttggg

SEQ ID NO: 12690 - DNA, 22 bp, Artificial Sequence
  chemically synthesized
caaactgcttctcctcttggga

SEQ ID NO: 12691 - DNA, 22 bp, Artificial Sequence
  chemically synthesized
cttctcctcttgggaagtgtaa

SEQ ID NO: 12692 - DNA, 22 bp, Artificial Sequence
  chemically synthesized
ctcctcttgggaagtgtaagga

SEQ ID NO: 12693 - DNA, 22 bp, Artificial Sequence
  chemically synthesized
tcctcttgggaagtgtaaggaa

SEQ ID NO: 12694 - DNA, 22 bp, Artificial Sequence
  chemically synthesized
ctcttgggaagtgtaaggaagc

SEQ ID NO: 12695 - DNA, 22 bp, Artificial Sequence
  chemically synthesized
ttgggaagtgtaaggaagctgc

SEQ ID NO: 12696 - DNA, 22 bp, Artificial Sequence
  chemically synthesized
gggaagtgtaaggaagctgcag

SEQ ID NO: 12697 - DNA, 22 bp, Artificial Sequence
  chemically synthesized
ggaagtgtaaggaagctgcagc

SEQ ID NO: 12698 - DNA, 22 bp, Artificial Sequence
  chemically synthesized
cagcaccaggatcagtgaaacg

SEQ ID NO: 12699 - DNA, 22 bp, Artificial Sequence
  chemically synthesized
aggttctgggagagggtagcgc

SEQ ID NO: 12700 - DNA, 22 bp, Artificial Sequence
  chemically synthesized
tgggagagggtagcgcagggtg

SEQ ID NO: 12701 - DNA, 22 bp, Artificial Sequence
  chemically synthesized
ggagagggtagcgcagggtggc

SEQ ID NO: 12702 - DNA, 22 bp, Artificial Sequence
  chemically synthesized
agaaccgggcaggtcacgcatc

SEQ ID NO: 12703 - DNA, 22 bp, Artificial Sequence
  chemically synthesized
ccctcccaccccctgccaagct

SEQ ID NO: 12704 - DNA, 22 bp, Artificial Sequence
  chemically synthesized
cctcccaccccctgccaagctc

SEQ ID NO: 12705 - DNA, 22 bp, Artificial Sequence
  chemically synthesized
ccaccccctgccaagctctccc

SEQ ID NO: 12706 - DNA, 22 bp, Artificial Sequence
  chemically synthesized
ccaagctctccctcccaggatc

SEQ ID NO: 12707 - DNA, 22 bp, Artificial Sequence
  chemically synthesized
tccctcccaggatcctctctgg

SEQ ID NO: 12708 - DNA, 22 bp, Artificial Sequence
  chemically synthesized
cctcccaggatcctctctggct

SEQ ID NO: 12709 - DNA, 22 bp, Artificial Sequence
  chemically synthesized
ccaggatcctctctggctccat

SEQ ID NO: 12710 - DNA, 22 bp, Artificial Sequence
  chemically synthesized
tctggctccatcgtaagcaaac

SEQ ID NO: 12711 - DNA, 22 bp, Artificial Sequence
  chemically synthesized
tggctccatcgtaagcaaacct

SEQ ID NO: 12712 - DNA, 22 bp, Artificial Sequence
  chemically synthesized
gctccatcgtaagcaaacctta

SEQ ID NO: 12713 - DNA, 22 bp, Artificial Sequence
  chemically synthesized
catcgtaagcaaaccttagagg

SEQ ID NO: 12714 - DNA, 22 bp, Artificial Sequence
  chemically synthesized
agaggttctggcaaggagagag

SEQ ID NO: 12715 - DNA, 22 bp, Artificial Sequence
  chemically synthesized
gaggttctggcaaggagagaga

SEQ ID NO: 12716 - DNA, 22 bp, Artificial Sequence
  chemically synthesized
tggcaaggagagagatggctcc

SEQ ID NO: 12717 - DNA, 22 bp, Artificial Sequence
  chemically synthesized
gcaaggagagagatggctccag

SEQ ID NO: 12718 - DNA, 22 bp, Artificial Sequence
  chemically synthesized
caggaaatgggggtgtgtcacc

SEQ ID NO: 12719 - DNA, 22 bp, Artificial Sequence
  chemically synthesized
cctaacaggaggtgggggttag

SEQ ID NO: 12720 - DNA, 22 bp, Artificial Sequence
  chemically synthesized
acaggaggtgggggttagaccc

SEQ ID NO: 12721 - DNA, 22 bp, Artificial Sequence
  chemically synthesized
gacccaatatcaggagactagg

SEQ ID NO: 12722 - DNA, 22 bp, Artificial Sequence
  chemically synthesized
ggaaggaggaggcctaaggatg

SEQ ID NO: 12723 - DNA, 22 bp, Artificial Sequence
  chemically synthesized
aggatggggcttttctgtcacc

SEQ ID NO: 12724 - DNA, 22 bp, Artificial Sequence
  chemically synthesized
ttctgtcaccaatcctgtccct

SEQ ID NO: 12725 - DNA, 22 bp, Artificial Sequence
  chemically synthesized
tctgtcaccaatcctgtcccta

SEQ ID NO: 12726 - DNA, 22 bp, Artificial Sequence
  chemically synthesized
ctgtcaccaatcctgtccctag

SEQ ID NO: 12727 - DNA, 22 bp, Artificial Sequence
  chemically synthesized
tgtcaccaatcctgtccctagt

SEQ ID NO: 12728 - DNA, 22 bp, Artificial Sequence
  chemically synthesized
tcaccaatcctgtccctagtgg

SEQ ID NO: 12729 - DNA, 22 bp, Artificial Sequence
  chemically synthesized
tccctagtggccccactgtggg

SEQ ID NO: 12730 - DNA, 22 bp, Artificial Sequence
  chemically synthesized
gtggccccactgtggggtggag

SEQ ID NO: 12731 - DNA, 22 bp, Artificial Sequence
  chemically synthesized
tggggtggaggggacagataaa

SEQ ID NO: 12732 - DNA, 22 bp, Artificial Sequence
  chemically synthesized
accggccctgggaatataaggt

SEQ ID NO: 12733 - DNA, 22 bp, Artificial Sequence
  chemically synthesized
ggaatataaggtggtcccagct

SEQ ID NO: 12734 - DNA, 22 bp, Artificial Sequence
  chemically synthesized
ggggacacaggatccctggagg

SEQ ID NO: 12735 - DNA, 22 bp, Artificial Sequence
  chemically synthesized
gaggcagcaaacatgctgtcct

SEQ ID NO: 12736 - DNA, 22 bp, Artificial Sequence
  chemically synthesized
tcctgaagtggacataggggcc

SEQ ID NO: 12737 - DNA, 22 bp, Artificial Sequence
  chemically synthesized
aagtggacataggggcccgggt

SEQ ID NO: 12738 - DNA, 22 bp, Artificial Sequence
  chemically synthesized
gaggaagaagactagctgagct

SEQ ID NO: 12739 - DNA, 22 bp, Artificial Sequence
  chemically synthesized
gctgagctctcggacccctgga

SEQ ID NO: 12740 - DNA, 22 bp, Artificial Sequence
  chemically synthesized
agctctcggacccctggaagat

SEQ ID NO: 12741 - DNA, 22 bp, Artificial Sequence
  chemically synthesized
tcggacccctggaagatgccat

SEQ ID NO: 12742 - DNA, 22 bp, Artificial Sequence
  chemically synthesized
ggacccctggaagatgccatga

SEQ ID NO: 12743 - DNA, 22 bp, Artificial Sequence
  chemically synthesized
gaagatgccatgacagggggct

SEQ ID NO: 12744 - DNA, 22 bp, Artificial Sequence
  chemically synthesized
gaagagctagcacagactagag

SEQ ID NO: 12745 - DNA, 22 bp, Artificial Sequence
  chemically synthesized
gcacagactagagaggtaaggg

SEQ ID NO: 12746 - DNA, 22 bp, Artificial Sequence
  chemically synthesized
gagaggtaaggggggtagggga

SEQ ID NO: 12747 - DNA, 22 bp, Artificial Sequence
  chemically synthesized
cccaaatgaaaggagtgagagg

SEQ ID NO: 12748 - DNA, 22 bp, Artificial Sequence
  chemically synthesized
aagccagggagacggggtactt

SEQ ID NO: 12749 - DNA, 22 bp, Artificial Sequence
  chemically synthesized
tggggttgtccagaaaaacggt

SEQ ID NO: 12750 - DNA, 22 bp, Artificial Sequence
  chemically synthesized
ggggttgtccagaaaaacggtg

SEQ ID NO: 12751 - DNA, 22 bp, Artificial Sequence
  chemically synthesized
gggttgtccagaaaaacggtga

SEQ ID NO: 12752 - DNA, 22 bp, Artificial Sequence
  chemically synthesized
tccagaaaaacggtgatgatgc

SEQ ID NO: 12753 - DNA, 22 bp, Artificial Sequence
  chemically synthesized
caagaaggggaggcgggacgca

SEQ ID NO: 12754 - DNA, 22 bp, Artificial Sequence
  chemically synthesized
agaaacgagagatggcacaggc

SEQ ID NO: 12755 - DNA, 22 bp, Artificial Sequence
  chemically synthesized
ggtgagggaggagagatgcccg

SEQ ID NO: 12756 - DNA, 22 bp, Artificial Sequence
  chemically synthesized
agaggacatcacgtggtgcagc

SEQ ID NO: 12757 - DNA, 22 bp, Artificial Sequence
  chemically synthesized
cggaaagagcatccttgggcag

SEQ ID NO: 12758 - DNA, 22 bp, Artificial Sequence
  chemically synthesized
gggcagcaacacagcagagagc

SEQ ID NO: 12759 - DNA, 22 bp, Artificial Sequence
  chemically synthesized
ggcagcaacacagcagagagca

SEQ ID NO: 12760 - DNA, 22 bp, Artificial Sequence
  chemically synthesized
aaggaggcggcagggaaggatc

SEQ ID NO: 12761 - DNA, 22 bp, Artificial Sequence
  chemically synthesized
ggccagccgtagaggtgaccca

SEQ ID NO: 12762 - DNA, 22 bp, Artificial Sequence
  chemically synthesized
cagacagaaagcggcacaggcc

SEQ ID NO: 12763 - DNA, 22 bp, Artificial Sequence
  chemically synthesized
cctgggaaggggaaacagtggg

SEQ ID NO: 12764 - DNA, 22 bp, Artificial Sequence
  chemically synthesized
ggaaggggaaacagtgggccag

SEQ ID NO: 12765 - DNA, 22 bp, Artificial Sequence
  chemically synthesized
aaagtggtccggactcaggaga

SEQ ID NO: 12766 - DNA, 22 bp, Artificial Sequence
  chemically synthesized
aggagagagacggcagcgttag

SEQ ID NO: 12767 - DNA, 22 bp, Artificial Sequence
  chemically synthesized
gagggcagagttccggcggcac

SEQ ID NO: 12768 - DNA, 22 bp, Artificial Sequence
  chemically synthesized
cggcggcacagcaagggcactc

SEQ ID NO: 12769 - DNA, 22 bp, Artificial Sequence
  chemically synthesized
gggggcgagaggagggcagcgc

SEQ ID NO: 12770 - DNA, 22 bp, Artificial Sequence
  chemically synthesized
agctatgggagctggctcaggt

SEQ ID NO: 12771 - DNA, 22 bp, Artificial Sequence
  chemically synthesized
tgggagctggctcaggttcagg

SEQ ID NO: 12772 - DNA, 22 bp, Artificial Sequence
  chemically synthesized
gctcaggttcaggagagggcag

SEQ ID NO: 12773 - DNA, 22 bp, Artificial Sequence
  chemically synthesized
aggttcaggagagggcagggca

SEQ ID NO: 12774 - DNA, 22 bp, Artificial Sequence
  chemically synthesized
aggagagggcagggcagggaag

SEQ ID NO: 12775 - DNA, 22 bp, Artificial Sequence
  chemically synthesized
gaggggctcaacatcggaagag

SEQ ID NO: 12776 - DNA, 22 bp, Artificial Sequence
  chemically synthesized
aacatcggaagaggggaagtcg

SEQ ID NO: 12777 - DNA, 22 bp, Artificial Sequence
  chemically synthesized
catgggtcagcacaggctgcca

SEQ ID NO: 12778 - DNA, 22 bp, Artificial Sequence
  chemically synthesized
ccaaagccagggccagttaaag

SEQ ID NO: 12779 - DNA, 22 bp, Artificial Sequence
  chemically synthesized
aagcgactccaatgcggaagag

SEQ ID NO: 12780 - DNA, 22 bp, Artificial Sequence
  chemically synthesized
caatgcggaagagagtaggtcg

SEQ ID NO: 12781 - DNA, 22 bp, Artificial Sequence
  chemically synthesized
gggcagagtggtcagcacagag

SEQ ID NO: 12782 - DNA, 22 bp, Artificial Sequence
  chemically synthesized
agcccagggccagttgaagcgg

SEQ ID NO: 12783 - DNA, 22 bp, Artificial Sequence
  chemically synthesized
aagcggctccaattcggaagtg

SEQ ID NO: 12784 - DNA, 22 bp, Artificial Sequence
  chemically synthesized
caattcggaagtggggtggtcg

SEQ ID NO: 12785 - DNA, 22 bp, Artificial Sequence
  chemically synthesized
ggaagtggggtggtcgaagggg

SEQ ID NO: 12786 - DNA, 22 bp, Artificial Sequence
  chemically synthesized
ggacggggtgtcagcatagggt

SEQ ID NO: 12787 - DNA, 22 bp, Artificial Sequence
  chemically synthesized
gcaacggggaaggaggatgccc

SEQ ID NO: 12788 - DNA, 22 bp, Artificial Sequence
  chemically synthesized
gccccgggagacgccgggcggg

SEQ ID NO: 12789 - DNA, 22 bp, Artificial Sequence
  chemically synthesized
acctggtgcagggcgctgatac

SEQ ID NO: 12790 - DNA, 22 bp, Artificial Sequence
  chemically synthesized
gtgcagggcgctgataccgtcg

SEQ ID NO: 12791 - DNA, 22 bp, Artificial Sequence
  chemically synthesized
ataccgtcggcgttggtggagt

SEQ ID NO: 12792 - DNA, 22 bp, Artificial Sequence
  chemically synthesized
gtggagtccagcacggcgcggg

SEQ ID NO: 12793 - DNA, 22 bp, Artificial Sequence
  chemically synthesized
ggcgccggggccagggtcggcg

SEQ ID NO: 12794 - DNA, 22 bp, Artificial Sequence
  chemically synthesized
gtccaggtcgccgcccgcacag

SEQ ID NO: 12795 - DNA, 22 bp, Artificial Sequence
  chemically synthesized
ggcggcgcgctcgaagcggacg

SEQ ID NO: 12796 - DNA, 22 bp, Artificial Sequence
  chemically synthesized
gaagcggacggtgcgggcgcgg

SEQ ID NO: 12797 - DNA, 22 bp, Artificial Sequence
  chemically synthesized
tccggggccaggctcggcgccc

SEQ ID NO: 12798 - DNA, 22 bp, Artificial Sequence
  chemically synthesized
cggggccaggctcggcgcccgc

SEQ ID NO: 12799 - DNA, 22 bp, Artificial Sequence
  chemically synthesized
ggcgcccgcccgcgccccccac

SEQ ID NO: 12800 - DNA, 22 bp, Artificial Sequence
  chemically synthesized
ccgcagctgctcccgtcgccgc

SEQ ID NO: 12801 - DNA, 22 bp, Artificial Sequence
  chemically synthesized
ctcccgtcgccgctcccgggca

SEQ ID NO: 12802 - DNA, 22 bp, Artificial Sequence
  chemically synthesized
ccgtcgccgctcccgggcagcc

SEQ ID NO: 12803 - DNA, 22 bp, Artificial Sequence
  chemically synthesized
ccgggcagccgccgccgccgcc

SEQ ID NO: 12804 - DNA, 22 bp, Artificial Sequence
  chemically synthesized
tccggacatcgcaccgcccgcc

SEQ ID NO: 12805 - DNA, 22 bp, Artificial Sequence
  chemically synthesized
cggacatcgcaccgcccgcccg

SEQ ID NO: 12806 - DNA, 22 bp, Artificial Sequence
  chemically synthesized
gggctcggcgctcgctcgctcg

SEQ ID NO: 12807 - DNA, 22 bp, Artificial Sequence
  chemically synthesized
ggcgctcgctcgctcgctgggc

SEQ ID NO: 12808 - DNA, 22 bp, Artificial Sequence
  chemically synthesized
gctcgctcgctgggcgggcggg

SEQ ID NO: 12809 - DNA, 22 bp, Artificial Sequence
  chemically synthesized
gctcgctgggcgggcgggcggt

SEQ ID NO: 12810 - DNA, 22 bp, Artificial Sequence
  chemically synthesized
gctgggcgggcgggcggtgcga

SEQ ID NO: 12811 - DNA, 22 bp, Artificial Sequence
  chemically synthesized
ggcgggcgggcggtgcgatgtc

SEQ ID NO: 12812 - DNA, 22 bp, Artificial Sequence
  chemically synthesized
gcccgggggcggcggcggcggc

SEQ ID NO: 12813 - DNA, 22 bp, Artificial Sequence
  chemically synthesized
cccgggagcggcgacgggagca

SEQ ID NO: 12814 - DNA, 22 bp, Artificial Sequence
  chemically synthesized
cggcagtggggggcgcgggcgg

SEQ ID NO: 12815 - DNA, 22 bp, Artificial Sequence
  chemically synthesized
gccccggagagcgccgcgcccg

SEQ ID NO: 12816 - DNA, 22 bp, Artificial Sequence
  chemically synthesized
cgagcgcgccgccgagttcctg

SEQ ID NO: 12817 - DNA, 22 bp, Artificial Sequence
  chemically synthesized
gagcgcgccgccgagttcctgg

SEQ ID NO: 12818 - DNA, 22 bp, Artificial Sequence
  chemically synthesized
ctggcggcctgtgcgggcggcg

SEQ ID NO: 12819 - DNA, 22 bp, Artificial Sequence
  chemically synthesized
gcggcctgtgcgggcggcgacc

SEQ ID NO: 12820 - DNA, 22 bp, Artificial Sequence
  chemically synthesized
tgcgggcggcgacctggacgag

SEQ ID NO: 12821 - DNA, 22 bp, Artificial Sequence
  chemically synthesized
gacgaggcgcgtctgatgctgc

SEQ ID NO: 12822 - DNA, 22 bp, Artificial Sequence
  chemically synthesized
atgctgcgcgccgccgaccctg

SEQ ID NO: 12823 - DNA, 22 bp, Artificial Sequence
  chemically synthesized
cgcgccgccgaccctggccccg

SEQ ID NO: 12824 - DNA, 22 bp, Artificial Sequence
  chemically synthesized
gccccggcgccgagctcgaccc

SEQ ID NO: 12825 - DNA, 22 bp, Artificial Sequence
  chemically synthesized
gaccccgccgcgccgccgcccg

SEQ ID NO: 12826 - DNA, 22 bp, Artificial Sequence
  chemically synthesized
gactccaccaacgccgacggta

SEQ ID NO: 12827 - DNA, 22 bp, Artificial Sequence
  chemically synthesized
caccaacgccgacggtatcagc

SEQ ID NO: 12828 - DNA, 22 bp, Artificial Sequence
  chemically synthesized
caccaggtcagcgccccccgcc

SEQ ID NO: 12829 - DNA, 22 bp, Artificial Sequence
  chemically synthesized
ccggggccaggtccaccctctg

SEQ ID NO: 12830 - DNA, 22 bp, Artificial Sequence
  chemically synthesized
tgctgcgccacctggggcatcc

SEQ ID NO: 12831 - DNA, 22 bp, Artificial Sequence
  chemically synthesized
ctgcgccacctggggcatcctc

SEQ ID NO: 12832 - DNA, 22 bp, Artificial Sequence
  chemically synthesized
cgccacctggggcatcctcctt

SEQ ID NO: 12833 - DNA, 22 bp, Artificial Sequence
  chemically synthesized
gggcatcctccttccccgttgc

SEQ ID NO: 12834 - DNA, 22 bp, Artificial Sequence
  chemically synthesized
cttccccgttgccagtctcgat

SEQ ID NO: 12835 - DNA, 22 bp, Artificial Sequence
  chemically synthesized
ccccgttgccagtctcgatccg

SEQ ID NO: 12836 - DNA, 22 bp, Artificial Sequence
  chemically synthesized
cccgttgccagtctcgatccgc

SEQ ID NO: 12837 - DNA, 22 bp, Artificial Sequence
  chemically synthesized
ccagtctcgatccgccccgtcg

SEQ ID NO: 12838 - DNA, 22 bp, Artificial Sequence
  chemically synthesized
gatccgccccgtcgttcctggc

SEQ ID NO: 12839 - DNA, 22 bp, Artificial Sequence
  chemically synthesized
ctggccctgggctttgccaccc

SEQ ID NO: 12840 - DNA, 22 bp, Artificial Sequence
  chemically synthesized
gccctgggctttgccaccctat

SEQ ID NO: 12841 - DNA, 22 bp, Artificial Sequence
  chemically synthesized
ggctttgccaccctatgctgac

SEQ ID NO: 12842 - DNA, 22 bp, Artificial Sequence
  chemically synthesized
tgccaccctatgctgacacccc

SEQ ID NO: 12843 - DNA, 22 bp, Artificial Sequence
  chemically synthesized
gccaccctatgctgacaccccg

SEQ ID NO: 12844 - DNA, 22 bp, Artificial Sequence
  chemically synthesized
ccaccctatgctgacaccccgt

SEQ ID NO: 12845 - DNA, 22 bp, Artificial Sequence
  chemically synthesized
tgctgacaccccgtcccagtcc

SEQ ID NO: 12846 - DNA, 22 bp, Artificial Sequence
  chemically synthesized
acaccccgtcccagtccccctt

SEQ ID NO: 12847 - DNA, 22 bp, Artificial Sequence
  chemically synthesized
accattccccttcgaccacccc

SEQ ID NO: 12848 - DNA, 22 bp, Artificial Sequence
  chemically synthesized
ccattccccttcgaccacccca

SEQ ID NO: 12849 - DNA, 22 bp, Artificial Sequence
  chemically synthesized
cccttcgaccaccccacttccg

SEQ ID NO: 12850 - DNA, 22 bp, Artificial Sequence
  chemically synthesized
cgaccaccccacttccgaattg

SEQ ID NO: 12851 - DNA, 22 bp, Artificial Sequence
  chemically synthesized
gaccaccccacttccgaattgg

SEQ ID NO: 12852 - DNA, 22 bp, Artificial Sequence
  chemically synthesized
ccgaattggagccgcttcaact

SEQ ID NO: 12853 - DNA, 22 bp, Artificial Sequence
  chemically synthesized
cgaattggagccgcttcaactg

SEQ ID NO: 12854 - DNA, 22 bp, Artificial Sequence
  chemically synthesized
gagccgcttcaactggccctgg

SEQ ID NO: 12855 - DNA, 22 bp, Artificial Sequence
  chemically synthesized
caactggccctgggcttagcca

SEQ ID NO: 12856 - DNA, 22 bp, Artificial Sequence
  chemically synthesized
aactggccctgggcttagccac

SEQ ID NO: 12857 - DNA, 22 bp, Artificial Sequence
  chemically synthesized
gccctgggcttagccactctgt

SEQ ID NO: 12858 - DNA, 22 bp, Artificial Sequence
  chemically synthesized
ggcttagccactctgtgctgac

SEQ ID NO: 12859 - DNA, 22 bp, Artificial Sequence
  chemically synthesized
agccactctgtgctgaccactc

SEQ ID NO: 12860 - DNA, 22 bp, Artificial Sequence
  chemically synthesized
gccactctgtgctgaccactct

SEQ ID NO: 12861 - DNA, 22 bp, Artificial Sequence
  chemically synthesized
tgtgctgaccactctgccccag

SEQ ID NO: 12862 - DNA, 22 bp, Artificial Sequence
  chemically synthesized
tgctgaccactctgccccaggc

SEQ ID NO: 12863 - DNA, 22 bp, Artificial Sequence
  chemically synthesized
accactctgccccaggcctcct

SEQ ID NO: 12864 - DNA, 22 bp, Artificial Sequence
  chemically synthesized
tgccccaggcctccttaccatt

SEQ ID NO: 12865 - DNA, 22 bp, Artificial Sequence
  chemically synthesized
ccccaggcctccttaccattcc

SEQ ID NO: 12866 - DNA, 22 bp, Artificial Sequence
  chemically synthesized
cttaccattccccttcgaccta

SEQ ID NO: 12867 - DNA, 22 bp, Artificial Sequence
  chemically synthesized
accattccccttcgacctactc

SEQ ID NO: 12868 - DNA, 22 bp, Artificial Sequence
  chemically synthesized
ccattccccttcgacctactct

SEQ ID NO: 12869 - DNA, 22 bp, Artificial Sequence
  chemically synthesized
cccttcgacctactctcttccg

SEQ ID NO: 12870 - DNA, 22 bp, Artificial Sequence
  chemically synthesized
cgacctactctcttccgcattg

SEQ ID NO: 12871 - DNA, 22 bp, Artificial Sequence
  chemically synthesized
gacctactctcttccgcattgg

SEQ ID NO: 12872 - DNA, 22 bp, Artificial Sequence
  chemically synthesized
ctctcttccgcattggagtcgc

SEQ ID NO: 12873 - DNA, 22 bp, Artificial Sequence
  chemically synthesized
tcttccgcattggagtcgcttt

SEQ ID NO: 12874 - DNA, 22 bp, Artificial Sequence
  chemically synthesized
ttccgcattggagtcgctttaa

SEQ ID NO: 12875 - DNA, 22 bp, Artificial Sequence
  chemically synthesized
ccgcattggagtcgctttaact

SEQ ID NO: 12876 - DNA, 22 bp, Artificial Sequence
  chemically synthesized
cgcattggagtcgctttaactg

SEQ ID NO: 12877 - DNA, 22 bp, Artificial Sequence
  chemically synthesized
gagtcgctttaactggccctgg

SEQ ID NO: 12878 - DNA, 22 bp, Artificial Sequence
  chemically synthesized
taactggccctggctttggcag

SEQ ID NO: 12879 - DNA, 22 bp, Artificial Sequence
  chemically synthesized
aactggccctggctttggcagc

SEQ ID NO: 12880 - DNA, 22 bp, Artificial Sequence
  chemically synthesized
actggccctggctttggcagcc

SEQ ID NO: 12881 - DNA, 22 bp, Artificial Sequence
  chemically synthesized
gccctggctttggcagcctgtg

SEQ ID NO: 12882 - DNA, 22 bp, Artificial Sequence
  chemically synthesized
gctttggcagcctgtgctgacc

SEQ ID NO: 12883 - DNA, 22 bp, Artificial Sequence
  chemically synthesized
tggcagcctgtgctgacccatg

SEQ ID NO: 12884 - DNA, 22 bp, Artificial Sequence
  chemically synthesized
ggcagcctgtgctgacccatgc

SEQ ID NO: 12885 - DNA, 22 bp, Artificial Sequence
  chemically synthesized
gcagcctgtgctgacccatgca

SEQ ID NO: 12886 - DNA, 22 bp, Artificial Sequence
  chemically synthesized
tgctgacccatgcagtcctcct

SEQ ID NO: 12887 - DNA, 22 bp, Artificial Sequence
  chemically synthesized
acccatgcagtcctccttacca

SEQ ID NO: 12888 - DNA, 22 bp, Artificial Sequence
  chemically synthesized
cttaccatccctccctcgactt

SEQ ID NO: 12889 - DNA, 22 bp, Artificial Sequence
  chemically synthesized
accatccctccctcgacttccc

SEQ ID NO: 12890 - DNA, 22 bp, Artificial Sequence
  chemically synthesized
ccatccctccctcgacttcccc

SEQ ID NO: 12891 - DNA, 22 bp, Artificial Sequence
  chemically synthesized
cctcgacttcccctcttccgat

SEQ ID NO: 12892 - DNA, 22 bp, Artificial Sequence
  chemically synthesized
gacttcccctcttccgatgttg

SEQ ID NO: 12893 - DNA, 22 bp, Artificial Sequence
  chemically synthesized
cccctcttccgatgttgagccc

SEQ ID NO: 12894 - DNA, 22 bp, Artificial Sequence
  chemically synthesized
ccctcttccgatgttgagcccc

SEQ ID NO: 12895 - DNA, 22 bp, Artificial Sequence
  chemically synthesized
ttccgatgttgagcccctccag

SEQ ID NO: 12896 - DNA, 22 bp, Artificial Sequence
  chemically synthesized
ccgatgttgagcccctccagcc

SEQ ID NO: 12897 - DNA, 22 bp, Artificial Sequence
  chemically synthesized
cgatgttgagcccctccagccg

SEQ ID NO: 12898 - DNA, 22 bp, Artificial Sequence
  chemically synthesized
agcccctccagccggtcctgga

SEQ ID NO: 12899 - DNA, 22 bp, Artificial Sequence
  chemically synthesized
cagccggtcctggactttgtct

SEQ ID NO: 12900 - DNA, 22 bp, Artificial Sequence
  chemically synthesized
gactttgtctccttccctgccc

SEQ ID NO: 12901 - DNA, 22 bp, Artificial Sequence
  chemically synthesized
tgtctccttccctgccctgccc

SEQ ID NO: 12902 - DNA, 22 bp, Artificial Sequence
  chemically synthesized
gtctccttccctgccctgccct

SEQ ID NO: 12903 - DNA, 22 bp, Artificial Sequence
  chemically synthesized
tctccttccctgccctgccctc

SEQ ID NO: 12904 - DNA, 22 bp, Artificial Sequence
  chemically synthesized
cttccctgccctgccctctcct

SEQ ID NO: 12905 - DNA, 22 bp, Artificial Sequence
  chemically synthesized
ccctgccctgccctctcctgaa

SEQ ID NO: 12906 - DNA, 22 bp, Artificial Sequence
  chemically synthesized
cctgccctgccctctcctgaac

SEQ ID NO: 12907 - DNA, 22 bp, Artificial Sequence
  chemically synthesized
ccctgccctctcctgaacctga

SEQ ID NO: 12908 - DNA, 22 bp, Artificial Sequence
  chemically synthesized
ccctctcctgaacctgagccag

SEQ ID NO: 12909 - DNA, 22 bp, Artificial Sequence
  chemically synthesized
tcctgaacctgagccagctccc

SEQ ID NO: 12910 - DNA, 22 bp, Artificial Sequence
  chemically synthesized
ctgaacctgagccagctcccat

SEQ ID NO: 12911 - DNA, 22 bp, Artificial Sequence
  chemically synthesized
aacctgagccagctcccatagc

SEQ ID NO: 12912 - DNA, 22 bp, Artificial Sequence
  chemically synthesized
agccagctcccatagctcagtc

SEQ ID NO: 12913 - DNA, 22 bp, Artificial Sequence
  chemically synthesized
ccatagctcagtctggtctatc

SEQ ID NO: 12914 - DNA, 22 bp, Artificial Sequence
  chemically synthesized
agtctggtctatctgcctggcc

SEQ ID NO: 12915 - DNA, 22 bp, Artificial Sequence
  chemically synthesized
gtctatctgcctggccctggcc

SEQ ID NO: 12916 - DNA, 22 bp, Artificial Sequence
  chemically synthesized
tctgcctggccctggccattgt

SEQ ID NO: 12917 - DNA, 22 bp, Artificial Sequence
  chemically synthesized
cctggccctggccattgtcact

SEQ ID NO: 12918 - DNA, 22 bp, Artificial Sequence
  chemically synthesized
gccctggccattgtcactttgc

SEQ ID NO: 12919 - DNA, 22 bp, Artificial Sequence
  chemically synthesized
gccattgtcactttgcgctgcc

SEQ ID NO: 12920 - DNA, 22 bp, Artificial Sequence
  chemically synthesized
tcactttgcgctgccctcctct

SEQ ID NO: 12921 - DNA, 22 bp, Artificial Sequence
  chemically synthesized
tgcgctgccctcctctcgcccc

SEQ ID NO: 12922 - DNA, 22 bp, Artificial Sequence
  chemically synthesized
gcgctgccctcctctcgccccc

SEQ ID NO: 12923 - DNA, 22 bp, Artificial Sequence
  chemically synthesized
cgctgccctcctctcgcccccg

SEQ ID NO: 12924 - DNA, 22 bp, Artificial Sequence
  chemically synthesized
ccctcctctcgcccccgagtgc

SEQ ID NO: 12925 - DNA, 22 bp, Artificial Sequence
  chemically synthesized
ctctcgcccccgagtgcccttg

SEQ ID NO: 12926 - DNA, 22 bp, Artificial Sequence
  chemically synthesized
tcgcccccgagtgcccttgctg

SEQ ID NO: 12927 - DNA, 22 bp, Artificial Sequence
  chemically synthesized
gcccccgagtgcccttgctgtg

SEQ ID NO: 12928 - DNA, 22 bp, Artificial Sequence
  chemically synthesized
gctgtgccgccggaactctgcc

SEQ ID NO: 12929 - DNA, 22 bp, Artificial Sequence
  chemically synthesized
ctgtgccgccggaactctgccc

SEQ ID NO: 12930 - DNA, 22 bp, Artificial Sequence
  chemically synthesized
tgccgccggaactctgccctct

SEQ ID NO: 12931 - DNA, 22 bp, Artificial Sequence
  chemically synthesized
tgccctctaacgctgccgtctc

SEQ ID NO: 12932 - DNA, 22 bp, Artificial Sequence
  chemically synthesized
ccctctaacgctgccgtctctc

SEQ ID NO: 12933 - DNA, 22 bp, Artificial Sequence
  chemically synthesized
taacgctgccgtctctctcctg

SEQ ID NO: 12934 - DNA, 22 bp, Artificial Sequence
  chemically synthesized
acgctgccgtctctctcctgag

SEQ ID NO: 12935 - DNA, 22 bp, Artificial Sequence
  chemically synthesized
ccgtctctctcctgagtccgga

SEQ ID NO: 12936 - DNA, 22 bp, Artificial Sequence
  chemically synthesized
tctcctgagtccggaccacttt

SEQ ID NO: 12937 - DNA, 22 bp, Artificial Sequence
  chemically synthesized
tcctgagtccggaccactttga

SEQ ID NO: 12938 - DNA, 22 bp, Artificial Sequence
  chemically synthesized
ctgagtccggaccactttgagc

SEQ ID NO: 12939 - DNA, 22 bp, Artificial Sequence
  chemically synthesized
agtccggaccactttgagctct

SEQ ID NO: 12940 - DNA, 22 bp, Artificial Sequence
  chemically synthesized
tgagctctactggcttctgcgc

SEQ ID NO: 12941 - DNA, 22 bp, Artificial Sequence
  chemically synthesized
gagctctactggcttctgcgcc

SEQ ID NO: 12942 - DNA, 22 bp, Artificial Sequence
  chemically synthesized
agctctactggcttctgcgccg

SEQ ID NO: 12943 - DNA, 22 bp, Artificial Sequence
  chemically synthesized
tactggcttctgcgccgcctct

SEQ ID NO: 12944 - DNA, 22 bp, Artificial Sequence
  chemically synthesized
ctggcttctgcgccgcctctgg

SEQ ID NO: 12945 - DNA, 22 bp, Artificial Sequence
  chemically synthesized
gcttctgcgccgcctctggccc

SEQ ID NO: 12946 - DNA, 22 bp, Artificial Sequence
  chemically synthesized
ctgcgccgcctctggcccactg

SEQ ID NO: 12947 - DNA, 22 bp, Artificial Sequence
  chemically synthesized
tgcgccgcctctggcccactgt

SEQ ID NO: 12948 - DNA, 22 bp, Artificial Sequence
  chemically synthesized
cgccgcctctggcccactgttt

SEQ ID NO: 12949 - DNA, 22 bp, Artificial Sequence
  chemically synthesized
tggcccactgtttccccttccc

SEQ ID NO: 12950 - DNA, 22 bp, Artificial Sequence
  chemically synthesized
gcccactgtttccccttcccag

SEQ ID NO: 12951 - DNA, 22 bp, Artificial Sequence
  chemically synthesized
tttccccttcccaggcaggtcc

SEQ ID NO: 12952 - DNA, 22 bp, Artificial Sequence
  chemically synthesized
ccccttcccaggcaggtcctgc

SEQ ID NO: 12953 - DNA, 22 bp, Artificial Sequence
  chemically synthesized
cccttcccaggcaggtcctgct

SEQ ID NO: 12954 - DNA, 22 bp, Artificial Sequence
  chemically synthesized
cccaggcaggtcctgctttctc

SEQ ID NO: 12955 - DNA, 22 bp, Artificial Sequence
  chemically synthesized
ccaggcaggtcctgctttctct

SEQ ID NO: 12956 - DNA, 22 bp, Artificial Sequence
  chemically synthesized
ctttctctgacctgcattctct

SEQ ID NO: 12957 - DNA, 22 bp, Artificial Sequence
  chemically synthesized
tctctgacctgcattctctccc

SEQ ID NO: 12958 - DNA, 22 bp, Artificial Sequence
  chemically synthesized
ctctgacctgcattctctcccc

SEQ ID NO: 12959 - DNA, 22 bp, Artificial Sequence
  chemically synthesized
tctgacctgcattctctcccct

SEQ ID NO: 12960 - DNA, 22 bp, Artificial Sequence
  chemically synthesized
tgacctgcattctctcccctgg

SEQ ID NO: 12961 - DNA, 22 bp, Artificial Sequence
  chemically synthesized
acctgcattctctcccctgggc

SEQ ID NO: 12962 - DNA, 22 bp, Artificial Sequence
  chemically synthesized
cattctctcccctgggcctgtg

SEQ ID NO: 12963 - DNA, 22 bp, Artificial Sequence
  chemically synthesized
tctcccctgggcctgtgccgct

SEQ ID NO: 12964 - DNA, 22 bp, Artificial Sequence
  chemically synthesized
tcccctgggcctgtgccgcttt

SEQ ID NO: 12965 - DNA, 22 bp, Artificial Sequence
  chemically synthesized
ccctgggcctgtgccgctttct

SEQ ID NO: 12966 - DNA, 22 bp, Artificial Sequence
  chemically synthesized
ggcctgtgccgctttctgtctg

SEQ ID NO: 12967 - DNA, 22 bp, Artificial Sequence
  chemically synthesized
tgccgctttctgtctgcagctt

SEQ ID NO: 12968 - DNA, 22 bp, Artificial Sequence
  chemically synthesized
tctgtctgcagcttgtggcctg

SEQ ID NO: 12969 - DNA, 22 bp, Artificial Sequence
  chemically synthesized
ctgtctgcagcttgtggcctgg

SEQ ID NO: 12970 - DNA, 22 bp, Artificial Sequence
  chemically synthesized
tgtctgcagcttgtggcctggg

SEQ ID NO: 12971 - DNA, 22 bp, Artificial Sequence
  chemically synthesized
tctgcagcttgtggcctgggtc

SEQ ID NO: 12972 - DNA, 22 bp, Artificial Sequence
  chemically synthesized
cagcttgtggcctgggtcacct

SEQ ID NO: 12973 - DNA, 22 bp, Artificial Sequence
  chemically synthesized
gtggcctgggtcacctctacgg

SEQ ID NO: 12974 - DNA, 22 bp, Artificial Sequence
  chemically synthesized
tggcctgggtcacctctacggc

SEQ ID NO: 12975 - DNA, 22 bp, Artificial Sequence
  chemically synthesized
ggtcacctctacggctggccca

SEQ ID NO: 12976 - DNA, 22 bp, Artificial Sequence
  chemically synthesized
tacggctggcccagatccttcc

SEQ ID NO: 12977 - DNA, 22 bp, Artificial Sequence
  chemically synthesized
cggctggcccagatccttccct

SEQ ID NO: 12978 - DNA, 22 bp, Artificial Sequence
  chemically synthesized
gcccagatccttccctgccgcc

SEQ ID NO: 12979 - DNA, 22 bp, Artificial Sequence
  chemically synthesized
ccctgccgcctccttcaggttc

SEQ ID NO: 12980 - DNA, 22 bp, Artificial Sequence
  chemically synthesized
cctgccgcctccttcaggttcc

SEQ ID NO: 12981 - DNA, 22 bp, Artificial Sequence
  chemically synthesized
ccgcctccttcaggttccgtct

SEQ ID NO: 12982 - DNA, 22 bp, Artificial Sequence
  chemically synthesized
cttcaggttccgtcttcctcca

SEQ ID NO: 12983 - DNA, 22 bp, Artificial Sequence
  chemically synthesized
caggttccgtcttcctccactc

SEQ ID NO: 12984 - DNA, 22 bp, Artificial Sequence
  chemically synthesized
aggttccgtcttcctccactcc

SEQ ID NO: 12985 - DNA, 22 bp, Artificial Sequence
  chemically synthesized
cgtcttcctccactccctcttc

SEQ ID NO: 12986 - DNA, 22 bp, Artificial Sequence
  chemically synthesized
cctccactccctcttccccttg

SEQ ID NO: 12987 - DNA, 22 bp, Artificial Sequence
  chemically synthesized
ctccactccctcttccccttgc

SEQ ID NO: 12988 - DNA, 22 bp, Artificial Sequence
  chemically synthesized
cactccctcttccccttgctct

SEQ ID NO: 12989 - DNA, 22 bp, Artificial Sequence
  chemically synthesized
cctcttccccttgctctctgct

SEQ ID NO: 12990 - DNA, 22 bp, Artificial Sequence
  chemically synthesized
ttccccttgctctctgctgtgt

SEQ ID NO: 12991 - DNA, 22 bp, Artificial Sequence
  chemically synthesized
ccccttgctctctgctgtgttg

SEQ ID NO: 12992 - DNA, 22 bp, Artificial Sequence
  chemically synthesized
cccttgctctctgctgtgttgc

SEQ ID NO: 12993 - DNA, 22 bp, Artificial Sequence
  chemically synthesized
gctctctgctgtgttgctgccc

SEQ ID NO: 12994 - DNA, 22 bp, Artificial Sequence
  chemically synthesized
ctctctgctgtgttgctgccca

SEQ ID NO: 12995 - DNA, 22 bp, Artificial Sequence
  chemically synthesized
tctgctgtgttgctgcccaagg

SEQ ID NO: 12996 - DNA, 22 bp, Artificial Sequence
  chemically synthesized
tgctgtgttgctgcccaaggat

SEQ ID NO: 12997 - DNA, 22 bp, Artificial Sequence
  chemically synthesized
ctgtgttgctgcccaaggatgc

SEQ ID NO: 12998 - DNA, 22 bp, Artificial Sequence
  chemically synthesized
tgttgctgcccaaggatgctct

SEQ ID NO: 12999 - DNA, 22 bp, Artificial Sequence
  chemically synthesized
ctgcccaaggatgctctttccg

SEQ ID NO: 13000 - DNA, 22 bp, Artificial Sequence
  chemically synthesized
cccaaggatgctctttccggag

SEQ ID NO: 13001 - DNA, 22 bp, Artificial Sequence
  chemically synthesized
tttccggagcacttccttctcg

SEQ ID NO: 13002 - DNA, 22 bp, Artificial Sequence
  chemically synthesized
tccggagcacttccttctcggc

SEQ ID NO: 13003 - DNA, 22 bp, Artificial Sequence
  chemically synthesized
ccggagcacttccttctcggcg

SEQ ID NO: 13004 - DNA, 22 bp, Artificial Sequence
  chemically synthesized
cggagcacttccttctcggcgc

SEQ ID NO: 13005 - DNA, 22 bp, Artificial Sequence
  chemically synthesized
ccttctcggcgctgcaccacgt

SEQ ID NO: 13006 - DNA, 22 bp, Artificial Sequence
  chemically synthesized
cttctcggcgctgcaccacgtg

SEQ ID NO: 13007 - DNA, 22 bp, Artificial Sequence
  chemically synthesized
ctcggcgctgcaccacgtgatg

SEQ ID NO: 13008 - DNA, 22 bp, Artificial Sequence
  chemically synthesized
tcggcgctgcaccacgtgatgt

SEQ ID NO: 13009 - DNA, 22 bp, Artificial Sequence
  chemically synthesized
ggcgctgcaccacgtgatgtcc

SEQ ID NO: 13010 - DNA, 22 bp, Artificial Sequence
  chemically synthesized
caccacgtgatgtcctctgagc

SEQ ID NO: 13011 - DNA, 22 bp, Artificial Sequence
  chemically synthesized
tgagcggatcctccccgtgtct

SEQ ID NO: 13012 - DNA, 22 bp, Artificial Sequence
  chemically synthesized
agcggatcctccccgtgtctgg

SEQ ID NO: 13013 - DNA, 22 bp, Artificial Sequence
  chemically synthesized
cccgtgtctgggtcctctccgg

SEQ ID NO: 13014 - DNA, 22 bp, Artificial Sequence
  chemically synthesized
ggtcctctccgggcatctctcc

SEQ ID NO: 13015 - DNA, 22 bp, Artificial Sequence
  chemically synthesized
tccgggcatctctcctccctca

SEQ ID NO: 13016 - DNA, 22 bp, Artificial Sequence
  chemically synthesized
cgggcatctctcctccctcacc

SEQ ID NO: 13017 - DNA, 22 bp, Artificial Sequence
  chemically synthesized
tcctccctcacccaaccccatg

SEQ ID NO: 13018 - DNA, 22 bp, Artificial Sequence
  chemically synthesized
ctccctcacccaaccccatgcc

SEQ ID NO: 13019 - DNA, 22 bp, Artificial Sequence
  chemically synthesized
cctcacccaaccccatgccgtc

SEQ ID NO: 13020 - DNA, 22 bp, Artificial Sequence
  chemically synthesized
acccaaccccatgccgtcttca

SEQ ID NO: 13021 - DNA, 22 bp, Artificial Sequence
  chemically synthesized
cactcgctgggttcccttttcc

SEQ ID NO: 13022 - DNA, 22 bp, Artificial Sequence
  chemically synthesized
actcgctgggttcccttttcct

SEQ ID NO: 13023 - DNA, 22 bp, Artificial Sequence
  chemically synthesized
gctgggttcccttttccttctc

SEQ ID NO: 13024 - DNA, 22 bp, Artificial Sequence
  chemically synthesized
ggttcccttttccttctccttc

SEQ ID NO: 13025 - DNA, 22 bp, Artificial Sequence
  chemically synthesized
ccttttccttctccttctgggg

SEQ ID NO: 13026 - DNA, 22 bp, Artificial Sequence
  chemically synthesized
ttccttctccttctggggcctg

SEQ ID NO: 13027 - DNA, 22 bp, Artificial Sequence
  chemically synthesized
tccttctccttctggggcctgt

SEQ ID NO: 13028 - DNA, 22 bp, Artificial Sequence
  chemically synthesized
ccttctccttctggggcctgtg

SEQ ID NO: 13029 - DNA, 22 bp, Artificial Sequence
  chemically synthesized
cttctccttctggggcctgtgc

SEQ ID NO: 13030 - DNA, 22 bp, Artificial Sequence
  chemically synthesized
ctccttctggggcctgtgccat

SEQ ID NO: 13031 - DNA, 22 bp, Artificial Sequence
  chemically synthesized
tccttctggggcctgtgccatc

SEQ ID NO: 13032 - DNA, 22 bp, Artificial Sequence
  chemically synthesized
cttctggggcctgtgccatctc

SEQ ID NO: 13033 - DNA, 22 bp, Artificial Sequence
  chemically synthesized
ctggggcctgtgccatctctcg

SEQ ID NO: 13034 - DNA, 22 bp, Artificial Sequence
  chemically synthesized
tggggcctgtgccatctctcgt

SEQ ID NO: 13035 - DNA, 22 bp, Artificial Sequence
  chemically synthesized
gggcctgtgccatctctcgttt

SEQ ID NO: 13036 - DNA, 22 bp, Artificial Sequence
  chemically synthesized
tgccatctctcgtttcttagga

SEQ ID NO: 13037 - DNA, 22 bp, Artificial Sequence
  chemically synthesized
tcgtttcttaggatggccttct

SEQ ID NO: 13038 - DNA, 22 bp, Artificial Sequence
  chemically synthesized
gtttcttaggatggccttctcc

SEQ ID NO: 13039 - DNA, 22 bp, Artificial Sequence
  chemically synthesized
cttaggatggccttctccgacg

SEQ ID NO: 13040 - DNA, 22 bp, Artificial Sequence
  chemically synthesized
ttaggatggccttctccgacgg

SEQ ID NO: 13041 - DNA, 22 bp, Artificial Sequence
  chemically synthesized
aggatggccttctccgacggat

SEQ ID NO: 13042 - DNA, 22 bp, Artificial Sequence
  chemically synthesized
ggatggccttctccgacggatg

SEQ ID NO: 13043 - DNA, 22 bp, Artificial Sequence
  chemically synthesized
ctccgacggatgtctcccttgc

SEQ ID NO: 13044 - DNA, 22 bp, Artificial Sequence
  chemically synthesized
tccgacggatgtctcccttgcg

SEQ ID NO: 13045 - DNA, 22 bp, Artificial Sequence
  chemically synthesized
cgacggatgtctcccttgcgtc

SEQ ID NO: 13046 - DNA, 22 bp, Artificial Sequence
  chemically synthesized
ccttgcgtcccgcctccccttc

SEQ ID NO: 13047 - DNA, 22 bp, Artificial Sequence
  chemically synthesized
gcgtcccgcctccccttcttgt

SEQ ID NO: 13048 - DNA, 22 bp, Artificial Sequence
  chemically synthesized
cgtcccgcctccccttcttgta

SEQ ID NO: 13049 - DNA, 22 bp, Artificial Sequence
  chemically synthesized
cccttcttgtaggcctgcatca

SEQ ID NO: 13050 - DNA, 22 bp, Artificial Sequence
  chemically synthesized
cttgtaggcctgcatcatcacc

SEQ ID NO: 13051 - DNA, 22 bp, Artificial Sequence
  chemically synthesized
ttgtaggcctgcatcatcaccg

SEQ ID NO: 13052 - DNA, 22 bp, Artificial Sequence
  chemically synthesized
gtaggcctgcatcatcaccgtt

SEQ ID NO: 13053 - DNA, 22 bp, Artificial Sequence
  chemically synthesized
taggcctgcatcatcaccgttt

SEQ ID NO: 13054 - DNA, 22 bp, Artificial Sequence
  chemically synthesized
catcatcaccgtttttctggac

SEQ ID NO: 13055 - DNA, 22 bp, Artificial Sequence
  chemically synthesized
ttctggacaaccccaaagtacc

SEQ ID NO: 13056 - DNA, 22 bp, Artificial Sequence
  chemically synthesized
tctggacaaccccaaagtaccc

SEQ ID NO: 13057 - DNA, 22 bp, Artificial Sequence
  chemically synthesized
ctggacaaccccaaagtacccc

SEQ ID NO: 13058 - DNA, 22 bp, Artificial Sequence
  chemically synthesized
tggacaaccccaaagtaccccg

SEQ ID NO: 13059 - DNA, 22 bp, Artificial Sequence
  chemically synthesized
gacaaccccaaagtaccccgtc

SEQ ID NO: 13060 - DNA, 22 bp, Artificial Sequence
  chemically synthesized
cctggctttagccacctctcca

SEQ ID NO: 13061 - DNA, 22 bp, Artificial Sequence
  chemically synthesized
gctttagccacctctccatcct

SEQ ID NO: 13062 - DNA, 22 bp, Artificial Sequence
  chemically synthesized
tagccacctctccatcctcttg

SEQ ID NO: 13063 - DNA, 22 bp, Artificial Sequence
  chemically synthesized
agccacctctccatcctcttgc

SEQ ID NO: 13064 - DNA, 22 bp, Artificial Sequence
  chemically synthesized
gccacctctccatcctcttgct

SEQ ID NO: 13065 - DNA, 22 bp, Artificial Sequence
  chemically synthesized
tccatcctcttgctttctttgc

SEQ ID NO: 13066 - DNA, 22 bp, Artificial Sequence
  chemically synthesized
catcctcttgctttctttgcct

SEQ ID NO: 13067 - DNA, 22 bp, Artificial Sequence
  chemically synthesized
ttgctttctttgcctggacacc

SEQ ID NO: 13068 - DNA, 22 bp, Artificial Sequence
  chemically synthesized
gctttctttgcctggacacccc

SEQ ID NO: 13069 - DNA, 22 bp, Artificial Sequence
  chemically synthesized
ctttctttgcctggacaccccg

SEQ ID NO: 13070 - DNA, 22 bp, Artificial Sequence
  chemically synthesized
tctttgcctggacaccccgttc

SEQ ID NO: 13071 - DNA, 22 bp, Artificial Sequence
  chemically synthesized
ctttgcctggacaccccgttct

SEQ ID NO: 13072 - DNA, 22 bp, Artificial Sequence
  chemically synthesized
tttgcctggacaccccgttctc

SEQ ID NO: 13073 - DNA, 22 bp, Artificial Sequence
  chemically synthesized
tgcctggacaccccgttctcct

SEQ ID NO: 13074 - DNA, 22 bp, Artificial Sequence
  chemically synthesized
gcctggacaccccgttctcctg

SEQ ID NO: 13075 - DNA, 22 bp, Artificial Sequence
  chemically synthesized
cctggacaccccgttctcctgt

SEQ ID NO: 13076 - DNA, 22 bp, Artificial Sequence
  chemically synthesized
gacaccccgttctcctgtggat

SEQ ID NO: 13077 - DNA, 22 bp, Artificial Sequence
  chemically synthesized
tcctgtggattcgggtcacctc

SEQ ID NO: 13078 - DNA, 22 bp, Artificial Sequence
  chemically synthesized
ctgtggattcgggtcacctctc

SEQ ID NO: 13079 - DNA, 22 bp, Artificial Sequence
  chemically synthesized
tggattcgggtcacctctcact

SEQ ID NO: 13080 - DNA, 22 bp, Artificial Sequence
  chemically synthesized
gggtcacctctcactcctttca

SEQ ID NO: 13081 - DNA, 22 bp, Artificial Sequence
  chemically synthesized
tcactcctttcatttgggcagc

SEQ ID NO: 13082 - DNA, 22 bp, Artificial Sequence
  chemically synthesized
actcctttcatttgggcagctc

SEQ ID NO: 13083 - DNA, 22 bp, Artificial Sequence
  chemically synthesized
ctttcatttgggcagctcccct

SEQ ID NO: 13084 - DNA, 22 bp, Artificial Sequence
  chemically synthesized
tcatttgggcagctcccctacc

SEQ ID NO: 13085 - DNA, 22 bp, Artificial Sequence
  chemically synthesized
catttgggcagctcccctaccc

SEQ ID NO: 13086 - DNA, 22 bp, Artificial Sequence
  chemically synthesized
atttgggcagctcccctacccc

SEQ ID NO: 13087 - DNA, 22 bp, Artificial Sequence
  chemically synthesized
gggcagctcccctacccccctt

SEQ ID NO: 13088 - DNA, 22 bp, Artificial Sequence
  chemically synthesized
ggcagctcccctacccccctta

SEQ ID NO: 13089 - DNA, 22 bp, Artificial Sequence
  chemically synthesized
ccctaccccccttacctctcta

SEQ ID NO: 13090 - DNA, 22 bp, Artificial Sequence
  chemically synthesized
ccccccttacctctctagtctg

SEQ ID NO: 13091 - DNA, 22 bp, Artificial Sequence
  chemically synthesized
acctctctagtctgtgctagct

SEQ ID NO: 13092 - DNA, 22 bp, Artificial Sequence
  chemically synthesized
cctctctagtctgtgctagctc

SEQ ID NO: 13093 - DNA, 22 bp, Artificial Sequence
  chemically synthesized
tctagtctgtgctagctcttcc

SEQ ID NO: 13094 - DNA, 22 bp, Artificial Sequence
  chemically synthesized
tagtctgtgctagctcttccag

SEQ ID NO: 13095 - DNA, 22 bp, Artificial Sequence
  chemically synthesized
gtctgtgctagctcttccagcc

SEQ ID NO: 13096 - DNA, 22 bp, Artificial Sequence
  chemically synthesized
tgctagctcttccagccccctg

SEQ ID NO: 13097 - DNA, 22 bp, Artificial Sequence
  chemically synthesized
gctcttccagccccctgtcatg

SEQ ID NO: 13098 - DNA, 22 bp, Artificial Sequence
  chemically synthesized
ttccagccccctgtcatggcat

SEQ ID NO: 13099 - DNA, 22 bp, Artificial Sequence
  chemically synthesized
ccagccccctgtcatggcatct

SEQ ID NO: 13100 - DNA, 22 bp, Artificial Sequence
  chemically synthesized
cagccccctgtcatggcatctt

SEQ ID NO: 13101 - DNA, 22 bp, Artificial Sequence
  chemically synthesized
tcatggcatcttccaggggtcc

SEQ ID NO: 13102 - DNA, 22 bp, Artificial Sequence
  chemically synthesized
ccaggggtccgagagctcagct

SEQ ID NO: 13103 - DNA, 22 bp, Artificial Sequence
  chemically synthesized
caggggtccgagagctcagcta

SEQ ID NO: 13104 - DNA, 22 bp, Artificial Sequence
  chemically synthesized
agctagtcttcttcctccaacc

SEQ ID NO: 13105 - DNA, 22 bp, Artificial Sequence
  chemically synthesized
gtcttcttcctccaacccgggc

SEQ ID NO: 13106 - DNA, 22 bp, Artificial Sequence
  chemically synthesized
cttcctccaacccgggccccta

SEQ ID NO: 13107 - DNA, 22 bp, Artificial Sequence
  chemically synthesized
ttcctccaacccgggcccctat

SEQ ID NO: 13108 - DNA, 22 bp, Artificial Sequence
  chemically synthesized
cctccaacccgggcccctatgt

SEQ ID NO: 13109 - DNA, 22 bp, Artificial Sequence
  chemically synthesized
ctccaacccgggcccctatgtc

SEQ ID NO: 13110 - DNA, 22 bp, Artificial Sequence
  chemically synthesized
caacccgggcccctatgtccac

SEQ ID NO: 13111 - DNA, 22 bp, Artificial Sequence
  chemically synthesized
tgtccacttcaggacagcatgt

SEQ ID NO: 13112 - DNA, 22 bp, Artificial Sequence
  chemically synthesized
caggacagcatgtttgctgcct

SEQ ID NO: 13113 - DNA, 22 bp, Artificial Sequence
  chemically synthesized
aggacagcatgtttgctgcctc

SEQ ID NO: 13114 - DNA, 22 bp, Artificial Sequence
  chemically synthesized
gctgcctccagggatcctgtgt

SEQ ID NO: 13115 - DNA, 22 bp, Artificial Sequence
  chemically synthesized
ctgcctccagggatcctgtgtc

SEQ ID NO: 13116 - DNA, 22 bp, Artificial Sequence
  chemically synthesized
cctccagggatcctgtgtcccc

SEQ ID NO: 13117 - DNA, 22 bp, Artificial Sequence
  chemically synthesized
cagggatcctgtgtccccgagc

SEQ ID NO: 13118 - DNA, 22 bp, Artificial Sequence
  chemically synthesized
tgtccccgagctgggaccacct

SEQ ID NO: 13119 - DNA, 22 bp, Artificial Sequence
  chemically synthesized
ggaccaccttatattcccaggg

SEQ ID NO: 13120 - DNA, 22 bp, Artificial Sequence
  chemically synthesized
atattcccagggccggttaatg

SEQ ID NO: 13121 - DNA, 22 bp, Artificial Sequence
  chemically synthesized
tattcccagggccggttaatgt

SEQ ID NO: 13122 - DNA, 22 bp, Artificial Sequence
  chemically synthesized
ccagggccggttaatgtggctc

SEQ ID NO: 13123 - DNA, 22 bp, Artificial Sequence
  chemically synthesized
atgtggctctggttctgggtac

SEQ ID NO: 13124 - DNA, 22 bp, Artificial Sequence
  chemically synthesized
tggttctgggtacttttatctg

SEQ ID NO: 13125 - DNA, 22 bp, Artificial Sequence
  chemically synthesized
gttctgggtacttttatctgtc

SEQ ID NO: 13126 - DNA, 22 bp, Artificial Sequence
  chemically synthesized
tgggtacttttatctgtcccct

SEQ ID NO: 13127 - DNA, 22 bp, Artificial Sequence
  chemically synthesized
ggtacttttatctgtcccctcc

SEQ ID NO: 13128 - DNA, 22 bp, Artificial Sequence
  chemically synthesized
ttatctgtcccctccaccccac

SEQ ID NO: 13129 - DNA, 22 bp, Artificial Sequence
  chemically synthesized
tatctgtcccctccaccccaca

SEQ ID NO: 13130 - DNA, 22 bp, Artificial Sequence
  chemically synthesized
atctgtcccctccaccccacag

SEQ ID NO: 13131 - DNA, 22 bp, Artificial Sequence
  chemically synthesized
tctgtcccctccaccccacagt

SEQ ID NO: 13132 - DNA, 22 bp, Artificial Sequence
  chemically synthesized
tcccctccaccccacagtgggg

SEQ ID NO: 13133 - DNA, 22 bp, Artificial Sequence
  chemically synthesized
caccccacagtggggccactag

SEQ ID NO: 13134 - DNA, 22 bp, Artificial Sequence
  chemically synthesized
gggacaggattggtgacagaaa

SEQ ID NO: 13135 - DNA, 22 bp, Artificial Sequence
  chemically synthesized
gtgacagaaaagccccatcctt

SEQ ID NO: 13136 - DNA, 22 bp, Artificial Sequence
  chemically synthesized
aggcctcctccttcctagtctc

SEQ ID NO: 13137 - DNA, 22 bp, Artificial Sequence
  chemically synthesized
ggcctcctccttcctagtctcc

SEQ ID NO: 13138 - DNA, 22 bp, Artificial Sequence
  chemically synthesized
ctccttcctagtctcctgatat

SEQ ID NO: 13139 - DNA, 22 bp, Artificial Sequence
  chemically synthesized
cttcctagtctcctgatattgg

SEQ ID NO: 13140 - DNA, 22 bp, Artificial Sequence
  chemically synthesized
cctagtctcctgatattgggtc

SEQ ID NO: 13141 - DNA, 22 bp, Artificial Sequence
  chemically synthesized
ctagtctcctgatattgggtct

SEQ ID NO: 13142 - DNA, 22 bp, Artificial Sequence
  chemically synthesized
gtctcctgatattgggtctaac

SEQ ID NO: 13143 - DNA, 22 bp, Artificial Sequence
  chemically synthesized
ctgatattgggtctaaccccca

SEQ ID NO: 13144 - DNA, 22 bp, Artificial Sequence
  chemically synthesized
atattgggtctaacccccacct

SEQ ID NO: 13145 - DNA, 22 bp, Artificial Sequence
  chemically synthesized
ggtctaacccccacctcctgtt

SEQ ID NO: 13146 - DNA, 22 bp, Artificial Sequence
  chemically synthesized
acccccacctcctgttaggcag

SEQ ID NO: 13147 - DNA, 22 bp, Artificial Sequence
  chemically synthesized
ctgttaggcagattccttatct

SEQ ID NO: 13148 - DNA, 22 bp, Artificial Sequence
  chemically synthesized
ttaggcagattccttatctggt

SEQ ID NO: 13149 - DNA, 22 bp, Artificial Sequence
  chemically synthesized
ggcagattccttatctggtgac

SEQ ID NO: 13150 - DNA, 22 bp, Artificial Sequence
  chemically synthesized
cttatctggtgacacaccccca

SEQ ID NO: 13151 - DNA, 22 bp, Artificial Sequence
  chemically synthesized
atctggtgacacacccccattt

SEQ ID NO: 13152 - DNA, 22 bp, Artificial Sequence
  chemically synthesized
tctggtgacacacccccatttc

SEQ ID NO: 13153 - DNA, 22 bp, Artificial Sequence
  chemically synthesized
gtgacacacccccatttcctgg

SEQ ID NO: 13154 - DNA, 22 bp, Artificial Sequence
  chemically synthesized
cctggagccatctctctccttg

SEQ ID NO: 13155 - DNA, 22 bp, Artificial Sequence
  chemically synthesized
ctggagccatctctctccttgc

SEQ ID NO: 13156 - DNA, 22 bp, Artificial Sequence
  chemically synthesized
gagccatctctctccttgccag

SEQ ID NO: 13157 - DNA, 22 bp, Artificial Sequence
  chemically synthesized
tctccttgccagaacctctaag

SEQ ID NO: 13158 - DNA, 22 bp, Artificial Sequence
  chemically synthesized
tccttgccagaacctctaaggt

SEQ ID NO: 13159 - DNA, 22 bp, Artificial Sequence
  chemically synthesized
cttgccagaacctctaaggttt

SEQ ID NO: 13160 - DNA, 22 bp, Artificial Sequence
  chemically synthesized
gccagaacctctaaggtttgct

SEQ ID NO: 13161 - DNA, 22 bp, Artificial Sequence
  chemically synthesized
ccagaacctctaaggtttgctt

SEQ ID NO: 13162 - DNA, 22 bp, Artificial Sequence
  chemically synthesized
taaggtttgcttacgatggagc

SEQ ID NO: 13163 - DNA, 22 bp, Artificial Sequence
  chemically synthesized
aggtttgcttacgatggagcca

SEQ ID NO: 13164 - DNA, 22 bp, Artificial Sequence
  chemically synthesized
gcttacgatggagccagagagg

SEQ ID NO: 13165 - DNA, 22 bp, Artificial Sequence
  chemically synthesized
cttacgatggagccagagagga

SEQ ID NO: 13166 - DNA, 22 bp, Artificial Sequence
  chemically synthesized
acgatggagccagagaggatcc

SEQ ID NO: 13167 - DNA, 22 bp, Artificial Sequence
  chemically synthesized
cgatggagccagagaggatcct

SEQ ID NO: 13168 - DNA, 22 bp, Artificial Sequence
  chemically synthesized
ggagggagagcttggcaggggg

SEQ ID NO: 13169 - DNA, 22 bp, Artificial Sequence
  chemically synthesized
ggcagggggtgggagggaaggg

SEQ ID NO: 13170 - DNA, 22 bp, Artificial Sequence
  chemically synthesized
gcagggggtgggagggaagggg

SEQ ID NO: 13171 - DNA, 22 bp, Artificial Sequence
  chemically synthesized
cccggttctcagtggccaccct

SEQ ID NO: 13172 - DNA, 22 bp, Artificial Sequence
  chemically synthesized
tcagtggccaccctgcgctacc

SEQ ID NO: 13173 - DNA, 22 bp, Artificial Sequence
  chemically synthesized
agtggccaccctgcgctaccct

SEQ ID NO: 13174 - DNA, 22 bp, Artificial Sequence
  chemically synthesized
cgctaccctctcccagaacctg

SEQ ID NO: 13175 - DNA, 22 bp, Artificial Sequence
  chemically synthesized
ccctctcccagaacctgagctg

SEQ ID NO: 13176 - DNA, 22 bp, Artificial Sequence
  chemically synthesized
tcccagaacctgagctgctctg

SEQ ID NO: 13177 - DNA, 22 bp, Artificial Sequence
  chemically synthesized
ccagaacctgagctgctctgac

SEQ ID NO: 13178 - DNA, 22 bp, Artificial Sequence
  chemically synthesized
agctgctctgacgcggccgtct

SEQ ID NO: 13179 - DNA, 22 bp, Artificial Sequence
  chemically synthesized
ctctgacgcggccgtctggtgc

SEQ ID NO: 13180 - DNA, 22 bp, Artificial Sequence
  chemically synthesized
tgacgcggccgtctggtgcgtt

SEQ ID NO: 13181 - DNA, 22 bp, Artificial Sequence
  chemically synthesized
acgcggccgtctggtgcgtttc

SEQ ID NO: 13182 - DNA, 22 bp, Artificial Sequence
  chemically synthesized
gtgcgtttcactgatcctggtg

SEQ ID NO: 13183 - DNA, 22 bp, Artificial Sequence
  chemically synthesized
cactgatcctggtgctgcagct

SEQ ID NO: 13184 - DNA, 22 bp, Artificial Sequence
  chemically synthesized
actgatcctggtgctgcagctt

SEQ ID NO: 13185 - DNA, 22 bp, Artificial Sequence
  chemically synthesized
atcctggtgctgcagcttcctt

SEQ ID NO: 13186 - DNA, 22 bp, Artificial Sequence
  chemically synthesized
gtgctgcagcttccttacactt

SEQ ID NO: 13187 - DNA, 22 bp, Artificial Sequence
  chemically synthesized
cagcttccttacacttcccaag

SEQ ID NO: 13188 - DNA, 22 bp, Artificial Sequence
  chemically synthesized
ccttacacttcccaagaggaga

SEQ ID NO: 13189 - DNA, 22 bp, Artificial Sequence
  chemically synthesized
cttacacttcccaagaggagaa

SEQ ID NO: 13190 - DNA, 22 bp, Artificial Sequence
  chemically synthesized
acacttcccaagaggagaagca

SEQ ID NO: 13191 - DNA, 22 bp, Artificial Sequence
  chemically synthesized
cacttcccaagaggagaagcag

SEQ ID NO: 13192 - DNA, 22 bp, Artificial Sequence
  chemically synthesized
cccaagaggagaagcagtttgg

SEQ ID NO: 13193 - DNA, 22 bp, Artificial Sequence
  chemically synthesized
ccaagaggagaagcagtttgga

SEQ ID NO: 13194 - DNA, 22 bp, Artificial Sequence
  chemically synthesized
ggaaaaacaaaatcagaataag

SEQ ID NO: 13195 - DNA, 22 bp, Artificial Sequence
  chemically synthesized
gaaaaacaaaatcagaataagt

SEQ ID NO: 13196 - DNA, 22 bp, Artificial Sequence
  chemically synthesized
gtcctgagttctaactttggct

SEQ ID NO: 13197 - DNA, 22 bp, Artificial Sequence
  chemically synthesized
agttctaactttggctcttcac

SEQ ID NO: 13198 - DNA, 22 bp, Artificial Sequence
  chemically synthesized
taactttggctcttcacctttc

SEQ ID NO: 13199 - DNA, 22 bp, Artificial Sequence
  chemically synthesized
actttggctcttcacctttcta

SEQ ID NO: 13200 - DNA, 22 bp, Artificial Sequence
  chemically synthesized
tggctcttcacctttctagtcc

SEQ ID NO: 13201 - DNA, 22 bp, Artificial Sequence
  chemically synthesized
ggctcttcacctttctagtccc

SEQ ID NO: 13202 - DNA, 22 bp, Artificial Sequence
  chemically synthesized
gctcttcacctttctagtcccc

SEQ ID NO: 13203 - DNA, 22 bp, Artificial Sequence
  chemically synthesized
ttcacctttctagtccccaatt

SEQ ID NO: 13204 - DNA, 22 bp, Artificial Sequence
  chemically synthesized
cacctttctagtccccaattta

SEQ ID NO: 13205 - DNA, 22 bp, Artificial Sequence
  chemically synthesized
acctttctagtccccaatttat

SEQ ID NO: 13206 - DNA, 22 bp, Artificial Sequence
  chemically synthesized
tctagtccccaatttatattgt

SEQ ID NO: 13207 - DNA, 22 bp, Artificial Sequence
  chemically synthesized
ctagtccccaatttatattgtt

SEQ ID NO: 13208 - DNA, 22 bp, Artificial Sequence
  chemically synthesized
tagtccccaatttatattgttc

SEQ ID NO: 13209 - DNA, 22 bp, Artificial Sequence
  chemically synthesized
gtccccaatttatattgttcct

SEQ ID NO: 13210 - DNA, 22 bp, Artificial Sequence
  chemically synthesized
atattgttcctccgtgcgtcag

SEQ ID NO: 13211 - DNA, 22 bp, Artificial Sequence
  chemically synthesized
tattgttcctccgtgcgtcagt

SEQ ID NO: 13212 - DNA, 22 bp, Artificial Sequence
  chemically synthesized
ttcctccgtgcgtcagttttac

SEQ ID NO: 13213 - DNA, 22 bp, Artificial Sequence
  chemically synthesized
ctccgtgcgtcagttttacctg

SEQ ID NO: 13214 - DNA, 22 bp, Artificial Sequence
  chemically synthesized
cgtgcgtcagttttacctgtga

SEQ ID NO: 13215 - DNA, 22 bp, Artificial Sequence
  chemically synthesized
tacctgtgagataaggccagta

SEQ ID NO: 13216 - DNA, 22 bp, Artificial Sequence
  chemically synthesized
acctgtgagataaggccagtag

SEQ ID NO: 13217 - DNA, 22 bp, Artificial Sequence
  chemically synthesized
cctgtgagataaggccagtagc

SEQ ID NO: 13218 - DNA, 22 bp, Artificial Sequence
  chemically synthesized
tgagataaggccagtagccagc

SEQ ID NO: 13219 - DNA, 22 bp, Artificial Sequence
  chemically synthesized
gcagggctgtggtgaggagggg

SEQ ID NO: 13220 - DNA, 22 bp, Artificial Sequence
  chemically synthesized
tggtgaggaggggggtgtccgt

SEQ ID NO: 13221 - DNA, 22 bp, Artificial Sequence
  chemically synthesized
cctttgtgagaatggtgcgtcc

SEQ ID NO: 13222 - DNA, 22 bp, Artificial Sequence
  chemically synthesized
tgtgagaatggtgcgtcctagg

SEQ ID NO: 13223 - DNA, 22 bp, Artificial Sequence
  chemically synthesized
gtgagaatggtgcgtcctaggt

SEQ ID NO: 13224 - DNA, 22 bp, Artificial Sequence
  chemically synthesized
tgagaatggtgcgtcctaggtg

SEQ ID NO: 13225 - DNA, 22 bp, Artificial Sequence
  chemically synthesized
ggtgttcaccaggtcgtggccg

SEQ ID NO: 13226 - DNA, 22 bp, Artificial Sequence
  chemically synthesized
accaggtcgtggccgcctctac

SEQ ID NO: 13227 - DNA, 22 bp, Artificial Sequence
  chemically synthesized
tactccctttctctttctccat

SEQ ID NO: 13228 - DNA, 22 bp, Artificial Sequence
  chemically synthesized
ctccctttctctttctccatcc

SEQ ID NO: 13229 - DNA, 22 bp, Artificial Sequence
  chemically synthesized
cctttctctttctccatccttc

SEQ ID NO: 13230 - DNA, 22 bp, Artificial Sequence
  chemically synthesized
tctctttctccatccttctttc

SEQ ID NO: 13231 - DNA, 22 bp, Artificial Sequence
  chemically synthesized
ctctttctccatccttctttcc

SEQ ID NO: 13232 - DNA, 22 bp, Artificial Sequence
  chemically synthesized
tctttctccatccttctttcct

SEQ ID NO: 13233 - DNA, 22 bp, Artificial Sequence
  chemically synthesized
tttctccatccttctttcctta

SEQ ID NO: 13234 - DNA, 22 bp, Artificial Sequence
  chemically synthesized
tctccatccttctttccttaaa

SEQ ID NO: 13235 - DNA, 22 bp, Artificial Sequence
  chemically synthesized
ctccatccttctttccttaaag

SEQ ID NO: 13236 - DNA, 22 bp, Artificial Sequence
  chemically synthesized
tccatccttctttccttaaaga

SEQ ID NO: 13237 - DNA, 22 bp, Artificial Sequence
  chemically synthesized
catccttctttccttaaagagt

SEQ ID NO: 13238 - DNA, 22 bp, Artificial Sequence
  chemically synthesized
ctttccttaaagagtccccagt

SEQ ID NO: 13239 - DNA, 22 bp, Artificial Sequence
  chemically synthesized
tttccttaaagagtccccagtg

SEQ ID NO: 13240 - DNA, 22 bp, Artificial Sequence
  chemically synthesized
tccttaaagagtccccagtgct

SEQ ID NO: 13241 - DNA, 22 bp, Artificial Sequence
  chemically synthesized
ccttaaagagtccccagtgcta

SEQ ID NO: 13242 - DNA, 22 bp, Artificial Sequence
  chemically synthesized
cttaaagagtccccagtgctat

SEQ ID NO: 13243 - DNA, 22 bp, Artificial Sequence
  chemically synthesized
aaagagtccccagtgctatctg

SEQ ID NO: 13244 - DNA, 22 bp, Artificial Sequence
  chemically synthesized
aagagtccccagtgctatctgg

SEQ ID NO: 13245 - DNA, 22 bp, Artificial Sequence
  chemically synthesized
tctgggacatattcctccgccc

SEQ ID NO: 13246 - DNA, 22 bp, Artificial Sequence
  chemically synthesized
ggacatattcctccgcccagag

SEQ ID NO: 13247 - DNA, 22 bp, Artificial Sequence
  chemically synthesized
ctccgcccagagcagggtcccg

SEQ ID NO: 13248 - DNA, 22 bp, Artificial Sequence
  chemically synthesized
cgcccagagcagggtcccgctt

SEQ ID NO: 13249 - DNA, 22 bp, Artificial Sequence
  chemically synthesized
ccctaaggccctgctctgggct

SEQ ID NO: 13250 - DNA, 22 bp, Artificial Sequence
  chemically synthesized
cctaaggccctgctctgggctt

SEQ ID NO: 13251 - DNA, 22 bp, Artificial Sequence
  chemically synthesized
aggccctgctctgggcttctgg

SEQ ID NO: 13252 - DNA, 22 bp, Artificial Sequence
  chemically synthesized
ctctgggcttctgggtttgagt

SEQ ID NO: 13253 - DNA, 22 bp, Artificial Sequence
  chemically synthesized
tgggcttctgggtttgagtcct

SEQ ID NO: 13254 - DNA, 22 bp, Artificial Sequence
  chemically synthesized
ggcttctgggtttgagtccttg

SEQ ID NO: 13255 - DNA, 22 bp, Artificial Sequence
  chemically synthesized
ctgggtttgagtccttggcaag

SEQ ID NO: 13256 - DNA, 22 bp, Artificial Sequence
  chemically synthesized
tgggtttgagtccttggcaagc

SEQ ID NO: 13257 - DNA, 22 bp, Artificial Sequence
  chemically synthesized
ggtttgagtccttggcaagccc

SEQ ID NO: 13258 - DNA, 22 bp, Artificial Sequence
  chemically synthesized
gagtccttggcaagcccaggag

SEQ ID NO: 13259 - DNA, 22 bp, Artificial Sequence
  chemically synthesized
agtccttggcaagcccaggaga

SEQ ID NO: 13260 - DNA, 22 bp, Artificial Sequence
  chemically synthesized
ggcaagcccaggagaggcgctc

SEQ ID NO: 13261 - DNA, 22 bp, Artificial Sequence
  chemically synthesized
gcaagcccaggagaggcgctca

SEQ ID NO: 13262 - DNA, 22 bp, Artificial Sequence
  chemically synthesized
aggcttccctgtcccccttcct

SEQ ID NO: 13263 - DNA, 22 bp, Artificial Sequence
  chemically synthesized
ccctgtcccccttcctcgtcca

SEQ ID NO: 13264 - DNA, 22 bp, Artificial Sequence
  chemically synthesized
cctgtcccccttcctcgtccac

SEQ ID NO: 13265 - DNA, 22 bp, Artificial Sequence
  chemically synthesized
tcccccttcctcgtccaccatc

SEQ ID NO: 13266 - DNA, 22 bp, Artificial Sequence
  chemically synthesized
cctcgtccaccatctcatgccc

SEQ ID NO: 13267 - DNA, 22 bp, Artificial Sequence
  chemically synthesized
ctcgtccaccatctcatgcccc

SEQ ID NO: 13268 - DNA, 22 bp, Artificial Sequence
  chemically synthesized
gtccaccatctcatgcccctgg

SEQ ID NO: 13269 - DNA, 22 bp, Artificial Sequence
  chemically synthesized
atgcccctggctctcctgcccc

SEQ ID NO: 13270 - DNA, 22 bp, Artificial Sequence
  chemically synthesized
gctctcctgccccttccctaca

SEQ ID NO: 13271 - DNA, 22 bp, Artificial Sequence
  chemically synthesized
tcctgccccttccctacagggg

SEQ ID NO: 13272 - DNA, 22 bp, Artificial Sequence
  chemically synthesized
ctgccccttccctacaggggtt

SEQ ID NO: 13273 - DNA, 22 bp, Artificial Sequence
  chemically synthesized
ccccttccctacaggggttcct

SEQ ID NO: 13274 - DNA, 22 bp, Artificial Sequence
  chemically synthesized
ccctacaggggttcctggctct

SEQ ID NO: 13275 - DNA, 22 bp, Artificial Sequence
  chemically synthesized
cctacaggggttcctggctctg

SEQ ID NO: 13276 - DNA, 22 bp, Artificial Sequence
  chemically synthesized
caggggttcctggctctgctct

SEQ ID NO: 13277 - DNA, 22 bp, Artificial Sequence
  chemically synthesized
ctggctctgctcttcagactga

SEQ ID NO: 13278 - DNA, 22 bp, Artificial Sequence
  chemically synthesized
gctctgctcttcagactgagcc

SEQ ID NO: 13279 - DNA, 22 bp, Artificial Sequence
  chemically synthesized
tgctcttcagactgagccccgt

SEQ ID NO: 13280 - DNA, 22 bp, Artificial Sequence
  chemically synthesized
ctcttcagactgagccccgttc

SEQ ID NO: 13281 - DNA, 22 bp, Artificial Sequence
  chemically synthesized
ttcagactgagccccgttcccc

SEQ ID NO: 13282 - DNA, 22 bp, Artificial Sequence
  chemically synthesized
cagactgagccccgttcccctg

SEQ ID NO: 13283 - DNA, 22 bp, Artificial Sequence
  chemically synthesized
agactgagccccgttcccctgc

SEQ ID NO: 13284 - DNA, 22 bp, Artificial Sequence
  chemically synthesized
agccccgttcccctgcatcccc

SEQ ID NO: 13285 - DNA, 22 bp, Artificial Sequence
  chemically synthesized
ccctgcatccccgttcccctgc

SEQ ID NO: 13286 - DNA, 22 bp, Artificial Sequence
  chemically synthesized
catccccgttcccctgcatccc

SEQ ID NO: 13287 - DNA, 22 bp, Artificial Sequence
  chemically synthesized
ccctgcatcccccttcccctgc

SEQ ID NO: 13288 - DNA, 22 bp, Artificial Sequence
  chemically synthesized
catcccccttcccctgcatccc

SEQ ID NO: 13289 - DNA, 22 bp, Artificial Sequence
  chemically synthesized
cccctgcatcccccagaggccc

SEQ ID NO: 13290 - DNA, 22 bp, Artificial Sequence
  chemically synthesized
ccctgcatcccccagaggcccc

SEQ ID NO: 13291 - DNA, 22 bp, Artificial Sequence
  chemically synthesized
catcccccagaggccccaggcc

SEQ ID NO: 13292 - DNA, 22 bp, Artificial Sequence
  chemically synthesized
cttggcctggaccccacgagag

SEQ ID NO: 13293 - DNA, 22 bp, Artificial Sequence
  chemically synthesized
ggcctggaccccacgagaggcc

SEQ ID NO: 13294 - DNA, 22 bp, Artificial Sequence
  chemically synthesized
gcctggaccccacgagaggcca

SEQ ID NO: 13295 - DNA, 22 bp, Artificial Sequence
  chemically synthesized
gaccccacgagaggccacccca

SEQ ID NO: 13296 - DNA, 22 bp, Artificial Sequence
  chemically synthesized
tctaccaggctgccttttgggt

SEQ ID NO: 13297 - DNA, 22 bp, Artificial Sequence
  chemically synthesized
ccaggctgccttttgggtggat

SEQ ID NO: 13298 - DNA, 22 bp, Artificial Sequence
  chemically synthesized
ccttttgggtggattctcctcc

SEQ ID NO: 13299 - DNA, 22 bp, Artificial Sequence
  chemically synthesized
ttgggtggattctcctccaact

SEQ ID NO: 13300 - DNA, 22 bp, Artificial Sequence
  chemically synthesized
tgggtggattctcctccaactg

SEQ ID NO: 13301 - DNA, 22 bp, Artificial Sequence
  chemically synthesized
gggtggattctcctccaactgt

SEQ ID NO: 13302 - DNA, 22 bp, Artificial Sequence
  chemically synthesized
ggtggattctcctccaactgtg

SEQ ID NO: 13303 - DNA, 22 bp, Artificial Sequence
  chemically synthesized
tcctccaactgtggggtgactg

SEQ ID NO: 13304 - DNA, 22 bp, Artificial Sequence
  chemically synthesized
ctccaactgtggggtgactgct

SEQ ID NO: 13305 - DNA, 22 bp, Artificial Sequence
  chemically synthesized
caactgtggggtgactgcttgg

SEQ ID NO: 13306 - DNA, 22 bp, Artificial Sequence
  chemically synthesized
tggggtgactgcttggcaaact

SEQ ID NO: 13307 - DNA, 22 bp, Artificial Sequence
  chemically synthesized
cttggcaaactcactcttcggg

SEQ ID NO: 13308 - DNA, 22 bp, Artificial Sequence
  chemically synthesized
ggcaaactcactcttcggggta

SEQ ID NO: 13309 - DNA, 22 bp, Artificial Sequence
  chemically synthesized
gcaaactcactcttcggggtat

SEQ ID NO: 13310 - DNA, 22 bp, Artificial Sequence
  chemically synthesized
actcttcggggtatcccaggag

SEQ ID NO: 13311 - DNA, 22 bp, Artificial Sequence
  chemically synthesized
ttcggggtatcccaggaggcct

SEQ ID NO: 13312 - DNA, 22 bp, Artificial Sequence
  chemically synthesized
cggggtatcccaggaggcctgg

SEQ ID NO: 13313 - DNA, 22 bp, Artificial Sequence
  chemically synthesized
ggggtatcccaggaggcctgga

SEQ ID NO: 13314 - DNA, 22 bp, Artificial Sequence
  chemically synthesized
gagcattggggtgggctggggt

SEQ ID NO: 13315 - DNA, 22 bp, Artificial Sequence
  chemically synthesized
gggtgggctggggttcagagag

SEQ ID NO: 13316 - DNA, 22 bp, Artificial Sequence
  chemically synthesized
gggttcagagaggagggattcc

SEQ ID NO: 13317 - DNA, 22 bp, Artificial Sequence
  chemically synthesized
agagaggagggattcccttctc

SEQ ID NO: 13318 - DNA, 22 bp, Artificial Sequence
  chemically synthesized
ccttctcaggttacgtggccaa

SEQ ID NO: 13319 - DNA, 22 bp, Artificial Sequence
  chemically synthesized
ctcaggttacgtggccaagaag

SEQ ID NO: 13320 - DNA, 22 bp, Artificial Sequence
  chemically synthesized
tcaggttacgtggccaagaagc

SEQ ID NO: 13321 - DNA, 22 bp, Artificial Sequence
  chemically synthesized
aggttacgtggccaagaagcag

SEQ ID NO: 13322 - DNA, 22 bp, Artificial Sequence
  chemically synthesized
cgtggccaagaagcaggggagc

SEQ ID NO: 13323 - DNA, 22 bp, Artificial Sequence
  chemically synthesized
ggtttgggtcaggtctgggtgt

SEQ ID NO: 13324 - DNA, 22 bp, Artificial Sequence
  chemically synthesized
gggtcaggtctgggtgtggggt

SEQ ID NO: 13325 - DNA, 22 bp, Artificial Sequence
  chemically synthesized
ggtcaggtctgggtgtggggtg

SEQ ID NO: 13326 - DNA, 22 bp, Artificial Sequence
  chemically synthesized
ggtgtggggtgaccagcttatg

SEQ ID NO: 13327 - DNA, 22 bp, Artificial Sequence
  chemically synthesized
atgctgtttgcccaggacagcc

SEQ ID NO: 13328 - DNA, 22 bp, Artificial Sequence
  chemically synthesized
tgctgtttgcccaggacagcct

SEQ ID NO: 13329 - DNA, 22 bp, Artificial Sequence
  chemically synthesized
tttgcccaggacagcctagttt

SEQ ID NO: 13330 - DNA, 22 bp, Artificial Sequence
  chemically synthesized
gcccaggacagcctagttttag

SEQ ID NO: 13331 - DNA, 22 bp, Artificial Sequence
  chemically synthesized
cccaggacagcctagttttagc

SEQ ID NO: 13332 - DNA, 22 bp, Artificial Sequence
  chemically synthesized
gttttagcactgaaaccctcag

SEQ ID NO: 13333 - DNA, 22 bp, Artificial Sequence
  chemically synthesized
tagcactgaaaccctcagtcct

SEQ ID NO: 13334 - DNA, 22 bp, Artificial Sequence
  chemically synthesized
agcactgaaaccctcagtccta

SEQ ID NO: 13335 - DNA, 22 bp, Artificial Sequence
  chemically synthesized
gcactgaaaccctcagtcctag

SEQ ID NO: 13336 - DNA, 22 bp, Artificial Sequence
  chemically synthesized
aaaccctcagtcctaggaaaac

SEQ ID NO: 13337 - DNA, 22 bp, Artificial Sequence
  chemically synthesized
agtcctaggaaaacagggatgg

SEQ ID NO: 13338 - DNA, 22 bp, Artificial Sequence
  chemically synthesized
ggaaaacagggatggttggtca

SEQ ID NO: 13339 - DNA, 22 bp, Artificial Sequence
  chemically synthesized
gtcactgtctctgggtgactct

SEQ ID NO: 13340 - DNA, 22 bp, Artificial Sequence
  chemically synthesized
tctctgggtgactcttgattcc

SEQ ID NO: 13341 - DNA, 22 bp, Artificial Sequence
  chemically synthesized
tgggtgactcttgattcccggc

SEQ ID NO: 13342 - DNA, 22 bp, Artificial Sequence
  chemically synthesized
ggtgactcttgattcccggcca

SEQ ID NO: 13343 - DNA, 22 bp, Artificial Sequence
  chemically synthesized
ttgattcccggccagtttctcc

SEQ ID NO: 13344 - DNA, 22 bp, Artificial Sequence
  chemically synthesized
gattcccggccagtttctccac

SEQ ID NO: 13345 - DNA, 22 bp, Artificial Sequence
  chemically synthesized
attcccggccagtttctccacc

SEQ ID NO: 13346 - DNA, 22 bp, Artificial Sequence
  chemically synthesized
ccggccagtttctccacctggg

SEQ ID NO: 13347 - DNA, 22 bp, Artificial Sequence
  chemically synthesized
ctccacctggggctgtgtttct

SEQ ID NO: 13348 - DNA, 22 bp, Artificial Sequence
  chemically synthesized
tccacctggggctgtgtttctc

SEQ ID NO: 13349 - DNA, 22 bp, Artificial Sequence
  chemically synthesized
cacctggggctgtgtttctcgt

SEQ ID NO: 13350 - DNA, 22 bp, Artificial Sequence
  chemically synthesized
gggctgtgtttctcgtcctgca

SEQ ID NO: 13351 - DNA, 22 bp, Artificial Sequence
  chemically synthesized
tgtttctcgtcctgcatccttc

SEQ ID NO: 13352 - DNA, 22 bp, Artificial Sequence
  chemically synthesized
ctcgtcctgcatccttctccag

SEQ ID NO: 13353 - DNA, 22 bp, Artificial Sequence
  chemically synthesized
tcgtcctgcatccttctccagg

SEQ ID NO: 13354 - DNA, 22 bp, Artificial Sequence
  chemically synthesized
gtcctgcatccttctccaggca

SEQ ID NO: 13355 - DNA, 22 bp, Artificial Sequence
  chemically synthesized
catccttctccaggcaggtccc

SEQ ID NO: 13356 - DNA, 22 bp, Artificial Sequence
  chemically synthesized
ctccaggcaggtccccaagcat

SEQ ID NO: 13357 - DNA, 22 bp, Artificial Sequence
  chemically synthesized
tccaggcaggtccccaagcatc

SEQ ID NO: 13358 - DNA, 22 bp, Artificial Sequence
  chemically synthesized
caggcaggtccccaagcatcgc

SEQ ID NO: 13359 - DNA, 22 bp, Artificial Sequence
  chemically synthesized
ctgtggctgttcccaagttctt

SEQ ID NO: 13360 - DNA, 22 bp, Artificial Sequence
  chemically synthesized
tggctgttcccaagttcttagg

SEQ ID NO: 13361 - DNA, 22 bp, Artificial Sequence
  chemically synthesized
ttcccaagttcttagggtaccc

SEQ ID NO: 13362 - DNA, 22 bp, Artificial Sequence
  chemically synthesized
ccaagttcttagggtaccccac

SEQ ID NO: 13363 - DNA, 22 bp, Artificial Sequence
  chemically synthesized
ttagggtaccccacgtgggttt

SEQ ID NO: 13364 - DNA, 22 bp, Artificial Sequence
  chemically synthesized
agggtaccccacgtgggtttat

SEQ ID NO: 13365 - DNA, 22 bp, Artificial Sequence
  chemically synthesized
gggtaccccacgtgggtttatc

SEQ ID NO: 13366 - DNA, 22 bp, Artificial Sequence
  chemically synthesized
atcaaccacttggtgaggctgg

SEQ ID NO: 13367 - DNA, 22 bp, Artificial Sequence
  chemically synthesized
tcaaccacttggtgaggctggt

SEQ ID NO: 13368 - DNA, 22 bp, Artificial Sequence
  chemically synthesized
ggtgaggctggtaccctgcccc

SEQ ID NO: 13369 - DNA, 22 bp, Artificial Sequence
  chemically synthesized
gtgaggctggtaccctgccccc

SEQ ID NO: 13370 - DNA, 22 bp, Artificial Sequence
  chemically synthesized
gtaccctgcccccattcctgca

SEQ ID NO: 13371 - DNA, 22 bp, Artificial Sequence
  chemically synthesized
cccccattcctgcaccccaatt

SEQ ID NO: 13372 - DNA, 22 bp, Artificial Sequence
  chemically synthesized
ctgcaccccaattgccttagtg

SEQ ID NO: 13373 - DNA, 22 bp, Artificial Sequence
  chemically synthesized
caccccaattgccttagtggct

SEQ ID NO: 13374 - DNA, 22 bp, Artificial Sequence
  chemically synthesized
ccttagtggctagggggttggg

SEQ ID NO: 13375 - DNA, 22 bp, Artificial Sequence
  chemically synthesized
agtggctagggggttgggggct

SEQ ID NO: 13376 - DNA, 22 bp, Artificial Sequence
  chemically synthesized
gtggctagggggttgggggcta

SEQ ID NO: 13377 - DNA, 22 bp, Artificial Sequence
  chemically synthesized
gggggttgggggctagagtagg

SEQ ID NO: 13378 - DNA, 22 bp, Artificial Sequence
  chemically synthesized
ggggctagagtaggaggggctg

SEQ ID NO: 13379 - DNA, 22 bp, Artificial Sequence
  chemically synthesized
gagtaggaggggctggagccag

SEQ ID NO: 13380 - DNA, 22 bp, Artificial Sequence
  chemically synthesized
gagccaggattcttagggctga

SEQ ID NO: 13381 - DNA, 22 bp, Artificial Sequence
  chemically synthesized
ttagggctgaacagagaagagc

SEQ ID NO: 13382 - DNA, 22 bp, Artificial Sequence
  chemically synthesized
agggctgaacagagaagagctg

SEQ ID NO: 13383 - DNA, 22 bp, Artificial Sequence
  chemically synthesized
gggctgaacagagaagagctgg

SEQ ID NO: 13384 - DNA, 22 bp, Artificial Sequence
  chemically synthesized
aacagagaagagctgggggcct

SEQ ID NO: 13385 - DNA, 22 bp, Artificial Sequence
  chemically synthesized
ggggcctgggctcctgggtttg

SEQ ID NO: 13386 - DNA, 22 bp, Artificial Sequence
  chemically synthesized
ggctcctgggtttgagagagga

SEQ ID NO: 13387 - DNA, 22 bp, Artificial Sequence
  chemically synthesized
ctgggtttgagagaggaggggc

SEQ ID NO: 13388 - DNA, 22 bp, Artificial Sequence
  chemically synthesized
ggtttgagagaggaggggctgg

SEQ ID NO: 13389 - DNA, 22 bp, Artificial Sequence
  chemically synthesized
gagagaggaggggctggggcct

SEQ ID NO: 13390 - DNA, 22 bp, Artificial Sequence
  chemically synthesized
agagaggaggggctggggcctg

SEQ ID NO: 13391 - DNA, 22 bp, Artificial Sequence
  chemically synthesized
gggcctggactcctgggtccga

SEQ ID NO: 13392 - DNA, 22 bp, Artificial Sequence
  chemically synthesized
gactcctgggtccgagggagga

SEQ ID NO: 13393 - DNA, 22 bp, Artificial Sequence
  chemically synthesized
ctgggtccgagggaggaggggc

SEQ ID NO: 13394 - DNA, 22 bp, Artificial Sequence
  chemically synthesized
ggtccgagggaggaggggctgg

SEQ ID NO: 13395 - DNA, 22 bp, Artificial Sequence
  chemically synthesized
gggcctggactcctgggtctga

SEQ ID NO: 13396 - DNA, 22 bp, Artificial Sequence
  chemically synthesized
gactcctgggtctgagggtgga

SEQ ID NO: 13397 - DNA, 22 bp, Artificial Sequence
  chemically synthesized
ctgggtctgagggtggagggac

SEQ ID NO: 13398 - DNA, 22 bp, Artificial Sequence
  chemically synthesized
ggtctgagggtggagggactgg

SEQ ID NO: 13399 - DNA, 22 bp, Artificial Sequence
  chemically synthesized
agggtggagggactgggggcct

SEQ ID NO: 13400 - DNA, 22 bp, Artificial Sequence
  chemically synthesized
ggggcctggactcctgggtccg

SEQ ID NO: 13401 - DNA, 22 bp, Artificial Sequence
  chemically synthesized
gactcctgggtccgagggagga

SEQ ID NO: 13402 - DNA, 22 bp, Artificial Sequence
  chemically synthesized
ctgggtccgagggaggaggggc

SEQ ID NO: 13403 - DNA, 22 bp, Artificial Sequence
  chemically synthesized
ggtccgagggaggaggggctgg

SEQ ID NO: 13404 - DNA, 22 bp, Artificial Sequence
  chemically synthesized
gggcctggactcgtgggtctga

SEQ ID NO: 13405 - DNA, 22 bp, Artificial Sequence
  chemically synthesized
gactcgtgggtctgagggagga

SEQ ID NO: 13406 - DNA, 22 bp, Artificial Sequence
  chemically synthesized
gtgggtctgagggaggaggggc

SEQ ID NO: 13407 - DNA, 22 bp, Artificial Sequence
  chemically synthesized
agggaggaggggctgggggcct

SEQ ID NO: 13408 - DNA, 22 bp, Artificial Sequence
  chemically synthesized
ggggcctggacttctgggtctt

SEQ ID NO: 13409 - DNA, 22 bp, Artificial Sequence
  chemically synthesized
gacttctgggtcttagggaggc

SEQ ID NO: 13410 - DNA, 22 bp, Artificial Sequence
  chemically synthesized
ctgggtcttagggaggcggggc

SEQ ID NO: 13411 - DNA, 22 bp, Artificial Sequence
  chemically synthesized
tgggtcttagggaggcggggct

SEQ ID NO: 13412 - DNA, 22 bp, Artificial Sequence
  chemically synthesized
ggtcttagggaggcggggctgg

SEQ ID NO: 13413 - DNA, 22 bp, Artificial Sequence
  chemically synthesized
agggaggcggggctgggcctgg

SEQ ID NO: 13414 - DNA, 22 bp, Artificial Sequence
  chemically synthesized
gggaggcggggctgggcctgga

SEQ ID NO: 13415 - DNA, 22 bp, Artificial Sequence
  chemically synthesized
ggcctggacccctgggtctgaa

SEQ ID NO: 13416 - DNA, 22 bp, Artificial Sequence
  chemically synthesized
gacccctgggtctgaatgggga

SEQ ID NO: 13417 - DNA, 22 bp, Artificial Sequence
  chemically synthesized
ggtctgaatggggagaggctgg

SEQ ID NO: 13418 - DNA, 22 bp, Artificial Sequence
  chemically synthesized
aatggggagaggctgggggcct

SEQ ID NO: 13419 - DNA, 22 bp, Artificial Sequence
  chemically synthesized
ggggcctggactccttcatctg

SEQ ID NO: 13420 - DNA, 22 bp, Artificial Sequence
  chemically synthesized
gactccttcatctgagggcgga

SEQ ID NO: 13421 - DNA, 22 bp, Artificial Sequence
  chemically synthesized
cttcatctgagggcggaagggc

SEQ ID NO: 13422 - DNA, 22 bp, Artificial Sequence
  chemically synthesized
catctgagggcggaagggctgg

SEQ ID NO: 13423 - DNA, 22 bp, Artificial Sequence
  chemically synthesized
atctgagggcggaagggctggg

SEQ ID NO: 13424 - DNA, 22 bp, Artificial Sequence
  chemically synthesized
agggcggaagggctggggcctg

SEQ ID NO: 13425 - DNA, 22 bp, Artificial Sequence
  chemically synthesized
gggcctggcctcctgggttgaa

SEQ ID NO: 13426 - DNA, 22 bp, Artificial Sequence
  chemically synthesized
gcctcctgggttgaatggggag

SEQ ID NO: 13427 - DNA, 22 bp, Artificial Sequence
  chemically synthesized
ctgggttgaatggggaggggtt

SEQ ID NO: 13428 - DNA, 22 bp, Artificial Sequence
  chemically synthesized
ggttgaatggggaggggttggg

SEQ ID NO: 13429 - DNA, 22 bp, Artificial Sequence
  chemically synthesized
aatggggaggggttgggcctgg

SEQ ID NO: 13430 - DNA, 22 bp, Artificial Sequence
  chemically synthesized
ggcctggactctggagtccctg

SEQ ID NO: 13431 - DNA, 22 bp, Artificial Sequence
  chemically synthesized
gactctggagtccctggtgccc

SEQ ID NO: 13432 - DNA, 22 bp, Artificial Sequence
  chemically synthesized
tggagtccctggtgcccaggcc

SEQ ID NO: 13433 - DNA, 22 bp, Artificial Sequence
  chemically synthesized
gagtccctggtgcccaggcctc

SEQ ID NO: 13434 - DNA, 22 bp, Artificial Sequence
  chemically synthesized
gtgcccaggcctcaggcatctt

SEQ ID NO: 13435 - DNA, 22 bp, Artificial Sequence
  chemically synthesized
aggcatctttcacagggatgcc

SEQ ID NO: 13436 - DNA, 22 bp, Artificial Sequence
  chemically synthesized
tcacagggatgcctgtactggg

SEQ ID NO: 13437 - DNA, 22 bp, Artificial Sequence
  chemically synthesized
cacagggatgcctgtactgggc

SEQ ID NO: 13438 - DNA, 22 bp, Artificial Sequence
  chemically synthesized
acagggatgcctgtactgggca

SEQ ID NO: 13439 - DNA, 22 bp, Artificial Sequence
  chemically synthesized
tactgggcaggtccttgaaagg

SEQ ID NO: 13440 - DNA, 22 bp, Artificial Sequence
  chemically synthesized
ggcaggtccttgaaagggaaag

SEQ ID NO: 13441 - DNA, 22 bp, Artificial Sequence
  chemically synthesized
gaaagggaaaggcccattgctc

SEQ ID NO: 13442 - DNA, 22 bp, Artificial Sequence
  chemically synthesized
aaagggaaaggcccattgctct

SEQ ID NO: 13443 - DNA, 22 bp, Artificial Sequence
  chemically synthesized
ctctccttgcccccctccccta

SEQ ID NO: 13444 - DNA, 22 bp, Artificial Sequence
  chemically synthesized
tccttgcccccctcccctatcg

SEQ ID NO: 13445 - DNA, 22 bp, Artificial Sequence
  chemically synthesized
cttgcccccctcccctatcgcc

SEQ ID NO: 13446 - DNA, 22 bp, Artificial Sequence
  chemically synthesized
gcccccctcccctatcgccatg

SEQ ID NO: 13447 - DNA, 22 bp, Artificial Sequence
  chemically synthesized
cccccctcccctatcgccatga

SEQ ID NO: 13448 - DNA, 22 bp, Artificial Sequence
  chemically synthesized
ccctatcgccatgacaactggg

SEQ ID NO: 13449 - DNA, 22 bp, Artificial Sequence
  chemically synthesized
tcgccatgacaactgggtggaa

SEQ ID NO: 13450 - DNA, 22 bp, Artificial Sequence
  chemically synthesized
ggtggaaataaacgagccgagt

SEQ ID NO: 13451 - DNA, 22 bp, Artificial Sequence
  chemically synthesized
atcccgttcccagggcacgtgc

SEQ ID NO: 13452 - DNA, 22 bp, Artificial Sequence
  chemically synthesized
ccagggcacgtgcggccccttc

SEQ ID NO: 13453 - DNA, 22 bp, Artificial Sequence
  chemically synthesized
cacagcccgagtttccatgacc

SEQ ID NO: 13454 - DNA, 22 bp, Artificial Sequence
  chemically synthesized
acagcccgagtttccatgacct

SEQ ID NO: 13455 - DNA, 22 bp, Artificial Sequence
  chemically synthesized
ccatgacctcatgctcttggcc

SEQ ID NO: 13456 - DNA, 22 bp, Artificial Sequence
  chemically synthesized
catgacctcatgctcttggccc

SEQ ID NO: 13457 - DNA, 22 bp, Artificial Sequence
  chemically synthesized
atgctcttggccctcgtagctc

SEQ ID NO: 13458 - DNA, 22 bp, Artificial Sequence
  chemically synthesized
ttggccctcgtagctccctccc

SEQ ID NO: 13459 - DNA, 22 bp, Artificial Sequence
  chemically synthesized
ggccctcgtagctccctcccgc

SEQ ID NO: 13460 - DNA, 22 bp, Artificial Sequence
  chemically synthesized
gccctcgtagctccctcccgcc

SEQ ID NO: 13461 - DNA, 22 bp, Artificial Sequence
  chemically synthesized
gtagctccctcccgcctcctcc

SEQ ID NO: 13462 - DNA, 22 bp, Artificial Sequence
  chemically synthesized
cctcccgcctcctccagatggg

SEQ ID NO: 13463 - DNA, 22 bp, Artificial Sequence
  chemically synthesized
ccgcctcctccagatgggcagc

SEQ ID NO: 13464 - DNA, 22 bp, Artificial Sequence
  chemically synthesized
ctccagatgggcagctttggag

SEQ ID NO: 13465 - DNA, 22 bp, Artificial Sequence
  chemically synthesized
cagatgggcagctttggagagg

SEQ ID NO: 13466 - DNA, 22 bp, Artificial Sequence
  chemically synthesized
tggagaggtgagggacttgggg

SEQ ID NO: 13467 - DNA, 22 bp, Artificial Sequence
  chemically synthesized
ggagaggtgagggacttggggg

SEQ ID NO: 13468 - DNA, 22 bp, Artificial Sequence
  chemically synthesized
gagaggtgagggacttgggggg

SEQ ID NO: 13469 - DNA, 22 bp, Artificial Sequence
  chemically synthesized
ggggggtaatttatcccgtgga

SEQ ID NO: 13470 - DNA, 22 bp, Artificial Sequence
  chemically synthesized
gggggtaatttatcccgtggat

SEQ ID NO: 13471 - DNA, 22 bp, Artificial Sequence
  chemically synthesized
atcccgtggatctaggagttta

SEQ ID NO: 13472 - DNA, 22 bp, Artificial Sequence
  chemically synthesized
tcccgtggatctaggagtttag

SEQ ID NO: 13473 - DNA, 22 bp, Artificial Sequence
  chemically synthesized
ggagtttagcttcactccttcc

SEQ ID NO: 13474 - DNA, 22 bp, Artificial Sequence
  chemically synthesized
agcttcactccttcctcagctc

SEQ ID NO: 13475 - DNA, 22 bp, Artificial Sequence
  chemically synthesized
gcttcactccttcctcagctcc

SEQ ID NO: 13476 - DNA, 22 bp, Artificial Sequence
  chemically synthesized
cactccttcctcagctccagtt

SEQ ID NO: 13477 - DNA, 22 bp, Artificial Sequence
  chemically synthesized
actccttcctcagctccagttc

SEQ ID NO: 13478 - DNA, 22 bp, Artificial Sequence
  chemically synthesized
cttcctcagctccagttcaggt

SEQ ID NO: 13479 - DNA, 22 bp, Artificial Sequence
  chemically synthesized
cctcagctccagttcaggtccc

SEQ ID NO: 13480 - DNA, 22 bp, Artificial Sequence
  chemically synthesized
ctcagctccagttcaggtcccg

SEQ ID NO: 13481 - DNA, 22 bp, Artificial Sequence
  chemically synthesized
agctccagttcaggtcccggag

SEQ ID NO: 13482 - DNA, 22 bp, Artificial Sequence
  chemically synthesized
cagttcaggtcccggagcccac

SEQ ID NO: 13483 - DNA, 22 bp, Artificial Sequence
  chemically synthesized
aggtcccggagcccacccagtg

SEQ ID NO: 13484 - DNA, 22 bp, Artificial Sequence
  chemically synthesized
gggcaagtccctcctccgaccc

SEQ ID NO: 13485 - DNA, 22 bp, Artificial Sequence
  chemically synthesized
ctccgaccccctggacttcggc

SEQ ID NO: 13486 - DNA, 22 bp, Artificial Sequence
  chemically synthesized
cgaccccctggacttcggcttt

SEQ ID NO: 13487 - DNA, 22 bp, Artificial Sequence
  chemically synthesized
gacttcggcttttgtcccccca

SEQ ID NO: 13488 - DNA, 22 bp, Artificial Sequence
  chemically synthesized
cggcttttgtccccccaagttt

SEQ ID NO: 13489 - DNA, 22 bp, Artificial Sequence
  chemically synthesized
ggcttttgtccccccaagtttt

SEQ ID NO: 13490 - DNA, 22 bp, Artificial Sequence
  chemically synthesized
ttgtccccccaagttttggacc

SEQ ID NO: 13491 - DNA, 22 bp, Artificial Sequence
  chemically synthesized
tgtccccccaagttttggaccc

SEQ ID NO: 13492 - DNA, 22 bp, Artificial Sequence
  chemically synthesized
gtccccccaagttttggacccc

SEQ ID NO: 13493 - DNA, 22 bp, Artificial Sequence
  chemically synthesized
tccccccaagttttggacccct

SEQ ID NO: 13494 - DNA, 22 bp, Artificial Sequence
  chemically synthesized
tggacccctaagggaagaatga

SEQ ID NO: 13495 - DNA, 22 bp, Artificial Sequence
  chemically synthesized
ggacccctaagggaagaatgag

SEQ ID NO: 13496 - DNA, 22 bp, Artificial Sequence
  chemically synthesized
gacccctaagggaagaatgaga

SEQ ID NO: 13497 - DNA, 22 bp, Artificial Sequence
  chemically synthesized
agggaagaatgagaaacggtgg

SEQ ID NO: 13498 - DNA, 22 bp, Artificial Sequence
  chemically synthesized
gctgcagggccccgtgcagagg

SEQ ID NO: 13499 - DNA, 22 bp, Artificial Sequence
  chemically synthesized
cagggccccgtgcagagggggc

SEQ ID NO: 13500 - DNA, 22 bp, Artificial Sequence
  chemically synthesized
agtgaactggagtgtgacagcc

SEQ ID NO: 13501 - DNA, 22 bp, Artificial Sequence
  chemically synthesized
gagtgtgacagcctggggccca

SEQ ID NO: 13502 - DNA, 22 bp, Artificial Sequence
  chemically synthesized
gggcccaggcacacaggtgtgc

SEQ ID NO: 13503 - DNA, 22 bp, Artificial Sequence
  chemically synthesized
tctcacccctctgggagtcccg

SEQ ID NO: 13504 - DNA, 22 bp, Artificial Sequence
  chemically synthesized
acccctctgggagtcccgccca

SEQ ID NO: 13505 - DNA, 22 bp, Artificial Sequence
  chemically synthesized
tgggagtcccgcccaggcccct

SEQ ID NO: 13506 - DNA, 22 bp, Artificial Sequence
  chemically synthesized
ggagtcccgcccaggcccctga

SEQ ID NO: 13507 - DNA, 22 bp, Artificial Sequence
  chemically synthesized
agtctgtcccagcacagggtgg

SEQ ID NO: 13508 - DNA, 22 bp, Artificial Sequence
  chemically synthesized
tcccagcacagggtggccttcc

SEQ ID NO: 13509 - DNA, 22 bp, Artificial Sequence
  chemically synthesized
cctccaccctgcatagccctgg

SEQ ID NO: 13510 - DNA, 22 bp, Artificial Sequence
  chemically synthesized
ctccaccctgcatagccctggg

SEQ ID NO: 13511 - DNA, 22 bp, Artificial Sequence
  chemically synthesized
caccctgcatagccctgggccc

SEQ ID NO: 13512 - DNA, 22 bp, Artificial Sequence
  chemically synthesized
catagccctgggcccacggctt

SEQ ID NO: 13513 - DNA, 22 bp, Artificial Sequence
  chemically synthesized
ggcccacggcttcgttcctgca

SEQ ID NO: 13514 - DNA, 22 bp, Artificial Sequence
  chemically synthesized
cgttcctgcagagtatctgctg

SEQ ID NO: 13515 - DNA, 22 bp, Artificial Sequence
  chemically synthesized
gttcctgcagagtatctgctgg

SEQ ID NO: 13516 - DNA, 22 bp, Artificial Sequence
  chemically synthesized
ctgcagagtatctgctggggtg

SEQ ID NO: 13517 - DNA, 22 bp, Artificial Sequence
  chemically synthesized
cagagtatctgctggggtggtt

SEQ ID NO: 13518 - DNA, 22 bp, Artificial Sequence
  chemically synthesized
ctggggtggtttccgagcttga

SEQ ID NO: 13519 - DNA, 22 bp, Artificial Sequence
  chemically synthesized
gggtggtttccgagcttgaccc

SEQ ID NO: 13520 - DNA, 22 bp, Artificial Sequence
  chemically synthesized
ccgagcttgacccttggaagga

SEQ ID NO: 13521 - DNA, 22 bp, Artificial Sequence
  chemically synthesized
cgagcttgacccttggaaggac

SEQ ID NO: 13522 - DNA, 22 bp, Artificial Sequence
  chemically synthesized
gacccttggaaggacctggctg

SEQ ID NO: 13523 - DNA, 22 bp, Artificial Sequence
  chemically synthesized
acccttggaaggacctggctgg

SEQ ID NO: 13524 - DNA, 22 bp, Artificial Sequence
  chemically synthesized
ggaaggacctggctgggtttaa

SEQ ID NO: 13525 - DNA, 22 bp, Artificial Sequence
  chemically synthesized
gaaggacctggctgggtttaag

SEQ ID NO: 13526 - DNA, 22 bp, Artificial Sequence
  chemically synthesized
gctgggtttaaggcaggagggg

SEQ ID NO: 13527 - DNA, 22 bp, Artificial Sequence
  chemically synthesized
ggtttaaggcaggaggggctgg

SEQ ID NO: 13528 - DNA, 22 bp, Artificial Sequence
  chemically synthesized
aaggcaggaggggctgggggcc

SEQ ID NO: 13529 - DNA, 22 bp, Artificial Sequence
  chemically synthesized
aggcaggaggggctgggggcca

SEQ ID NO: 13530 - DNA, 22 bp, Artificial Sequence
  chemically synthesized
ggggccaggactcctggctctg

SEQ ID NO: 13531 - DNA, 22 bp, Artificial Sequence
  chemically synthesized
ctggctctgaaggaggaggggc

SEQ ID NO: 13532 - DNA, 22 bp, Artificial Sequence
  chemically synthesized
gctctgaaggaggaggggctgg

SEQ ID NO: 13533 - DNA, 22 bp, Artificial Sequence
  chemically synthesized
tgaaggaggaggggctggaacc

SEQ ID NO: 13534 - DNA, 22 bp, Artificial Sequence
  chemically synthesized
aaggaggaggggctggaacctc

SEQ ID NO: 13535 - DNA, 22 bp, Artificial Sequence
  chemically synthesized
gaacctcttccctagtctgagc

SEQ ID NO: 13536 - DNA, 22 bp, Artificial Sequence
  chemically synthesized
ttccctagtctgagcactggaa

SEQ ID NO: 13537 - DNA, 22 bp, Artificial Sequence
  chemically synthesized
ccctagtctgagcactggaagc

SEQ ID NO: 13538 - DNA, 22 bp, Artificial Sequence
  chemically synthesized
cctagtctgagcactggaagcg

SEQ ID NO: 13539 - DNA, 22 bp, Artificial Sequence
  chemically synthesized
gtctgagcactggaagcgccac

SEQ ID NO: 13540 - DNA, 22 bp, Artificial Sequence
  chemically synthesized
agcactggaagcgccacctgtg

SEQ ID NO: 13541 - DNA, 22 bp, Artificial Sequence
  chemically synthesized
gaagcgccacctgtgggtggtg

SEQ ID NO: 13542 - DNA, 22 bp, Artificial Sequence
  chemically synthesized
tgggtggtgacgggggttttgc

SEQ ID NO: 13543 - DNA, 22 bp, Artificial Sequence
  chemically synthesized
tgccgtgtctaacaggtaccat

SEQ ID NO: 13544 - DNA, 22 bp, Artificial Sequence
  chemically synthesized
gccgtgtctaacaggtaccatg

SEQ ID NO: 13545 - DNA, 22 bp, Artificial Sequence
  chemically synthesized
ccgtgtctaacaggtaccatgt

SEQ ID NO: 13546 - DNA, 22 bp, Artificial Sequence
  chemically synthesized
acaggtaccatgtggggttccc

SEQ ID NO: 13547 - DNA, 22 bp, Artificial Sequence
  chemically synthesized
ccgcacccagatgagaagcccc

SEQ ID NO: 13548 - DNA, 22 bp, Artificial Sequence
  chemically synthesized
ccttccccgttcacttcctgtt

SEQ ID NO: 13549 - DNA, 22 bp, Artificial Sequence
  chemically synthesized
ccccgttcacttcctgtttgca

SEQ ID NO: 13550 - DNA, 22 bp, Artificial Sequence
  chemically synthesized
cccgttcacttcctgtttgcag

SEQ ID NO: 13551 - DNA, 22 bp, Artificial Sequence
  chemically synthesized
acttcctgtttgcagatagcca

SEQ ID NO: 13552 - DNA, 22 bp, Artificial Sequence
  chemically synthesized
cctgtttgcagatagccaggag

SEQ ID NO: 13553 - DNA, 22 bp, Artificial Sequence
  chemically synthesized
ctgtttgcagatagccaggagt

SEQ ID NO: 13554 - DNA, 22 bp, Artificial Sequence
  chemically synthesized
tttgcagatagccaggagtcct

SEQ ID NO: 13555 - DNA, 22 bp, Artificial Sequence
  chemically synthesized
gcagatagccaggagtcctttc

SEQ ID NO: 13556 - DNA, 22 bp, Artificial Sequence
  chemically synthesized
cagatagccaggagtcctttcg

SEQ ID NO: 13557 - DNA, 22 bp, Artificial Sequence
  chemically synthesized
tcgtggtttccactgagcactg

SEQ ID NO: 13558 - DNA, 22 bp, Artificial Sequence
  chemically synthesized
cgtggtttccactgagcactga

SEQ ID NO: 13559 - DNA, 22 bp, Artificial Sequence
  chemically synthesized
gtggtttccactgagcactgaa

SEQ ID NO: 13560 - DNA, 22 bp, Artificial Sequence
  chemically synthesized
ccactgagcactgaaggcctgg

SEQ ID NO: 13561 - DNA, 22 bp, Artificial Sequence
  chemically synthesized
cactgagcactgaaggcctggc

SEQ ID NO: 13562 - DNA, 22 bp, Artificial Sequence
  chemically synthesized
agcactgaaggcctggccggcc

SEQ ID NO: 13563 - DNA, 22 bp, Artificial Sequence
  chemically synthesized
aaggcctggccggcctgaccac

SEQ ID NO: 13564 - DNA, 22 bp, Artificial Sequence
  chemically synthesized
gccggcctgaccactgggcaac

SEQ ID NO: 13565 - DNA, 22 bp, Artificial Sequence
  chemically synthesized
accactgggcaaccaggcgtat

SEQ ID NO: 13566 - DNA, 22 bp, Artificial Sequence
  chemically synthesized
ggcaaccaggcgtatcttaaac

SEQ ID NO: 13567 - DNA, 22 bp, Artificial Sequence
  chemically synthesized
aaacagccagtggccagaggct

SEQ ID NO: 13568 - DNA, 22 bp, Artificial Sequence
  chemically synthesized
aacagccagtggccagaggctg

SEQ ID NO: 13569 - DNA, 22 bp, Artificial Sequence
  chemically synthesized
ttgggtcattttccccactgtc

SEQ ID NO: 13570 - DNA, 22 bp, Artificial Sequence
  chemically synthesized
ggtcattttccccactgtccta

SEQ ID NO: 13571 - DNA, 22 bp, Artificial Sequence
  chemically synthesized
tccccactgtcctagcaccgtg

SEQ ID NO: 13572 - DNA, 22 bp, Artificial Sequence
  chemically synthesized
ccccactgtcctagcaccgtgt

SEQ ID NO: 13573 - DNA, 22 bp, Artificial Sequence
  chemically synthesized
cccactgtcctagcaccgtgtc

SEQ ID NO: 13574 - DNA, 22 bp, Artificial Sequence
  chemically synthesized
tcctagcaccgtgtccctggat

SEQ ID NO: 13575 - DNA, 22 bp, Artificial Sequence
  chemically synthesized
gcaccgtgtccctggatctgtt

SEQ ID NO: 13576 - DNA, 22 bp, Artificial Sequence
  chemically synthesized
gatctgttttcgtggctccctc

SEQ ID NO: 13577 - DNA, 22 bp, Artificial Sequence
  chemically synthesized
ttttcgtggctccctctggagt

SEQ ID NO: 13578 - DNA, 22 bp, Artificial Sequence
  chemically synthesized
tcgtggctccctctggagtccc

SEQ ID NO: 13579 - DNA, 22 bp, Artificial Sequence
  chemically synthesized
cgtggctccctctggagtcccg

SEQ ID NO: 13580 - DNA, 22 bp, Artificial Sequence
  chemically synthesized
gtggctccctctggagtcccga

SEQ ID NO: 13581 - DNA, 22 bp, Artificial Sequence
  chemically synthesized
cctctggagtcccgacttgctg

SEQ ID NO: 13582 - DNA, 22 bp, Artificial Sequence
  chemically synthesized
tggagtcccgacttgctgggac

SEQ ID NO: 13583 - DNA, 22 bp, Artificial Sequence
  chemically synthesized
gagtcccgacttgctgggacac

SEQ ID NO: 13584 - DNA, 22 bp, Artificial Sequence
  chemically synthesized
gctgggacaccgtggctggggt

SEQ ID NO: 13585 - DNA, 22 bp, Artificial Sequence
  chemically synthesized
ctgggacaccgtggctggggta

SEQ ID NO: 13586 - DNA, 22 bp, Artificial Sequence
  chemically synthesized
ggacaccgtggctggggtaggt

SEQ ID NO: 13587 - DNA, 22 bp, Artificial Sequence
  chemically synthesized
gggtaggtgcggctgacggctg

SEQ ID NO: 13588 - DNA, 22 bp, Artificial Sequence
  chemically synthesized
acggctgtttcccacccccagg

SEQ ID NO: 13589 - DNA, 22 bp, Artificial Sequence
  chemically synthesized
tttcccacccccaggcctgcat

SEQ ID NO: 13590 - DNA, 22 bp, Artificial Sequence
  chemically synthesized
cccacccccaggcctgcattga

SEQ ID NO: 13591 - DNA, 22 bp, Artificial Sequence
  chemically synthesized
ccacccccaggcctgcattgat

SEQ ID NO: 13592 - DNA, 22 bp, Artificial Sequence
  chemically synthesized
cattgatgagaacctggaggtg

SEQ ID NO: 13593 - DNA, 22 bp, Artificial Sequence
  chemically synthesized
atgagaacctggaggtggtgcg

SEQ ID NO: 13594 - DNA, 22 bp, Artificial Sequence
  chemically synthesized
gaggtggtgcgcttcttggtgg

SEQ ID NO: 13595 - DNA, 22 bp, Artificial Sequence
  chemically synthesized
cttggtggagcagggcgccact

SEQ ID NO: 13596 - DNA, 22 bp, Artificial Sequence
  chemically synthesized
ttggtggagcagggcgccactg

SEQ ID NO: 13597 - DNA, 22 bp, Artificial Sequence
  chemically synthesized
ggtggagcagggcgccactgtg

SEQ ID NO: 13598 - DNA, 22 bp, Artificial Sequence
  chemically synthesized
gtggagcagggcgccactgtga

SEQ ID NO: 13599 - DNA, 22 bp, Artificial Sequence
  chemically synthesized
tgaaccaggcagacaacgaggg

SEQ ID NO: 13600 - DNA, 22 bp, Artificial Sequence
  chemically synthesized
gacgccactgcacgtggccgcc

SEQ ID NO: 13601 - DNA, 22 bp, Artificial Sequence
  chemically synthesized
cacgtggccgcctcctgtggct

SEQ ID NO: 13602 - DNA, 22 bp, Artificial Sequence
  chemically synthesized
ctgtggctacctagatatcgcc

SEQ ID NO: 13603 - DNA, 20 bp, Artificial Sequence
  chemically synthesized
taatttccctccgtttgtcc

SEQ ID NO: 13604 - DNA, 20 bp, Artificial Sequence
  chemically synthesized
ctgtcaaccccacacgcctt

SEQ ID NO: 13605 - DNA, 20 bp, Artificial Sequence
  chemically synthesized
cacacgcctttggcacaatg

SEQ ID NO: 13606 - DNA, 20 bp, Artificial Sequence
  chemically synthesized
acgcctttggcacaatgaag

SEQ ID NO: 13607 - DNA, 20 bp, Artificial Sequence
  chemically synthesized
cgcctttggcacaatgaagt

SEQ ID NO: 13608 - DNA, 20 bp, Artificial Sequence
  chemically synthesized
atttcccttctttttctctt

SEQ ID NO: 13609 - DNA, 20 bp, Artificial Sequence
  chemically synthesized
ccttctttttctctttagct

SEQ ID NO: 13610 - DNA, 20 bp, Artificial Sequence
  chemically synthesized
ctctttagctcggcttattc

SEQ ID NO: 13611 - DNA, 20 bp, Artificial Sequence
  chemically synthesized
tctttagctcggcttattcc

SEQ ID NO: 13612 - DNA, 20 bp, Artificial Sequence
  chemically synthesized
ctttagctcggcttattcca

SEQ ID NO: 13613 - DNA, 20 bp, Artificial Sequence
  chemically synthesized
tttagctcggcttattccag

SEQ ID NO: 13614 - DNA, 20 bp, Artificial Sequence
  chemically synthesized
ttccaggggtgtgtttcgtc

SEQ ID NO: 13615 - DNA, 20 bp, Artificial Sequence
  chemically synthesized
tgtttcgtcgagatgcacgt

SEQ ID NO: 13616 - DNA, 20 bp, Artificial Sequence
  chemically synthesized
caacttttattctattttcc

SEQ ID NO: 13617 - DNA, 20 bp, Artificial Sequence
  chemically synthesized
tctattttcccagtaaaata

SEQ ID NO: 13618 - DNA, 20 bp, Artificial Sequence
  chemically synthesized
ttcccagtaaaataaagttt

SEQ ID NO: 13619 - DNA, 20 bp, Artificial Sequence
  chemically synthesized
tagtaaactctgcatcttta

SEQ ID NO: 13620 - DNA, 20 bp, Artificial Sequence
  chemically synthesized
gcatctttaaagaattattt

SEQ ID NO: 13621 - DNA, 20 bp, Artificial Sequence
  chemically synthesized
tttggcatttatttctaaaa

SEQ ID NO: 13622 - DNA, 20 bp, Artificial Sequence
  chemically synthesized
catttatttctaaaatggca

SEQ ID NO: 13623 - DNA, 20 bp, Artificial Sequence
  chemically synthesized
catagtattttgtatttgtg

SEQ ID NO: 13624 - DNA, 20 bp, Artificial Sequence
  chemically synthesized
ttgtatttgtgaagtcttac

SEQ ID NO: 13625 - DNA, 20 bp, Artificial Sequence
  chemically synthesized
tgtatttgtgaagtcttaca

SEQ ID NO: 13626 - DNA, 20 bp, Artificial Sequence
  chemically synthesized
ttaataaaattcaaacatcc

SEQ ID NO: 13627 - DNA, 20 bp, Artificial Sequence
  chemically synthesized
taataaaattcaaacatcct

SEQ ID NO: 13628 - DNA, 20 bp, Artificial Sequence
  chemically synthesized
atcctaggtaaaaaaaaaaa

SEQ ID NO: 13629 - DNA, 20 bp, Artificial Sequence
  chemically synthesized
tcctaggtaaaaaaaaaaaa

SEQ ID NO: 13630 - DNA, 20 bp, Artificial Sequence
  chemically synthesized
aggtaaaaaaaaaaaaaggt

SEQ ID NO: 13631 - DNA, 20 bp, Artificial Sequence
  chemically synthesized
aaaaaaaggtcagaattgtt

SEQ ID NO: 13632 - DNA, 20 bp, Artificial Sequence
  chemically synthesized
gtaattttcttttgcgcact

SEQ ID NO: 13633 - DNA, 20 bp, Artificial Sequence
  chemically synthesized
taattttcttttgcgcacta

SEQ ID NO: 13634 - DNA, 20 bp, Artificial Sequence
  chemically synthesized
tttcttttgcgcactaagga

SEQ ID NO: 13635 - DNA, 20 bp, Artificial Sequence
  chemically synthesized
tgcgcactaaggaaagtgca

SEQ ID NO: 13636 - DNA, 20 bp, Artificial Sequence
  chemically synthesized
aaggaaagtgcaaagtaact

SEQ ID NO: 13637 - DNA, 20 bp, Artificial Sequence
  chemically synthesized
ggaaagtgcaaagtaactta

SEQ ID NO: 13638 - DNA, 20 bp, Artificial Sequence
  chemically synthesized
ttagagtgactgaaacttca

SEQ ID NO: 13639 - DNA, 20 bp, Artificial Sequence
  chemically synthesized
gtgactgaaacttcacagaa

SEQ ID NO: 13640 - DNA, 20 bp, Artificial Sequence
  chemically synthesized
tgactgaaacttcacagaat

SEQ ID NO: 13641 - DNA, 20 bp, Artificial Sequence
  chemically synthesized
gactgaaacttcacagaata

SEQ ID NO: 13642 - DNA, 20 bp, Artificial Sequence
  chemically synthesized
aacttcacagaatagggttg

SEQ ID NO: 13643 - DNA, 20 bp, Artificial Sequence
  chemically synthesized
ttgaattcataactatccca

SEQ ID NO: 13644 - DNA, 20 bp, Artificial Sequence
  chemically synthesized
tgtgctgttgatctcataaa

SEQ ID NO: 13645 - DNA, 20 bp, Artificial Sequence
  chemically synthesized
atttatatttattttcattt

SEQ ID NO: 13646 - DNA, 20 bp, Artificial Sequence
  chemically synthesized
ttcattttagtctgtcttct

SEQ ID NO: 13647 - DNA, 20 bp, Artificial Sequence
  chemically synthesized
gtcttcttggttgctgttga

SEQ ID NO: 13648 - DNA, 20 bp, Artificial Sequence
  chemically synthesized
ttgctgttgatagacactaa

SEQ ID NO: 13649 - DNA, 20 bp, Artificial Sequence
  chemically synthesized
gctgttgatagacactaaaa

SEQ ID NO: 13650 - DNA, 20 bp, Artificial Sequence
  chemically synthesized
gatagacactaaaagagtat

SEQ ID NO: 13651 - DNA, 20 bp, Artificial Sequence
  chemically synthesized
aagagtattagatattatct

SEQ ID NO: 13652 - DNA, 20 bp, Artificial Sequence
  chemically synthesized
tattatctaagtttgaatat

SEQ ID NO: 13653 - DNA, 20 bp, Artificial Sequence
  chemically synthesized
attatctaagtttgaatata

SEQ ID NO: 13654 - DNA, 20 bp, Artificial Sequence
  chemically synthesized
atatttaataatttttaaaa

SEQ ID NO: 13655 - DNA, 20 bp, Artificial Sequence
  chemically synthesized
aatttttaaaatagtattct

SEQ ID NO: 13656 - DNA, 20 bp, Artificial Sequence
  chemically synthesized
ttgaattattcttctgttta

SEQ ID NO: 13657 - DNA, 20 bp, Artificial Sequence
  chemically synthesized
tgaattattcttctgtttaa

SEQ ID NO: 13658 - DNA, 20 bp, Artificial Sequence
  chemically synthesized
attattcttctgtttaaagg

SEQ ID NO: 13659 - DNA, 20 bp, Artificial Sequence
  chemically synthesized
attcttctgtttaaaggcag

SEQ ID NO: 13660 - DNA, 20 bp, Artificial Sequence
  chemically synthesized
aaataattgaacatcatcct

SEQ ID NO: 13661 - DNA, 20 bp, Artificial Sequence
  chemically synthesized
catcatcctgagtttttctg

SEQ ID NO: 13662 - DNA, 20 bp, Artificial Sequence
  chemically synthesized
atcatcctgagtttttctgt

SEQ ID NO: 13663 - DNA, 20 bp, Artificial Sequence
  chemically synthesized
ctgagtttttctgtaggaat

SEQ ID NO: 13664 - DNA, 20 bp, Artificial Sequence
  chemically synthesized
gagtttttctgtaggaatca

SEQ ID NO: 13665 - DNA, 20 bp, Artificial Sequence
  chemically synthesized
ttgaaacaaatgcataatct

SEQ ID NO: 13666 - DNA, 20 bp, Artificial Sequence
  chemically synthesized
aatgcataatctaagtcaaa

SEQ ID NO: 13667 - DNA, 20 bp, Artificial Sequence
  chemically synthesized
cataatctaagtcaaatgga

SEQ ID NO: 13668 - DNA, 20 bp, Artificial Sequence
  chemically synthesized
caaatggaaagaaatataaa

SEQ ID NO: 13669 - DNA, 20 bp, Artificial Sequence
  chemically synthesized
ttattacttcttgttttctt

SEQ ID NO: 13670 - DNA, 20 bp, Artificial Sequence
  chemically synthesized
cttttttttcttcccttgcc

SEQ ID NO: 13671 - DNA, 20 bp, Artificial Sequence
  chemically synthesized
ttttcttcccttgcccagac

SEQ ID NO: 13672 - DNA, 20 bp, Artificial Sequence
  chemically synthesized
ttcttcccttgcccagacaa

SEQ ID NO: 13673 - DNA, 20 bp, Artificial Sequence
  chemically synthesized
tcccttgcccagacaagagt

SEQ ID NO: 13674 - DNA, 20 bp, Artificial Sequence
  chemically synthesized
cccttgcccagacaagagtg

SEQ ID NO: 13675 - DNA, 20 bp, Artificial Sequence
  chemically synthesized
acaagagtgaggttgctcat

SEQ ID NO: 13676 - DNA, 20 bp, Artificial Sequence
  chemically synthesized
tgaggttgctcatcggttta

SEQ ID NO: 13677 - DNA, 20 bp, Artificial Sequence
  chemically synthesized
tgctcatcggtttaaagatt

SEQ ID NO: 13678 - DNA, 20 bp, Artificial Sequence
  chemically synthesized
gctcatcggtttaaagattt

SEQ ID NO: 13679 - DNA, 20 bp, Artificial Sequence
  chemically synthesized
tcatcggtttaaagatttgg

SEQ ID NO: 13680 - DNA, 20 bp, Artificial Sequence
  chemically synthesized
tcggtttaaagatttgggag

SEQ ID NO: 13681 - DNA, 20 bp, Artificial Sequence
  chemically synthesized
tttgggagaagaaaatttca

SEQ ID NO: 13682 - DNA, 20 bp, Artificial Sequence
  chemically synthesized
tcccaaatctttaaaccgat

SEQ ID NO: 13683 - DNA, 20 bp, Artificial Sequence
  chemically synthesized
tgagcaacctcactcttgtc

SEQ ID NO: 13684 - DNA, 20 bp, Artificial Sequence
  chemically synthesized
gagcaacctcactcttgtct

SEQ ID NO: 13685 - DNA, 20 bp, Artificial Sequence
  chemically synthesized
aacctcactcttgtctgggc

SEQ ID NO: 13686 - DNA, 20 bp, Artificial Sequence
  chemically synthesized
acctcactcttgtctgggca

SEQ ID NO: 13687 - DNA, 20 bp, Artificial Sequence
  chemically synthesized
cctcactcttgtctgggcaa

SEQ ID NO: 13688 - DNA, 20 bp, Artificial Sequence
  chemically synthesized
cactcttgtctgggcaaggg

SEQ ID NO: 13689 - DNA, 20 bp, Artificial Sequence
  chemically synthesized
ctgggcaagggaagaaaaaa

SEQ ID NO: 13690 - DNA, 20 bp, Artificial Sequence
  chemically synthesized
tgggcaagggaagaaaaaaa

SEQ ID NO: 13691 - DNA, 20 bp, Artificial Sequence
  chemically synthesized
aaaaggattgttaaatactg

SEQ ID NO: 13692 - DNA, 20 bp, Artificial Sequence
  chemically synthesized
tgttaaatactgaagaaaac

SEQ ID NO: 13693 - DNA, 20 bp, Artificial Sequence
  chemically synthesized
taaatactgaagaaaacaag

SEQ ID NO: 13694 - DNA, 20 bp, Artificial Sequence
  chemically synthesized
atatttctttccatttgact

SEQ ID NO: 13695 - DNA, 20 bp, Artificial Sequence
  chemically synthesized
atgcatttgtttcaaaatat

SEQ ID NO: 13696 - DNA, 20 bp, Artificial Sequence
  chemically synthesized
tgcatttgtttcaaaatatt

SEQ ID NO: 13697 - DNA, 20 bp, Artificial Sequence
  chemically synthesized
atattgggctctgattccta

SEQ ID NO: 13698 - DNA, 20 bp, Artificial Sequence
  chemically synthesized
ctgattcctacagaaaaact

SEQ ID NO: 13699 - DNA, 20 bp, Artificial Sequence
  chemically synthesized
tgattcctacagaaaaactc

SEQ ID NO: 13700 - DNA, 20 bp, Artificial Sequence
  chemically synthesized
ttatttcttctgcctttaaa

SEQ ID NO: 13701 - DNA, 20 bp, Artificial Sequence
  chemically synthesized
tttcttctgcctttaaacag

SEQ ID NO: 13702 - DNA, 20 bp, Artificial Sequence
  chemically synthesized
agaagaataattcaattacc

SEQ ID NO: 13703 - DNA, 20 bp, Artificial Sequence
  chemically synthesized
taaaaattattaaatattta

SEQ ID NO: 13704 - DNA, 20 bp, Artificial Sequence
  chemically synthesized
tatagccttatattcaaact

SEQ ID NO: 13705 - DNA, 20 bp, Artificial Sequence
  chemically synthesized
gataatatctaatactcttt

SEQ ID NO: 13706 - DNA, 20 bp, Artificial Sequence
  chemically synthesized
actcttttagtgtctatcaa

SEQ ID NO: 13707 - DNA, 20 bp, Artificial Sequence
  chemically synthesized
agtgtctatcaacagcaacc

SEQ ID NO: 13708 - DNA, 20 bp, Artificial Sequence
  chemically synthesized
gtctatcaacagcaaccaag

SEQ ID NO: 13709 - DNA, 20 bp, Artificial Sequence
  chemically synthesized
atcaacagcaaccaagaaga

SEQ ID NO: 13710 - DNA, 20 bp, Artificial Sequence
  chemically synthesized
atgaaaataaatataaatac

SEQ ID NO: 13711 - DNA, 20 bp, Artificial Sequence
  chemically synthesized
taaatacaagttctatttat

SEQ ID NO: 13712 - DNA, 20 bp, Artificial Sequence
  chemically synthesized
agttctatttatgagatcaa

SEQ ID NO: 13713 - DNA, 20 bp, Artificial Sequence
  chemically synthesized
tatttatgagatcaacagca

SEQ ID NO: 13714 - DNA, 20 bp, Artificial Sequence
  chemically synthesized
atttatgagatcaacagcac

SEQ ID NO: 13715 - DNA, 20 bp, Artificial Sequence
  chemically synthesized
gatcaacagcacaggttttg

SEQ ID NO: 13716 - DNA, 20 bp, Artificial Sequence
  chemically synthesized
ggttttgtggtttttaaata

SEQ ID NO: 13717 - DNA, 20 bp, Artificial Sequence
  chemically synthesized
tgtggtttttaaataaagca

SEQ ID NO: 13718 - DNA, 20 bp, Artificial Sequence
  chemically synthesized
ttaaataaagcatagtgcaa

SEQ ID NO: 13719 - DNA, 20 bp, Artificial Sequence
  chemically synthesized
ataaagcatagtgcaatgga

SEQ ID NO: 13720 - DNA, 20 bp, Artificial Sequence
  chemically synthesized
taaagcatagtgcaatggat

SEQ ID NO: 13721 - DNA, 20 bp, Artificial Sequence
  chemically synthesized
tagtgcaatggataggtctt

SEQ ID NO: 13722 - DNA, 20 bp, Artificial Sequence
  chemically synthesized
agtgcaatggataggtcttt

SEQ ID NO: 13723 - DNA, 20 bp, Artificial Sequence
  chemically synthesized
caatggataggtctttggga

SEQ ID NO: 13724 - DNA, 20 bp, Artificial Sequence
  chemically synthesized
atcttcaaccctattctgtg

SEQ ID NO: 13725 - DNA, 20 bp, Artificial Sequence
  chemically synthesized
aaccctattctgtgaagttt

SEQ ID NO: 13726 - DNA, 20 bp, Artificial Sequence
  chemically synthesized
tgtgaagtttcagtcactct

SEQ ID NO: 13727 - DNA, 20 bp, Artificial Sequence
  chemically synthesized
aagttactttgcactttcct

SEQ ID NO: 13728 - DNA, 20 bp, Artificial Sequence
  chemically synthesized
gcactttccttagtgcgcaa

SEQ ID NO: 13729 - DNA, 20 bp, Artificial Sequence
  chemically synthesized
tagtgcgcaaaagaaaatta

SEQ ID NO: 13730 - DNA, 20 bp, Artificial Sequence
  chemically synthesized
gacctttttttttttttacc

SEQ ID NO: 13731 - DNA, 20 bp, Artificial Sequence
  chemically synthesized
acctttttttttttttacct

SEQ ID NO: 13732 - DNA, 20 bp, Artificial Sequence
  chemically synthesized
gatgtttgaattttattaat

SEQ ID NO: 13733 - DNA, 20 bp, Artificial Sequence
  chemically synthesized
tattaataagataaccttgt

SEQ ID NO: 13734 - DNA, 20 bp, Artificial Sequence
  chemically synthesized
tacaaaatactatgccattt

SEQ ID NO: 13735 - DNA, 20 bp, Artificial Sequence
  chemically synthesized
aatgccaaaataattcttta

SEQ ID NO: 13736 - DNA, 20 bp, Artificial Sequence
  chemically synthesized
aaaataattctttaaagatg

SEQ ID NO: 13737 - DNA, 20 bp, Artificial Sequence
  chemically synthesized
aataattctttaaagatgca

SEQ ID NO: 13738 - DNA, 20 bp, Artificial Sequence
  chemically synthesized
ttactaaaactttattttac

SEQ ID NO: 13739 - DNA, 20 bp, Artificial Sequence
  chemically synthesized
tactaaaactttattttact

SEQ ID NO: 13740 - DNA, 20 bp, Artificial Sequence
  chemically synthesized
actttattttactgggaaaa

SEQ ID NO: 13741 - DNA, 20 bp, Artificial Sequence
  chemically synthesized
ttactgggaaaatagaataa

SEQ ID NO: 13742 - DNA, 20 bp, Artificial Sequence
  chemically synthesized
atagaataaaagttgaacaa

SEQ ID NO: 13743 - DNA, 20 bp, Artificial Sequence
  chemically synthesized
aaagttgaacaatagaaaaa

SEQ ID NO: 13744 - DNA, 20 bp, Artificial Sequence
  chemically synthesized
atctcgacgaaacacacccc

SEQ ID NO: 13745 - DNA, 20 bp, Artificial Sequence
  chemically synthesized
acgaaacacacccctggaat

SEQ ID NO: 13746 - DNA, 20 bp, Artificial Sequence
  chemically synthesized
acacacccctggaataagcc

SEQ ID NO: 13747 - DNA, 20 bp, Artificial Sequence
  chemically synthesized
ccctggaataagccgagcta

SEQ ID NO: 13748 - DNA, 20 bp, Artificial Sequence
  chemically synthesized
ctggaataagccgagctaaa

SEQ ID NO: 13749 - DNA, 20 bp, Artificial Sequence
  chemically synthesized
taagccgagctaaagagaaa

SEQ ID NO: 13750 - DNA, 20 bp, Artificial Sequence
  chemically synthesized
gccgagctaaagagaaaaag

SEQ ID NO: 13751 - DNA, 20 bp, Artificial Sequence
  chemically synthesized
ccgagctaaagagaaaaaga

SEQ ID NO: 13752 - DNA, 20 bp, Artificial Sequence
  chemically synthesized
cgagctaaagagaaaaagaa

SEQ ID NO: 13753 - DNA, 20 bp, Artificial Sequence
  chemically synthesized
agagaaaaagaagggaaata

SEQ ID NO: 13754 - DNA, 20 bp, Artificial Sequence
  chemically synthesized
gagaaaaagaagggaaataa

SEQ ID NO: 13755 - DNA, 20 bp, Artificial Sequence
  chemically synthesized
ttacccacttcattgtgcca

SEQ ID NO: 13756 - DNA, 20 bp, Artificial Sequence
  chemically synthesized
tacccacttcattgtgccaa

SEQ ID NO: 13757 - DNA, 20 bp, Artificial Sequence
  chemically synthesized
ttcattgtgccaaaggcgtg

SEQ ID NO: 13758 - DNA, 20 bp, Artificial Sequence
  chemically synthesized
tcattgtgccaaaggcgtgt

SEQ ID NO: 13759 - DNA, 20 bp, Artificial Sequence
  chemically synthesized
cattgtgccaaaggcgtgtg

SEQ ID NO: 13760 - DNA, 20 bp, Artificial Sequence
  chemically synthesized
ccaaaggcgtgtggggttga

SEQ ID NO: 13761 - DNA, 20 bp, Artificial Sequence
  chemically synthesized
aaggcgtgtggggttgacag

SEQ ID NO: 13762 - DNA, 20 bp, Artificial Sequence
  chemically synthesized
ggcgtgtggggttgacagaa

SEQ ID NO: 13763 - DNA, 20 bp, Artificial Sequence
  chemically synthesized
gtggggttgacagaagagaa

SEQ ID NO: 13764 - DNA, 20 bp, Artificial Sequence
  chemically synthesized
ggttgacagaagagaaaagc

SEQ ID NO: 13765 - DNA, 20 bp, Artificial Sequence
  chemically synthesized
gttgacagaagagaaaagct

SEQ ID NO: 13766 - DNA, 20 bp, Artificial Sequence
  chemically synthesized
aagagaaaagctaggacaaa

SEQ ID NO: 13767 - DNA, 20 bp, Artificial Sequence
  chemically synthesized
gagaaaagctaggacaaacg

SEQ ID NO: 13768 - DNA, 20 bp, Artificial Sequence
  chemically synthesized
agaaaagctaggacaaacgg

SEQ ID NO: 13769 - DNA, 20 bp, Artificial Sequence
  chemically synthesized
gaaaagctaggacaaacgga

SEQ ID NO: 13770 - DNA, 20 bp, Artificial Sequence
  chemically synthesized
taggacaaacggagggaaat

SEQ ID NO: 13771 - DNA, 20 bp, Artificial Sequence
  chemically synthesized
cacgcctttggcacaatgaa

SEQ ID NO: 13772 - DNA, 20 bp, Artificial Sequence
  chemically synthesized
tctttagctcggcttattcc

SEQ ID NO: 13773 - DNA, 20 bp, Artificial Sequence
  chemically synthesized
tagtaaactctgcatcttta

SEQ ID NO: 13774 - DNA, 20 bp, Artificial Sequence
  chemically synthesized
aggtaaaaaaaaaaaaaggt

SEQ ID NO: 13775 - DNA, 20 bp, Artificial Sequence
  chemically synthesized
aaggaaagtgcaaagtaact

SEQ ID NO: 13776 - DNA, 20 bp, Artificial Sequence
  chemically synthesized
ttagagtgactgaaacttca

SEQ ID NO: 13777 - DNA, 20 bp, Artificial Sequence
  chemically synthesized
gtgactgaaacttcacagaa

SEQ ID NO: 13778 - DNA, 20 bp, Artificial Sequence
  chemically synthesized
tcacagaatagggttgaaga

SEQ ID NO: 13779 - DNA, 20 bp, Artificial Sequence
  chemically synthesized
ttgctgttgatagacactaa

SEQ ID NO: 13780 - DNA, 20 bp, Artificial Sequence
  chemically synthesized
gtattagatattatctaagt

SEQ ID NO: 13781 - DNA, 20 bp, Artificial Sequence
  chemically synthesized
taaaatagtattcttggtaa

SEQ ID NO: 13782 - DNA, 20 bp, Artificial Sequence
  chemically synthesized
agaaataattgaacatcatc

SEQ ID NO: 13783 - DNA, 20 bp, Artificial Sequence
  chemically synthesized
atcatcctgagtttttctgt

SEQ ID NO: 13784 - DNA, 20 bp, Artificial Sequence
  chemically synthesized
ttttcttcccttgcccagac

SEQ ID NO: 13785 - DNA, 20 bp, Artificial Sequence
  chemically synthesized
ctgggcaagggaagaaaaaa

SEQ ID NO: 13786 - DNA, 20 bp, Artificial Sequence
  chemically synthesized
ctgattcctacagaaaaact

SEQ ID NO: 13787 - DNA, 20 bp, Artificial Sequence
  chemically synthesized
tttcttctgcctttaaacag

SEQ ID NO: 13788 - DNA, 20 bp, Artificial Sequence
  chemically synthesized
agaagaataattcaattacc

SEQ ID NO: 13789 - DNA, 20 bp, Artificial Sequence
  chemically synthesized
tttaaataaagcatagtgca

SEQ ID NO: 13790 - DNA, 20 bp, Artificial Sequence
  chemically synthesized
tagtgcaatggataggtctt

SEQ ID NO: 13791 - DNA, 20 bp, Artificial Sequence
  chemically synthesized
gataggtctttgggatagtt

SEQ ID NO: 13792 - DNA, 20 bp, Artificial Sequence
  chemically synthesized
gacctttttttttttttacc

SEQ ID NO: 13793 - DNA, 20 bp, Artificial Sequence
  chemically synthesized
tttttttttacctaggatgt

SEQ ID NO: 13794 - DNA, 20 bp, Artificial Sequence
  chemically synthesized
aaaataattctttaaagatg

SEQ ID NO: 13795 - DNA, 20 bp, Artificial Sequence
  chemically synthesized
actttattttactgggaaaa

SEQ ID NO: 13796 - DNA, 20 bp, Artificial Sequence
  chemically synthesized
aaaagttgaacaatagaaaa

SEQ ID NO: 13797 - DNA, 20 bp, Artificial Sequence
  chemically synthesized
atctcgacgaaacacacccc

SEQ ID NO: 13798 - DNA, 20 bp, Artificial Sequence
  chemically synthesized
ttcattgtgccaaaggcgtg

SEQ ID NO: 13799 - DNA, 20 bp, Artificial Sequence
  chemically synthesized
gtgtttcgtcgagatgcacg

SEQ ID NO: 13800 - DNA, 20 bp, Artificial Sequence
  chemically synthesized
ttagtaaactctgcatcttt

SEQ ID NO: 13801 - DNA, 20 bp, Artificial Sequence
  chemically synthesized
taggtaaaaaaaaaaaaagg

SEQ ID NO: 13802 - DNA, 20 bp, Artificial Sequence
  chemically synthesized
cttagagtgactgaaacttc

SEQ ID NO: 13803 - DNA, 20 bp, Artificial Sequence
  chemically synthesized
tattcttctgtttaaaggca

SEQ ID NO: 13804 - DNA, 20 bp, Artificial Sequence
  chemically synthesized
gcataatctaagtcaaatgg

SEQ ID NO: 13805 - DNA, 20 bp, Artificial Sequence
  chemically synthesized
atcggtttaaagatttggga

SEQ ID NO: 13806 - DNA, 20 bp, Artificial Sequence
  chemically synthesized
tcactcttgtctgggcaagg

SEQ ID NO: 13807 - DNA, 20 bp, Artificial Sequence
  chemically synthesized
aaaaaggattgttaaatact

SEQ ID NO: 13808 - DNA, 20 bp, Artificial Sequence
  chemically synthesized
aatattgggctctgattcct

SEQ ID NO: 13809 - DNA, 20 bp, Artificial Sequence
  chemically synthesized
atttcttctgcctttaaaca

SEQ ID NO: 13810 - DNA, 20 bp, Artificial Sequence
  chemically synthesized
cagaagaataattcaattac

SEQ ID NO: 13811 - DNA, 20 bp, Artificial Sequence
  chemically synthesized
tgcactttccttagtgcgca

SEQ ID NO: 13812 - DNA, 20 bp, Artificial Sequence
  chemically synthesized
atacaaaatactatgccatt

SEQ ID NO: 13813 - DNA, 20 bp, Artificial Sequence
  chemically synthesized
aactttattttactgggaaa

SEQ ID NO: 13814 - DNA, 20 bp, Artificial Sequence
  chemically synthesized
aatagaataaaagttgaaca

SEQ ID NO: 13815 - DNA, 20 bp, Artificial Sequence
  chemically synthesized
cctggaataagccgagctaa

SEQ ID NO: 13816 - DNA, 20 bp, Artificial Sequence
  chemically synthesized
aggcgtgtggggttgacaga

SEQ ID NO: 13817 - DNA, 20 bp, Artificial Sequence
  chemically synthesized
cattgcactatgctttattt

SEQ ID NO: 13818 - DNA, 20 bp, Artificial Sequence
  chemically synthesized
tatgctttatttaaaaacca

SEQ ID NO: 13819 - DNA, 20 bp, Artificial Sequence
  chemically synthesized
aaggattgttaaatactgaa

SEQ ID NO: 13820 - DNA, 20 bp, Artificial Sequence
  chemically synthesized
ttgggctctgattcctacag

SEQ ID NO: 13821 - DNA, 20 bp, Artificial Sequence
  chemically synthesized
tttaaagatgcagagtttac

SEQ ID NO: 13822 - DNA, 20 bp, Artificial Sequence
  chemically synthesized
gtatattagtgctaatttcc

SEQ ID NO: 13823 - DNA, 20 bp, Artificial Sequence
  chemically synthesized
gctaatttccctccgtttgt

SEQ ID NO: 13824 - DNA, 20 bp, Artificial Sequence
  chemically synthesized
tcccttctttttctctttag

SEQ ID NO: 13825 - DNA, 20 bp, Artificial Sequence
  chemically synthesized
tagctcggcttattccaggg

SEQ ID NO: 13826 - DNA, 20 bp, Artificial Sequence
  chemically synthesized
attctattttcccagtaaaa

SEQ ID NO: 13827 - DNA, 20 bp, Artificial Sequence
  chemically synthesized
taaaaaaaaaaaaaggtcag

SEQ ID NO: 13828 - DNA, 20 bp, Artificial Sequence
  chemically synthesized
gaaacttcacagaatagggt

SEQ ID NO: 13829 - DNA, 20 bp, Artificial Sequence
  chemically synthesized
ccaaagacctatccattgca

SEQ ID NO: 13830 - DNA, 20 bp, Artificial Sequence
  chemically synthesized
aaaagagtattagatattat

SEQ ID NO: 13831 - DNA, 20 bp, Artificial Sequence
  chemically synthesized
tcttggtaattgaattattc

SEQ ID NO: 13832 - DNA, 20 bp, Artificial Sequence
  chemically synthesized
agaaataattgaacatcatc

SEQ ID NO: 13833 - DNA, 20 bp, Artificial Sequence
  chemically synthesized
taaaaagtaacattattact

SEQ ID NO: 13834 - DNA, 20 bp, Artificial Sequence
  chemically synthesized
agacaagagtgaggttgctc

SEQ ID NO: 13835 - DNA, 20 bp, Artificial Sequence
  chemically synthesized
agtgaggttgctcatcggtt

SEQ ID NO: 13836 - DNA, 20 bp, Artificial Sequence
  chemically synthesized
tctgggcaagggaagaaaaa

SEQ ID NO: 13837 - DNA, 20 bp, Artificial Sequence
  chemically synthesized
ttatatttctttccatttga

SEQ ID NO: 13838 - DNA, 20 bp, Artificial Sequence
  chemically synthesized
ccatttgacttagattatgc

SEQ ID NO: 13839 - DNA, 20 bp, Artificial Sequence
  chemically synthesized
atttgtttcaaaatattggg

SEQ ID NO: 13840 - DNA, 20 bp, Artificial Sequence
  chemically synthesized
ctatttatgagatcaacagc

SEQ ID NO: 13841 - DNA, 20 bp, Artificial Sequence
  chemically synthesized
gagatcaacagcacaggttt

SEQ ID NO: 13842 - DNA, 20 bp, Artificial Sequence
  chemically synthesized
caatcttcaaccctattctg

SEQ ID NO: 13843 - DNA, 20 bp, Artificial Sequence
  chemically synthesized
cctttttttttttttaccta

SEQ ID NO: 13844 - DNA, 20 bp, Artificial Sequence
  chemically synthesized
aaaataattctttaaagatg

SEQ ID NO: 13845 - DNA, 20 bp, Artificial Sequence
  chemically synthesized
taaaagttgaacaatagaaa

SEQ ID NO: 13846 - DNA, 22 bp, Artificial Sequence
  chemically synthesized
gtgctaatttccctccgtttgt

SEQ ID NO: 13847 - DNA, 22 bp, Artificial Sequence
  chemically synthesized
atttccctccgtttgtcctagc

SEQ ID NO: 13848 - DNA, 22 bp, Artificial Sequence
  chemically synthesized
ccctccgtttgtcctagctttt

SEQ ID NO: 13849 - DNA, 22 bp, Artificial Sequence
  chemically synthesized
cctccgtttgtcctagcttttc

SEQ ID NO: 13850 - DNA, 22 bp, Artificial Sequence
  chemically synthesized
cgtttgtcctagcttttctctt

SEQ ID NO: 13851 - DNA, 22 bp, Artificial Sequence
  chemically synthesized
gtcctagcttttctcttctgtc

SEQ ID NO: 13852 - DNA, 22 bp, Artificial Sequence
  chemically synthesized
tcctagcttttctcttctgtca

SEQ ID NO: 13853 - DNA, 22 bp, Artificial Sequence
  chemically synthesized
gcttttctcttctgtcaacccc

SEQ ID NO: 13854 - DNA, 22 bp, Artificial Sequence
  chemically synthesized
ttctcttctgtcaaccccacac

SEQ ID NO: 13855 - DNA, 22 bp, Artificial Sequence
  chemically synthesized
tctcttctgtcaaccccacacg

SEQ ID NO: 13856 - DNA, 22 bp, Artificial Sequence
  chemically synthesized
ctcttctgtcaaccccacacgc

SEQ ID NO: 13857 - DNA, 22 bp, Artificial Sequence
  chemically synthesized
tcttctgtcaaccccacacgcc

SEQ ID NO: 13858 - DNA, 22 bp, Artificial Sequence
  chemically synthesized
ttctgtcaaccccacacgcctt

SEQ ID NO: 13859 - DNA, 22 bp, Artificial Sequence
  chemically synthesized
ctgtcaaccccacacgcctttg

SEQ ID NO: 13860 - DNA, 22 bp, Artificial Sequence
  chemically synthesized
tgtcaaccccacacgcctttgg

SEQ ID NO: 13861 - DNA, 22 bp, Artificial Sequence
  chemically synthesized
tcaaccccacacgcctttggca

SEQ ID NO: 13862 - DNA, 22 bp, Artificial Sequence
  chemically synthesized
tggcacaatgaagtgggtaacc

SEQ ID NO: 13863 - DNA, 22 bp, Artificial Sequence
  chemically synthesized
ggcacaatgaagtgggtaacct

SEQ ID NO: 13864 - DNA, 22 bp, Artificial Sequence
  chemically synthesized
gcacaatgaagtgggtaacctt

SEQ ID NO: 13865 - DNA, 22 bp, Artificial Sequence
  chemically synthesized
tatttcccttctttttctcttt

SEQ ID NO: 13866 - DNA, 22 bp, Artificial Sequence
  chemically synthesized
atttcccttctttttctcttta

SEQ ID NO: 13867 - DNA, 22 bp, Artificial Sequence
  chemically synthesized
tttcccttctttttctctttag

SEQ ID NO: 13868 - DNA, 22 bp, Artificial Sequence
  chemically synthesized
cccttctttttctctttagctc

SEQ ID NO: 13869 - DNA, 22 bp, Artificial Sequence
  chemically synthesized
ccttctttttctctttagctcg

SEQ ID NO: 13870 - DNA, 22 bp, Artificial Sequence
  chemically synthesized
ctttttctctttagctcggctt

SEQ ID NO: 13871 - DNA, 22 bp, Artificial Sequence
  chemically synthesized
tttttctctttagctcggctta

SEQ ID NO: 13872 - DNA, 22 bp, Artificial Sequence
  chemically synthesized
tttctctttagctcggcttatt

SEQ ID NO: 13873 - DNA, 22 bp, Artificial Sequence
  chemically synthesized
ttctctttagctcggcttattc

SEQ ID NO: 13874 - DNA, 22 bp, Artificial Sequence
  chemically synthesized
tctctttagctcggcttattcc

SEQ ID NO: 13875 - DNA, 22 bp, Artificial Sequence
  chemically synthesized
ctctttagctcggcttattcca

SEQ ID NO: 13876 - DNA, 22 bp, Artificial Sequence
  chemically synthesized
tctttagctcggcttattccag

SEQ ID NO: 13877 - DNA, 22 bp, Artificial Sequence
  chemically synthesized
tttagctcggcttattccaggg

SEQ ID NO: 13878 - DNA, 22 bp, Artificial Sequence
  chemically synthesized
tagctcggcttattccaggggt

SEQ ID NO: 13879 - DNA, 22 bp, Artificial Sequence
  chemically synthesized
agctcggcttattccaggggtg

SEQ ID NO: 13880 - DNA, 22 bp, Artificial Sequence
  chemically synthesized
gctcggcttattccaggggtgt

SEQ ID NO: 13881 - DNA, 22 bp, Artificial Sequence
  chemically synthesized
ggcttattccaggggtgtgttt

SEQ ID NO: 13882 - DNA, 22 bp, Artificial Sequence
  chemically synthesized
attccaggggtgtgtttcgtcg

SEQ ID NO: 13883 - DNA, 22 bp, Artificial Sequence
  chemically synthesized
ttccaggggtgtgtttcgtcga

SEQ ID NO: 13884 - DNA, 22 bp, Artificial Sequence
  chemically synthesized
caggggtgtgtttcgtcgagat

SEQ ID NO: 13885 - DNA, 22 bp, Artificial Sequence
  chemically synthesized
cgtcgagatgcacgtaagaaat

SEQ ID NO: 13886 - DNA, 22 bp, Artificial Sequence
  chemically synthesized
gtcgagatgcacgtaagaaatc

SEQ ID NO: 13887 - DNA, 22 bp, Artificial Sequence
  chemically synthesized
ttctattgttcaacttttattc

SEQ ID NO: 13888 - DNA, 22 bp, Artificial Sequence
  chemically synthesized
tctattgttcaacttttattct

SEQ ID NO: 13889 - DNA, 22 bp, Artificial Sequence
  chemically synthesized
ctattgttcaacttttattcta

SEQ ID NO: 13890 - DNA, 22 bp, Artificial Sequence
  chemically synthesized
tattgttcaacttttattctat

SEQ ID NO: 13891 - DNA, 22 bp, Artificial Sequence
  chemically synthesized
ttgttcaacttttattctattt

SEQ ID NO: 13892 - DNA, 22 bp, Artificial Sequence
  chemically synthesized
ttcaacttttattctattttcc

SEQ ID NO: 13893 - DNA, 22 bp, Artificial Sequence
  chemically synthesized
aacttttattctattttcccag

SEQ ID NO: 13894 - DNA, 22 bp, Artificial Sequence
  chemically synthesized
ttattctattttcccagtaaaa

SEQ ID NO: 13895 - DNA, 22 bp, Artificial Sequence
  chemically synthesized
tattctattttcccagtaaaat

SEQ ID NO: 13896 - DNA, 22 bp, Artificial Sequence
  chemically synthesized
attctattttcccagtaaaata

SEQ ID NO: 13897 - DNA, 22 bp, Artificial Sequence
  chemically synthesized
ttctattttcccagtaaaataa

SEQ ID NO: 13898 - DNA, 22 bp, Artificial Sequence
  chemically synthesized
tattttcccagtaaaataaagt

SEQ ID NO: 13899 - DNA, 22 bp, Artificial Sequence
  chemically synthesized
ttttcccagtaaaataaagttt

SEQ ID NO: 13900 - DNA, 22 bp, Artificial Sequence
  chemically synthesized
tcccagtaaaataaagttttag

SEQ ID NO: 13901 - DNA, 22 bp, Artificial Sequence
  chemically synthesized
cccagtaaaataaagttttagt

SEQ ID NO: 13902 - DNA, 22 bp, Artificial Sequence
  chemically synthesized
ccagtaaaataaagttttagta

SEQ ID NO: 13903 - DNA, 22 bp, Artificial Sequence
  chemically synthesized
tagtaaactctgcatctttaaa

SEQ ID NO: 13904 - DNA, 22 bp, Artificial Sequence
  chemically synthesized
agtaaactctgcatctttaaag

SEQ ID NO: 13905 - DNA, 22 bp, Artificial Sequence
  chemically synthesized
gtaaactctgcatctttaaaga

SEQ ID NO: 13906 - DNA, 22 bp, Artificial Sequence
  chemically synthesized
tgcatctttaaagaattatttt

SEQ ID NO: 13907 - DNA, 22 bp, Artificial Sequence
  chemically synthesized
catctttaaagaattattttgg

SEQ ID NO: 13908 - DNA, 22 bp, Artificial Sequence
  chemically synthesized
taaagaattattttggcattta

SEQ ID NO: 13909 - DNA, 22 bp, Artificial Sequence
  chemically synthesized
aaagaattattttggcatttat

SEQ ID NO: 13910 - DNA, 22 bp, Artificial Sequence
  chemically synthesized
aagaattattttggcatttatt

SEQ ID NO: 13911 - DNA, 22 bp, Artificial Sequence
  chemically synthesized
ttttggcatttatttctaaaat

SEQ ID NO: 13912 - DNA, 22 bp, Artificial Sequence
  chemically synthesized
tggcatttatttctaaaatggc

SEQ ID NO: 13913 - DNA, 22 bp, Artificial Sequence
  chemically synthesized
ggcatttatttctaaaatggca

SEQ ID NO: 13914 - DNA, 22 bp, Artificial Sequence
  chemically synthesized
gcatttatttctaaaatggcat

SEQ ID NO: 13915 - DNA, 22 bp, Artificial Sequence
  chemically synthesized
atttctaaaatggcatagtatt

SEQ ID NO: 13916 - DNA, 22 bp, Artificial Sequence
  chemically synthesized
tttctaaaatggcatagtattt

SEQ ID NO: 13917 - DNA, 22 bp, Artificial Sequence
  chemically synthesized
ctaaaatggcatagtattttgt

SEQ ID NO: 13918 - DNA, 22 bp, Artificial Sequence
  chemically synthesized
taaaatggcatagtattttgta

SEQ ID NO: 13919 - DNA, 22 bp, Artificial Sequence
  chemically synthesized
aaatggcatagtattttgtatt

SEQ ID NO: 13920 - DNA, 22 bp, Artificial Sequence
  chemically synthesized
tgtatttgtgaagtcttacaag

SEQ ID NO: 13921 - DNA, 22 bp, Artificial Sequence
  chemically synthesized
gtatttgtgaagtcttacaagg

SEQ ID NO: 13922 - DNA, 22 bp, Artificial Sequence
  chemically synthesized
tatttgtgaagtcttacaaggt

SEQ ID NO: 13923 - DNA, 22 bp, Artificial Sequence
  chemically synthesized
gtgaagtcttacaaggttatct

SEQ ID NO: 13924 - DNA, 22 bp, Artificial Sequence
  chemically synthesized
tgaagtcttacaaggttatctt

SEQ ID NO: 13925 - DNA, 22 bp, Artificial Sequence
  chemically synthesized
acaaggttatcttattaataaa

SEQ ID NO: 13926 - DNA, 22 bp, Artificial Sequence
  chemically synthesized
caaggttatcttattaataaaa

SEQ ID NO: 13927 - DNA, 22 bp, Artificial Sequence
  chemically synthesized
tcttattaataaaattcaaaca

SEQ ID NO: 13928 - DNA, 22 bp, Artificial Sequence
  chemically synthesized
attaataaaattcaaacatcct

SEQ ID NO: 13929 - DNA, 22 bp, Artificial Sequence
  chemically synthesized
ttaataaaattcaaacatccta

SEQ ID NO: 13930 - DNA, 22 bp, Artificial Sequence
  chemically synthesized
ataaaattcaaacatcctaggt

SEQ ID NO: 13931 - DNA, 22 bp, Artificial Sequence
  chemically synthesized
aaacatcctaggtaaaaaaaaa

SEQ ID NO: 13932 - DNA, 22 bp, Artificial Sequence
  chemically synthesized
ggtaaaaaaaaaaaaaggtcag

SEQ ID NO: 13933 - DNA, 22 bp, Artificial Sequence
  chemically synthesized
tttagtgactgtaattttcttt

SEQ ID NO: 13934 - DNA, 22 bp, Artificial Sequence
  chemically synthesized
agtgactgtaattttcttttgc

SEQ ID NO: 13935 - DNA, 22 bp, Artificial Sequence
  chemically synthesized
gtgactgtaattttcttttgcg

SEQ ID NO: 13936 - DNA, 22 bp, Artificial Sequence
  chemically synthesized
taattttcttttgcgcactaag

SEQ ID NO: 13937 - DNA, 22 bp, Artificial Sequence
  chemically synthesized
tcttttgcgcactaaggaaagt

SEQ ID NO: 13938 - DNA, 22 bp, Artificial Sequence
  chemically synthesized
cttttgcgcactaaggaaagtg

SEQ ID NO: 13939 - DNA, 22 bp, Artificial Sequence
  chemically synthesized
ttttgcgcactaaggaaagtgc

SEQ ID NO: 13940 - DNA, 22 bp, Artificial Sequence
  chemically synthesized
ttgcgcactaaggaaagtgcaa

SEQ ID NO: 13941 - DNA, 22 bp, Artificial Sequence
  chemically synthesized
tgcgcactaaggaaagtgcaaa

SEQ ID NO: 13942 - DNA, 22 bp, Artificial Sequence
  chemically synthesized
gcgcactaaggaaagtgcaaag

SEQ ID NO: 13943 - DNA, 22 bp, Artificial Sequence
  chemically synthesized
cgcactaaggaaagtgcaaagt

SEQ ID NO: 13944 - DNA, 22 bp, Artificial Sequence
  chemically synthesized
aggaaagtgcaaagtaacttag

SEQ ID NO: 13945 - DNA, 22 bp, Artificial Sequence
  chemically synthesized
agagtgactgaaacttcacaga

SEQ ID NO: 13946 - DNA, 22 bp, Artificial Sequence
  chemically synthesized
gagtgactgaaacttcacagaa

SEQ ID NO: 13947 - DNA, 22 bp, Artificial Sequence
  chemically synthesized
aaacttcacagaatagggttga

SEQ ID NO: 13948 - DNA, 22 bp, Artificial Sequence
  chemically synthesized
cacagaatagggttgaagattg

SEQ ID NO: 13949 - DNA, 22 bp, Artificial Sequence
  chemically synthesized
acagaatagggttgaagattga

SEQ ID NO: 13950 - DNA, 22 bp, Artificial Sequence
  chemically synthesized
aagattgaattcataactatcc

SEQ ID NO: 13951 - DNA, 22 bp, Artificial Sequence
  chemically synthesized
aattcataactatcccaaagac

SEQ ID NO: 13952 - DNA, 22 bp, Artificial Sequence
  chemically synthesized
ataactatcccaaagacctatc

SEQ ID NO: 13953 - DNA, 22 bp, Artificial Sequence
  chemically synthesized
tcccaaagacctatccattgca

SEQ ID NO: 13954 - DNA, 22 bp, Artificial Sequence
  chemically synthesized
tccattgcactatgctttattt

SEQ ID NO: 13955 - DNA, 22 bp, Artificial Sequence
  chemically synthesized
cactatgctttatttaaaaacc

SEQ ID NO: 13956 - DNA, 22 bp, Artificial Sequence
  chemically synthesized
tgctttatttaaaaaccacaaa

SEQ ID NO: 13957 - DNA, 22 bp, Artificial Sequence
  chemically synthesized
tatttaaaaaccacaaaacctg

SEQ ID NO: 13958 - DNA, 22 bp, Artificial Sequence
  chemically synthesized
atttaaaaaccacaaaacctgt

SEQ ID NO: 13959 - DNA, 22 bp, Artificial Sequence
  chemically synthesized
tttaaaaaccacaaaacctgtg

SEQ ID NO: 13960 - DNA, 22 bp, Artificial Sequence
  chemically synthesized
aaaaaccacaaaacctgtgctg

SEQ ID NO: 13961 - DNA, 22 bp, Artificial Sequence
  chemically synthesized
aaaaccacaaaacctgtgctgt

SEQ ID NO: 13962 - DNA, 22 bp, Artificial Sequence
  chemically synthesized
tgctgttgatctcataaataga

SEQ ID NO: 13963 - DNA, 22 bp, Artificial Sequence
  chemically synthesized
ttgatctcataaatagaacttg

SEQ ID NO: 13964 - DNA, 22 bp, Artificial Sequence
  chemically synthesized
atctcataaatagaacttgtat

SEQ ID NO: 13965 - DNA, 22 bp, Artificial Sequence
  chemically synthesized
ataaatagaacttgtatttata

SEQ ID NO: 13966 - DNA, 22 bp, Artificial Sequence
  chemically synthesized
gtatttatatttattttcattt

SEQ ID NO: 13967 - DNA, 22 bp, Artificial Sequence
  chemically synthesized
tatttatatttattttcatttt

SEQ ID NO: 13968 - DNA, 22 bp, Artificial Sequence
  chemically synthesized
atatttattttcattttagtct

SEQ ID NO: 13969 - DNA, 22 bp, Artificial Sequence
  chemically synthesized
tatttattttcattttagtctg

SEQ ID NO: 13970 - DNA, 22 bp, Artificial Sequence
  chemically synthesized
attttcattttagtctgtcttc

SEQ ID NO: 13971 - DNA, 22 bp, Artificial Sequence
  chemically synthesized
ttttcattttagtctgtcttct

SEQ ID NO: 13972 - DNA, 22 bp, Artificial Sequence
  chemically synthesized
tcattttagtctgtcttcttgg

SEQ ID NO: 13973 - DNA, 22 bp, Artificial Sequence
  chemically synthesized
cattttagtctgtcttcttggt

SEQ ID NO: 13974 - DNA, 22 bp, Artificial Sequence
  chemically synthesized
attttagtctgtcttcttggtt

SEQ ID NO: 13975 - DNA, 22 bp, Artificial Sequence
  chemically synthesized
tagtctgtcttcttggttgctg

SEQ ID NO: 13976 - DNA, 22 bp, Artificial Sequence
  chemically synthesized
agtctgtcttcttggttgctgt

SEQ ID NO: 13977 - DNA, 22 bp, Artificial Sequence
  chemically synthesized
gtctgtcttcttggttgctgtt

SEQ ID NO: 13978 - DNA, 22 bp, Artificial Sequence
  chemically synthesized
tcttcttggttgctgttgatag

SEQ ID NO: 13979 - DNA, 22 bp, Artificial Sequence
  chemically synthesized
cttggttgctgttgatagacac

SEQ ID NO: 13980 - DNA, 22 bp, Artificial Sequence
  chemically synthesized
ttggttgctgttgatagacact

SEQ ID NO: 13981 - DNA, 22 bp, Artificial Sequence
  chemically synthesized
ggttgctgttgatagacactaa

SEQ ID NO: 13982 - DNA, 22 bp, Artificial Sequence
  chemically synthesized
gttgctgttgatagacactaaa

SEQ ID NO: 13983 - DNA, 22 bp, Artificial Sequence
  chemically synthesized
ctgttgatagacactaaaagag

SEQ ID NO: 13984 - DNA, 22 bp, Artificial Sequence
  chemically synthesized
ttgatagacactaaaagagtat

SEQ ID NO: 13985 - DNA, 22 bp, Artificial Sequence
  chemically synthesized
atagacactaaaagagtattag

SEQ ID NO: 13986 - DNA, 22 bp, Artificial Sequence
  chemically synthesized
aaagagtattagatattatcta

SEQ ID NO: 13987 - DNA, 22 bp, Artificial Sequence
  chemically synthesized
gatattatctaagtttgaatat

SEQ ID NO: 13988 - DNA, 22 bp, Artificial Sequence
  chemically synthesized
tctaagtttgaatataaggcta

SEQ ID NO: 13989 - DNA, 22 bp, Artificial Sequence
  chemically synthesized
agtttgaatataaggctataaa

SEQ ID NO: 13990 - DNA, 22 bp, Artificial Sequence
  chemically synthesized
gaatataaggctataaatattt

SEQ ID NO: 13991 - DNA, 22 bp, Artificial Sequence
  chemically synthesized
aatataaggctataaatattta

SEQ ID NO: 13992 - DNA, 22 bp, Artificial Sequence
  chemically synthesized
taaatatttaataatttttaaa

SEQ ID NO: 13993 - DNA, 22 bp, Artificial Sequence
  chemically synthesized
aataatttttaaaatagtattc

SEQ ID NO: 13994 - DNA, 22 bp, Artificial Sequence
  chemically synthesized
ataatttttaaaatagtattct

SEQ ID NO: 13995 - DNA, 22 bp, Artificial Sequence
  chemically synthesized
ttaaaatagtattcttggtaat

SEQ ID NO: 13996 - DNA, 22 bp, Artificial Sequence
  chemically synthesized
taaaatagtattcttggtaatt

SEQ ID NO: 13997 - DNA, 22 bp, Artificial Sequence
  chemically synthesized
aaaatagtattcttggtaattg

SEQ ID NO: 13998 - DNA, 22 bp, Artificial Sequence
  chemically synthesized
aaatagtattcttggtaattga

SEQ ID NO: 13999 - DNA, 22 bp, Artificial Sequence
  chemically synthesized
ttggtaattgaattattcttct

SEQ ID NO: 14000 - DNA, 22 bp, Artificial Sequence
  chemically synthesized
ggtaattgaattattcttctgt

SEQ ID NO: 14001 - DNA, 22 bp, Artificial Sequence
  chemically synthesized
gtaattgaattattcttctgtt

SEQ ID NO: 14002 - DNA, 22 bp, Artificial Sequence
  chemically synthesized
aattattcttctgtttaaaggc

SEQ ID NO: 14003 - DNA, 22 bp, Artificial Sequence
  chemically synthesized
ttcttctgtttaaaggcagaag

SEQ ID NO: 14004 - DNA, 22 bp, Artificial Sequence
  chemically synthesized
ttctgtttaaaggcagaagaaa

SEQ ID NO: 14005 - DNA, 22 bp, Artificial Sequence
  chemically synthesized
ctgtttaaaggcagaagaaata

SEQ ID NO: 14006 - DNA, 22 bp, Artificial Sequence
  chemically synthesized
tgtttaaaggcagaagaaataa

SEQ ID NO: 14007 - DNA, 22 bp, Artificial Sequence
  chemically synthesized
tttaaaggcagaagaaataatt

SEQ ID NO: 14008 - DNA, 22 bp, Artificial Sequence
  chemically synthesized
aaaggcagaagaaataattgaa

SEQ ID NO: 14009 - DNA, 22 bp, Artificial Sequence
  chemically synthesized
aaggcagaagaaataattgaac

SEQ ID NO: 14010 - DNA, 22 bp, Artificial Sequence
  chemically synthesized
aacatcatcctgagtttttctg

SEQ ID NO: 14011 - DNA, 22 bp, Artificial Sequence
  chemically synthesized
agtttttctgtaggaatcagag

SEQ ID NO: 14012 - DNA, 22 bp, Artificial Sequence
  chemically synthesized
ttctgtaggaatcagagcccaa

SEQ ID NO: 14013 - DNA, 22 bp, Artificial Sequence
  chemically synthesized
tctgtaggaatcagagcccaat

SEQ ID NO: 14014 - DNA, 22 bp, Artificial Sequence
  chemically synthesized
ctgtaggaatcagagcccaata

SEQ ID NO: 14015 - DNA, 22 bp, Artificial Sequence
  chemically synthesized
tgtaggaatcagagcccaatat

SEQ ID NO: 14016 - DNA, 22 bp, Artificial Sequence
  chemically synthesized
taggaatcagagcccaatattt

SEQ ID NO: 14017 - DNA, 22 bp, Artificial Sequence
  chemically synthesized
tgaaacaaatgcataatctaag

SEQ ID NO: 14018 - DNA, 22 bp, Artificial Sequence
  chemically synthesized
gaaacaaatgcataatctaagt

SEQ ID NO: 14019 - DNA, 22 bp, Artificial Sequence
  chemically synthesized
aaacaaatgcataatctaagtc

SEQ ID NO: 14020 - DNA, 22 bp, Artificial Sequence
  chemically synthesized
agtcaaatggaaagaaatataa

SEQ ID NO: 14021 - DNA, 22 bp, Artificial Sequence
  chemically synthesized
ttacttcttgttttcttcagta

SEQ ID NO: 14022 - DNA, 22 bp, Artificial Sequence
  chemically synthesized
cttcttgttttcttcagtattt

SEQ ID NO: 14023 - DNA, 22 bp, Artificial Sequence
  chemically synthesized
cttgttttcttcagtatttaac

SEQ ID NO: 14024 - DNA, 22 bp, Artificial Sequence
  chemically synthesized
ttgttttcttcagtatttaaca

SEQ ID NO: 14025 - DNA, 22 bp, Artificial Sequence
  chemically synthesized
gttttcttcagtatttaacaat

SEQ ID NO: 14026 - DNA, 22 bp, Artificial Sequence
  chemically synthesized
ttttcttcagtatttaacaatc

SEQ ID NO: 14027 - DNA, 22 bp, Artificial Sequence
  chemically synthesized
tcttcagtatttaacaatcctt

SEQ ID NO: 14028 - DNA, 22 bp, Artificial Sequence
  chemically synthesized
cttcagtatttaacaatccttt

SEQ ID NO: 14029 - DNA, 22 bp, Artificial Sequence
  chemically synthesized
ttcagtatttaacaatcctttt

SEQ ID NO: 14030 - DNA, 22 bp, Artificial Sequence
  chemically synthesized
cagtatttaacaatcctttttt

SEQ ID NO: 14031 - DNA, 22 bp, Artificial Sequence
  chemically synthesized
agtatttaacaatccttttttt

SEQ ID NO: 14032 - DNA, 22 bp, Artificial Sequence
  chemically synthesized
aacaatccttttttttcttccc

SEQ ID NO: 14033 - DNA, 22 bp, Artificial Sequence
  chemically synthesized
acaatccttttttttcttccct

SEQ ID NO: 14034 - DNA, 22 bp, Artificial Sequence
  chemically synthesized
ttttttcttcccttgcccagac

SEQ ID NO: 14035 - DNA, 22 bp, Artificial Sequence
  chemically synthesized
tttttcttcccttgcccagaca

SEQ ID NO: 14036 - DNA, 22 bp, Artificial Sequence
  chemically synthesized
ttttcttcccttgcccagacaa

SEQ ID NO: 14037 - DNA, 22 bp, Artificial Sequence
  chemically synthesized
tttcttcccttgcccagacaag

SEQ ID NO: 14038 - DNA, 22 bp, Artificial Sequence
  chemically synthesized
ttcttcccttgcccagacaaga

SEQ ID NO: 14039 - DNA, 22 bp, Artificial Sequence
  chemically synthesized
tcttcccttgcccagacaagag

SEQ ID NO: 14040 - DNA, 22 bp, Artificial Sequence
  chemically synthesized
cttcccttgcccagacaagagt

SEQ ID NO: 14041 - DNA, 22 bp, Artificial Sequence
  chemically synthesized
ttcccttgcccagacaagagtg

SEQ ID NO: 14042 - DNA, 22 bp, Artificial Sequence
  chemically synthesized
cccttgcccagacaagagtgag

SEQ ID NO: 14043 - DNA, 22 bp, Artificial Sequence
  chemically synthesized
ccttgcccagacaagagtgagg

SEQ ID NO: 14044 - DNA, 22 bp, Artificial Sequence
  chemically synthesized
gcccagacaagagtgaggttgc

SEQ ID NO: 14045 - DNA, 22 bp, Artificial Sequence
  chemically synthesized
cccagacaagagtgaggttgct

SEQ ID NO: 14046 - DNA, 22 bp, Artificial Sequence
  chemically synthesized
ctcatcggtttaaagatttggg

SEQ ID NO: 14047 - DNA, 22 bp, Artificial Sequence
  chemically synthesized
atcggtttaaagatttgggaga

SEQ ID NO: 14048 - DNA, 22 bp, Artificial Sequence
  chemically synthesized
aaagatttgggagaagaaaatt

SEQ ID NO: 14049 - DNA, 22 bp, Artificial Sequence
  chemically synthesized
aagatttgggagaagaaaattt

SEQ ID NO: 14050 - DNA, 22 bp, Artificial Sequence
  chemically synthesized
gggagaagaaaatttcaaagcc

SEQ ID NO: 14051 - DNA, 22 bp, Artificial Sequence
  chemically synthesized
ggagaagaaaatttcaaagcct

SEQ ID NO: 14052 - DNA, 22 bp, Artificial Sequence
  chemically synthesized
tgaaattttcttctcccaaatc

SEQ ID NO: 14053 - DNA, 22 bp, Artificial Sequence
  chemically synthesized
gaaattttcttctcccaaatct

SEQ ID NO: 14054 - DNA, 22 bp, Artificial Sequence
  chemically synthesized
aaattttcttctcccaaatctt

SEQ ID NO: 14055 - DNA, 22 bp, Artificial Sequence
  chemically synthesized
tcttctcccaaatctttaaacc

SEQ ID NO: 14056 - DNA, 22 bp, Artificial Sequence
  chemically synthesized
cttctcccaaatctttaaaccg

SEQ ID NO: 14057 - DNA, 22 bp, Artificial Sequence
  chemically synthesized
ttctcccaaatctttaaaccga

SEQ ID NO: 14058 - DNA, 22 bp, Artificial Sequence
  chemically synthesized
ctcccaaatctttaaaccgatg

SEQ ID NO: 14059 - DNA, 22 bp, Artificial Sequence
  chemically synthesized
tcccaaatctttaaaccgatga

SEQ ID NO: 14060 - DNA, 22 bp, Artificial Sequence
  chemically synthesized
ccaaatctttaaaccgatgagc

SEQ ID NO: 14061 - DNA, 22 bp, Artificial Sequence
  chemically synthesized
taaaccgatgagcaacctcact

SEQ ID NO: 14062 - DNA, 22 bp, Artificial Sequence
  chemically synthesized
aaaccgatgagcaacctcactc

SEQ ID NO: 14063 - DNA, 22 bp, Artificial Sequence
  chemically synthesized
aaccgatgagcaacctcactct

SEQ ID NO: 14064 - DNA, 22 bp, Artificial Sequence
  chemically synthesized
actcttgtctgggcaagggaag

SEQ ID NO: 14065 - DNA, 22 bp, Artificial Sequence
  chemically synthesized
ttgtctgggcaagggaagaaaa

SEQ ID NO: 14066 - DNA, 22 bp, Artificial Sequence
  chemically synthesized
gtctgggcaagggaagaaaaaa

SEQ ID NO: 14067 - DNA, 22 bp, Artificial Sequence
  chemically synthesized
tctgggcaagggaagaaaaaaa

SEQ ID NO: 14068 - DNA, 22 bp, Artificial Sequence
  chemically synthesized
ggcaagggaagaaaaaaaagga

SEQ ID NO: 14069 - DNA, 22 bp, Artificial Sequence
  chemically synthesized
ttaaatactgaagaaaacaaga

SEQ ID NO: 14070 - DNA, 22 bp, Artificial Sequence
  chemically synthesized
aatactgaagaaaacaagaagt

SEQ ID NO: 14071 - DNA, 22 bp, Artificial Sequence
  chemically synthesized
aagaaaacaagaagtaataatg

SEQ ID NO: 14072 - DNA, 22 bp, Artificial Sequence
  chemically synthesized
ctttttatatttctttccattt

SEQ ID NO: 14073 - DNA, 22 bp, Artificial Sequence
  chemically synthesized
tttatatttctttccatttgac

SEQ ID NO: 14074 - DNA, 22 bp, Artificial Sequence
  chemically synthesized
ttatatttctttccatttgact

SEQ ID NO: 14075 - DNA, 22 bp, Artificial Sequence
  chemically synthesized
tatatttctttccatttgactt

SEQ ID NO: 14076 - DNA, 22 bp, Artificial Sequence
  chemically synthesized
atatttctttccatttgactta

SEQ ID NO: 14077 - DNA, 22 bp, Artificial Sequence
  chemically synthesized
tatttctttccatttgacttag

SEQ ID NO: 14078 - DNA, 22 bp, Artificial Sequence
  chemically synthesized
ctttccatttgacttagattat

SEQ ID NO: 14079 - DNA, 22 bp, Artificial Sequence
  chemically synthesized
tttccatttgacttagattatg

SEQ ID NO: 14080 - DNA, 22 bp, Artificial Sequence
  chemically synthesized
tccatttgacttagattatgca

SEQ ID NO: 14081 - DNA, 22 bp, Artificial Sequence
  chemically synthesized
ccatttgacttagattatgcat

SEQ ID NO: 14082 - DNA, 22 bp, Artificial Sequence
  chemically synthesized
catttgacttagattatgcatt

SEQ ID NO: 14083 - DNA, 22 bp, Artificial Sequence
  chemically synthesized
gacttagattatgcatttgttt

SEQ ID NO: 14084 - DNA, 22 bp, Artificial Sequence
  chemically synthesized
acttagattatgcatttgtttc

SEQ ID NO: 14085 - DNA, 22 bp, Artificial Sequence
  chemically synthesized
agattatgcatttgtttcaaaa

SEQ ID NO: 14086 - DNA, 22 bp, Artificial Sequence
  chemically synthesized
gattatgcatttgtttcaaaat

SEQ ID NO: 14087 - DNA, 22 bp, Artificial Sequence
  chemically synthesized
tgcatttgtttcaaaatattgg

SEQ ID NO: 14088 - DNA, 22 bp, Artificial Sequence
  chemically synthesized
gtttcaaaatattgggctctga

SEQ ID NO: 14089 - DNA, 22 bp, Artificial Sequence
  chemically synthesized
tttcaaaatattgggctctgat

SEQ ID NO: 14090 - DNA, 22 bp, Artificial Sequence
  chemically synthesized
caaaatattgggctctgattcc

SEQ ID NO: 14091 - DNA, 22 bp, Artificial Sequence
  chemically synthesized
aaaatattgggctctgattcct

SEQ ID NO: 14092 - DNA, 22 bp, Artificial Sequence
  chemically synthesized
ggctctgattcctacagaaaaa

SEQ ID NO: 14093 - DNA, 22 bp, Artificial Sequence
  chemically synthesized
tgattcctacagaaaaactcag

SEQ ID NO: 14094 - DNA, 22 bp, Artificial Sequence
  chemically synthesized
attcctacagaaaaactcagga

SEQ ID NO: 14095 - DNA, 22 bp, Artificial Sequence
  chemically synthesized
ctacagaaaaactcaggatgat

SEQ ID NO: 14096 - DNA, 22 bp, Artificial Sequence
  chemically synthesized
cagaaaaactcaggatgatgtt

SEQ ID NO: 14097 - DNA, 22 bp, Artificial Sequence
  chemically synthesized
aggatgatgttcaattatttct

SEQ ID NO: 14098 - DNA, 22 bp, Artificial Sequence
  chemically synthesized
aattatttcttctgcctttaaa

SEQ ID NO: 14099 - DNA, 22 bp, Artificial Sequence
  chemically synthesized
tttcttctgcctttaaacagaa

SEQ ID NO: 14100 - DNA, 22 bp, Artificial Sequence
  chemically synthesized
cttctgcctttaaacagaagaa

SEQ ID NO: 14101 - DNA, 22 bp, Artificial Sequence
  chemically synthesized
ttctgcctttaaacagaagaat

SEQ ID NO: 14102 - DNA, 22 bp, Artificial Sequence
  chemically synthesized
ctgcctttaaacagaagaataa

SEQ ID NO: 14103 - DNA, 22 bp, Artificial Sequence
  chemically synthesized
tgcctttaaacagaagaataat

SEQ ID NO: 14104 - DNA, 22 bp, Artificial Sequence
  chemically synthesized
cctttaaacagaagaataattc

SEQ ID NO: 14105 - DNA, 22 bp, Artificial Sequence
  chemically synthesized
taaacagaagaataattcaatt

SEQ ID NO: 14106 - DNA, 22 bp, Artificial Sequence
  chemically synthesized
aaacagaagaataattcaatta

SEQ ID NO: 14107 - DNA, 22 bp, Artificial Sequence
  chemically synthesized
aacagaagaataattcaattac

SEQ ID NO: 14108 - DNA, 22 bp, Artificial Sequence
  chemically synthesized
aattaccaagaatactatttta

SEQ ID NO: 14109 - DNA, 22 bp, Artificial Sequence
  chemically synthesized
ccaagaatactattttaaaaat

SEQ ID NO: 14110 - DNA, 22 bp, Artificial Sequence
  chemically synthesized
ttttaaaaattattaaatattt

SEQ ID NO: 14111 - DNA, 22 bp, Artificial Sequence
  chemically synthesized
taaaaattattaaatatttata

SEQ ID NO: 14112 - DNA, 22 bp, Artificial Sequence
  chemically synthesized
aaaaattattaaatatttatag

SEQ ID NO: 14113 - DNA, 22 bp, Artificial Sequence
  chemically synthesized
aaaattattaaatatttatagc

SEQ ID NO: 14114 - DNA, 22 bp, Artificial Sequence
  chemically synthesized
ttaaatatttatagccttatat

SEQ ID NO: 14115 - DNA, 22 bp, Artificial Sequence
  chemically synthesized
aatatttatagccttatattca

SEQ ID NO: 14116 - DNA, 22 bp, Artificial Sequence
  chemically synthesized
atagccttatattcaaacttag

SEQ ID NO: 14117 - DNA, 22 bp, Artificial Sequence
  chemically synthesized
tagccttatattcaaacttaga

SEQ ID NO: 14118 - DNA, 22 bp, Artificial Sequence
  chemically synthesized
atattcaaacttagataatatc

SEQ ID NO: 14119 - DNA, 22 bp, Artificial Sequence
  chemically synthesized
tattcaaacttagataatatct

SEQ ID NO: 14120 - DNA, 22 bp, Artificial Sequence
  chemically synthesized
aaacttagataatatctaatac

SEQ ID NO: 14121 - DNA, 22 bp, Artificial Sequence
  chemically synthesized
agataatatctaatactctttt

SEQ ID NO: 14122 - DNA, 22 bp, Artificial Sequence
  chemically synthesized
gataatatctaatactctttta

SEQ ID NO: 14123 - DNA, 22 bp, Artificial Sequence
  chemically synthesized
atactcttttagtgtctatcaa

SEQ ID NO: 14124 - DNA, 22 bp, Artificial Sequence
  chemically synthesized
ttttagtgtctatcaacagcaa

SEQ ID NO: 14125 - DNA, 22 bp, Artificial Sequence
  chemically synthesized
ttagtgtctatcaacagcaacc

SEQ ID NO: 14126 - DNA, 22 bp, Artificial Sequence
  chemically synthesized
tagtgtctatcaacagcaacca

SEQ ID NO: 14127 - DNA, 22 bp, Artificial Sequence
  chemically synthesized
agtgtctatcaacagcaaccaa

SEQ ID NO: 14128 - DNA, 22 bp, Artificial Sequence
  chemically synthesized
gtgtctatcaacagcaaccaag

SEQ ID NO: 14129 - DNA, 22 bp, Artificial Sequence
  chemically synthesized
tcaacagcaaccaagaagacag

SEQ ID NO: 14130 - DNA, 22 bp, Artificial Sequence
  chemically synthesized
aaatgaaaataaatataaatac

SEQ ID NO: 14131 - DNA, 22 bp, Artificial Sequence
  chemically synthesized
tatttatgagatcaacagcaca

SEQ ID NO: 14132 - DNA, 22 bp, Artificial Sequence
  chemically synthesized
tttatgagatcaacagcacagg

SEQ ID NO: 14133 - DNA, 22 bp, Artificial Sequence
  chemically synthesized
atgagatcaacagcacaggttt

SEQ ID NO: 14134 - DNA, 22 bp, Artificial Sequence
  chemically synthesized
tgagatcaacagcacaggtttt

SEQ ID NO: 14135 - DNA, 22 bp, Artificial Sequence
  chemically synthesized
tgtggtttttaaataaagcata

SEQ ID NO: 14136 - DNA, 22 bp, Artificial Sequence
  chemically synthesized
gtggtttttaaataaagcatag

SEQ ID NO: 14137 - DNA, 22 bp, Artificial Sequence
  chemically synthesized
tggtttttaaataaagcatagt

SEQ ID NO: 14138 - DNA, 22 bp, Artificial Sequence
  chemically synthesized
ttaaataaagcatagtgcaatg

SEQ ID NO: 14139 - DNA, 22 bp, Artificial Sequence
  chemically synthesized
taaataaagcatagtgcaatgg

SEQ ID NO: 14140 - DNA, 22 bp, Artificial Sequence
  chemically synthesized
aaataaagcatagtgcaatgga

SEQ ID NO: 14141 - DNA, 22 bp, Artificial Sequence
  chemically synthesized
aataaagcatagtgcaatggat

SEQ ID NO: 14142 - DNA, 22 bp, Artificial Sequence
  chemically synthesized
tgggatagttatgaattcaatc

SEQ ID NO: 14143 - DNA, 22 bp, Artificial Sequence
  chemically synthesized
gggatagttatgaattcaatct

SEQ ID NO: 14144 - DNA, 22 bp, Artificial Sequence
  chemically synthesized
ggatagttatgaattcaatctt

SEQ ID NO: 14145 - DNA, 22 bp, Artificial Sequence
  chemically synthesized
tgaattcaatcttcaaccctat

SEQ ID NO: 14146 - DNA, 22 bp, Artificial Sequence
  chemically synthesized
aatcttcaaccctattctgtga

SEQ ID NO: 14147 - DNA, 22 bp, Artificial Sequence
  chemically synthesized
caaccctattctgtgaagtttc

SEQ ID NO: 14148 - DNA, 22 bp, Artificial Sequence
  chemically synthesized
aaccctattctgtgaagtttca

SEQ ID NO: 14149 - DNA, 22 bp, Artificial Sequence
  chemically synthesized
ttctgtgaagtttcagtcactc

SEQ ID NO: 14150 - DNA, 22 bp, Artificial Sequence
  chemically synthesized
tgtgaagtttcagtcactctaa

SEQ ID NO: 14151 - DNA, 22 bp, Artificial Sequence
  chemically synthesized
tgaagtttcagtcactctaagt

SEQ ID NO: 14152 - DNA, 22 bp, Artificial Sequence
  chemically synthesized
cagtcactctaagttactttgc

SEQ ID NO: 14153 - DNA, 22 bp, Artificial Sequence
  chemically synthesized
agtcactctaagttactttgca

SEQ ID NO: 14154 - DNA, 22 bp, Artificial Sequence
  chemically synthesized
taagttactttgcactttcctt

SEQ ID NO: 14155 - DNA, 22 bp, Artificial Sequence
  chemically synthesized
agttactttgcactttccttag

SEQ ID NO: 14156 - DNA, 22 bp, Artificial Sequence
  chemically synthesized
ctttgcactttccttagtgcgc

SEQ ID NO: 14157 - DNA, 22 bp, Artificial Sequence
  chemically synthesized
tgcactttccttagtgcgcaaa

SEQ ID NO: 14158 - DNA, 22 bp, Artificial Sequence
  chemically synthesized
gcactttccttagtgcgcaaaa

SEQ ID NO: 14159 - DNA, 22 bp, Artificial Sequence
  chemically synthesized
cactttccttagtgcgcaaaag

SEQ ID NO: 14160 - DNA, 22 bp, Artificial Sequence
  chemically synthesized
tccttagtgcgcaaaagaaaat

SEQ ID NO: 14161 - DNA, 22 bp, Artificial Sequence
  chemically synthesized
ccttagtgcgcaaaagaaaatt

SEQ ID NO: 14162 - DNA, 22 bp, Artificial Sequence
  chemically synthesized
cttagtgcgcaaaagaaaatta

SEQ ID NO: 14163 - DNA, 22 bp, Artificial Sequence
  chemically synthesized
agtgcgcaaaagaaaattacag

SEQ ID NO: 14164 - DNA, 22 bp, Artificial Sequence
  chemically synthesized
gtgcgcaaaagaaaattacagt

SEQ ID NO: 14165 - DNA, 22 bp, Artificial Sequence
  chemically synthesized
cagtcactaaacaattctgacc

SEQ ID NO: 14166 - DNA, 22 bp, Artificial Sequence
  chemically synthesized
aacaattctgaccttttttttt

SEQ ID NO: 14167 - DNA, 22 bp, Artificial Sequence
  chemically synthesized
tgacctttttttttttttacct

SEQ ID NO: 14168 - DNA, 22 bp, Artificial Sequence
  chemically synthesized
acctttttttttttttacctag

SEQ ID NO: 14169 - DNA, 22 bp, Artificial Sequence
  chemically synthesized
tttttttttttacctaggatgt

SEQ ID NO: 14170 - DNA, 22 bp, Artificial Sequence
  chemically synthesized
ttttttttttacctaggatgtt

SEQ ID NO: 14171 - DNA, 22 bp, Artificial Sequence
  chemically synthesized
tttttttttacctaggatgttt

SEQ ID NO: 14172 - DNA, 22 bp, Artificial Sequence
  chemically synthesized
ttttttttacctaggatgtttg

SEQ ID NO: 14173 - DNA, 22 bp, Artificial Sequence
  chemically synthesized
tttttttacctaggatgtttga

SEQ ID NO: 14174 - DNA, 22 bp, Artificial Sequence
  chemically synthesized
ttttttacctaggatgtttgaa

SEQ ID NO: 14175 - DNA, 22 bp, Artificial Sequence
  chemically synthesized
tttttacctaggatgtttgaat

SEQ ID NO: 14176 - DNA, 22 bp, Artificial Sequence
  chemically synthesized
ttttacctaggatgtttgaatt

SEQ ID NO: 14177 - DNA, 22 bp, Artificial Sequence
  chemically synthesized
tttacctaggatgtttgaattt

SEQ ID NO: 14178 - DNA, 22 bp, Artificial Sequence
  chemically synthesized
ttacctaggatgtttgaatttt

SEQ ID NO: 14179 - DNA, 22 bp, Artificial Sequence
  chemically synthesized
tacctaggatgtttgaatttta

SEQ ID NO: 14180 - DNA, 22 bp, Artificial Sequence
  chemically synthesized
acctaggatgtttgaattttat

SEQ ID NO: 14181 - DNA, 22 bp, Artificial Sequence
  chemically synthesized
cctaggatgtttgaattttatt

SEQ ID NO: 14182 - DNA, 22 bp, Artificial Sequence
  chemically synthesized
ggatgtttgaattttattaata

SEQ ID NO: 14183 - DNA, 22 bp, Artificial Sequence
  chemically synthesized
gaattttattaataagataacc

SEQ ID NO: 14184 - DNA, 22 bp, Artificial Sequence
  chemically synthesized
aattttattaataagataacct

SEQ ID NO: 14185 - DNA, 22 bp, Artificial Sequence
  chemically synthesized
tattaataagataaccttgtaa

SEQ ID NO: 14186 - DNA, 22 bp, Artificial Sequence
  chemically synthesized
attaataagataaccttgtaag

SEQ ID NO: 14187 - DNA, 22 bp, Artificial Sequence
  chemically synthesized
ttaataagataaccttgtaaga

SEQ ID NO: 14188 - DNA, 22 bp, Artificial Sequence
  chemically synthesized
ataagataaccttgtaagactt

SEQ ID NO: 14189 - DNA, 22 bp, Artificial Sequence
  chemically synthesized
gtaagacttcacaaatacaaaa

SEQ ID NO: 14190 - DNA, 22 bp, Artificial Sequence
  chemically synthesized
taagacttcacaaatacaaaat

SEQ ID NO: 14191 - DNA, 22 bp, Artificial Sequence
  chemically synthesized
cacaaatacaaaatactatgcc

SEQ ID NO: 14192 - DNA, 22 bp, Artificial Sequence
  chemically synthesized
acaaatacaaaatactatgcca

SEQ ID NO: 14193 - DNA, 22 bp, Artificial Sequence
  chemically synthesized
tgccattttagaaataaatgcc

SEQ ID NO: 14194 - DNA, 22 bp, Artificial Sequence
  chemically synthesized
tagaaataaatgccaaaataat

SEQ ID NO: 14195 - DNA, 22 bp, Artificial Sequence
  chemically synthesized
agaaataaatgccaaaataatt

SEQ ID NO: 14196 - DNA, 22 bp, Artificial Sequence
  chemically synthesized
gaaataaatgccaaaataattc

SEQ ID NO: 14197 - DNA, 22 bp, Artificial Sequence
  chemically synthesized
tttaaagatgcagagtttacta

SEQ ID NO: 14198 - DNA, 22 bp, Artificial Sequence
  chemically synthesized
taaagatgcagagtttactaaa

SEQ ID NO: 14199 - DNA, 22 bp, Artificial Sequence
  chemically synthesized
aaagatgcagagtttactaaaa

SEQ ID NO: 14200 - DNA, 22 bp, Artificial Sequence
  chemically synthesized
aagatgcagagtttactaaaac

SEQ ID NO: 14201 - DNA, 22 bp, Artificial Sequence
  chemically synthesized
actaaaactttattttactggg

SEQ ID NO: 14202 - DNA, 22 bp, Artificial Sequence
  chemically synthesized
ctaaaactttattttactggga

SEQ ID NO: 14203 - DNA, 22 bp, Artificial Sequence
  chemically synthesized
aaactttattttactgggaaaa

SEQ ID NO: 14204 - DNA, 22 bp, Artificial Sequence
  chemically synthesized
tattttactgggaaaatagaat

SEQ ID NO: 14205 - DNA, 22 bp, Artificial Sequence
  chemically synthesized
attttactgggaaaatagaata

SEQ ID NO: 14206 - DNA, 22 bp, Artificial Sequence
  chemically synthesized
ttttactgggaaaatagaataa

SEQ ID NO: 14207 - DNA, 22 bp, Artificial Sequence
  chemically synthesized
tactgggaaaatagaataaaag

SEQ ID NO: 14208 - DNA, 22 bp, Artificial Sequence
  chemically synthesized
actgggaaaatagaataaaagt

SEQ ID NO: 14209 - DNA, 22 bp, Artificial Sequence
  chemically synthesized
ctgggaaaatagaataaaagtt

SEQ ID NO: 14210 - DNA, 22 bp, Artificial Sequence
  chemically synthesized
ggaaaatagaataaaagttgaa

SEQ ID NO: 14211 - DNA, 22 bp, Artificial Sequence
  chemically synthesized
aacaatagaaaaatggatttct

SEQ ID NO: 14212 - DNA, 22 bp, Artificial Sequence
  chemically synthesized
cttacgtgcatctcgacgaaac

SEQ ID NO: 14213 - DNA, 22 bp, Artificial Sequence
  chemically synthesized
ttacgtgcatctcgacgaaaca

SEQ ID NO: 14214 - DNA, 22 bp, Artificial Sequence
  chemically synthesized
acgtgcatctcgacgaaacaca

SEQ ID NO: 14215 - DNA, 22 bp, Artificial Sequence
  chemically synthesized
cgtgcatctcgacgaaacacac

SEQ ID NO: 14216 - DNA, 22 bp, Artificial Sequence
  chemically synthesized
gacgaaacacacccctggaata

SEQ ID NO: 14217 - DNA, 22 bp, Artificial Sequence
  chemically synthesized
gaataagccgagctaaagagaa

SEQ ID NO: 14218 - DNA, 22 bp, Artificial Sequence
  chemically synthesized
aagagaaaaagaagggaaataa

SEQ ID NO: 14219 - DNA, 22 bp, Artificial Sequence
  chemically synthesized
cccacttcattgtgccaaaggc

SEQ ID NO: 14220 - DNA, 22 bp, Artificial Sequence
  chemically synthesized
cattgtgccaaaggcgtgtggg

SEQ ID NO: 14221 - DNA, 22 bp, Artificial Sequence
  chemically synthesized
attgtgccaaaggcgtgtgggg

SEQ ID NO: 14222 - DNA, 22 bp, Artificial Sequence
  chemically synthesized
tgccaaaggcgtgtggggttga

SEQ ID NO: 14223 - DNA, 22 bp, Artificial Sequence
  chemically synthesized
acagaagagaaaagctaggaca

SEQ ID NO: 14224 - DNA, 22 bp, Artificial Sequence
  chemically synthesized
ggacaaacggagggaaattagc

SEQ ID NO: 14225 - DNA, 20 bp, Artificial Sequence
  chemically synthesized
aataaatttacccaacaaaa

SEQ ID NO: 14226 - DNA, 20 bp, Artificial Sequence
  chemically synthesized
aatctcttaaaatcataaaa

SEQ ID NO: 14227 - DNA, 20 bp, Artificial Sequence
  chemically synthesized
aaatcataaaaaagtaaaat

SEQ ID NO: 14228 - DNA, 20 bp, Artificial Sequence
  chemically synthesized
gtaaaattagcttttaaaaa

SEQ ID NO: 14229 - DNA, 20 bp, Artificial Sequence
  chemically synthesized
taaaattagcttttaaaaac

SEQ ID NO: 14230 - DNA, 20 bp, Artificial Sequence
  chemically synthesized
aattagcttttaaaaacagg

SEQ ID NO: 14231 - DNA, 20 bp, Artificial Sequence
  chemically synthesized
ttaaaaacaggtagtcacca

SEQ ID NO: 14232 - DNA, 20 bp, Artificial Sequence
  chemically synthesized
tcaccatagcattgaatgtg

SEQ ID NO: 14233 - DNA, 20 bp, Artificial Sequence
  chemically synthesized
tgaatgtgtagtttataata

SEQ ID NO: 14234 - DNA, 20 bp, Artificial Sequence
  chemically synthesized
gtgtagtttataatacagca

SEQ ID NO: 14235 - DNA, 20 bp, Artificial Sequence
  chemically synthesized
acaatttcaaattacctatt

SEQ ID NO: 14236 - DNA, 20 bp, Artificial Sequence
  chemically synthesized
tttcaaattacctattaagt

SEQ ID NO: 14237 - DNA, 20 bp, Artificial Sequence
  chemically synthesized
ctcatttctttgatttcatt

SEQ ID NO: 14238 - DNA, 20 bp, Artificial Sequence
  chemically synthesized
agcattgatctaactcaatg

SEQ ID NO: 14239 - DNA, 20 bp, Artificial Sequence
  chemically synthesized
attgatctaactcaatgtgg

SEQ ID NO: 14240 - DNA, 20 bp, Artificial Sequence
  chemically synthesized
gatctaactcaatgtggaag

SEQ ID NO: 14241 - DNA, 20 bp, Artificial Sequence
  chemically synthesized
atctaactcaatgtggaaga

SEQ ID NO: 14242 - DNA, 20 bp, Artificial Sequence
  chemically synthesized
gaagaaggttacattcgtgc

SEQ ID NO: 14243 - DNA, 20 bp, Artificial Sequence
  chemically synthesized
tacattcgtgcaagttaaca

SEQ ID NO: 14244 - DNA, 20 bp, Artificial Sequence
  chemically synthesized
cctaccaaccttaccttttc

SEQ ID NO: 14245 - DNA, 20 bp, Artificial Sequence
  chemically synthesized
ctaccaaccttaccttttct

SEQ ID NO: 14246 - DNA, 20 bp, Artificial Sequence
  chemically synthesized
taccttttctgggcaaatat

SEQ ID NO: 14247 - DNA, 20 bp, Artificial Sequence
  chemically synthesized
tgggcaaatattggtatata

SEQ ID NO: 14248 - DNA, 20 bp, Artificial Sequence
  chemically synthesized
ggcaaatattggtatatata

SEQ ID NO: 14249 - DNA, 20 bp, Artificial Sequence
  chemically synthesized
atattggtatatatagagtt

SEQ ID NO: 14250 - DNA, 20 bp, Artificial Sequence
  chemically synthesized
ttggtatatatagagttaag

SEQ ID NO: 14251 - DNA, 20 bp, Artificial Sequence
  chemically synthesized
atatatagagttaagaagtc

SEQ ID NO: 14252 - DNA, 20 bp, Artificial Sequence
  chemically synthesized
tatatagagttaagaagtct

SEQ ID NO: 14253 - DNA, 20 bp, Artificial Sequence
  chemically synthesized
aagaagtctaggtctgcttc

SEQ ID NO: 14254 - DNA, 20 bp, Artificial Sequence
  chemically synthesized
aagtctaggtctgcttccag

SEQ ID NO: 14255 - DNA, 20 bp, Artificial Sequence
  chemically synthesized
ggtctgcttccagaagaaaa

SEQ ID NO: 14256 - DNA, 20 bp, Artificial Sequence
  chemically synthesized
gttgcttgaaattgaaaatc

SEQ ID NO: 14257 - DNA, 20 bp, Artificial Sequence
  chemically synthesized
agataaaaatgttcacaatt

SEQ ID NO: 14258 - DNA, 20 bp, Artificial Sequence
  chemically synthesized
ccttctttttattgttcctc

SEQ ID NO: 14259 - DNA, 20 bp, Artificial Sequence
  chemically synthesized
gttcctctagttatttcctc

SEQ ID NO: 14260 - DNA, 20 bp, Artificial Sequence
  chemically synthesized
tatttcctccagaattgatc

SEQ ID NO: 14261 - DNA, 20 bp, Artificial Sequence
  chemically synthesized
atcatttgattctctatctc

SEQ ID NO: 14262 - DNA, 20 bp, Artificial Sequence
  chemically synthesized
catttgattctctatctcca

SEQ ID NO: 14263 - DNA, 20 bp, Artificial Sequence
  chemically synthesized
ctatctccagagccaaaatc

SEQ ID NO: 14264 - DNA, 20 bp, Artificial Sequence
  chemically synthesized
aaaatcaagatttgctatgt

SEQ ID NO: 14265 - DNA, 20 bp, Artificial Sequence
  chemically synthesized
gttagacgatgtaaaaattt

SEQ ID NO: 14266 - DNA, 20 bp, Artificial Sequence
  chemically synthesized
gatgtaaaaattttagccaa

SEQ ID NO: 14267 - DNA, 20 bp, Artificial Sequence
  chemically synthesized
ttttagccaatggcctcctt

SEQ ID NO: 14268 - DNA, 20 bp, Artificial Sequence
  chemically synthesized
agccaatggcctccttcagt

SEQ ID NO: 14269 - DNA, 20 bp, Artificial Sequence
  chemically synthesized
gccaatggcctccttcagtt

SEQ ID NO: 14270 - DNA, 20 bp, Artificial Sequence
  chemically synthesized
ggcctccttcagttgggaca

SEQ ID NO: 14271 - DNA, 20 bp, Artificial Sequence
  chemically synthesized
tcagttgggacatggtctta

SEQ ID NO: 14272 - DNA, 20 bp, Artificial Sequence
  chemically synthesized
gtcttaaagactttgtccat

SEQ ID NO: 14273 - DNA, 20 bp, Artificial Sequence
  chemically synthesized
aagactttgtccataagacg

SEQ ID NO: 14274 - DNA, 20 bp, Artificial Sequence
  chemically synthesized
agactttgtccataagacga

SEQ ID NO: 14275 - DNA, 20 bp, Artificial Sequence
  chemically synthesized
gactttgtccataagacgaa

SEQ ID NO: 14276 - DNA, 20 bp, Artificial Sequence
  chemically synthesized
aaaaactcaacatatttgat

SEQ ID NO: 14277 - DNA, 20 bp, Artificial Sequence
  chemically synthesized
tatgatctatcgctgcaaac

SEQ ID NO: 14278 - DNA, 20 bp, Artificial Sequence
  chemically synthesized
gctgcaaaccagtgaaatca

SEQ ID NO: 14279 - DNA, 20 bp, Artificial Sequence
  chemically synthesized
gcaaaccagtgaaatcaaag

SEQ ID NO: 14280 - DNA, 20 bp, Artificial Sequence
  chemically synthesized
aaccagtgaaatcaaagaag

SEQ ID NO: 14281 - DNA, 20 bp, Artificial Sequence
  chemically synthesized
gtgaaatcaaagaagaagaa

SEQ ID NO: 14282 - DNA, 20 bp, Artificial Sequence
  chemically synthesized
tgaaatcaaagaagaagaaa

SEQ ID NO: 14283 - DNA, 20 bp, Artificial Sequence
  chemically synthesized
aaagaagaagaaaaggaact

SEQ ID NO: 14284 - DNA, 20 bp, Artificial Sequence
  chemically synthesized
gaagaagaaaaggaactgag

SEQ ID NO: 14285 - DNA, 20 bp, Artificial Sequence
  chemically synthesized
aagaactacatataaactac

SEQ ID NO: 14286 - DNA, 20 bp, Artificial Sequence
  chemically synthesized
taaactacaagtcaaaaatg

SEQ ID NO: 14287 - DNA, 20 bp, Artificial Sequence
  chemically synthesized
aactacaagtcaaaaatgaa

SEQ ID NO: 14288 - DNA, 20 bp, Artificial Sequence
  chemically synthesized
actacaagtcaaaaatgaag

SEQ ID NO: 14289 - DNA, 20 bp, Artificial Sequence
  chemically synthesized
aagtcaaaaatgaagaggta

SEQ ID NO: 14290 - DNA, 20 bp, Artificial Sequence
  chemically synthesized
gaactcaactcaaaacttga

SEQ ID NO: 14291 - DNA, 20 bp, Artificial Sequence
  chemically synthesized
ctcaaaacttgaaagcctcc

SEQ ID NO: 14292 - DNA, 20 bp, Artificial Sequence
  chemically synthesized
aaaacttgaaagcctcctag

SEQ ID NO: 14293 - DNA, 20 bp, Artificial Sequence
  chemically synthesized
aaaaattctacttcaacaaa

SEQ ID NO: 14294 - DNA, 20 bp, Artificial Sequence
  chemically synthesized
tcaacaaaaagtgaaatatt

SEQ ID NO: 14295 - DNA, 20 bp, Artificial Sequence
  chemically synthesized
acaaaaagtgaaatatttag

SEQ ID NO: 14296 - DNA, 20 bp, Artificial Sequence
  chemically synthesized
aaaaagtgaaatatttagaa

SEQ ID NO: 14297 - DNA, 20 bp, Artificial Sequence
  chemically synthesized
tcaaaatcaacctgaaactc

SEQ ID NO: 14298 - DNA, 20 bp, Artificial Sequence
  chemically synthesized
acctgaaactccagaacacc

SEQ ID NO: 14299 - DNA, 20 bp, Artificial Sequence
  chemically synthesized
tgaaactccagaacacccag

SEQ ID NO: 14300 - DNA, 20 bp, Artificial Sequence
  chemically synthesized
cccagaagtaacttcactta

SEQ ID NO: 14301 - DNA, 20 bp, Artificial Sequence
  chemically synthesized
gaagtaacttcacttaaagt

SEQ ID NO: 14302 - DNA, 20 bp, Artificial Sequence
  chemically synthesized
gtaacttcacttaaagtaag

SEQ ID NO: 14303 - DNA, 20 bp, Artificial Sequence
  chemically synthesized
cttaaagtaagtagaaaata

SEQ ID NO: 14304 - DNA, 20 bp, Artificial Sequence
  chemically synthesized
taaagtaagtagaaaataaa

SEQ ID NO: 14305 - DNA, 20 bp, Artificial Sequence
  chemically synthesized
aaagtaagtagaaaataaag

SEQ ID NO: 14306 - DNA, 20 bp, Artificial Sequence
  chemically synthesized
aagtaagtagaaaataaaga

SEQ ID NO: 14307 - DNA, 20 bp, Artificial Sequence
  chemically synthesized
tcatgtttatgttttcaatg

SEQ ID NO: 14308 - DNA, 20 bp, Artificial Sequence
  chemically synthesized
cttttaaaaaaaatatttct

SEQ ID NO: 14309 - DNA, 20 bp, Artificial Sequence
  chemically synthesized
ttttaaaaaaaatatttcta

SEQ ID NO: 14310 - DNA, 20 bp, Artificial Sequence
  chemically synthesized
gttgaaatacttttttttcc

SEQ ID NO: 14311 - DNA, 20 bp, Artificial Sequence
  chemically synthesized
tttccaagaaaaataatctc

SEQ ID NO: 14312 - DNA, 20 bp, Artificial Sequence
  chemically synthesized
aaatttcctattataatttc

SEQ ID NO: 14313 - DNA, 20 bp, Artificial Sequence
  chemically synthesized
ttcctattataatttcaagt

SEQ ID NO: 14314 - DNA, 20 bp, Artificial Sequence
  chemically synthesized
tttatatgaaaattacaaat

SEQ ID NO: 14315 - DNA, 20 bp, Artificial Sequence
  chemically synthesized
atcggttaaattatacaatc

SEQ ID NO: 14316 - DNA, 20 bp, Artificial Sequence
  chemically synthesized
tacactattgtaaattactg

SEQ ID NO: 14317 - DNA, 20 bp, Artificial Sequence
  chemically synthesized
acactattgtaaattactga

SEQ ID NO: 14318 - DNA, 20 bp, Artificial Sequence
  chemically synthesized
tattgtaaattactgaaggt

SEQ ID NO: 14319 - DNA, 20 bp, Artificial Sequence
  chemically synthesized
aattactgaaggtaagtaaa

SEQ ID NO: 14320 - DNA, 20 bp, Artificial Sequence
  chemically synthesized
aaaaatttaaaactattctc

SEQ ID NO: 14321 - DNA, 20 bp, Artificial Sequence
  chemically synthesized
ctattctccagtgtttaaaa

SEQ ID NO: 14322 - DNA, 20 bp, Artificial Sequence
  chemically synthesized
ttaaaacagattaaataata

SEQ ID NO: 14323 - DNA, 20 bp, Artificial Sequence
  chemically synthesized
agattaaataatacagtaaa

SEQ ID NO: 14324 - DNA, 20 bp, Artificial Sequence
  chemically synthesized
aaataatacagtaaatggaa

SEQ ID NO: 14325 - DNA, 20 bp, Artificial Sequence
  chemically synthesized
ttattcatatgaaaatatgc

SEQ ID NO: 14326 - DNA, 20 bp, Artificial Sequence
  chemically synthesized
tattcatatgaaaatatgct

SEQ ID NO: 14327 - DNA, 20 bp, Artificial Sequence
  chemically synthesized
tgggctttttcttttaattg

SEQ ID NO: 14328 - DNA, 20 bp, Artificial Sequence
  chemically synthesized
tttttcttttaattgaagtt

SEQ ID NO: 14329 - DNA, 20 bp, Artificial Sequence
  chemically synthesized
aagttcagaaaatcaaattt

SEQ ID NO: 14330 - DNA, 20 bp, Artificial Sequence
  chemically synthesized
gttcagaaaatcaaatttta

SEQ ID NO: 14331 - DNA, 20 bp, Artificial Sequence
  chemically synthesized
agaaaatcaaattttagaga

SEQ ID NO: 14332 - DNA, 20 bp, Artificial Sequence
  chemically synthesized
tacaatttaaataaaatgtt

SEQ ID NO: 14333 - DNA, 20 bp, Artificial Sequence
  chemically synthesized
acaatttaaataaaatgtta

SEQ ID NO: 14334 - DNA, 20 bp, Artificial Sequence
  chemically synthesized
caaaaatatgtgctatttga

SEQ ID NO: 14335 - DNA, 20 bp, Artificial Sequence
  chemically synthesized
aaatatgtgctatttgaaag

SEQ ID NO: 14336 - DNA, 20 bp, Artificial Sequence
  chemically synthesized
gctatttgaaagaagcatac

SEQ ID NO: 14337 - DNA, 20 bp, Artificial Sequence
  chemically synthesized
ctatttgaaagaagcataca

SEQ ID NO: 14338 - DNA, 20 bp, Artificial Sequence
  chemically synthesized
tatttgaaagaagcatacaa

SEQ ID NO: 14339 - DNA, 20 bp, Artificial Sequence
  chemically synthesized
atttgaaagaagcatacaag

SEQ ID NO: 14340 - DNA, 20 bp, Artificial Sequence
  chemically synthesized
tgaaagaagcatacaagggg

SEQ ID NO: 14341 - DNA, 20 bp, Artificial Sequence
  chemically synthesized
gaaagaagcatacaagggga

SEQ ID NO: 14342 - DNA, 20 bp, Artificial Sequence
  chemically synthesized
tcatttttcaaatccattat

SEQ ID NO: 14343 - DNA, 20 bp, Artificial Sequence
  chemically synthesized
ccattattagtttaaaaatt

SEQ ID NO: 14344 - DNA, 20 bp, Artificial Sequence
  chemically synthesized
tttaaaaatttagattatga

SEQ ID NO: 14345 - DNA, 20 bp, Artificial Sequence
  chemically synthesized
tttagattatgatagtgtta

SEQ ID NO: 14346 - DNA, 20 bp, Artificial Sequence
  chemically synthesized
ttagattatgatagtgttac

SEQ ID NO: 14347 - DNA, 20 bp, Artificial Sequence
  chemically synthesized
atagtgttacaggaaattaa

SEQ ID NO: 14348 - DNA, 20 bp, Artificial Sequence
  chemically synthesized
gttacaggaaattaatagaa

SEQ ID NO: 14349 - DNA, 20 bp, Artificial Sequence
  chemically synthesized
caggaaattaatagaaaaga

SEQ ID NO: 14350 - DNA, 20 bp, Artificial Sequence
  chemically synthesized
ggaaattaatagaaaagaaa

SEQ ID NO: 14351 - DNA, 20 bp, Artificial Sequence
  chemically synthesized
gaaattaatagaaaagaaag

SEQ ID NO: 14352 - DNA, 20 bp, Artificial Sequence
  chemically synthesized
ttaatagaaaagaaagagga

SEQ ID NO: 14353 - DNA, 20 bp, Artificial Sequence
  chemically synthesized
accaacctactctctatatc

SEQ ID NO: 14354 - DNA, 20 bp, Artificial Sequence
  chemically synthesized
tctctatatccagacttttg

SEQ ID NO: 14355 - DNA, 20 bp, Artificial Sequence
  chemically synthesized
ccagacttttgtagaaaaac

SEQ ID NO: 14356 - DNA, 20 bp, Artificial Sequence
  chemically synthesized
tttgtagaaaaacaagataa

SEQ ID NO: 14357 - DNA, 20 bp, Artificial Sequence
  chemically synthesized
aaaacaagataatagcatca

SEQ ID NO: 14358 - DNA, 20 bp, Artificial Sequence
  chemically synthesized
atagcatcaaagaccttctc

SEQ ID NO: 14359 - DNA, 20 bp, Artificial Sequence
  chemically synthesized
caaagaccttctccagaccg

SEQ ID NO: 14360 - DNA, 20 bp, Artificial Sequence
  chemically synthesized
agaccttctccagaccgtgg

SEQ ID NO: 14361 - DNA, 20 bp, Artificial Sequence
  chemically synthesized
aatataaacaattaaaccaa

SEQ ID NO: 14362 - DNA, 20 bp, Artificial Sequence
  chemically synthesized
aaacaattaaaccaacagca

SEQ ID NO: 14363 - DNA, 20 bp, Artificial Sequence
  chemically synthesized
ccaacagcatagtcaaataa

SEQ ID NO: 14364 - DNA, 20 bp, Artificial Sequence
  chemically synthesized
gcatagtcaaataaaagaaa

SEQ ID NO: 14365 - DNA, 20 bp, Artificial Sequence
  chemically synthesized
aaataaaagaaatagaaaat

SEQ ID NO: 14366 - DNA, 20 bp, Artificial Sequence
  chemically synthesized
aataaaagaaatagaaaatc

SEQ ID NO: 14367 - DNA, 20 bp, Artificial Sequence
  chemically synthesized
aaagaaatagaaaatcaggt

SEQ ID NO: 14368 - DNA, 20 bp, Artificial Sequence
  chemically synthesized
aaatagaaaatcaggtaagt

SEQ ID NO: 14369 - DNA, 20 bp, Artificial Sequence
  chemically synthesized
caggtaagtcagtattttaa

SEQ ID NO: 14370 - DNA, 20 bp, Artificial Sequence
  chemically synthesized
ggtatgtcccatctttcaca

SEQ ID NO: 14371 - DNA, 20 bp, Artificial Sequence
  chemically synthesized
gtatgtcccatctttcacac

SEQ ID NO: 14372 - DNA, 20 bp, Artificial Sequence
  chemically synthesized
tgaatcctaaaattatttac

SEQ ID NO: 14373 - DNA, 20 bp, Artificial Sequence
  chemically synthesized
aattatttacaagctttaac

SEQ ID NO: 14374 - DNA, 20 bp, Artificial Sequence
  chemically synthesized
acaagctttaactggatcat

SEQ ID NO: 14375 - DNA, 20 bp, Artificial Sequence
  chemically synthesized
catgagtaaaattatcacat

SEQ ID NO: 14376 - DNA, 20 bp, Artificial Sequence
  chemically synthesized
cagcataactgttaaaattg

SEQ ID NO: 14377 - DNA, 20 bp, Artificial Sequence
  chemically synthesized
agcataactgttaaaattgc

SEQ ID NO: 14378 - DNA, 20 bp, Artificial Sequence
  chemically synthesized
tgttaaaattgcaggctctg

SEQ ID NO: 14379 - DNA, 20 bp, Artificial Sequence
  chemically synthesized
aactacctgcatttaaacca

SEQ ID NO: 14380 - DNA, 20 bp, Artificial Sequence
  chemically synthesized
tacttcacccctttatctct

SEQ ID NO: 14381 - DNA, 20 bp, Artificial Sequence
  chemically synthesized
gtttcctcacatatactaca

SEQ ID NO: 14382 - DNA, 20 bp, Artificial Sequence
  chemically synthesized
atatactacaaagataataa

SEQ ID NO: 14383 - DNA, 20 bp, Artificial Sequence
  chemically synthesized
aaagataataacagaactta

SEQ ID NO: 14384 - DNA, 20 bp, Artificial Sequence
  chemically synthesized
aagataataacagaacttat

SEQ ID NO: 14385 - DNA, 20 bp, Artificial Sequence
  chemically synthesized
agaacttataggattattgt

SEQ ID NO: 14386 - DNA, 20 bp, Artificial Sequence
  chemically synthesized
taagaaaaaaaattaattca

SEQ ID NO: 14387 - DNA, 20 bp, Artificial Sequence
  chemically synthesized
gaaaaaaaattaattcatag

SEQ ID NO: 14388 - DNA, 20 bp, Artificial Sequence
  chemically synthesized
catcttactaaaattcaaat

SEQ ID NO: 14389 - DNA, 20 bp, Artificial Sequence
  chemically synthesized
ctttgctcaaaaccacacaa

SEQ ID NO: 14390 - DNA, 20 bp, Artificial Sequence
  chemically synthesized
gctttccatttcactcatat

SEQ ID NO: 14391 - DNA, 20 bp, Artificial Sequence
  chemically synthesized
tttcactcatattggctctt

SEQ ID NO: 14392 - DNA, 20 bp, Artificial Sequence
  chemically synthesized
tcatattggctctttagacc

SEQ ID NO: 14393 - DNA, 20 bp, Artificial Sequence
  chemically synthesized
ttgggtaatcttggtctaaa

SEQ ID NO: 14394 - DNA, 20 bp, Artificial Sequence
  chemically synthesized
ttggtctaaagagccaatat

SEQ ID NO: 14395 - DNA, 20 bp, Artificial Sequence
  chemically synthesized
aagagccaatatgagtgaaa

SEQ ID NO: 14396 - DNA, 20 bp, Artificial Sequence
  chemically synthesized
gccaatatgagtgaaatgga

SEQ ID NO: 14397 - DNA, 20 bp, Artificial Sequence
  chemically synthesized
tgaaatggaaagctattgtg

SEQ ID NO: 14398 - DNA, 20 bp, Artificial Sequence
  chemically synthesized
gaaagctattgtgtggtttt

SEQ ID NO: 14399 - DNA, 20 bp, Artificial Sequence
  chemically synthesized
ctattgtgtggttttgagca

SEQ ID NO: 14400 - DNA, 20 bp, Artificial Sequence
  chemically synthesized
attgtgtggttttgagcaaa

SEQ ID NO: 14401 - DNA, 20 bp, Artificial Sequence
  chemically synthesized
acatgatctaatttgaattt

SEQ ID NO: 14402 - DNA, 20 bp, Artificial Sequence
  chemically synthesized
gatctaatttgaattttagt

SEQ ID NO: 14403 - DNA, 20 bp, Artificial Sequence
  chemically synthesized
gaattttagtaagatgacat

SEQ ID NO: 14404 - DNA, 20 bp, Artificial Sequence
  chemically synthesized
ttttcttacaataatcctat

SEQ ID NO: 14405 - DNA, 20 bp, Artificial Sequence
  chemically synthesized
aagttctgttattatctttg

SEQ ID NO: 14406 - DNA, 20 bp, Artificial Sequence
  chemically synthesized
attatctttgtagtatatgt

SEQ ID NO: 14407 - DNA, 20 bp, Artificial Sequence
  chemically synthesized
ttatctttgtagtatatgtg

SEQ ID NO: 14408 - DNA, 20 bp, Artificial Sequence
  chemically synthesized
gtagtatatgtgaggaaact

SEQ ID NO: 14409 - DNA, 20 bp, Artificial Sequence
  chemically synthesized
agtatatgtgaggaaactga

SEQ ID NO: 14410 - DNA, 20 bp, Artificial Sequence
  chemically synthesized
tgtgaggaaactgagagata

SEQ ID NO: 14411 - DNA, 20 bp, Artificial Sequence
  chemically synthesized
gtgaggaaactgagagataa

SEQ ID NO: 14412 - DNA, 20 bp, Artificial Sequence
  chemically synthesized
tgaggaaactgagagataaa

SEQ ID NO: 14413 - DNA, 20 bp, Artificial Sequence
  chemically synthesized
gaggaaactgagagataaag

SEQ ID NO: 14414 - DNA, 20 bp, Artificial Sequence
  chemically synthesized
aactgagagataaaggggtg

SEQ ID NO: 14415 - DNA, 20 bp, Artificial Sequence
  chemically synthesized
aggggtgaagtaatttattc

SEQ ID NO: 14416 - DNA, 20 bp, Artificial Sequence
  chemically synthesized
ggggtgaagtaatttattca

SEQ ID NO: 14417 - DNA, 20 bp, Artificial Sequence
  chemically synthesized
aatttattcaaggtcacaca

SEQ ID NO: 14418 - DNA, 20 bp, Artificial Sequence
  chemically synthesized
ttcaaggtcacacaaagttt

SEQ ID NO: 14419 - DNA, 20 bp, Artificial Sequence
  chemically synthesized
caaggtcacacaaagtttta

SEQ ID NO: 14420 - DNA, 20 bp, Artificial Sequence
  chemically synthesized
cacacaaagttttagagcca

SEQ ID NO: 14421 - DNA, 20 bp, Artificial Sequence
  chemically synthesized
ttagagccatggtttaaatg

SEQ ID NO: 14422 - DNA, 20 bp, Artificial Sequence
  chemically synthesized
tagagccatggtttaaatgc

SEQ ID NO: 14423 - DNA, 20 bp, Artificial Sequence
  chemically synthesized
agccatggtttaaatgcagg

SEQ ID NO: 14424 - DNA, 20 bp, Artificial Sequence
  chemically synthesized
tttaaatgcaggtagtttat

SEQ ID NO: 14425 - DNA, 20 bp, Artificial Sequence
  chemically synthesized
tgcaggtagtttattagctt

SEQ ID NO: 14426 - DNA, 20 bp, Artificial Sequence
  chemically synthesized
caggtagtttattagcttca

SEQ ID NO: 14427 - DNA, 20 bp, Artificial Sequence
  chemically synthesized
ttcagagcctgcaattttaa

SEQ ID NO: 14428 - DNA, 20 bp, Artificial Sequence
  chemically synthesized
tgataattttactcatgatc

SEQ ID NO: 14429 - DNA, 20 bp, Artificial Sequence
  chemically synthesized
ttttactcatgatccagtta

SEQ ID NO: 14430 - DNA, 20 bp, Artificial Sequence
  chemically synthesized
ttaaagcttgtaaataattt

SEQ ID NO: 14431 - DNA, 20 bp, Artificial Sequence
  chemically synthesized
taaagcttgtaaataatttt

SEQ ID NO: 14432 - DNA, 20 bp, Artificial Sequence
  chemically synthesized
ttgtaaataattttaggatt

SEQ ID NO: 14433 - DNA, 20 bp, Artificial Sequence
  chemically synthesized
tttaggattcagtgttttta

SEQ ID NO: 14434 - DNA, 20 bp, Artificial Sequence
  chemically synthesized
gtttttacagacctgtgtga

SEQ ID NO: 14435 - DNA, 20 bp, Artificial Sequence
  chemically synthesized
ttacagacctgtgtgaaaga

SEQ ID NO: 14436 - DNA, 20 bp, Artificial Sequence
  chemically synthesized
tacagacctgtgtgaaagat

SEQ ID NO: 14437 - DNA, 20 bp, Artificial Sequence
  chemically synthesized
cttttatttgactatgctgt

SEQ ID NO: 14438 - DNA, 20 bp, Artificial Sequence
  chemically synthesized
gttggtttaattgtttatat

SEQ ID NO: 14439 - DNA, 20 bp, Artificial Sequence
  chemically synthesized
ttgtttatattggtcttcca

SEQ ID NO: 14440 - DNA, 20 bp, Artificial Sequence
  chemically synthesized
tatattggtcttccacggtc

SEQ ID NO: 14441 - DNA, 20 bp, Artificial Sequence
  chemically synthesized
tattggtcttccacggtctg

SEQ ID NO: 14442 - DNA, 20 bp, Artificial Sequence
  chemically synthesized
tggtcttccacggtctggag

SEQ ID NO: 14443 - DNA, 20 bp, Artificial Sequence
  chemically synthesized
ggtcttccacggtctggaga

SEQ ID NO: 14444 - DNA, 20 bp, Artificial Sequence
  chemically synthesized
attatcttgtttttctacaa

SEQ ID NO: 14445 - DNA, 20 bp, Artificial Sequence
  chemically synthesized
cttgtttttctacaaaagtc

SEQ ID NO: 14446 - DNA, 20 bp, Artificial Sequence
  chemically synthesized
tttctacaaaagtctggata

SEQ ID NO: 14447 - DNA, 20 bp, Artificial Sequence
  chemically synthesized
tctacaaaagtctggatata

SEQ ID NO: 14448 - DNA, 20 bp, Artificial Sequence
  chemically synthesized
tacaaaagtctggatataga

SEQ ID NO: 14449 - DNA, 20 bp, Artificial Sequence
  chemically synthesized
aaaagtctggatatagagag

SEQ ID NO: 14450 - DNA, 20 bp, Artificial Sequence
  chemically synthesized
aaagtctggatatagagagt

SEQ ID NO: 14451 - DNA, 20 bp, Artificial Sequence
  chemically synthesized
tctggatatagagagtaggt

SEQ ID NO: 14452 - DNA, 20 bp, Artificial Sequence
  chemically synthesized
atagagagtaggttggttat

SEQ ID NO: 14453 - DNA, 20 bp, Artificial Sequence
  chemically synthesized
ctaaatttttaaactaataa

SEQ ID NO: 14454 - DNA, 20 bp, Artificial Sequence
  chemically synthesized
tggatttgaaaaatgaatat

SEQ ID NO: 14455 - DNA, 20 bp, Artificial Sequence
  chemically synthesized
ccttgtatgcttctttcaaa

SEQ ID NO: 14456 - DNA, 20 bp, Artificial Sequence
  chemically synthesized
attttctgaacttcaattaa

SEQ ID NO: 14457 - DNA, 20 bp, Artificial Sequence
  chemically synthesized
tgaacttcaattaaaagaaa

SEQ ID NO: 14458 - DNA, 20 bp, Artificial Sequence
  chemically synthesized
ttcaattaaaagaaaaagcc

SEQ ID NO: 14459 - DNA, 20 bp, Artificial Sequence
  chemically synthesized
atttaatctgttttaaacac

SEQ ID NO: 14460 - DNA, 20 bp, Artificial Sequence
  chemically synthesized
ttaatctgttttaaacactg

SEQ ID NO: 14461 - DNA, 20 bp, Artificial Sequence
  chemically synthesized
ctgttttaaacactggagaa

SEQ ID NO: 14462 - DNA, 20 bp, Artificial Sequence
  chemically synthesized
tttaactttttacttacctt

SEQ ID NO: 14463 - DNA, 20 bp, Artificial Sequence
  chemically synthesized
ttaccttcagtaatttacaa

SEQ ID NO: 14464 - DNA, 20 bp, Artificial Sequence
  chemically synthesized
tttacaatagtgtaatgaca

SEQ ID NO: 14465 - DNA, 20 bp, Artificial Sequence
  chemically synthesized
agtgtaatgacatagtgttc

SEQ ID NO: 14466 - DNA, 20 bp, Artificial Sequence
  chemically synthesized
tcatataaaatgcaaatttt

SEQ ID NO: 14467 - DNA, 20 bp, Artificial Sequence
  chemically synthesized
agtgttttcatatataacat

SEQ ID NO: 14468 - DNA, 20 bp, Artificial Sequence
  chemically synthesized
gtgttttcatatataacatt

SEQ ID NO: 14469 - DNA, 20 bp, Artificial Sequence
  chemically synthesized
tgttttcatatataacatta

SEQ ID NO: 14470 - DNA, 20 bp, Artificial Sequence
  chemically synthesized
aaactaacttgaaattataa

SEQ ID NO: 14471 - DNA, 20 bp, Artificial Sequence
  chemically synthesized
aactaacttgaaattataat

SEQ ID NO: 14472 - DNA, 20 bp, Artificial Sequence
  chemically synthesized
taataggaaattttattttc

SEQ ID NO: 14473 - DNA, 20 bp, Artificial Sequence
  chemically synthesized
ataggaaattttattttctg

SEQ ID NO: 14474 - DNA, 20 bp, Artificial Sequence
  chemically synthesized
tttctggagattatttttct

SEQ ID NO: 14475 - DNA, 20 bp, Artificial Sequence
  chemically synthesized
attatttttcttggaaaaaa

SEQ ID NO: 14476 - DNA, 20 bp, Artificial Sequence
  chemically synthesized
agtatttcaacaatgcaaca

SEQ ID NO: 14477 - DNA, 20 bp, Artificial Sequence
  chemically synthesized
atgcaacaaagtatttcaaa

SEQ ID NO: 14478 - DNA, 20 bp, Artificial Sequence
  chemically synthesized
gtatttcaaatggcatgcct

SEQ ID NO: 14479 - DNA, 20 bp, Artificial Sequence
  chemically synthesized
cttagaaatattttttttaa

SEQ ID NO: 14480 - DNA, 20 bp, Artificial Sequence
  chemically synthesized
ctttattttctacttacttt

SEQ ID NO: 14481 - DNA, 20 bp, Artificial Sequence
  chemically synthesized
ttttctacttactttaagtg

SEQ ID NO: 14482 - DNA, 20 bp, Artificial Sequence
  chemically synthesized
actttaagtgaagttacttc

SEQ ID NO: 14483 - DNA, 20 bp, Artificial Sequence
  chemically synthesized
ctttaagtgaagttacttct

SEQ ID NO: 14484 - DNA, 20 bp, Artificial Sequence
  chemically synthesized
gaagttacttctgggtgttc

SEQ ID NO: 14485 - DNA, 20 bp, Artificial Sequence
  chemically synthesized
agttacttctgggtgttctg

SEQ ID NO: 14486 - DNA, 20 bp, Artificial Sequence
  chemically synthesized
ttctgggtgttctggagttt

SEQ ID NO: 14487 - DNA, 20 bp, Artificial Sequence
  chemically synthesized
tctgggtgttctggagtttc

SEQ ID NO: 14488 - DNA, 20 bp, Artificial Sequence
  chemically synthesized
tttcaggttgattttgaatt

SEQ ID NO: 14489 - DNA, 20 bp, Artificial Sequence
  chemically synthesized
aggttgattttgaattaagt

SEQ ID NO: 14490 - DNA, 20 bp, Artificial Sequence
  chemically synthesized
tgattttgaattaagttagt

SEQ ID NO: 14491 - DNA, 20 bp, Artificial Sequence
  chemically synthesized
aaatatttcactttttgttg

SEQ ID NO: 14492 - DNA, 20 bp, Artificial Sequence
  chemically synthesized
tatttcactttttgttgaag

SEQ ID NO: 14493 - DNA, 20 bp, Artificial Sequence
  chemically synthesized
tgaagtagaattttttcttc

SEQ ID NO: 14494 - DNA, 20 bp, Artificial Sequence
  chemically synthesized
gaagtagaattttttcttct

SEQ ID NO: 14495 - DNA, 20 bp, Artificial Sequence
  chemically synthesized
agtagaattttttcttctag

SEQ ID NO: 14496 - DNA, 20 bp, Artificial Sequence
  chemically synthesized
gtagaattttttcttctagg

SEQ ID NO: 14497 - DNA, 20 bp, Artificial Sequence
  chemically synthesized
ttttcttctaggaggctttc

SEQ ID NO: 14498 - DNA, 20 bp, Artificial Sequence
  chemically synthesized
ctaggaggctttcaagtttt

SEQ ID NO: 14499 - DNA, 20 bp, Artificial Sequence
  chemically synthesized
aggctttcaagttttgagtt

SEQ ID NO: 14500 - DNA, 20 bp, Artificial Sequence
  chemically synthesized
tcaagttttgagttgagttc

SEQ ID NO: 14501 - DNA, 20 bp, Artificial Sequence
  chemically synthesized
acctcttcatttttgacttg

SEQ ID NO: 14502 - DNA, 20 bp, Artificial Sequence
  chemically synthesized
tttgacttgtagtttatatg

SEQ ID NO: 14503 - DNA, 20 bp, Artificial Sequence
  chemically synthesized
agtttatatgtagttcttct

SEQ ID NO: 14504 - DNA, 20 bp, Artificial Sequence
  chemically synthesized
ttcttcttctttgatttcac

SEQ ID NO: 14505 - DNA, 20 bp, Artificial Sequence
  chemically synthesized
tctttgatttcactggtttg

SEQ ID NO: 14506 - DNA, 20 bp, Artificial Sequence
  chemically synthesized
atttcactggtttgcagcga

SEQ ID NO: 14507 - DNA, 20 bp, Artificial Sequence
  chemically synthesized
ttgcagcgatagatcataaa

SEQ ID NO: 14508 - DNA, 20 bp, Artificial Sequence
  chemically synthesized
aaagactgatcaaatatgtt

SEQ ID NO: 14509 - DNA, 20 bp, Artificial Sequence
  chemically synthesized
tttgaaatatgtcattaatt

SEQ ID NO: 14510 - DNA, 20 bp, Artificial Sequence
  chemically synthesized
taatttggcccttcgtctta

SEQ ID NO: 14511 - DNA, 20 bp, Artificial Sequence
  chemically synthesized
ggcccttcgtcttatggaca

SEQ ID NO: 14512 - DNA, 20 bp, Artificial Sequence
  chemically synthesized
gtcttatggacaaagtcttt

SEQ ID NO: 14513 - DNA, 20 bp, Artificial Sequence
  chemically synthesized
ttaagaccatgtcccaactg

SEQ ID NO: 14514 - DNA, 20 bp, Artificial Sequence
  chemically synthesized
taagaccatgtcccaactga

SEQ ID NO: 14515 - DNA, 20 bp, Artificial Sequence
  chemically synthesized
agaccatgtcccaactgaag

SEQ ID NO: 14516 - DNA, 20 bp, Artificial Sequence
  chemically synthesized
gaccatgtcccaactgaagg

SEQ ID NO: 14517 - DNA, 20 bp, Artificial Sequence
  chemically synthesized
tcccaactgaaggaggccat

SEQ ID NO: 14518 - DNA, 20 bp, Artificial Sequence
  chemically synthesized
aatttttacatcgtctaaca

SEQ ID NO: 14519 - DNA, 20 bp, Artificial Sequence
  chemically synthesized
aacatagcaaatcttgattt

SEQ ID NO: 14520 - DNA, 20 bp, Artificial Sequence
  chemically synthesized
gcaaatcttgattttggctc

SEQ ID NO: 14521 - DNA, 20 bp, Artificial Sequence
  chemically synthesized
aaatcttgattttggctctg

SEQ ID NO: 14522 - DNA, 20 bp, Artificial Sequence
  chemically synthesized
cttgattttggctctggaga

SEQ ID NO: 14523 - DNA, 20 bp, Artificial Sequence
  chemically synthesized
tgattttggctctggagata

SEQ ID NO: 14524 - DNA, 20 bp, Artificial Sequence
  chemically synthesized
tgaattgtcttgatcaattc

SEQ ID NO: 14525 - DNA, 20 bp, Artificial Sequence
  chemically synthesized
aattgtcttgatcaattctg

SEQ ID NO: 14526 - DNA, 20 bp, Artificial Sequence
  chemically synthesized
attgtcttgatcaattctgg

SEQ ID NO: 14527 - DNA, 20 bp, Artificial Sequence
  chemically synthesized
tcaattctggaggaaataac

SEQ ID NO: 14528 - DNA, 20 bp, Artificial Sequence
  chemically synthesized
aattctggaggaaataacta

SEQ ID NO: 14529 - DNA, 20 bp, Artificial Sequence
  chemically synthesized
attctggaggaaataactag

SEQ ID NO: 14530 - DNA, 20 bp, Artificial Sequence
  chemically synthesized
ataactagaggaacaataaa

SEQ ID NO: 14531 - DNA, 20 bp, Artificial Sequence
  chemically synthesized
actagaggaacaataaaaag

SEQ ID NO: 14532 - DNA, 20 bp, Artificial Sequence
  chemically synthesized
ctagaggaacaataaaaaga

SEQ ID NO: 14533 - DNA, 20 bp, Artificial Sequence
  chemically synthesized
agaggaacaataaaaagaag

SEQ ID NO: 14534 - DNA, 20 bp, Artificial Sequence
  chemically synthesized
ttatcttgattttcaatttc

SEQ ID NO: 14535 - DNA, 20 bp, Artificial Sequence
  chemically synthesized
attttcaatttcaagcaacg

SEQ ID NO: 14536 - DNA, 20 bp, Artificial Sequence
  chemically synthesized
aacgtggaactgttttcttc

SEQ ID NO: 14537 - DNA, 20 bp, Artificial Sequence
  chemically synthesized
gtggaactgttttcttctgg

SEQ ID NO: 14538 - DNA, 20 bp, Artificial Sequence
  chemically synthesized
gaactgttttcttctggaag

SEQ ID NO: 14539 - DNA, 20 bp, Artificial Sequence
  chemically synthesized
ttttcttctggaagcagacc

SEQ ID NO: 14540 - DNA, 20 bp, Artificial Sequence
  chemically synthesized
tatatataccaatatttgcc

SEQ ID NO: 14541 - DNA, 20 bp, Artificial Sequence
  chemically synthesized
ataccaatatttgcccagaa

SEQ ID NO: 14542 - DNA, 20 bp, Artificial Sequence
  chemically synthesized
taccaatatttgcccagaaa

SEQ ID NO: 14543 - DNA, 20 bp, Artificial Sequence
  chemically synthesized
aatatttgcccagaaaaggt

SEQ ID NO: 14544 - DNA, 20 bp, Artificial Sequence
  chemically synthesized
atatttgcccagaaaaggta

SEQ ID NO: 14545 - DNA, 20 bp, Artificial Sequence
  chemically synthesized
ttgcccagaaaaggtaaggt

SEQ ID NO: 14546 - DNA, 20 bp, Artificial Sequence
  chemically synthesized
cccagaaaaggtaaggttgg

SEQ ID NO: 14547 - DNA, 20 bp, Artificial Sequence
  chemically synthesized
ccagaaaaggtaaggttggt

SEQ ID NO: 14548 - DNA, 20 bp, Artificial Sequence
  chemically synthesized
gtaaggttggtaggtgaaca

SEQ ID NO: 14549 - DNA, 20 bp, Artificial Sequence
  chemically synthesized
ggtgaacatagttaatcatt

SEQ ID NO: 14550 - DNA, 20 bp, Artificial Sequence
  chemically synthesized
atgtaaccttcttccacatt

SEQ ID NO: 14551 - DNA, 20 bp, Artificial Sequence
  chemically synthesized
aaccttcttccacattgagt

SEQ ID NO: 14552 - DNA, 20 bp, Artificial Sequence
  chemically synthesized
atcaatgctaaatgaaatca

SEQ ID NO: 14553 - DNA, 20 bp, Artificial Sequence
  chemically synthesized
ctaaatgaaatcaaagaaat

SEQ ID NO: 14554 - DNA, 20 bp, Artificial Sequence
  chemically synthesized
gaaatgagcaactaacttaa

SEQ ID NO: 14555 - DNA, 20 bp, Artificial Sequence
  chemically synthesized
aaatgagcaactaacttaat

SEQ ID NO: 14556 - DNA, 20 bp, Artificial Sequence
  chemically synthesized
aaactacacattcaatgcta

SEQ ID NO: 14557 - DNA, 20 bp, Artificial Sequence
  chemically synthesized
tggtgactacctgtttttaa

SEQ ID NO: 14558 - DNA, 20 bp, Artificial Sequence
  chemically synthesized
ttttacttttttatgatttt

SEQ ID NO: 14559 - DNA, 20 bp, Artificial Sequence
  chemically synthesized
ttacttttttatgattttaa

SEQ ID NO: 14560 - DNA, 20 bp, Artificial Sequence
  chemically synthesized
tatgattttaagagatttac

SEQ ID NO: 14561 - DNA, 20 bp, Artificial Sequence
  chemically synthesized
tcaaaaataaacttttttgt

SEQ ID NO: 14562 - DNA, 20 bp, Artificial Sequence
  chemically synthesized
caaaaataaacttttttgtt

SEQ ID NO: 14563 - DNA, 20 bp, Artificial Sequence
  chemically synthesized
gttgggtaaatttattatta

SEQ ID NO: 14564 - DNA, 20 bp, Artificial Sequence
  chemically synthesized
gtaaatttattattaaagtt

SEQ ID NO: 14565 - DNA, 20 bp, Artificial Sequence
  chemically synthesized
taaatttattattaaagttg

SEQ ID NO: 14566 - DNA, 20 bp, Artificial Sequence
  chemically synthesized
aaatttattattaaagttga

SEQ ID NO: 14567 - DNA, 20 bp, Artificial Sequence
  chemically synthesized
aatttattattaaagttgag

SEQ ID NO: 14568 - DNA, 20 bp, Artificial Sequence
  chemically synthesized
tattaaagttgaggggaaaa

SEQ ID NO: 14569 - DNA, 20 bp, Artificial Sequence
  chemically synthesized
ggggaaaaaagtaatgaatt

SEQ ID NO: 14570 - DNA, 20 bp, Artificial Sequence
  chemically synthesized
aacaggtagtcaccatagca

SEQ ID NO: 14571 - DNA, 20 bp, Artificial Sequence
  chemically synthesized
tgggcaaatattggtatata

SEQ ID NO: 14572 - DNA, 20 bp, Artificial Sequence
  chemically synthesized
gttcctctagttatttcctc

SEQ ID NO: 14573 - DNA, 20 bp, Artificial Sequence
  chemically synthesized
aagtcaaaaatgaagaggta

SEQ ID NO: 14574 - DNA, 20 bp, Artificial Sequence
  chemically synthesized
taaagtaagtagaaaataaa

SEQ ID NO: 14575 - DNA, 20 bp, Artificial Sequence
  chemically synthesized
ttcatgtttatgttttcaat

SEQ ID NO: 14576 - DNA, 20 bp, Artificial Sequence
  chemically synthesized
gaaagaagcatacaagggga

SEQ ID NO: 14577 - DNA, 20 bp, Artificial Sequence
  chemically synthesized
cacacaggtctgtaaaaaca

SEQ ID NO: 14578 - DNA, 20 bp, Artificial Sequence
  chemically synthesized
aaattatttacaagctttaa

SEQ ID NO: 14579 - DNA, 20 bp, Artificial Sequence
  chemically synthesized
ttacaagctttaactggatc

SEQ ID NO: 14580 - DNA, 20 bp, Artificial Sequence
  chemically synthesized
ctctaaaactttgtgtgacc

SEQ ID NO: 14581 - DNA, 20 bp, Artificial Sequence
  chemically synthesized
aaagataataacagaactta

SEQ ID NO: 14582 - DNA, 20 bp, Artificial Sequence
  chemically synthesized
tcttggtctaaagagccaat

SEQ ID NO: 14583 - DNA, 20 bp, Artificial Sequence
  chemically synthesized
aaagagaaacatgatctaat

SEQ ID NO: 14584 - DNA, 20 bp, Artificial Sequence
  chemically synthesized
gtaagatgacattggctgct

SEQ ID NO: 14585 - DNA, 20 bp, Artificial Sequence
  chemically synthesized
gtgaggaaactgagagataa

SEQ ID NO: 14586 - DNA, 20 bp, Artificial Sequence
  chemically synthesized
ttaaagcttgtaaataattt

SEQ ID NO: 14587 - DNA, 20 bp, Artificial Sequence
  chemically synthesized
tcttgtttttctacaaaagt

SEQ ID NO: 14588 - DNA, 20 bp, Artificial Sequence
  chemically synthesized
tctacaaaagtctggatata

SEQ ID NO: 14589 - DNA, 20 bp, Artificial Sequence
  chemically synthesized
tctaaatttttaaactaata

SEQ ID NO: 14590 - DNA, 20 bp, Artificial Sequence
  chemically synthesized
actaataatggatttgaaaa

SEQ ID NO: 14591 - DNA, 20 bp, Artificial Sequence
  chemically synthesized
aaagcccagcatattttcat

SEQ ID NO: 14592 - DNA, 20 bp, Artificial Sequence
  chemically synthesized
ttaatctgttttaaacactg

SEQ ID NO: 14593 - DNA, 20 bp, Artificial Sequence
  chemically synthesized
tactttaagtgaagttactt

SEQ ID NO: 14594 - DNA, 20 bp, Artificial Sequence
  chemically synthesized
gaagttacttctgggtgttc

SEQ ID NO: 14595 - DNA, 20 bp, Artificial Sequence
  chemically synthesized
tctggagtttcaggttgatt

SEQ ID NO: 14596 - DNA, 20 bp, Artificial Sequence
  chemically synthesized
tatttcactttttgttgaag

SEQ ID NO: 14597 - DNA, 20 bp, Artificial Sequence
  chemically synthesized
ttctaggaggctttcaagtt

SEQ ID NO: 14598 - DNA, 20 bp, Artificial Sequence
  chemically synthesized
ggaggctttcaagttttgag

SEQ ID NO: 14599 - DNA, 20 bp, Artificial Sequence
  chemically synthesized
aaaaagactgatcaaatatg

SEQ ID NO: 14600 - DNA, 20 bp, Artificial Sequence
  chemically synthesized
tgattttggctctggagata

SEQ ID NO: 14601 - DNA, 20 bp, Artificial Sequence
  chemically synthesized
tggagatagagaatcaaatg

SEQ ID NO: 14602 - DNA, 20 bp, Artificial Sequence
  chemically synthesized
attaagccgtgttaacttgc

SEQ ID NO: 14603 - DNA, 20 bp, Artificial Sequence
  chemically synthesized
gaatgtaaccttcttccaca

SEQ ID NO: 14604 - DNA, 20 bp, Artificial Sequence
  chemically synthesized
gtcaaaaataaacttttttg

SEQ ID NO: 14605 - DNA, 20 bp, Artificial Sequence
  chemically synthesized
aagttgaggggaaaaaagta

SEQ ID NO: 14606 - DNA, 20 bp, Artificial Sequence
  chemically synthesized
gaagtctaggtctgcttcca

SEQ ID NO: 14607 - DNA, 20 bp, Artificial Sequence
  chemically synthesized
tgttcctctagttatttcct

SEQ ID NO: 14608 - DNA, 20 bp, Artificial Sequence
  chemically synthesized
aaaccagtgaaatcaaagaa

SEQ ID NO: 14609 - DNA, 20 bp, Artificial Sequence
  chemically synthesized
caagtcaaaaatgaagaggt

SEQ ID NO: 14610 - DNA, 20 bp, Artificial Sequence
  chemically synthesized
caaaacttgaaagcctccta

SEQ ID NO: 14611 - DNA, 20 bp, Artificial Sequence
  chemically synthesized
agtaacttcacttaaagtaa

SEQ ID NO: 14612 - DNA, 20 bp, Artificial Sequence
  chemically synthesized
tgttgaaatacttttttttc

SEQ ID NO: 14613 - DNA, 20 bp, Artificial Sequence
  chemically synthesized
ttttccaagaaaaataatct

SEQ ID NO: 14614 - DNA, 20 bp, Artificial Sequence
  chemically synthesized
ctttttcttttaattgaagt

SEQ ID NO: 14615 - DNA, 20 bp, Artificial Sequence
  chemically synthesized
gatagtgttacaggaaatta

SEQ ID NO: 14616 - DNA, 20 bp, Artificial Sequence
  chemically synthesized
tgttacaggaaattaataga

SEQ ID NO: 14617 - DNA, 20 bp, Artificial Sequence
  chemically synthesized
ctctctatatccagactttt

SEQ ID NO: 14618 - DNA, 20 bp, Artificial Sequence
  chemically synthesized
accaacagcatagtcaaata

SEQ ID NO: 14619 - DNA, 20 bp, Artificial Sequence
  chemically synthesized
agcatagtcaaataaaagaa

SEQ ID NO: 14620 - DNA, 20 bp, Artificial Sequence
  chemically synthesized
cagaacttataggattattg

SEQ ID NO: 14621 - DNA, 20 bp, Artificial Sequence
  chemically synthesized
tattgtgtggttttgagcaa

SEQ ID NO: 14622 - DNA, 20 bp, Artificial Sequence
  chemically synthesized
gattttctgaacttcaatta

SEQ ID NO: 14623 - DNA, 20 bp, Artificial Sequence
  chemically synthesized
tttaatctgttttaaacact

SEQ ID NO: 14624 - DNA, 20 bp, Artificial Sequence
  chemically synthesized
agtatttcaaatggcatgcc

SEQ ID NO: 14625 - DNA, 20 bp, Artificial Sequence
  chemically synthesized
atatttcactttttgttgaa

SEQ ID NO: 14626 - DNA, 20 bp, Artificial Sequence
  chemically synthesized
ttgattttggctctggagat

SEQ ID NO: 14627 - DNA, 20 bp, Artificial Sequence
  chemically synthesized
ctatatataccaatatttgc

SEQ ID NO: 14628 - DNA, 20 bp, Artificial Sequence
  chemically synthesized
gatcaatgctaaatgaaatc

SEQ ID NO: 14629 - DNA, 20 bp, Artificial Sequence
  chemically synthesized
aaaaagtaaaattagctttt

SEQ ID NO: 14630 - DNA, 20 bp, Artificial Sequence
  chemically synthesized
gtctaggtctgcttccagaa

SEQ ID NO: 14631 - DNA, 20 bp, Artificial Sequence
  chemically synthesized
ccaaattaatgacatatttc

SEQ ID NO: 14632 - DNA, 20 bp, Artificial Sequence
  chemically synthesized
tatgtcacttgaactcaact

SEQ ID NO: 14633 - DNA, 20 bp, Artificial Sequence
  chemically synthesized
gtttccctaatgttatatat

SEQ ID NO: 14634 - DNA, 20 bp, Artificial Sequence
  chemically synthesized
gtaaaaagttaaaaaaaatt

SEQ ID NO: 14635 - DNA, 20 bp, Artificial Sequence
  chemically synthesized
taaaactattctccagtgtt

SEQ ID NO: 14636 - DNA, 20 bp, Artificial Sequence
  chemically synthesized
ctatatccagacttttgtag

SEQ ID NO: 14637 - DNA, 20 bp, Artificial Sequence
  chemically synthesized
catctttcacacaggtctgt

SEQ ID NO: 14638 - DNA, 20 bp, Artificial Sequence
  chemically synthesized
ctgcatttaaaccatggctc

SEQ ID NO: 14639 - DNA, 20 bp, Artificial Sequence
  chemically synthesized
agatcatgtttctctttgct

SEQ ID NO: 14640 - DNA, 20 bp, Artificial Sequence
  chemically synthesized
tatataacattagggaaaca

SEQ ID NO: 14641 - DNA, 20 bp, Artificial Sequence
  chemically synthesized
ttttttaaaagatccacatt

SEQ ID NO: 14642 - DNA, 20 bp, Artificial Sequence
  chemically synthesized
ataataaatttacccaacaa

SEQ ID NO: 14643 - DNA, 20 bp, Artificial Sequence
  chemically synthesized
taaaatcataaaaaagtaaa

SEQ ID NO: 14644 - DNA, 20 bp, Artificial Sequence
  chemically synthesized
agtcaccatagcattgaatg

SEQ ID NO: 14645 - DNA, 20 bp, Artificial Sequence
  chemically synthesized
attaagttagttgctcattt

SEQ ID NO: 14646 - DNA, 20 bp, Artificial Sequence
  chemically synthesized
gttacattcgtgcaagttaa

SEQ ID NO: 14647 - DNA, 20 bp, Artificial Sequence
  chemically synthesized
tcgtgcaagttaacacggct

SEQ ID NO: 14648 - DNA, 20 bp, Artificial Sequence
  chemically synthesized
tatagagttaagaagtctag

SEQ ID NO: 14649 - DNA, 20 bp, Artificial Sequence
  chemically synthesized
tccagaagaaaacagttcca

SEQ ID NO: 14650 - DNA, 20 bp, Artificial Sequence
  chemically synthesized
attgatcaagacaattcatc

SEQ ID NO: 14651 - DNA, 20 bp, Artificial Sequence
  chemically synthesized
ctctatctccagagccaaaa

SEQ ID NO: 14652 - DNA, 20 bp, Artificial Sequence
  chemically synthesized
aagtagaaaataaagagggt

SEQ ID NO: 14653 - DNA, 20 bp, Artificial Sequence
  chemically synthesized
aaaataaagagggttcatgt

SEQ ID NO: 14654 - DNA, 20 bp, Artificial Sequence
  chemically synthesized
atttcctattataatttcaa

SEQ ID NO: 14655 - DNA, 20 bp, Artificial Sequence
  chemically synthesized
attataatttcaagttagtt

SEQ ID NO: 14656 - DNA, 20 bp, Artificial Sequence
  chemically synthesized
aaaaatttaaaactattctc

SEQ ID NO: 14657 - DNA, 20 bp, Artificial Sequence
  chemically synthesized
aactattctccagtgtttaa

SEQ ID NO: 14658 - DNA, 20 bp, Artificial Sequence
  chemically synthesized
ttaaataatacagtaaatgg

SEQ ID NO: 14659 - DNA, 20 bp, Artificial Sequence
  chemically synthesized
tttattcatatgaaaatatg

SEQ ID NO: 14660 - DNA, 20 bp, Artificial Sequence
  chemically synthesized
attcatttttcaaatccatt

SEQ ID NO: 14661 - DNA, 20 bp, Artificial Sequence
  chemically synthesized
atccattattagtttaaaaa

SEQ ID NO: 14662 - DNA, 20 bp, Artificial Sequence
  chemically synthesized
actgaatcctaaaattattt

SEQ ID NO: 14663 - DNA, 20 bp, Artificial Sequence
  chemically synthesized
attacttcacccctttatct

SEQ ID NO: 14664 - DNA, 20 bp, Artificial Sequence
  chemically synthesized
caaagataataacagaactt

SEQ ID NO: 14665 - DNA, 20 bp, Artificial Sequence
  chemically synthesized
ttactaaaattcaaattaga

SEQ ID NO: 14666 - DNA, 20 bp, Artificial Sequence
  chemically synthesized
ctctttgctcaaaaccacac

SEQ ID NO: 14667 - DNA, 20 bp, Artificial Sequence
  chemically synthesized
actcatattggctctttaga

SEQ ID NO: 14668 - DNA, 20 bp, Artificial Sequence
  chemically synthesized
agtgaaatggaaagctattg

SEQ ID NO: 14669 - DNA, 20 bp, Artificial Sequence
  chemically synthesized
gtaatttattcaaggtcaca

SEQ ID NO: 14670 - DNA, 20 bp, Artificial Sequence
  chemically synthesized
gtcacacaaagttttagagc

SEQ ID NO: 14671 - DNA, 20 bp, Artificial Sequence
  chemically synthesized
agagccatggtttaaatgca

SEQ ID NO: 14672 - DNA, 20 bp, Artificial Sequence
  chemically synthesized
ggtttaaatgcaggtagttt

SEQ ID NO: 14673 - DNA, 20 bp, Artificial Sequence
  chemically synthesized
aattttactcatgatccagt

SEQ ID NO: 14674 - DNA, 20 bp, Artificial Sequence
  chemically synthesized
gttaaagcttgtaaataatt

SEQ ID NO: 14675 - DNA, 20 bp, Artificial Sequence
  chemically synthesized
ttgtaaataattttaggatt

SEQ ID NO: 14676 - DNA, 20 bp, Artificial Sequence
  chemically synthesized
taccattaaaatactgactt

SEQ ID NO: 14677 - DNA, 20 bp, Artificial Sequence
  chemically synthesized
ttcttttatttgactatgct

SEQ ID NO: 14678 - DNA, 20 bp, Artificial Sequence
  chemically synthesized
tttgactatgctgttggttt

SEQ ID NO: 14679 - DNA, 20 bp, Artificial Sequence
  chemically synthesized
gaaggtctttgatgctatta

SEQ ID NO: 14680 - DNA, 20 bp, Artificial Sequence
  chemically synthesized
tagagagtaggttggttata

SEQ ID NO: 14681 - DNA, 20 bp, Artificial Sequence
  chemically synthesized
atctaaatttttaaactaat

SEQ ID NO: 14682 - DNA, 20 bp, Artificial Sequence
  chemically synthesized
attggcaattccttcccctt

SEQ ID NO: 14683 - DNA, 20 bp, Artificial Sequence
  chemically synthesized
taaattgtactatctctaaa

SEQ ID NO: 14684 - DNA, 20 bp, Artificial Sequence
  chemically synthesized
tccatttactgtattattta

SEQ ID NO: 14685 - DNA, 20 bp, Artificial Sequence
  chemically synthesized
atctgttttaaacactggag

SEQ ID NO: 14686 - DNA, 20 bp, Artificial Sequence
  chemically synthesized
atagtgtaatgacatagtgt

SEQ ID NO: 14687 - DNA, 20 bp, Artificial Sequence
  chemically synthesized
tgttctagattgtataattt

SEQ ID NO: 14688 - DNA, 20 bp, Artificial Sequence
  chemically synthesized
tcatataaaatgcaaatttt

SEQ ID NO: 14689 - DNA, 20 bp, Artificial Sequence
  chemically synthesized
taataggaaattttattttc

SEQ ID NO: 14690 - DNA, 20 bp, Artificial Sequence
  chemically synthesized
gaagttacttctgggtgttc

SEQ ID NO: 14691 - DNA, 20 bp, Artificial Sequence
  chemically synthesized
ctgggtgttctggagtttca

SEQ ID NO: 14692 - DNA, 20 bp, Artificial Sequence
  chemically synthesized
aagtagaattttttcttcta

SEQ ID NO: 14693 - DNA, 20 bp, Artificial Sequence
  chemically synthesized
ttttttcttctaggaggctt

SEQ ID NO: 14694 - DNA, 20 bp, Artificial Sequence
  chemically synthesized
ttacctcttcatttttgact

SEQ ID NO: 14695 - DNA, 20 bp, Artificial Sequence
  chemically synthesized
tctcagttccttttcttctt

SEQ ID NO: 14696 - DNA, 20 bp, Artificial Sequence
  chemically synthesized
ttttcttcttctttgatttc

SEQ ID NO: 14697 - DNA, 20 bp, Artificial Sequence
  chemically synthesized
aaaaagactgatcaaatatg

SEQ ID NO: 14698 - DNA, 20 bp, Artificial Sequence
  chemically synthesized
acatcgtctaacatagcaaa

SEQ ID NO: 14699 - DNA, 20 bp, Artificial Sequence
  chemically synthesized
ctagaggaacaataaaaaga

SEQ ID NO: 14700 - DNA, 20 bp, Artificial Sequence
  chemically synthesized
cttaattgtgaacattttta

SEQ ID NO: 14701 - DNA, 20 bp, Artificial Sequence
  chemically synthesized
ttcaatttcaagcaacgtgg

SEQ ID NO: 14702 - DNA, 20 bp, Artificial Sequence
  chemically synthesized
cattcaatgctatggtgact

SEQ ID NO: 14703 - DNA, 20 bp, Artificial Sequence
  chemically synthesized
taaaagctaattttactttt

SEQ ID NO: 14704 - DNA, 20 bp, Artificial Sequence
  chemically synthesized
ttttacttttttatgatttt

SEQ ID NO: 14705 - DNA, 22 bp, Artificial Sequence
  chemically synthesized
aattcattacttttttcccctc

SEQ ID NO: 14706 - DNA, 22 bp, Artificial Sequence
  chemically synthesized
attcattacttttttcccctca

SEQ ID NO: 14707 - DNA, 22 bp, Artificial Sequence
  chemically synthesized
attacttttttcccctcaactt

SEQ ID NO: 14708 - DNA, 22 bp, Artificial Sequence
  chemically synthesized
cttttttcccctcaactttaat

SEQ ID NO: 14709 - DNA, 22 bp, Artificial Sequence
  chemically synthesized
ttttcccctcaactttaataat

SEQ ID NO: 14710 - DNA, 22 bp, Artificial Sequence
  chemically synthesized
tttcccctcaactttaataata

SEQ ID NO: 14711 - DNA, 22 bp, Artificial Sequence
  chemically synthesized
ttcccctcaactttaataataa

SEQ ID NO: 14712 - DNA, 22 bp, Artificial Sequence
  chemically synthesized
tcccctcaactttaataataaa

SEQ ID NO: 14713 - DNA, 22 bp, Artificial Sequence
  chemically synthesized
cccctcaactttaataataaat

SEQ ID NO: 14714 - DNA, 22 bp, Artificial Sequence
  chemically synthesized
ccctcaactttaataataaatt

SEQ ID NO: 14715 - DNA, 22 bp, Artificial Sequence
  chemically synthesized
aactttaataataaatttaccc

SEQ ID NO: 14716 - DNA, 22 bp, Artificial Sequence
  chemically synthesized
taataataaatttacccaacaa

SEQ ID NO: 14717 - DNA, 22 bp, Artificial Sequence
  chemically synthesized
aataataaatttacccaacaaa

SEQ ID NO: 14718 - DNA, 22 bp, Artificial Sequence
  chemically synthesized
ataataaatttacccaacaaaa

SEQ ID NO: 14719 - DNA, 22 bp, Artificial Sequence
  chemically synthesized
acccaacaaaaaagtttatttt

SEQ ID NO: 14720 - DNA, 22 bp, Artificial Sequence
  chemically synthesized
cccaacaaaaaagtttattttt

SEQ ID NO: 14721 - DNA, 22 bp, Artificial Sequence
  chemically synthesized
atttttgacttgtaaatctctt

SEQ ID NO: 14722 - DNA, 22 bp, Artificial Sequence
  chemically synthesized
tttttgacttgtaaatctctta

SEQ ID NO: 14723 - DNA, 22 bp, Artificial Sequence
  chemically synthesized
ttgacttgtaaatctcttaaaa

SEQ ID NO: 14724 - DNA, 22 bp, Artificial Sequence
  chemically synthesized
tgacttgtaaatctcttaaaat

SEQ ID NO: 14725 - DNA, 22 bp, Artificial Sequence
  chemically synthesized
gacttgtaaatctcttaaaatc

SEQ ID NO: 14726 - DNA, 22 bp, Artificial Sequence
  chemically synthesized
acttgtaaatctcttaaaatca

SEQ ID NO: 14727 - DNA, 22 bp, Artificial Sequence
  chemically synthesized
gtaaatctcttaaaatcataaa

SEQ ID NO: 14728 - DNA, 22 bp, Artificial Sequence
  chemically synthesized
taaatctcttaaaatcataaaa

SEQ ID NO: 14729 - DNA, 22 bp, Artificial Sequence
  chemically synthesized
ttaaaatcataaaaaagtaaaa

SEQ ID NO: 14730 - DNA, 22 bp, Artificial Sequence
  chemically synthesized
aaaatcataaaaaagtaaaatt

SEQ ID NO: 14731 - DNA, 22 bp, Artificial Sequence
  chemically synthesized
aaatcataaaaaagtaaaatta

SEQ ID NO: 14732 - DNA, 22 bp, Artificial Sequence
  chemically synthesized
gcttttaaaaacaggtagtcac

SEQ ID NO: 14733 - DNA, 22 bp, Artificial Sequence
  chemically synthesized
ttaaaaacaggtagtcaccata

SEQ ID NO: 14734 - DNA, 22 bp, Artificial Sequence
  chemically synthesized
taaaaacaggtagtcaccatag

SEQ ID NO: 14735 - DNA, 22 bp, Artificial Sequence
  chemically synthesized
aaaaacaggtagtcaccatagc

SEQ ID NO: 14736 - DNA, 22 bp, Artificial Sequence
  chemically synthesized
aaaacaggtagtcaccatagca

SEQ ID NO: 14737 - DNA, 22 bp, Artificial Sequence
  chemically synthesized
aatgtgtagtttataatacagc

SEQ ID NO: 14738 - DNA, 22 bp, Artificial Sequence
  chemically synthesized
ataatacagcaaagttaaatac

SEQ ID NO: 14739 - DNA, 22 bp, Artificial Sequence
  chemically synthesized
taatacagcaaagttaaataca

SEQ ID NO: 14740 - DNA, 22 bp, Artificial Sequence
  chemically synthesized
aatacaatttcaaattacctat

SEQ ID NO: 14741 - DNA, 22 bp, Artificial Sequence
  chemically synthesized
caaattacctattaagttagtt

SEQ ID NO: 14742 - DNA, 22 bp, Artificial Sequence
  chemically synthesized
aaattacctattaagttagttg

SEQ ID NO: 14743 - DNA, 22 bp, Artificial Sequence
  chemically synthesized
cctattaagttagttgctcatt

SEQ ID NO: 14744 - DNA, 22 bp, Artificial Sequence
  chemically synthesized
ttaagttagttgctcatttctt

SEQ ID NO: 14745 - DNA, 22 bp, Artificial Sequence
  chemically synthesized
agttagttgctcatttctttga

SEQ ID NO: 14746 - DNA, 22 bp, Artificial Sequence
  chemically synthesized
gttgctcatttctttgatttca

SEQ ID NO: 14747 - DNA, 22 bp, Artificial Sequence
  chemically synthesized
ctcatttctttgatttcattta

SEQ ID NO: 14748 - DNA, 22 bp, Artificial Sequence
  chemically synthesized
atttctttgatttcatttagca

SEQ ID NO: 14749 - DNA, 22 bp, Artificial Sequence
  chemically synthesized
ctttgatttcatttagcattga

SEQ ID NO: 14750 - DNA, 22 bp, Artificial Sequence
  chemically synthesized
tttgatttcatttagcattgat

SEQ ID NO: 14751 - DNA, 22 bp, Artificial Sequence
  chemically synthesized
tgatttcatttagcattgatct

SEQ ID NO: 14752 - DNA, 22 bp, Artificial Sequence
  chemically synthesized
gatttcatttagcattgatcta

SEQ ID NO: 14753 - DNA, 22 bp, Artificial Sequence
  chemically synthesized
atttcatttagcattgatctaa

SEQ ID NO: 14754 - DNA, 22 bp, Artificial Sequence
  chemically synthesized
catttagcattgatctaactca

SEQ ID NO: 14755 - DNA, 22 bp, Artificial Sequence
  chemically synthesized
atttagcattgatctaactcaa

SEQ ID NO: 14756 - DNA, 22 bp, Artificial Sequence
  chemically synthesized
agcattgatctaactcaatgtg

SEQ ID NO: 14757 - DNA, 22 bp, Artificial Sequence
  chemically synthesized
gcattgatctaactcaatgtgg

SEQ ID NO: 14758 - DNA, 22 bp, Artificial Sequence
  chemically synthesized
atctaactcaatgtggaagaag

SEQ ID NO: 14759 - DNA, 22 bp, Artificial Sequence
  chemically synthesized
actcaatgtggaagaaggttac

SEQ ID NO: 14760 - DNA, 22 bp, Artificial Sequence
  chemically synthesized
aatgtggaagaaggttacattc

SEQ ID NO: 14761 - DNA, 22 bp, Artificial Sequence
  chemically synthesized
cattcgtgcaagttaacacggc

SEQ ID NO: 14762 - DNA, 22 bp, Artificial Sequence
  chemically synthesized
gtgcaagttaacacggcttaat

SEQ ID NO: 14763 - DNA, 22 bp, Artificial Sequence
  chemically synthesized
acacggcttaatgattaactat

SEQ ID NO: 14764 - DNA, 22 bp, Artificial Sequence
  chemically synthesized
aatgattaactatgttcaccta

SEQ ID NO: 14765 - DNA, 22 bp, Artificial Sequence
  chemically synthesized
atgattaactatgttcacctac

SEQ ID NO: 14766 - DNA, 22 bp, Artificial Sequence
  chemically synthesized
actatgttcacctaccaacctt

SEQ ID NO: 14767 - DNA, 22 bp, Artificial Sequence
  chemically synthesized
tgttcacctaccaaccttacct

SEQ ID NO: 14768 - DNA, 22 bp, Artificial Sequence
  chemically synthesized
acctaccaaccttaccttttct

SEQ ID NO: 14769 - DNA, 22 bp, Artificial Sequence
  chemically synthesized
ccaaccttaccttttctgggca

SEQ ID NO: 14770 - DNA, 22 bp, Artificial Sequence
  chemically synthesized
accttttctgggcaaatattgg

SEQ ID NO: 14771 - DNA, 22 bp, Artificial Sequence
  chemically synthesized
ccttttctgggcaaatattggt

SEQ ID NO: 14772 - DNA, 22 bp, Artificial Sequence
  chemically synthesized
ttctgggcaaatattggtatat

SEQ ID NO: 14773 - DNA, 22 bp, Artificial Sequence
  chemically synthesized
tctgggcaaatattggtatata

SEQ ID NO: 14774 - DNA, 22 bp, Artificial Sequence
  chemically synthesized
ctgggcaaatattggtatatat

SEQ ID NO: 14775 - DNA, 22 bp, Artificial Sequence
  chemically synthesized
tgggcaaatattggtatatata

SEQ ID NO: 14776 - DNA, 22 bp, Artificial Sequence
  chemically synthesized
ggcaaatattggtatatataga

SEQ ID NO: 14777 - DNA, 22 bp, Artificial Sequence
  chemically synthesized
gtatatatagagttaagaagtc

SEQ ID NO: 14778 - DNA, 22 bp, Artificial Sequence
  chemically synthesized
agaagtctaggtctgcttccag

SEQ ID NO: 14779 - DNA, 22 bp, Artificial Sequence
  chemically synthesized
ggtctgcttccagaagaaaaca

SEQ ID NO: 14780 - DNA, 22 bp, Artificial Sequence
  chemically synthesized
cttccagaagaaaacagttcca

SEQ ID NO: 14781 - DNA, 22 bp, Artificial Sequence
  chemically synthesized
ccagaagaaaacagttccacgt

SEQ ID NO: 14782 - DNA, 22 bp, Artificial Sequence
  chemically synthesized
cagaagaaaacagttccacgtt

SEQ ID NO: 14783 - DNA, 22 bp, Artificial Sequence
  chemically synthesized
cacgttgcttgaaattgaaaat

SEQ ID NO: 14784 - DNA, 22 bp, Artificial Sequence
  chemically synthesized
cttgaaattgaaaatcaagata

SEQ ID NO: 14785 - DNA, 22 bp, Artificial Sequence
  chemically synthesized
gaaattgaaaatcaagataaaa

SEQ ID NO: 14786 - DNA, 22 bp, Artificial Sequence
  chemically synthesized
aaattgaaaatcaagataaaaa

SEQ ID NO: 14787 - DNA, 22 bp, Artificial Sequence
  chemically synthesized
aaaatcaagataaaaatgttca

SEQ ID NO: 14788 - DNA, 22 bp, Artificial Sequence
  chemically synthesized
acaattaagctccttcttttta

SEQ ID NO: 14789 - DNA, 22 bp, Artificial Sequence
  chemically synthesized
agctccttctttttattgttcc

SEQ ID NO: 14790 - DNA, 22 bp, Artificial Sequence
  chemically synthesized
cttctttttattgttcctctag

SEQ ID NO: 14791 - DNA, 22 bp, Artificial Sequence
  chemically synthesized
ctttttattgttcctctagtta

SEQ ID NO: 14792 - DNA, 22 bp, Artificial Sequence
  chemically synthesized
tttttattgttcctctagttat

SEQ ID NO: 14793 - DNA, 22 bp, Artificial Sequence
  chemically synthesized
tttattgttcctctagttattt

SEQ ID NO: 14794 - DNA, 22 bp, Artificial Sequence
  chemically synthesized
ttattgttcctctagttatttc

SEQ ID NO: 14795 - DNA, 22 bp, Artificial Sequence
  chemically synthesized
tattgttcctctagttatttcc

SEQ ID NO: 14796 - DNA, 22 bp, Artificial Sequence
  chemically synthesized
attgttcctctagttatttcct

SEQ ID NO: 14797 - DNA, 22 bp, Artificial Sequence
  chemically synthesized
ttgttcctctagttatttcctc

SEQ ID NO: 14798 - DNA, 22 bp, Artificial Sequence
  chemically synthesized
ttcctctagttatttcctccag

SEQ ID NO: 14799 - DNA, 22 bp, Artificial Sequence
  chemically synthesized
ctctagttatttcctccagaat

SEQ ID NO: 14800 - DNA, 22 bp, Artificial Sequence
  chemically synthesized
tagttatttcctccagaattga

SEQ ID NO: 14801 - DNA, 22 bp, Artificial Sequence
  chemically synthesized
gttatttcctccagaattgatc

SEQ ID NO: 14802 - DNA, 22 bp, Artificial Sequence
  chemically synthesized
tttcctccagaattgatcaaga

SEQ ID NO: 14803 - DNA, 22 bp, Artificial Sequence
  chemically synthesized
cctccagaattgatcaagacaa

SEQ ID NO: 14804 - DNA, 22 bp, Artificial Sequence
  chemically synthesized
ctccagaattgatcaagacaat

SEQ ID NO: 14805 - DNA, 22 bp, Artificial Sequence
  chemically synthesized
cagaattgatcaagacaattca

SEQ ID NO: 14806 - DNA, 22 bp, Artificial Sequence
  chemically synthesized
atcaagacaattcatcatttga

SEQ ID NO: 14807 - DNA, 22 bp, Artificial Sequence
  chemically synthesized
atcatttgattctctatctcca

SEQ ID NO: 14808 - DNA, 22 bp, Artificial Sequence
  chemically synthesized
gattctctatctccagagccaa

SEQ ID NO: 14809 - DNA, 22 bp, Artificial Sequence
  chemically synthesized
attctctatctccagagccaaa

SEQ ID NO: 14810 - DNA, 22 bp, Artificial Sequence
  chemically synthesized
tctatctccagagccaaaatca

SEQ ID NO: 14811 - DNA, 22 bp, Artificial Sequence
  chemically synthesized
tatctccagagccaaaatcaag

SEQ ID NO: 14812 - DNA, 22 bp, Artificial Sequence
  chemically synthesized
tctccagagccaaaatcaagat

SEQ ID NO: 14813 - DNA, 22 bp, Artificial Sequence
  chemically synthesized
cagagccaaaatcaagatttgc

SEQ ID NO: 14814 - DNA, 22 bp, Artificial Sequence
  chemically synthesized
gctatgttagacgatgtaaaaa

SEQ ID NO: 14815 - DNA, 22 bp, Artificial Sequence
  chemically synthesized
ctatgttagacgatgtaaaaat

SEQ ID NO: 14816 - DNA, 22 bp, Artificial Sequence
  chemically synthesized
tgttagacgatgtaaaaatttt

SEQ ID NO: 14817 - DNA, 22 bp, Artificial Sequence
  chemically synthesized
gacgatgtaaaaattttagcca

SEQ ID NO: 14818 - DNA, 22 bp, Artificial Sequence
  chemically synthesized
tagccaatggcctccttcagtt

SEQ ID NO: 14819 - DNA, 22 bp, Artificial Sequence
  chemically synthesized
agccaatggcctccttcagttg

SEQ ID NO: 14820 - DNA, 22 bp, Artificial Sequence
  chemically synthesized
gccaatggcctccttcagttgg

SEQ ID NO: 14821 - DNA, 22 bp, Artificial Sequence
  chemically synthesized
cttcagttgggacatggtctta

SEQ ID NO: 14822 - DNA, 22 bp, Artificial Sequence
  chemically synthesized
cagttgggacatggtcttaaag

SEQ ID NO: 14823 - DNA, 22 bp, Artificial Sequence
  chemically synthesized
agttgggacatggtcttaaaga

SEQ ID NO: 14824 - DNA, 22 bp, Artificial Sequence
  chemically synthesized
ggacatggtcttaaagactttg

SEQ ID NO: 14825 - DNA, 22 bp, Artificial Sequence
  chemically synthesized
aaagactttgtccataagacga

SEQ ID NO: 14826 - DNA, 22 bp, Artificial Sequence
  chemically synthesized
aagactttgtccataagacgaa

SEQ ID NO: 14827 - DNA, 22 bp, Artificial Sequence
  chemically synthesized
tgtccataagacgaagggccaa

SEQ ID NO: 14828 - DNA, 22 bp, Artificial Sequence
  chemically synthesized
gtccataagacgaagggccaaa

SEQ ID NO: 14829 - DNA, 22 bp, Artificial Sequence
  chemically synthesized
tccataagacgaagggccaaat

SEQ ID NO: 14830 - DNA, 22 bp, Artificial Sequence
  chemically synthesized
atgacatatttcaaaaactcaa

SEQ ID NO: 14831 - DNA, 22 bp, Artificial Sequence
  chemically synthesized
caaaaactcaacatatttgatc

SEQ ID NO: 14832 - DNA, 22 bp, Artificial Sequence
  chemically synthesized
aaaaactcaacatatttgatca

SEQ ID NO: 14833 - DNA, 22 bp, Artificial Sequence
  chemically synthesized
aacatatttgatcagtcttttt

SEQ ID NO: 14834 - DNA, 22 bp, Artificial Sequence
  chemically synthesized
gatcagtctttttatgatctat

SEQ ID NO: 14835 - DNA, 22 bp, Artificial Sequence
  chemically synthesized
atcagtctttttatgatctatc

SEQ ID NO: 14836 - DNA, 22 bp, Artificial Sequence
  chemically synthesized
tttatgatctatcgctgcaaac

SEQ ID NO: 14837 - DNA, 22 bp, Artificial Sequence
  chemically synthesized
ttatgatctatcgctgcaaacc

SEQ ID NO: 14838 - DNA, 22 bp, Artificial Sequence
  chemically synthesized
tatgatctatcgctgcaaacca

SEQ ID NO: 14839 - DNA, 22 bp, Artificial Sequence
  chemically synthesized
atgatctatcgctgcaaaccag

SEQ ID NO: 14840 - DNA, 22 bp, Artificial Sequence
  chemically synthesized
tgatctatcgctgcaaaccagt

SEQ ID NO: 14841 - DNA, 22 bp, Artificial Sequence
  chemically synthesized
tcgctgcaaaccagtgaaatca

SEQ ID NO: 14842 - DNA, 22 bp, Artificial Sequence
  chemically synthesized
caaaccagtgaaatcaaagaag

SEQ ID NO: 14843 - DNA, 22 bp, Artificial Sequence
  chemically synthesized
agaagaactacatataaactac

SEQ ID NO: 14844 - DNA, 22 bp, Artificial Sequence
  chemically synthesized
catataaactacaagtcaaaaa

SEQ ID NO: 14845 - DNA, 22 bp, Artificial Sequence
  chemically synthesized
caagtcaaaaatgaagaggtaa

SEQ ID NO: 14846 - DNA, 22 bp, Artificial Sequence
  chemically synthesized
gaactcaactcaaaacttgaaa

SEQ ID NO: 14847 - DNA, 22 bp, Artificial Sequence
  chemically synthesized
aactcaactcaaaacttgaaag

SEQ ID NO: 14848 - DNA, 22 bp, Artificial Sequence
  chemically synthesized
aactcaaaacttgaaagcctcc

SEQ ID NO: 14849 - DNA, 22 bp, Artificial Sequence
  chemically synthesized
aaaacttgaaagcctcctagaa

SEQ ID NO: 14850 - DNA, 22 bp, Artificial Sequence
  chemically synthesized
gaaagcctcctagaagaaaaaa

SEQ ID NO: 14851 - DNA, 22 bp, Artificial Sequence
  chemically synthesized
aaagcctcctagaagaaaaaat

SEQ ID NO: 14852 - DNA, 22 bp, Artificial Sequence
  chemically synthesized
ctagaagaaaaaattctacttc

SEQ ID NO: 14853 - DNA, 22 bp, Artificial Sequence
  chemically synthesized
gaagaaaaaattctacttcaac

SEQ ID NO: 14854 - DNA, 22 bp, Artificial Sequence
  chemically synthesized
tacttcaacaaaaagtgaaata

SEQ ID NO: 14855 - DNA, 22 bp, Artificial Sequence
  chemically synthesized
cttcaacaaaaagtgaaatatt

SEQ ID NO: 14856 - DNA, 22 bp, Artificial Sequence
  chemically synthesized
caacaaaaagtgaaatatttag

SEQ ID NO: 14857 - DNA, 22 bp, Artificial Sequence
  chemically synthesized
aacaaaaagtgaaatatttaga

SEQ ID NO: 14858 - DNA, 22 bp, Artificial Sequence
  chemically synthesized
agaagagcaactaactaactta

SEQ ID NO: 14859 - DNA, 22 bp, Artificial Sequence
  chemically synthesized
gaagagcaactaactaacttaa

SEQ ID NO: 14860 - DNA, 22 bp, Artificial Sequence
  chemically synthesized
actaacttaattcaaaatcaac

SEQ ID NO: 14861 - DNA, 22 bp, Artificial Sequence
  chemically synthesized
acttaattcaaaatcaacctga

SEQ ID NO: 14862 - DNA, 22 bp, Artificial Sequence
  chemically synthesized
aattcaaaatcaacctgaaact

SEQ ID NO: 14863 - DNA, 22 bp, Artificial Sequence
  chemically synthesized
attcaaaatcaacctgaaactc

SEQ ID NO: 14864 - DNA, 22 bp, Artificial Sequence
  chemically synthesized
aaaatcaacctgaaactccaga

SEQ ID NO: 14865 - DNA, 22 bp, Artificial Sequence
  chemically synthesized
aaactccagaacacccagaagt

SEQ ID NO: 14866 - DNA, 22 bp, Artificial Sequence
  chemically synthesized
cagaacacccagaagtaacttc

SEQ ID NO: 14867 - DNA, 22 bp, Artificial Sequence
  chemically synthesized
cacttaaagtaagtagaaaata

SEQ ID NO: 14868 - DNA, 22 bp, Artificial Sequence
  chemically synthesized
acttaaagtaagtagaaaataa

SEQ ID NO: 14869 - DNA, 22 bp, Artificial Sequence
  chemically synthesized
aaagtaagtagaaaataaagag

SEQ ID NO: 14870 - DNA, 22 bp, Artificial Sequence
  chemically synthesized
aagtaagtagaaaataaagagg

SEQ ID NO: 14871 - DNA, 22 bp, Artificial Sequence
  chemically synthesized
atgtttatgttttcaatgtgga

SEQ ID NO: 14872 - DNA, 22 bp, Artificial Sequence
  chemically synthesized
atgttttcaatgtggatctttt

SEQ ID NO: 14873 - DNA, 22 bp, Artificial Sequence
  chemically synthesized
tgttttcaatgtggatctttta

SEQ ID NO: 14874 - DNA, 22 bp, Artificial Sequence
  chemically synthesized
tcaatgtggatcttttaaaaaa

SEQ ID NO: 14875 - DNA, 22 bp, Artificial Sequence
  chemically synthesized
caatgtggatcttttaaaaaaa

SEQ ID NO: 14876 - DNA, 22 bp, Artificial Sequence
  chemically synthesized
aatgtggatcttttaaaaaaaa

SEQ ID NO: 14877 - DNA, 22 bp, Artificial Sequence
  chemically synthesized
ttaaaaaaaatatttctaaggc

SEQ ID NO: 14878 - DNA, 22 bp, Artificial Sequence
  chemically synthesized
taaaaaaaatatttctaaggca

SEQ ID NO: 14879 - DNA, 22 bp, Artificial Sequence
  chemically synthesized
aaaaaaaatatttctaaggcat

SEQ ID NO: 14880 - DNA, 22 bp, Artificial Sequence
  chemically synthesized
aaaaaaatatttctaaggcatg

SEQ ID NO: 14881 - DNA, 22 bp, Artificial Sequence
  chemically synthesized
ctaaggcatgccatttgaaata

SEQ ID NO: 14882 - DNA, 22 bp, Artificial Sequence
  chemically synthesized
taaggcatgccatttgaaatac

SEQ ID NO: 14883 - DNA, 22 bp, Artificial Sequence
  chemically synthesized
aggcatgccatttgaaatactt

SEQ ID NO: 14884 - DNA, 22 bp, Artificial Sequence
  chemically synthesized
gaaatactttgttgcattgttg

SEQ ID NO: 14885 - DNA, 22 bp, Artificial Sequence
  chemically synthesized
aaatactttgttgcattgttga

SEQ ID NO: 14886 - DNA, 22 bp, Artificial Sequence
  chemically synthesized
tgttgcattgttgaaatacttt

SEQ ID NO: 14887 - DNA, 22 bp, Artificial Sequence
  chemically synthesized
gttgcattgttgaaatactttt

SEQ ID NO: 14888 - DNA, 22 bp, Artificial Sequence
  chemically synthesized
ttgcattgttgaaatacttttt

SEQ ID NO: 14889 - DNA, 22 bp, Artificial Sequence
  chemically synthesized
cattgttgaaatactttttttt

SEQ ID NO: 14890 - DNA, 22 bp, Artificial Sequence
  chemically synthesized
ttgaaatacttttttttccaag

SEQ ID NO: 14891 - DNA, 22 bp, Artificial Sequence
  chemically synthesized
aaatacttttttttccaagaaa

SEQ ID NO: 14892 - DNA, 22 bp, Artificial Sequence
  chemically synthesized
ttttttccaagaaaaataatct

SEQ ID NO: 14893 - DNA, 22 bp, Artificial Sequence
  chemically synthesized
tttttccaagaaaaataatctc

SEQ ID NO: 14894 - DNA, 22 bp, Artificial Sequence
  chemically synthesized
ttttccaagaaaaataatctcc

SEQ ID NO: 14895 - DNA, 22 bp, Artificial Sequence
  chemically synthesized
tttccaagaaaaataatctcca

SEQ ID NO: 14896 - DNA, 22 bp, Artificial Sequence
  chemically synthesized
ttccaagaaaaataatctccag

SEQ ID NO: 14897 - DNA, 22 bp, Artificial Sequence
  chemically synthesized
tccaagaaaaataatctccaga

SEQ ID NO: 14898 - DNA, 22 bp, Artificial Sequence
  chemically synthesized
ccaagaaaaataatctccagaa

SEQ ID NO: 14899 - DNA, 22 bp, Artificial Sequence
  chemically synthesized
caagaaaaataatctccagaaa

SEQ ID NO: 14900 - DNA, 22 bp, Artificial Sequence
  chemically synthesized
cagaaaataaaatttcctatta

SEQ ID NO: 14901 - DNA, 22 bp, Artificial Sequence
  chemically synthesized
cctattataatttcaagttagt

SEQ ID NO: 14902 - DNA, 22 bp, Artificial Sequence
  chemically synthesized
ctattataatttcaagttagtt

SEQ ID NO: 14903 - DNA, 22 bp, Artificial Sequence
  chemically synthesized
ttataatttcaagttagttttt

SEQ ID NO: 14904 - DNA, 22 bp, Artificial Sequence
  chemically synthesized
taatttcaagttagttttttgt

SEQ ID NO: 14905 - DNA, 22 bp, Artificial Sequence
  chemically synthesized
caagttagttttttgtttccct

SEQ ID NO: 14906 - DNA, 22 bp, Artificial Sequence
  chemically synthesized
aagttagttttttgtttcccta

SEQ ID NO: 14907 - DNA, 22 bp, Artificial Sequence
  chemically synthesized
gttttttgtttccctaatgtta

SEQ ID NO: 14908 - DNA, 22 bp, Artificial Sequence
  chemically synthesized
tttgtttccctaatgttatata

SEQ ID NO: 14909 - DNA, 22 bp, Artificial Sequence
  chemically synthesized
ttgtttccctaatgttatatat

SEQ ID NO: 14910 - DNA, 22 bp, Artificial Sequence
  chemically synthesized
tgtttccctaatgttatatatg

SEQ ID NO: 14911 - DNA, 22 bp, Artificial Sequence
  chemically synthesized
gtttccctaatgttatatatga

SEQ ID NO: 14912 - DNA, 22 bp, Artificial Sequence
  chemically synthesized
tttccctaatgttatatatgaa

SEQ ID NO: 14913 - DNA, 22 bp, Artificial Sequence
  chemically synthesized
ccctaatgttatatatgaaaac

SEQ ID NO: 14914 - DNA, 22 bp, Artificial Sequence
  chemically synthesized
cctaatgttatatatgaaaaca

SEQ ID NO: 14915 - DNA, 22 bp, Artificial Sequence
  chemically synthesized
atgttatatatgaaaacactga

SEQ ID NO: 14916 - DNA, 22 bp, Artificial Sequence
  chemically synthesized
tatatgaaaacactgaaaattt

SEQ ID NO: 14917 - DNA, 22 bp, Artificial Sequence
  chemically synthesized
aaaatttgcattttatatgaaa

SEQ ID NO: 14918 - DNA, 22 bp, Artificial Sequence
  chemically synthesized
gcattttatatgaaaattacaa

SEQ ID NO: 14919 - DNA, 22 bp, Artificial Sequence
  chemically synthesized
cattttatatgaaaattacaaa

SEQ ID NO: 14920 - DNA, 22 bp, Artificial Sequence
  chemically synthesized
tatatgaaaattacaaatcggt

SEQ ID NO: 14921 - DNA, 22 bp, Artificial Sequence
  chemically synthesized
atatgaaaattacaaatcggtt

SEQ ID NO: 14922 - DNA, 22 bp, Artificial Sequence
  chemically synthesized
tatgaaaattacaaatcggtta

SEQ ID NO: 14923 - DNA, 22 bp, Artificial Sequence
  chemically synthesized
caaatcggttaaattatacaat

SEQ ID NO: 14924 - DNA, 22 bp, Artificial Sequence
  chemically synthesized
aattatacaatctagaacacta

SEQ ID NO: 14925 - DNA, 22 bp, Artificial Sequence
  chemically synthesized
tacaatctagaacactatgtca

SEQ ID NO: 14926 - DNA, 22 bp, Artificial Sequence
  chemically synthesized
gaacactatgtcattacactat

SEQ ID NO: 14927 - DNA, 22 bp, Artificial Sequence
  chemically synthesized
tgtcattacactattgtaaatt

SEQ ID NO: 14928 - DNA, 22 bp, Artificial Sequence
  chemically synthesized
cactattgtaaattactgaagg

SEQ ID NO: 14929 - DNA, 22 bp, Artificial Sequence
  chemically synthesized
ttgtaaattactgaaggtaagt

SEQ ID NO: 14930 - DNA, 22 bp, Artificial Sequence
  chemically synthesized
taaattactgaaggtaagtaaa

SEQ ID NO: 14931 - DNA, 22 bp, Artificial Sequence
  chemically synthesized
ctgaaggtaagtaaaaagttaa

SEQ ID NO: 14932 - DNA, 22 bp, Artificial Sequence
  chemically synthesized
aaggtaagtaaaaagttaaaaa

SEQ ID NO: 14933 - DNA, 22 bp, Artificial Sequence
  chemically synthesized
aaaaaaatttaaaactattctc

SEQ ID NO: 14934 - DNA, 22 bp, Artificial Sequence
  chemically synthesized
aaaactattctccagtgtttaa

SEQ ID NO: 14935 - DNA, 22 bp, Artificial Sequence
  chemically synthesized
aaactattctccagtgtttaaa

SEQ ID NO: 14936 - DNA, 22 bp, Artificial Sequence
  chemically synthesized
ttctccagtgtttaaaacagat

SEQ ID NO: 14937 - DNA, 22 bp, Artificial Sequence
  chemically synthesized
tccagtgtttaaaacagattaa

SEQ ID NO: 14938 - DNA, 22 bp, Artificial Sequence
  chemically synthesized
cagtgtttaaaacagattaaat

SEQ ID NO: 14939 - DNA, 22 bp, Artificial Sequence
  chemically synthesized
aaaacagattaaataatacagt

SEQ ID NO: 14940 - DNA, 22 bp, Artificial Sequence
  chemically synthesized
aaacagattaaataatacagta

SEQ ID NO: 14941 - DNA, 22 bp, Artificial Sequence
  chemically synthesized
aataatacagtaaatggaaaag

SEQ ID NO: 14942 - DNA, 22 bp, Artificial Sequence
  chemically synthesized
attcatatgaaaatatgctggg

SEQ ID NO: 14943 - DNA, 22 bp, Artificial Sequence
  chemically synthesized
ttcatatgaaaatatgctgggc

SEQ ID NO: 14944 - DNA, 22 bp, Artificial Sequence
  chemically synthesized
atatgaaaatatgctgggcttt

SEQ ID NO: 14945 - DNA, 22 bp, Artificial Sequence
  chemically synthesized
ggctttttcttttaattgaagt

SEQ ID NO: 14946 - DNA, 22 bp, Artificial Sequence
  chemically synthesized
tttcttttaattgaagttcaga

SEQ ID NO: 14947 - DNA, 22 bp, Artificial Sequence
  chemically synthesized
ttcttttaattgaagttcagaa

SEQ ID NO: 14948 - DNA, 22 bp, Artificial Sequence
  chemically synthesized
tcttttaattgaagttcagaaa

SEQ ID NO: 14949 - DNA, 22 bp, Artificial Sequence
  chemically synthesized
cttttaattgaagttcagaaaa

SEQ ID NO: 14950 - DNA, 22 bp, Artificial Sequence
  chemically synthesized
ttttaattgaagttcagaaaat

SEQ ID NO: 14951 - DNA, 22 bp, Artificial Sequence
  chemically synthesized
ttaattgaagttcagaaaatca

SEQ ID NO: 14952 - DNA, 22 bp, Artificial Sequence
  chemically synthesized
taattgaagttcagaaaatcaa

SEQ ID NO: 14953 - DNA, 22 bp, Artificial Sequence
  chemically synthesized
aattgaagttcagaaaatcaaa

SEQ ID NO: 14954 - DNA, 22 bp, Artificial Sequence
  chemically synthesized
attgaagttcagaaaatcaaat

SEQ ID NO: 14955 - DNA, 22 bp, Artificial Sequence
  chemically synthesized
aagttcagaaaatcaaatttta

SEQ ID NO: 14956 - DNA, 22 bp, Artificial Sequence
  chemically synthesized
agaaaatcaaattttagagata

SEQ ID NO: 14957 - DNA, 22 bp, Artificial Sequence
  chemically synthesized
tagagatagtacaatttaaata

SEQ ID NO: 14958 - DNA, 22 bp, Artificial Sequence
  chemically synthesized
agagatagtacaatttaaataa

SEQ ID NO: 14959 - DNA, 22 bp, Artificial Sequence
  chemically synthesized
gagatagtacaatttaaataaa

SEQ ID NO: 14960 - DNA, 22 bp, Artificial Sequence
  chemically synthesized
aaataaaatgttaaggacaaaa

SEQ ID NO: 14961 - DNA, 22 bp, Artificial Sequence
  chemically synthesized
aataaaatgttaaggacaaaaa

SEQ ID NO: 14962 - DNA, 22 bp, Artificial Sequence
  chemically synthesized
aggacaaaaatatgtgctattt

SEQ ID NO: 14963 - DNA, 22 bp, Artificial Sequence
  chemically synthesized
tttgaaagaagcatacaagggg

SEQ ID NO: 14964 - DNA, 22 bp, Artificial Sequence
  chemically synthesized
gaaagaagcatacaaggggaag

SEQ ID NO: 14965 - DNA, 22 bp, Artificial Sequence
  chemically synthesized
aaagaagcatacaaggggaagg

SEQ ID NO: 14966 - DNA, 22 bp, Artificial Sequence
  chemically synthesized
ccaatattcatttttcaaatcc

SEQ ID NO: 14967 - DNA, 22 bp, Artificial Sequence
  chemically synthesized
atttttcaaatccattattagt

SEQ ID NO: 14968 - DNA, 22 bp, Artificial Sequence
  chemically synthesized
ttcaaatccattattagtttaa

SEQ ID NO: 14969 - DNA, 22 bp, Artificial Sequence
  chemically synthesized
tcaaatccattattagtttaaa

SEQ ID NO: 14970 - DNA, 22 bp, Artificial Sequence
  chemically synthesized
caaatccattattagtttaaaa

SEQ ID NO: 14971 - DNA, 22 bp, Artificial Sequence
  chemically synthesized
aaatccattattagtttaaaaa

SEQ ID NO: 14972 - DNA, 22 bp, Artificial Sequence
  chemically synthesized
ttagtttaaaaatttagattat

SEQ ID NO: 14973 - DNA, 22 bp, Artificial Sequence
  chemically synthesized
gtttaaaaatttagattatgat

SEQ ID NO: 14974 - DNA, 22 bp, Artificial Sequence
  chemically synthesized
aaaaatttagattatgatagtg

SEQ ID NO: 14975 - DNA, 22 bp, Artificial Sequence
  chemically synthesized
aaaatttagattatgatagtgt

SEQ ID NO: 14976 - DNA, 22 bp, Artificial Sequence
  chemically synthesized
agattatgatagtgttacagga

SEQ ID NO: 14977 - DNA, 22 bp, Artificial Sequence
  chemically synthesized
gattatgatagtgttacaggaa

SEQ ID NO: 14978 - DNA, 22 bp, Artificial Sequence
  chemically synthesized
tgatagtgttacaggaaattaa

SEQ ID NO: 14979 - DNA, 22 bp, Artificial Sequence
  chemically synthesized
caggaaattaatagaaaagaaa

SEQ ID NO: 14980 - DNA, 22 bp, Artificial Sequence
  chemically synthesized
atagaaaagaaagaggaaagca

SEQ ID NO: 14981 - DNA, 22 bp, Artificial Sequence
  chemically synthesized
ataaccaacctactctctatat

SEQ ID NO: 14982 - DNA, 22 bp, Artificial Sequence
  chemically synthesized
taaccaacctactctctatatc

SEQ ID NO: 14983 - DNA, 22 bp, Artificial Sequence
  chemically synthesized
ctctctatatccagacttttgt

SEQ ID NO: 14984 - DNA, 22 bp, Artificial Sequence
  chemically synthesized
tctatatccagacttttgtaga

SEQ ID NO: 14985 - DNA, 22 bp, Artificial Sequence
  chemically synthesized
tatatccagacttttgtagaaa

SEQ ID NO: 14986 - DNA, 22 bp, Artificial Sequence
  chemically synthesized
tatccagacttttgtagaaaaa

SEQ ID NO: 14987 - DNA, 22 bp, Artificial Sequence
  chemically synthesized
ttgtagaaaaacaagataatag

SEQ ID NO: 14988 - DNA, 22 bp, Artificial Sequence
  chemically synthesized
tgtagaaaaacaagataatagc

SEQ ID NO: 14989 - DNA, 22 bp, Artificial Sequence
  chemically synthesized
gtagaaaaacaagataatagca

SEQ ID NO: 14990 - DNA, 22 bp, Artificial Sequence
  chemically synthesized
tagaaaaacaagataatagcat

SEQ ID NO: 14991 - DNA, 22 bp, Artificial Sequence
  chemically synthesized
ctccagaccgtggaagaccaat

SEQ ID NO: 14992 - DNA, 22 bp, Artificial Sequence
  chemically synthesized
tccagaccgtggaagaccaata

SEQ ID NO: 14993 - DNA, 22 bp, Artificial Sequence
  chemically synthesized
cagaccgtggaagaccaatata

SEQ ID NO: 14994 - DNA, 22 bp, Artificial Sequence
  chemically synthesized
aaccaacagcatagtcaaataa

SEQ ID NO: 14995 - DNA, 22 bp, Artificial Sequence
  chemically synthesized
taatggtatgtcccatctttca

SEQ ID NO: 14996 - DNA, 22 bp, Artificial Sequence
  chemically synthesized
aatggtatgtcccatctttcac

SEQ ID NO: 14997 - DNA, 22 bp, Artificial Sequence
  chemically synthesized
atggtatgtcccatctttcaca

SEQ ID NO: 14998 - DNA, 22 bp, Artificial Sequence
  chemically synthesized
tcacacaggtctgtaaaaacac

SEQ ID NO: 14999 - DNA, 22 bp, Artificial Sequence
  chemically synthesized
cacacaggtctgtaaaaacact

SEQ ID NO: 15000 - DNA, 22 bp, Artificial Sequence
  chemically synthesized
acacaggtctgtaaaaacactg

SEQ ID NO: 15001 - DNA, 22 bp, Artificial Sequence
  chemically synthesized
taaaaacactgaatcctaaaat

SEQ ID NO: 15002 - DNA, 22 bp, Artificial Sequence
  chemically synthesized
aatcctaaaattatttacaagc

SEQ ID NO: 15003 - DNA, 22 bp, Artificial Sequence
  chemically synthesized
aaattatttacaagctttaact

SEQ ID NO: 15004 - DNA, 22 bp, Artificial Sequence
  chemically synthesized
tttacaagctttaactggatca

SEQ ID NO: 15005 - DNA, 22 bp, Artificial Sequence
  chemically synthesized
acaagctttaactggatcatga

SEQ ID NO: 15006 - DNA, 22 bp, Artificial Sequence
  chemically synthesized
caagctttaactggatcatgag

SEQ ID NO: 15007 - DNA, 22 bp, Artificial Sequence
  chemically synthesized
taactggatcatgagtaaaatt

SEQ ID NO: 15008 - DNA, 22 bp, Artificial Sequence
  chemically synthesized
aactggatcatgagtaaaatta

SEQ ID NO: 15009 - DNA, 22 bp, Artificial Sequence
  chemically synthesized
actggatcatgagtaaaattat

SEQ ID NO: 15010 - DNA, 22 bp, Artificial Sequence
  chemically synthesized
gatcatgagtaaaattatcaca

SEQ ID NO: 15011 - DNA, 22 bp, Artificial Sequence
  chemically synthesized
tcacatcagcataactgttaaa

SEQ ID NO: 15012 - DNA, 22 bp, Artificial Sequence
  chemically synthesized
ttaaaattgcaggctctgaagc

SEQ ID NO: 15013 - DNA, 22 bp, Artificial Sequence
  chemically synthesized
aaattgcaggctctgaagctaa

SEQ ID NO: 15014 - DNA, 22 bp, Artificial Sequence
  chemically synthesized
caggctctgaagctaataaact

SEQ ID NO: 15015 - DNA, 22 bp, Artificial Sequence
  chemically synthesized
tgaagctaataaactacctgca

SEQ ID NO: 15016 - DNA, 22 bp, Artificial Sequence
  chemically synthesized
aagctaataaactacctgcatt

SEQ ID NO: 15017 - DNA, 22 bp, Artificial Sequence
  chemically synthesized
ataaactacctgcatttaaacc

SEQ ID NO: 15018 - DNA, 22 bp, Artificial Sequence
  chemically synthesized
cctgcatttaaaccatggctct

SEQ ID NO: 15019 - DNA, 22 bp, Artificial Sequence
  chemically synthesized
catttaaaccatggctctaaaa

SEQ ID NO: 15020 - DNA, 22 bp, Artificial Sequence
  chemically synthesized
aaaccatggctctaaaactttg

SEQ ID NO: 15021 - DNA, 22 bp, Artificial Sequence
  chemically synthesized
aaccatggctctaaaactttgt

SEQ ID NO: 15022 - DNA, 22 bp, Artificial Sequence
  chemically synthesized
taaaactttgtgtgaccttgaa

SEQ ID NO: 15023 - DNA, 22 bp, Artificial Sequence
  chemically synthesized
aaactttgtgtgaccttgaata

SEQ ID NO: 15024 - DNA, 22 bp, Artificial Sequence
  chemically synthesized
tgtgtgaccttgaataaattac

SEQ ID NO: 15025 - DNA, 22 bp, Artificial Sequence
  chemically synthesized
gtgtgaccttgaataaattact

SEQ ID NO: 15026 - DNA, 22 bp, Artificial Sequence
  chemically synthesized
tgtgaccttgaataaattactt

SEQ ID NO: 15027 - DNA, 22 bp, Artificial Sequence
  chemically synthesized
gaataaattacttcaccccttt

SEQ ID NO: 15028 - DNA, 22 bp, Artificial Sequence
  chemically synthesized
aataaattacttcaccccttta

SEQ ID NO: 15029 - DNA, 22 bp, Artificial Sequence
  chemically synthesized
cttcacccctttatctctcagt

SEQ ID NO: 15030 - DNA, 22 bp, Artificial Sequence
  chemically synthesized
cacccctttatctctcagtttc

SEQ ID NO: 15031 - DNA, 22 bp, Artificial Sequence
  chemically synthesized
acccctttatctctcagtttcc

SEQ ID NO: 15032 - DNA, 22 bp, Artificial Sequence
  chemically synthesized
tatctctcagtttcctcacata

SEQ ID NO: 15033 - DNA, 22 bp, Artificial Sequence
  chemically synthesized
atctctcagtttcctcacatat

SEQ ID NO: 15034 - DNA, 22 bp, Artificial Sequence
  chemically synthesized
tctctcagtttcctcacatata

SEQ ID NO: 15035 - DNA, 22 bp, Artificial Sequence
  chemically synthesized
tcagtttcctcacatatactac

SEQ ID NO: 15036 - DNA, 22 bp, Artificial Sequence
  chemically synthesized
agtttcctcacatatactacaa

SEQ ID NO: 15037 - DNA, 22 bp, Artificial Sequence
  chemically synthesized
cctcacatatactacaaagata

SEQ ID NO: 15038 - DNA, 22 bp, Artificial Sequence
  chemically synthesized
ctcacatatactacaaagataa

SEQ ID NO: 15039 - DNA, 22 bp, Artificial Sequence
  chemically synthesized
acatatactacaaagataataa

SEQ ID NO: 15040 - DNA, 22 bp, Artificial Sequence
  chemically synthesized
caaagataataacagaacttat

SEQ ID NO: 15041 - DNA, 22 bp, Artificial Sequence
  chemically synthesized
ataggattattgtaagaaaaaa

SEQ ID NO: 15042 - DNA, 22 bp, Artificial Sequence
  chemically synthesized
taggattattgtaagaaaaaaa

SEQ ID NO: 15043 - DNA, 22 bp, Artificial Sequence
  chemically synthesized
ttgtaagaaaaaaaattaattc

SEQ ID NO: 15044 - DNA, 22 bp, Artificial Sequence
  chemically synthesized
taagaaaaaaaattaattcata

SEQ ID NO: 15045 - DNA, 22 bp, Artificial Sequence
  chemically synthesized
attcatagcagccaatgtcatc

SEQ ID NO: 15046 - DNA, 22 bp, Artificial Sequence
  chemically synthesized
atagcagccaatgtcatcttac

SEQ ID NO: 15047 - DNA, 22 bp, Artificial Sequence
  chemically synthesized
actaaaattcaaattagatcat

SEQ ID NO: 15048 - DNA, 22 bp, Artificial Sequence
  chemically synthesized
ctaaaattcaaattagatcatg

SEQ ID NO: 15049 - DNA, 22 bp, Artificial Sequence
  chemically synthesized
aaattcaaattagatcatgttt

SEQ ID NO: 15050 - DNA, 22 bp, Artificial Sequence
  chemically synthesized
aaattagatcatgtttctcttt

SEQ ID NO: 15051 - DNA, 22 bp, Artificial Sequence
  chemically synthesized
gatcatgtttctctttgctcaa

SEQ ID NO: 15052 - DNA, 22 bp, Artificial Sequence
  chemically synthesized
ctctttgctcaaaaccacacaa

SEQ ID NO: 15053 - DNA, 22 bp, Artificial Sequence
  chemically synthesized
tctttgctcaaaaccacacaat

SEQ ID NO: 15054 - DNA, 22 bp, Artificial Sequence
  chemically synthesized
tttgctcaaaaccacacaatag

SEQ ID NO: 15055 - DNA, 22 bp, Artificial Sequence
  chemically synthesized
tgctcaaaaccacacaatagct

SEQ ID NO: 15056 - DNA, 22 bp, Artificial Sequence
  chemically synthesized
gctcaaaaccacacaatagctt

SEQ ID NO: 15057 - DNA, 22 bp, Artificial Sequence
  chemically synthesized
ctcaaaaccacacaatagcttt

SEQ ID NO: 15058 - DNA, 22 bp, Artificial Sequence
  chemically synthesized
aaaaccacacaatagctttcca

SEQ ID NO: 15059 - DNA, 22 bp, Artificial Sequence
  chemically synthesized
tccatttcactcatattggctc

SEQ ID NO: 15060 - DNA, 22 bp, Artificial Sequence
  chemically synthesized
ccatttcactcatattggctct

SEQ ID NO: 15061 - DNA, 22 bp, Artificial Sequence
  chemically synthesized
catttcactcatattggctctt

SEQ ID NO: 15062 - DNA, 22 bp, Artificial Sequence
  chemically synthesized
cactcatattggctctttagac

SEQ ID NO: 15063 - DNA, 22 bp, Artificial Sequence
  chemically synthesized
actcatattggctctttagacc

SEQ ID NO: 15064 - DNA, 22 bp, Artificial Sequence
  chemically synthesized
atattggctctttagaccaaga

SEQ ID NO: 15065 - DNA, 22 bp, Artificial Sequence
  chemically synthesized
gctctttagaccaagattaccc

SEQ ID NO: 15066 - DNA, 22 bp, Artificial Sequence
  chemically synthesized
ggtaatcttggtctaaagagcc

SEQ ID NO: 15067 - DNA, 22 bp, Artificial Sequence
  chemically synthesized
ggtctaaagagccaatatgagt

SEQ ID NO: 15068 - DNA, 22 bp, Artificial Sequence
  chemically synthesized
gtctaaagagccaatatgagtg

SEQ ID NO: 15069 - DNA, 22 bp, Artificial Sequence
  chemically synthesized
aagagccaatatgagtgaaatg

SEQ ID NO: 15070 - DNA, 22 bp, Artificial Sequence
  chemically synthesized
ttgtgtggttttgagcaaagag

SEQ ID NO: 15071 - DNA, 22 bp, Artificial Sequence
  chemically synthesized
tgtggttttgagcaaagagaaa

SEQ ID NO: 15072 - DNA, 22 bp, Artificial Sequence
  chemically synthesized
tgagcaaagagaaacatgatct

SEQ ID NO: 15073 - DNA, 22 bp, Artificial Sequence
  chemically synthesized
gagcaaagagaaacatgatcta

SEQ ID NO: 15074 - DNA, 22 bp, Artificial Sequence
  chemically synthesized
agcaaagagaaacatgatctaa

SEQ ID NO: 15075 - DNA, 22 bp, Artificial Sequence
  chemically synthesized
atttgaattttagtaagatgac

SEQ ID NO: 15076 - DNA, 22 bp, Artificial Sequence
  chemically synthesized
gaattttagtaagatgacattg

SEQ ID NO: 15077 - DNA, 22 bp, Artificial Sequence
  chemically synthesized
aattttagtaagatgacattgg

SEQ ID NO: 15078 - DNA, 22 bp, Artificial Sequence
  chemically synthesized
tagtaagatgacattggctgct

SEQ ID NO: 15079 - DNA, 22 bp, Artificial Sequence
  chemically synthesized
agtaagatgacattggctgcta

SEQ ID NO: 15080 - DNA, 22 bp, Artificial Sequence
  chemically synthesized
gtaagatgacattggctgctat

SEQ ID NO: 15081 - DNA, 22 bp, Artificial Sequence
  chemically synthesized
gctgctatgaattaattttttt

SEQ ID NO: 15082 - DNA, 22 bp, Artificial Sequence
  chemically synthesized
ctatgaattaattttttttctt

SEQ ID NO: 15083 - DNA, 22 bp, Artificial Sequence
  chemically synthesized
tgaattaattttttttcttaca

SEQ ID NO: 15084 - DNA, 22 bp, Artificial Sequence
  chemically synthesized
attttttttcttacaataatcc

SEQ ID NO: 15085 - DNA, 22 bp, Artificial Sequence
  chemically synthesized
tttttcttacaataatcctata

SEQ ID NO: 15086 - DNA, 22 bp, Artificial Sequence
  chemically synthesized
ttttcttacaataatcctataa

SEQ ID NO: 15087 - DNA, 22 bp, Artificial Sequence
  chemically synthesized
tttcttacaataatcctataag

SEQ ID NO: 15088 - DNA, 22 bp, Artificial Sequence
  chemically synthesized
ttcttacaataatcctataagt

SEQ ID NO: 15089 - DNA, 22 bp, Artificial Sequence
  chemically synthesized
tcttacaataatcctataagtt

SEQ ID NO: 15090 - DNA, 22 bp, Artificial Sequence
  chemically synthesized
cttacaataatcctataagttc

SEQ ID NO: 15091 - DNA, 22 bp, Artificial Sequence
  chemically synthesized
ttacaataatcctataagttct

SEQ ID NO: 15092 - DNA, 22 bp, Artificial Sequence
  chemically synthesized
acaataatcctataagttctgt

SEQ ID NO: 15093 - DNA, 22 bp, Artificial Sequence
  chemically synthesized
caataatcctataagttctgtt

SEQ ID NO: 15094 - DNA, 22 bp, Artificial Sequence
  chemically synthesized
taagttctgttattatctttgt

SEQ ID NO: 15095 - DNA, 22 bp, Artificial Sequence
  chemically synthesized
tgttattatctttgtagtatat

SEQ ID NO: 15096 - DNA, 22 bp, Artificial Sequence
  chemically synthesized
ttattatctttgtagtatatgt

SEQ ID NO: 15097 - DNA, 22 bp, Artificial Sequence
  chemically synthesized
ttatctttgtagtatatgtgag

SEQ ID NO: 15098 - DNA, 22 bp, Artificial Sequence
  chemically synthesized
tctttgtagtatatgtgaggaa

SEQ ID NO: 15099 - DNA, 22 bp, Artificial Sequence
  chemically synthesized
tgtagtatatgtgaggaaactg

SEQ ID NO: 15100 - DNA, 22 bp, Artificial Sequence
  chemically synthesized
gtagtatatgtgaggaaactga

SEQ ID NO: 15101 - DNA, 22 bp, Artificial Sequence
  chemically synthesized
tagtatatgtgaggaaactgag

SEQ ID NO: 15102 - DNA, 22 bp, Artificial Sequence
  chemically synthesized
agagataaaggggtgaagtaat

SEQ ID NO: 15103 - DNA, 22 bp, Artificial Sequence
  chemically synthesized
attcaaggtcacacaaagtttt

SEQ ID NO: 15104 - DNA, 22 bp, Artificial Sequence
  chemically synthesized
ttcaaggtcacacaaagtttta

SEQ ID NO: 15105 - DNA, 22 bp, Artificial Sequence
  chemically synthesized
aaggtcacacaaagttttagag

SEQ ID NO: 15106 - DNA, 22 bp, Artificial Sequence
  chemically synthesized
tagagccatggtttaaatgcag

SEQ ID NO: 15107 - DNA, 22 bp, Artificial Sequence
  chemically synthesized
agagccatggtttaaatgcagg

SEQ ID NO: 15108 - DNA, 22 bp, Artificial Sequence
  chemically synthesized
gagccatggtttaaatgcaggt

SEQ ID NO: 15109 - DNA, 22 bp, Artificial Sequence
  chemically synthesized
aaatgcaggtagtttattagct

SEQ ID NO: 15110 - DNA, 22 bp, Artificial Sequence
  chemically synthesized
aatgcaggtagtttattagctt

SEQ ID NO: 15111 - DNA, 22 bp, Artificial Sequence
  chemically synthesized
attagcttcagagcctgcaatt

SEQ ID NO: 15112 - DNA, 22 bp, Artificial Sequence
  chemically synthesized
ttagcttcagagcctgcaattt

SEQ ID NO: 15113 - DNA, 22 bp, Artificial Sequence
  chemically synthesized
gcttcagagcctgcaattttaa

SEQ ID NO: 15114 - DNA, 22 bp, Artificial Sequence
  chemically synthesized
cagagcctgcaattttaacagt

SEQ ID NO: 15115 - DNA, 22 bp, Artificial Sequence
  chemically synthesized
agagcctgcaattttaacagtt

SEQ ID NO: 15116 - DNA, 22 bp, Artificial Sequence
  chemically synthesized
caattttaacagttatgctgat

SEQ ID NO: 15117 - DNA, 22 bp, Artificial Sequence
  chemically synthesized
taacagttatgctgatgtgata

SEQ ID NO: 15118 - DNA, 22 bp, Artificial Sequence
  chemically synthesized
aacagttatgctgatgtgataa

SEQ ID NO: 15119 - DNA, 22 bp, Artificial Sequence
  chemically synthesized
acagttatgctgatgtgataat

SEQ ID NO: 15120 - DNA, 22 bp, Artificial Sequence
  chemically synthesized
tgctgatgtgataattttactc

SEQ ID NO: 15121 - DNA, 22 bp, Artificial Sequence
  chemically synthesized
atgtgataattttactcatgat

SEQ ID NO: 15122 - DNA, 22 bp, Artificial Sequence
  chemically synthesized
tactcatgatccagttaaagct

SEQ ID NO: 15123 - DNA, 22 bp, Artificial Sequence
  chemically synthesized
actcatgatccagttaaagctt

SEQ ID NO: 15124 - DNA, 22 bp, Artificial Sequence
  chemically synthesized
ctcatgatccagttaaagcttg

SEQ ID NO: 15125 - DNA, 22 bp, Artificial Sequence
  chemically synthesized
atgatccagttaaagcttgtaa

SEQ ID NO: 15126 - DNA, 22 bp, Artificial Sequence
  chemically synthesized
aagcttgtaaataattttagga

SEQ ID NO: 15127 - DNA, 22 bp, Artificial Sequence
  chemically synthesized
gtaaataattttaggattcagt

SEQ ID NO: 15128 - DNA, 22 bp, Artificial Sequence
  chemically synthesized
taaataattttaggattcagtg

SEQ ID NO: 15129 - DNA, 22 bp, Artificial Sequence
  chemically synthesized
taggattcagtgtttttacaga

SEQ ID NO: 15130 - DNA, 22 bp, Artificial Sequence
  chemically synthesized
aggattcagtgtttttacagac

SEQ ID NO: 15131 - DNA, 22 bp, Artificial Sequence
  chemically synthesized
ggattcagtgtttttacagacc

SEQ ID NO: 15132 - DNA, 22 bp, Artificial Sequence
  chemically synthesized
agtgtttttacagacctgtgtg

SEQ ID NO: 15133 - DNA, 22 bp, Artificial Sequence
  chemically synthesized
ttacagacctgtgtgaaagatg

SEQ ID NO: 15134 - DNA, 22 bp, Artificial Sequence
  chemically synthesized
tacagacctgtgtgaaagatgg

SEQ ID NO: 15135 - DNA, 22 bp, Artificial Sequence
  chemically synthesized
acagacctgtgtgaaagatggg

SEQ ID NO: 15136 - DNA, 22 bp, Artificial Sequence
  chemically synthesized
cagacctgtgtgaaagatggga

SEQ ID NO: 15137 - DNA, 22 bp, Artificial Sequence
  chemically synthesized
tgtgaaagatgggacataccat

SEQ ID NO: 15138 - DNA, 22 bp, Artificial Sequence
  chemically synthesized
aaatactgacttacctgatttt

SEQ ID NO: 15139 - DNA, 22 bp, Artificial Sequence
  chemically synthesized
acttacctgattttctatttct

SEQ ID NO: 15140 - DNA, 22 bp, Artificial Sequence
  chemically synthesized
acctgattttctatttctttta

SEQ ID NO: 15141 - DNA, 22 bp, Artificial Sequence
  chemically synthesized
cctgattttctatttcttttat

SEQ ID NO: 15142 - DNA, 22 bp, Artificial Sequence
  chemically synthesized
attttctatttcttttatttga

SEQ ID NO: 15143 - DNA, 22 bp, Artificial Sequence
  chemically synthesized
tctatttcttttatttgactat

SEQ ID NO: 15144 - DNA, 22 bp, Artificial Sequence
  chemically synthesized
ctatttcttttatttgactatg

SEQ ID NO: 15145 - DNA, 22 bp, Artificial Sequence
  chemically synthesized
tatttcttttatttgactatgc

SEQ ID NO: 15146 - DNA, 22 bp, Artificial Sequence
  chemically synthesized
tttcttttatttgactatgctg

SEQ ID NO: 15147 - DNA, 22 bp, Artificial Sequence
  chemically synthesized
cttttatttgactatgctgttg

SEQ ID NO: 15148 - DNA, 22 bp, Artificial Sequence
  chemically synthesized
ttttatttgactatgctgttgg

SEQ ID NO: 15149 - DNA, 22 bp, Artificial Sequence
  chemically synthesized
ttatttgactatgctgttggtt

SEQ ID NO: 15150 - DNA, 22 bp, Artificial Sequence
  chemically synthesized
tatttgactatgctgttggttt

SEQ ID NO: 15151 - DNA, 22 bp, Artificial Sequence
  chemically synthesized
atttgactatgctgttggttta

SEQ ID NO: 15152 - DNA, 22 bp, Artificial Sequence
  chemically synthesized
tttgactatgctgttggtttaa

SEQ ID NO: 15153 - DNA, 22 bp, Artificial Sequence
  chemically synthesized
gactatgctgttggtttaattg

SEQ ID NO: 15154 - DNA, 22 bp, Artificial Sequence
  chemically synthesized
actatgctgttggtttaattgt

SEQ ID NO: 15155 - DNA, 22 bp, Artificial Sequence
  chemically synthesized
tgctgttggtttaattgtttat

SEQ ID NO: 15156 - DNA, 22 bp, Artificial Sequence
  chemically synthesized
ttggtttaattgtttatattgg

SEQ ID NO: 15157 - DNA, 22 bp, Artificial Sequence
  chemically synthesized
gtttaattgtttatattggtct

SEQ ID NO: 15158 - DNA, 22 bp, Artificial Sequence
  chemically synthesized
aattgtttatattggtcttcca

SEQ ID NO: 15159 - DNA, 22 bp, Artificial Sequence
  chemically synthesized
attgtttatattggtcttccac

SEQ ID NO: 15160 - DNA, 22 bp, Artificial Sequence
  chemically synthesized
tttatattggtcttccacggtc

SEQ ID NO: 15161 - DNA, 22 bp, Artificial Sequence
  chemically synthesized
atattggtcttccacggtctgg

SEQ ID NO: 15162 - DNA, 22 bp, Artificial Sequence
  chemically synthesized
tattggtcttccacggtctgga

SEQ ID NO: 15163 - DNA, 22 bp, Artificial Sequence
  chemically synthesized
gtcttccacggtctggagaagg

SEQ ID NO: 15164 - DNA, 22 bp, Artificial Sequence
  chemically synthesized
ccacggtctggagaaggtcttt

SEQ ID NO: 15165 - DNA, 22 bp, Artificial Sequence
  chemically synthesized
cacggtctggagaaggtctttg

SEQ ID NO: 15166 - DNA, 22 bp, Artificial Sequence
  chemically synthesized
gagaaggtctttgatgctatta

SEQ ID NO: 15167 - DNA, 22 bp, Artificial Sequence
  chemically synthesized
tgatgctattatcttgtttttc

SEQ ID NO: 15168 - DNA, 22 bp, Artificial Sequence
  chemically synthesized
gatgctattatcttgtttttct

SEQ ID NO: 15169 - DNA, 22 bp, Artificial Sequence
  chemically synthesized
atgctattatcttgtttttcta

SEQ ID NO: 15170 - DNA, 22 bp, Artificial Sequence
  chemically synthesized
ttatcttgtttttctacaaaag

SEQ ID NO: 15171 - DNA, 22 bp, Artificial Sequence
  chemically synthesized
tcttgtttttctacaaaagtct

SEQ ID NO: 15172 - DNA, 22 bp, Artificial Sequence
  chemically synthesized
gtttttctacaaaagtctggat

SEQ ID NO: 15173 - DNA, 22 bp, Artificial Sequence
  chemically synthesized
tttttctacaaaagtctggata

SEQ ID NO: 15174 - DNA, 22 bp, Artificial Sequence
  chemically synthesized
ttctacaaaagtctggatatag

SEQ ID NO: 15175 - DNA, 22 bp, Artificial Sequence
  chemically synthesized
tctacaaaagtctggatataga

SEQ ID NO: 15176 - DNA, 22 bp, Artificial Sequence
  chemically synthesized
ctacaaaagtctggatatagag

SEQ ID NO: 15177 - DNA, 22 bp, Artificial Sequence
  chemically synthesized
tacaaaagtctggatatagaga

SEQ ID NO: 15178 - DNA, 22 bp, Artificial Sequence
  chemically synthesized
caaaagtctggatatagagagt

SEQ ID NO: 15179 - DNA, 22 bp, Artificial Sequence
  chemically synthesized
gatatagagagtaggttggtta

SEQ ID NO: 15180 - DNA, 22 bp, Artificial Sequence
  chemically synthesized
gttataagttgctttcctcttt

SEQ ID NO: 15181 - DNA, 22 bp, Artificial Sequence
  chemically synthesized
taagttgctttcctctttcttt

SEQ ID NO: 15182 - DNA, 22 bp, Artificial Sequence
  chemically synthesized
ctttcctctttcttttctatta

SEQ ID NO: 15183 - DNA, 22 bp, Artificial Sequence
  chemically synthesized
tcctctttcttttctattaatt

SEQ ID NO: 15184 - DNA, 22 bp, Artificial Sequence
  chemically synthesized
cctctttcttttctattaattt

SEQ ID NO: 15185 - DNA, 22 bp, Artificial Sequence
  chemically synthesized
ctctttcttttctattaatttc

SEQ ID NO: 15186 - DNA, 22 bp, Artificial Sequence
  chemically synthesized
tttcttttctattaatttcctg

SEQ ID NO: 15187 - DNA, 22 bp, Artificial Sequence
  chemically synthesized
tcttttctattaatttcctgta

SEQ ID NO: 15188 - DNA, 22 bp, Artificial Sequence
  chemically synthesized
cttttctattaatttcctgtaa

SEQ ID NO: 15189 - DNA, 22 bp, Artificial Sequence
  chemically synthesized
ttttctattaatttcctgtaac

SEQ ID NO: 15190 - DNA, 22 bp, Artificial Sequence
  chemically synthesized
ttctattaatttcctgtaacac

SEQ ID NO: 15191 - DNA, 22 bp, Artificial Sequence
  chemically synthesized
tctattaatttcctgtaacact

SEQ ID NO: 15192 - DNA, 22 bp, Artificial Sequence
  chemically synthesized
ctattaatttcctgtaacacta

SEQ ID NO: 15193 - DNA, 22 bp, Artificial Sequence
  chemically synthesized
tattaatttcctgtaacactat

SEQ ID NO: 15194 - DNA, 22 bp, Artificial Sequence
  chemically synthesized
ttaatttcctgtaacactatca

SEQ ID NO: 15195 - DNA, 22 bp, Artificial Sequence
  chemically synthesized
atttcctgtaacactatcataa

SEQ ID NO: 15196 - DNA, 22 bp, Artificial Sequence
  chemically synthesized
cctgtaacactatcataatcta

SEQ ID NO: 15197 - DNA, 22 bp, Artificial Sequence
  chemically synthesized
ctgtaacactatcataatctaa

SEQ ID NO: 15198 - DNA, 22 bp, Artificial Sequence
  chemically synthesized
taacactatcataatctaaatt

SEQ ID NO: 15199 - DNA, 22 bp, Artificial Sequence
  chemically synthesized
tcataatctaaatttttaaact

SEQ ID NO: 15200 - DNA, 22 bp, Artificial Sequence
  chemically synthesized
aatttttaaactaataatggat

SEQ ID NO: 15201 - DNA, 22 bp, Artificial Sequence
  chemically synthesized
ttaaactaataatggatttgaa

SEQ ID NO: 15202 - DNA, 22 bp, Artificial Sequence
  chemically synthesized
taaactaataatggatttgaaa

SEQ ID NO: 15203 - DNA, 22 bp, Artificial Sequence
  chemically synthesized
aaactaataatggatttgaaaa

SEQ ID NO: 15204 - DNA, 22 bp, Artificial Sequence
  chemically synthesized
aactaataatggatttgaaaaa

SEQ ID NO: 15205 - DNA, 22 bp, Artificial Sequence
  chemically synthesized
ataatggatttgaaaaatgaat

SEQ ID NO: 15206 - DNA, 22 bp, Artificial Sequence
  chemically synthesized
gaaaaatgaatattggcaattc

SEQ ID NO: 15207 - DNA, 22 bp, Artificial Sequence
  chemically synthesized
aaaaatgaatattggcaattcc

SEQ ID NO: 15208 - DNA, 22 bp, Artificial Sequence
  chemically synthesized
gcaattccttccccttgtatgc

SEQ ID NO: 15209 - DNA, 22 bp, Artificial Sequence
  chemically synthesized
cttccccttgtatgcttctttc

SEQ ID NO: 15210 - DNA, 22 bp, Artificial Sequence
  chemically synthesized
ccccttgtatgcttctttcaaa

SEQ ID NO: 15211 - DNA, 22 bp, Artificial Sequence
  chemically synthesized
cccttgtatgcttctttcaaat

SEQ ID NO: 15212 - DNA, 22 bp, Artificial Sequence
  chemically synthesized
gtatgcttctttcaaatagcac

SEQ ID NO: 15213 - DNA, 22 bp, Artificial Sequence
  chemically synthesized
tatgcttctttcaaatagcaca

SEQ ID NO: 15214 - DNA, 22 bp, Artificial Sequence
  chemically synthesized
ctttcaaatagcacatattttt

SEQ ID NO: 15215 - DNA, 22 bp, Artificial Sequence
  chemically synthesized
tttcaaatagcacatatttttg

SEQ ID NO: 15216 - DNA, 22 bp, Artificial Sequence
  chemically synthesized
tcaaatagcacatatttttgtc

SEQ ID NO: 15217 - DNA, 22 bp, Artificial Sequence
  chemically synthesized
caaatagcacatatttttgtcc

SEQ ID NO: 15218 - DNA, 22 bp, Artificial Sequence
  chemically synthesized
aaatagcacatatttttgtcct

SEQ ID NO: 15219 - DNA, 22 bp, Artificial Sequence
  chemically synthesized
ttgtccttaacattttatttaa

SEQ ID NO: 15220 - DNA, 22 bp, Artificial Sequence
  chemically synthesized
tgtccttaacattttatttaaa

SEQ ID NO: 15221 - DNA, 22 bp, Artificial Sequence
  chemically synthesized
gtccttaacattttatttaaat

SEQ ID NO: 15222 - DNA, 22 bp, Artificial Sequence
  chemically synthesized
tccttaacattttatttaaatt

SEQ ID NO: 15223 - DNA, 22 bp, Artificial Sequence
  chemically synthesized
aacattttatttaaattgtact

SEQ ID NO: 15224 - DNA, 22 bp, Artificial Sequence
  chemically synthesized
acattttatttaaattgtacta

SEQ ID NO: 15225 - DNA, 22 bp, Artificial Sequence
  chemically synthesized
tatttaaattgtactatctcta

SEQ ID NO: 15226 - DNA, 22 bp, Artificial Sequence
  chemically synthesized
atttaaattgtactatctctaa

SEQ ID NO: 15227 - DNA, 22 bp, Artificial Sequence
  chemically synthesized
tttaaattgtactatctctaaa

SEQ ID NO: 15228 - DNA, 22 bp, Artificial Sequence
  chemically synthesized
aaattgtactatctctaaaatt

SEQ ID NO: 15229 - DNA, 22 bp, Artificial Sequence
  chemically synthesized
aattgtactatctctaaaattt

SEQ ID NO: 15230 - DNA, 22 bp, Artificial Sequence
  chemically synthesized
tactatctctaaaatttgattt

SEQ ID NO: 15231 - DNA, 22 bp, Artificial Sequence
  chemically synthesized
tctctaaaatttgattttctga

SEQ ID NO: 15232 - DNA, 22 bp, Artificial Sequence
  chemically synthesized
taaaatttgattttctgaactt

SEQ ID NO: 15233 - DNA, 22 bp, Artificial Sequence
  chemically synthesized
aaatttgattttctgaacttca

SEQ ID NO: 15234 - DNA, 22 bp, Artificial Sequence
  chemically synthesized
gattttctgaacttcaattaaa

SEQ ID NO: 15235 - DNA, 22 bp, Artificial Sequence
  chemically synthesized
attttctgaacttcaattaaaa

SEQ ID NO: 15236 - DNA, 22 bp, Artificial Sequence
  chemically synthesized
tctgaacttcaattaaaagaaa

SEQ ID NO: 15237 - DNA, 22 bp, Artificial Sequence
  chemically synthesized
ctgaacttcaattaaaagaaaa

SEQ ID NO: 15238 - DNA, 22 bp, Artificial Sequence
  chemically synthesized
tgaacttcaattaaaagaaaaa

SEQ ID NO: 15239 - DNA, 22 bp, Artificial Sequence
  chemically synthesized
aacttcaattaaaagaaaaagc

SEQ ID NO: 15240 - DNA, 22 bp, Artificial Sequence
  chemically synthesized
caattaaaagaaaaagcccagc

SEQ ID NO: 15241 - DNA, 22 bp, Artificial Sequence
  chemically synthesized
aattaaaagaaaaagcccagca

SEQ ID NO: 15242 - DNA, 22 bp, Artificial Sequence
  chemically synthesized
aaagaaaaagcccagcatattt

SEQ ID NO: 15243 - DNA, 22 bp, Artificial Sequence
  chemically synthesized
tcatatgaataaatcttttcca

SEQ ID NO: 15244 - DNA, 22 bp, Artificial Sequence
  chemically synthesized
catatgaataaatcttttccat

SEQ ID NO: 15245 - DNA, 22 bp, Artificial Sequence
  chemically synthesized
atatgaataaatcttttccatt

SEQ ID NO: 15246 - DNA, 22 bp, Artificial Sequence
  chemically synthesized
ttccatttactgtattatttaa

SEQ ID NO: 15247 - DNA, 22 bp, Artificial Sequence
  chemically synthesized
tccatttactgtattatttaat

SEQ ID NO: 15248 - DNA, 22 bp, Artificial Sequence
  chemically synthesized
ccatttactgtattatttaatc

SEQ ID NO: 15249 - DNA, 22 bp, Artificial Sequence
  chemically synthesized
catttactgtattatttaatct

SEQ ID NO: 15250 - DNA, 22 bp, Artificial Sequence
  chemically synthesized
actgtattatttaatctgtttt

SEQ ID NO: 15251 - DNA, 22 bp, Artificial Sequence
  chemically synthesized
ctgtattatttaatctgtttta

SEQ ID NO: 15252 - DNA, 22 bp, Artificial Sequence
  chemically synthesized
tattatttaatctgttttaaac

SEQ ID NO: 15253 - DNA, 22 bp, Artificial Sequence
  chemically synthesized
tttaatctgttttaaacactgg

SEQ ID NO: 15254 - DNA, 22 bp, Artificial Sequence
  chemically synthesized
aatctgttttaaacactggaga

SEQ ID NO: 15255 - DNA, 22 bp, Artificial Sequence
  chemically synthesized
atctgttttaaacactggagaa

SEQ ID NO: 15256 - DNA, 22 bp, Artificial Sequence
  chemically synthesized
ttttaaacactggagaatagtt

SEQ ID NO: 15257 - DNA, 22 bp, Artificial Sequence
  chemically synthesized
taaacactggagaatagtttta

SEQ ID NO: 15258 - DNA, 22 bp, Artificial Sequence
  chemically synthesized
aaacactggagaatagttttaa

SEQ ID NO: 15259 - DNA, 22 bp, Artificial Sequence
  chemically synthesized
aacactggagaatagttttaaa

SEQ ID NO: 15260 - DNA, 22 bp, Artificial Sequence
  chemically synthesized
gagaatagttttaaattttttt

SEQ ID NO: 15261 - DNA, 22 bp, Artificial Sequence
  chemically synthesized
taaattttttttaactttttac

SEQ ID NO: 15262 - DNA, 22 bp, Artificial Sequence
  chemically synthesized
aaattttttttaactttttact

SEQ ID NO: 15263 - DNA, 22 bp, Artificial Sequence
  chemically synthesized
aattttttttaactttttactt

SEQ ID NO: 15264 - DNA, 22 bp, Artificial Sequence
  chemically synthesized
tttttaactttttacttacctt

SEQ ID NO: 15265 - DNA, 22 bp, Artificial Sequence
  chemically synthesized
ttttaactttttacttaccttc

SEQ ID NO: 15266 - DNA, 22 bp, Artificial Sequence
  chemically synthesized
tttaactttttacttaccttca

SEQ ID NO: 15267 - DNA, 22 bp, Artificial Sequence
  chemically synthesized
ttaactttttacttaccttcag

SEQ ID NO: 15268 - DNA, 22 bp, Artificial Sequence
  chemically synthesized
taactttttacttaccttcagt

SEQ ID NO: 15269 - DNA, 22 bp, Artificial Sequence
  chemically synthesized
aactttttacttaccttcagta

SEQ ID NO: 15270 - DNA, 22 bp, Artificial Sequence
  chemically synthesized
actttttacttaccttcagtaa

SEQ ID NO: 15271 - DNA, 22 bp, Artificial Sequence
  chemically synthesized
tttacttaccttcagtaattta

SEQ ID NO: 15272 - DNA, 22 bp, Artificial Sequence
  chemically synthesized
ttacttaccttcagtaatttac

SEQ ID NO: 15273 - DNA, 22 bp, Artificial Sequence
  chemically synthesized
tacttaccttcagtaatttaca

SEQ ID NO: 15274 - DNA, 22 bp, Artificial Sequence
  chemically synthesized
acttaccttcagtaatttacaa

SEQ ID NO: 15275 - DNA, 22 bp, Artificial Sequence
  chemically synthesized
cttaccttcagtaatttacaat

SEQ ID NO: 15276 - DNA, 22 bp, Artificial Sequence
  chemically synthesized
accttcagtaatttacaatagt

SEQ ID NO: 15277 - DNA, 22 bp, Artificial Sequence
  chemically synthesized
ccttcagtaatttacaatagtg

SEQ ID NO: 15278 - DNA, 22 bp, Artificial Sequence
  chemically synthesized
cagtaatttacaatagtgtaat

SEQ ID NO: 15279 - DNA, 22 bp, Artificial Sequence
  chemically synthesized
agtaatttacaatagtgtaatg

SEQ ID NO: 15280 - DNA, 22 bp, Artificial Sequence
  chemically synthesized
acaatagtgtaatgacatagtg

SEQ ID NO: 15281 - DNA, 22 bp, Artificial Sequence
  chemically synthesized
caatagtgtaatgacatagtgt

SEQ ID NO: 15282 - DNA, 22 bp, Artificial Sequence
  chemically synthesized
tagattgtataatttaaccgat

SEQ ID NO: 15283 - DNA, 22 bp, Artificial Sequence
  chemically synthesized
gattgtataatttaaccgattt

SEQ ID NO: 15284 - DNA, 22 bp, Artificial Sequence
  chemically synthesized
tataatttaaccgatttgtaat

SEQ ID NO: 15285 - DNA, 22 bp, Artificial Sequence
  chemically synthesized
aaccgatttgtaattttcatat

SEQ ID NO: 15286 - DNA, 22 bp, Artificial Sequence
  chemically synthesized
accgatttgtaattttcatata

SEQ ID NO: 15287 - DNA, 22 bp, Artificial Sequence
  chemically synthesized
gtaattttcatataaaatgcaa

SEQ ID NO: 15288 - DNA, 22 bp, Artificial Sequence
  chemically synthesized
taattttcatataaaatgcaaa

SEQ ID NO: 15289 - DNA, 22 bp, Artificial Sequence
  chemically synthesized
tcatataaaatgcaaattttca

SEQ ID NO: 15290 - DNA, 22 bp, Artificial Sequence
  chemically synthesized
catataaaatgcaaattttcag

SEQ ID NO: 15291 - DNA, 22 bp, Artificial Sequence
  chemically synthesized
atataaaatgcaaattttcagt

SEQ ID NO: 15292 - DNA, 22 bp, Artificial Sequence
  chemically synthesized
tcagtgttttcatatataacat

SEQ ID NO: 15293 - DNA, 22 bp, Artificial Sequence
  chemically synthesized
cagtgttttcatatataacatt

SEQ ID NO: 15294 - DNA, 22 bp, Artificial Sequence
  chemically synthesized
agtgttttcatatataacatta

SEQ ID NO: 15295 - DNA, 22 bp, Artificial Sequence
  chemically synthesized
tcatatataacattagggaaac

SEQ ID NO: 15296 - DNA, 22 bp, Artificial Sequence
  chemically synthesized
catatataacattagggaaaca

SEQ ID NO: 15297 - DNA, 22 bp, Artificial Sequence
  chemically synthesized
atatataacattagggaaacaa

SEQ ID NO: 15298 - DNA, 22 bp, Artificial Sequence
  chemically synthesized
gggaaacaaaaaactaacttga

SEQ ID NO: 15299 - DNA, 22 bp, Artificial Sequence
  chemically synthesized
acttgaaattataataggaaat

SEQ ID NO: 15300 - DNA, 22 bp, Artificial Sequence
  chemically synthesized
gaaattataataggaaatttta

SEQ ID NO: 15301 - DNA, 22 bp, Artificial Sequence
  chemically synthesized
aaattataataggaaattttat

SEQ ID NO: 15302 - DNA, 22 bp, Artificial Sequence
  chemically synthesized
taataggaaattttattttctg

SEQ ID NO: 15303 - DNA, 22 bp, Artificial Sequence
  chemically synthesized
tattttctggagattatttttc

SEQ ID NO: 15304 - DNA, 22 bp, Artificial Sequence
  chemically synthesized
attttctggagattatttttct

SEQ ID NO: 15305 - DNA, 22 bp, Artificial Sequence
  chemically synthesized
ttttctggagattatttttctt

SEQ ID NO: 15306 - DNA, 22 bp, Artificial Sequence
  chemically synthesized
tctggagattatttttcttgga

SEQ ID NO: 15307 - DNA, 22 bp, Artificial Sequence
  chemically synthesized
ctggagattatttttcttggaa

SEQ ID NO: 15308 - DNA, 22 bp, Artificial Sequence
  chemically synthesized
tggagattatttttcttggaaa

SEQ ID NO: 15309 - DNA, 22 bp, Artificial Sequence
  chemically synthesized
gagattatttttcttggaaaaa

SEQ ID NO: 15310 - DNA, 22 bp, Artificial Sequence
  chemically synthesized
tttttcttggaaaaaaaagtat

SEQ ID NO: 15311 - DNA, 22 bp, Artificial Sequence
  chemically synthesized
ttcttggaaaaaaaagtatttc

SEQ ID NO: 15312 - DNA, 22 bp, Artificial Sequence
  chemically synthesized
tcttggaaaaaaaagtatttca

SEQ ID NO: 15313 - DNA, 22 bp, Artificial Sequence
  chemically synthesized
cttggaaaaaaaagtatttcaa

SEQ ID NO: 15314 - DNA, 22 bp, Artificial Sequence
  chemically synthesized
ttggaaaaaaaagtatttcaac

SEQ ID NO: 15315 - DNA, 22 bp, Artificial Sequence
  chemically synthesized
ggaaaaaaaagtatttcaacaa

SEQ ID NO: 15316 - DNA, 22 bp, Artificial Sequence
  chemically synthesized
gaaaaaaaagtatttcaacaat

SEQ ID NO: 15317 - DNA, 22 bp, Artificial Sequence
  chemically synthesized
caacaatgcaacaaagtatttc

SEQ ID NO: 15318 - DNA, 22 bp, Artificial Sequence
  chemically synthesized
aacaatgcaacaaagtatttca

SEQ ID NO: 15319 - DNA, 22 bp, Artificial Sequence
  chemically synthesized
caaatggcatgccttagaaata

SEQ ID NO: 15320 - DNA, 22 bp, Artificial Sequence
  chemically synthesized
aaatggcatgccttagaaatat

SEQ ID NO: 15321 - DNA, 22 bp, Artificial Sequence
  chemically synthesized
agaaatattttttttaaaagat

SEQ ID NO: 15322 - DNA, 22 bp, Artificial Sequence
  chemically synthesized
gaaatattttttttaaaagatc

SEQ ID NO: 15323 - DNA, 22 bp, Artificial Sequence
  chemically synthesized
tttttaaaagatccacattgaa

SEQ ID NO: 15324 - DNA, 22 bp, Artificial Sequence
  chemically synthesized
ttttaaaagatccacattgaaa

SEQ ID NO: 15325 - DNA, 22 bp, Artificial Sequence
  chemically synthesized
tttaaaagatccacattgaaaa

SEQ ID NO: 15326 - DNA, 22 bp, Artificial Sequence
  chemically synthesized
ttaaaagatccacattgaaaac

SEQ ID NO: 15327 - DNA, 22 bp, Artificial Sequence
  chemically synthesized
taaaagatccacattgaaaaca

SEQ ID NO: 15328 - DNA, 22 bp, Artificial Sequence
  chemically synthesized
aaaagatccacattgaaaacat

SEQ ID NO: 15329 - DNA, 22 bp, Artificial Sequence
  chemically synthesized
aaagatccacattgaaaacata

SEQ ID NO: 15330 - DNA, 22 bp, Artificial Sequence
  chemically synthesized
aaaacataaacatgaaccctct

SEQ ID NO: 15331 - DNA, 22 bp, Artificial Sequence
  chemically synthesized
tttattttctacttactttaag

SEQ ID NO: 15332 - DNA, 22 bp, Artificial Sequence
  chemically synthesized
tattttctacttactttaagtg

SEQ ID NO: 15333 - DNA, 22 bp, Artificial Sequence
  chemically synthesized
attttctacttactttaagtga

SEQ ID NO: 15334 - DNA, 22 bp, Artificial Sequence
  chemically synthesized
ttttctacttactttaagtgaa

SEQ ID NO: 15335 - DNA, 22 bp, Artificial Sequence
  chemically synthesized
tctacttactttaagtgaagtt

SEQ ID NO: 15336 - DNA, 22 bp, Artificial Sequence
  chemically synthesized
ctacttactttaagtgaagtta

SEQ ID NO: 15337 - DNA, 22 bp, Artificial Sequence
  chemically synthesized
tacttactttaagtgaagttac

SEQ ID NO: 15338 - DNA, 22 bp, Artificial Sequence
  chemically synthesized
cttactttaagtgaagttactt

SEQ ID NO: 15339 - DNA, 22 bp, Artificial Sequence
  chemically synthesized
actttaagtgaagttacttctg

SEQ ID NO: 15340 - DNA, 22 bp, Artificial Sequence
  chemically synthesized
ctttaagtgaagttacttctgg

SEQ ID NO: 15341 - DNA, 22 bp, Artificial Sequence
  chemically synthesized
taagtgaagttacttctgggtg

SEQ ID NO: 15342 - DNA, 22 bp, Artificial Sequence
  chemically synthesized
aagtgaagttacttctgggtgt

SEQ ID NO: 15343 - DNA, 22 bp, Artificial Sequence
  chemically synthesized
agtgaagttacttctgggtgtt

SEQ ID NO: 15344 - DNA, 22 bp, Artificial Sequence
  chemically synthesized
cttctgggtgttctggagtttc

SEQ ID NO: 15345 - DNA, 22 bp, Artificial Sequence
  chemically synthesized
ctgggtgttctggagtttcagg

SEQ ID NO: 15346 - DNA, 22 bp, Artificial Sequence
  chemically synthesized
tgggtgttctggagtttcaggt

SEQ ID NO: 15347 - DNA, 22 bp, Artificial Sequence
  chemically synthesized
ggtgttctggagtttcaggttg

SEQ ID NO: 15348 - DNA, 22 bp, Artificial Sequence
  chemically synthesized
tggagtttcaggttgattttga

SEQ ID NO: 15349 - DNA, 22 bp, Artificial Sequence
  chemically synthesized
gagtttcaggttgattttgaat

SEQ ID NO: 15350 - DNA, 22 bp, Artificial Sequence
  chemically synthesized
caggttgattttgaattaagtt

SEQ ID NO: 15351 - DNA, 22 bp, Artificial Sequence
  chemically synthesized
aggttgattttgaattaagtta

SEQ ID NO: 15352 - DNA, 22 bp, Artificial Sequence
  chemically synthesized
attttgaattaagttagttagt

SEQ ID NO: 15353 - DNA, 22 bp, Artificial Sequence
  chemically synthesized
tgaattaagttagttagttgct

SEQ ID NO: 15354 - DNA, 22 bp, Artificial Sequence
  chemically synthesized
gaattaagttagttagttgctc

SEQ ID NO: 15355 - DNA, 22 bp, Artificial Sequence
  chemically synthesized
aattaagttagttagttgctct

SEQ ID NO: 15356 - DNA, 22 bp, Artificial Sequence
  chemically synthesized
agttagttagttgctcttctaa

SEQ ID NO: 15357 - DNA, 22 bp, Artificial Sequence
  chemically synthesized
gttagttgctcttctaaatatt

SEQ ID NO: 15358 - DNA, 22 bp, Artificial Sequence
  chemically synthesized
gttgctcttctaaatatttcac

SEQ ID NO: 15359 - DNA, 22 bp, Artificial Sequence
  chemically synthesized
ctcttctaaatatttcactttt

SEQ ID NO: 15360 - DNA, 22 bp, Artificial Sequence
  chemically synthesized
ttctaaatatttcactttttgt

SEQ ID NO: 15361 - DNA, 22 bp, Artificial Sequence
  chemically synthesized
ctaaatatttcactttttgttg

SEQ ID NO: 15362 - DNA, 22 bp, Artificial Sequence
  chemically synthesized
taaatatttcactttttgttga

SEQ ID NO: 15363 - DNA, 22 bp, Artificial Sequence
  chemically synthesized
aatatttcactttttgttgaag

SEQ ID NO: 15364 - DNA, 22 bp, Artificial Sequence
  chemically synthesized
cactttttgttgaagtagaatt

SEQ ID NO: 15365 - DNA, 22 bp, Artificial Sequence
  chemically synthesized
actttttgttgaagtagaattt

SEQ ID NO: 15366 - DNA, 22 bp, Artificial Sequence
  chemically synthesized
tttgttgaagtagaattttttc

SEQ ID NO: 15367 - DNA, 22 bp, Artificial Sequence
  chemically synthesized
ttgttgaagtagaattttttct

SEQ ID NO: 15368 - DNA, 22 bp, Artificial Sequence
  chemically synthesized
tgttgaagtagaattttttctt

SEQ ID NO: 15369 - DNA, 22 bp, Artificial Sequence
  chemically synthesized
gttgaagtagaattttttcttc

SEQ ID NO: 15370 - DNA, 22 bp, Artificial Sequence
  chemically synthesized
ttgaagtagaattttttcttct

SEQ ID NO: 15371 - DNA, 22 bp, Artificial Sequence
  chemically synthesized
aagtagaattttttcttctagg

SEQ ID NO: 15372 - DNA, 22 bp, Artificial Sequence
  chemically synthesized
tttcttctaggaggctttcaag

SEQ ID NO: 15373 - DNA, 22 bp, Artificial Sequence
  chemically synthesized
ttcttctaggaggctttcaagt

SEQ ID NO: 15374 - DNA, 22 bp, Artificial Sequence
  chemically synthesized
tcttctaggaggctttcaagtt

SEQ ID NO: 15375 - DNA, 22 bp, Artificial Sequence
  chemically synthesized
cttctaggaggctttcaagttt

SEQ ID NO: 15376 - DNA, 22 bp, Artificial Sequence
  chemically synthesized
ttctaggaggctttcaagtttt

SEQ ID NO: 15377 - DNA, 22 bp, Artificial Sequence
  chemically synthesized
ctaggaggctttcaagttttga

SEQ ID NO: 15378 - DNA, 22 bp, Artificial Sequence
  chemically synthesized
taggaggctttcaagttttgag

SEQ ID NO: 15379 - DNA, 22 bp, Artificial Sequence
  chemically synthesized
ggaggctttcaagttttgagtt

SEQ ID NO: 15380 - DNA, 22 bp, Artificial Sequence
  chemically synthesized
tcaagttttgagttgagttcaa

SEQ ID NO: 15381 - DNA, 22 bp, Artificial Sequence
  chemically synthesized
caagttttgagttgagttcaag

SEQ ID NO: 15382 - DNA, 22 bp, Artificial Sequence
  chemically synthesized
aagttttgagttgagttcaagt

SEQ ID NO: 15383 - DNA, 22 bp, Artificial Sequence
  chemically synthesized
tgagttgagttcaagtgacata

SEQ ID NO: 15384 - DNA, 22 bp, Artificial Sequence
  chemically synthesized
gagttgagttcaagtgacatat

SEQ ID NO: 15385 - DNA, 22 bp, Artificial Sequence
  chemically synthesized
agttgagttcaagtgacatatt

SEQ ID NO: 15386 - DNA, 22 bp, Artificial Sequence
  chemically synthesized
agttcaagtgacatattcttta

SEQ ID NO: 15387 - DNA, 22 bp, Artificial Sequence
  chemically synthesized
aagtgacatattctttacctct

SEQ ID NO: 15388 - DNA, 22 bp, Artificial Sequence
  chemically synthesized
tttacctcttcatttttgactt

SEQ ID NO: 15389 - DNA, 22 bp, Artificial Sequence
  chemically synthesized
tacctcttcatttttgacttgt

SEQ ID NO: 15390 - DNA, 22 bp, Artificial Sequence
  chemically synthesized
acctcttcatttttgacttgta

SEQ ID NO: 15391 - DNA, 22 bp, Artificial Sequence
  chemically synthesized
cctcttcatttttgacttgtag

SEQ ID NO: 15392 - DNA, 22 bp, Artificial Sequence
  chemically synthesized
ttcatttttgacttgtagttta

SEQ ID NO: 15393 - DNA, 22 bp, Artificial Sequence
  chemically synthesized
catttttgacttgtagtttata

SEQ ID NO: 15394 - DNA, 22 bp, Artificial Sequence
  chemically synthesized
atttttgacttgtagtttatat

SEQ ID NO: 15395 - DNA, 22 bp, Artificial Sequence
  chemically synthesized
ttgacttgtagtttatatgtag

SEQ ID NO: 15396 - DNA, 22 bp, Artificial Sequence
  chemically synthesized
tgacttgtagtttatatgtagt

SEQ ID NO: 15397 - DNA, 22 bp, Artificial Sequence
  chemically synthesized
gacttgtagtttatatgtagtt

SEQ ID NO: 15398 - DNA, 22 bp, Artificial Sequence
  chemically synthesized
acttgtagtttatatgtagttc

SEQ ID NO: 15399 - DNA, 22 bp, Artificial Sequence
  chemically synthesized
gtagtttatatgtagttcttct

SEQ ID NO: 15400 - DNA, 22 bp, Artificial Sequence
  chemically synthesized
tagtttatatgtagttcttctc

SEQ ID NO: 15401 - DNA, 22 bp, Artificial Sequence
  chemically synthesized
atatgtagttcttctcagttcc

SEQ ID NO: 15402 - DNA, 22 bp, Artificial Sequence
  chemically synthesized
tatgtagttcttctcagttcct

SEQ ID NO: 15403 - DNA, 22 bp, Artificial Sequence
  chemically synthesized
ttctcagttccttttcttcttc

SEQ ID NO: 15404 - DNA, 22 bp, Artificial Sequence
  chemically synthesized
ctcagttccttttcttcttctt

SEQ ID NO: 15405 - DNA, 22 bp, Artificial Sequence
  chemically synthesized
tcagttccttttcttcttcttt

SEQ ID NO: 15406 - DNA, 22 bp, Artificial Sequence
  chemically synthesized
agttccttttcttcttctttga

SEQ ID NO: 15407 - DNA, 22 bp, Artificial Sequence
  chemically synthesized
cttttcttcttctttgatttca

SEQ ID NO: 15408 - DNA, 22 bp, Artificial Sequence
  chemically synthesized
ttcttcttctttgatttcactg

SEQ ID NO: 15409 - DNA, 22 bp, Artificial Sequence
  chemically synthesized
tcttcttctttgatttcactgg

SEQ ID NO: 15410 - DNA, 22 bp, Artificial Sequence
  chemically synthesized
cttcttctttgatttcactggt

SEQ ID NO: 15411 - DNA, 22 bp, Artificial Sequence
  chemically synthesized
ttcttctttgatttcactggtt

SEQ ID NO: 15412 - DNA, 22 bp, Artificial Sequence
  chemically synthesized
cttctttgatttcactggtttg

SEQ ID NO: 15413 - DNA, 22 bp, Artificial Sequence
  chemically synthesized
ttctttgatttcactggtttgc

SEQ ID NO: 15414 - DNA, 22 bp, Artificial Sequence
  chemically synthesized
ctttgatttcactggtttgcag

SEQ ID NO: 15415 - DNA, 22 bp, Artificial Sequence
  chemically synthesized
tttgatttcactggtttgcagc

SEQ ID NO: 15416 - DNA, 22 bp, Artificial Sequence
  chemically synthesized
tgatttcactggtttgcagcga

SEQ ID NO: 15417 - DNA, 22 bp, Artificial Sequence
  chemically synthesized
gatttcactggtttgcagcgat

SEQ ID NO: 15418 - DNA, 22 bp, Artificial Sequence
  chemically synthesized
atttcactggtttgcagcgata

SEQ ID NO: 15419 - DNA, 22 bp, Artificial Sequence
  chemically synthesized
cactggtttgcagcgatagatc

SEQ ID NO: 15420 - DNA, 22 bp, Artificial Sequence
  chemically synthesized
actggtttgcagcgatagatca

SEQ ID NO: 15421 - DNA, 22 bp, Artificial Sequence
  chemically synthesized
gtttgcagcgatagatcataaa

SEQ ID NO: 15422 - DNA, 22 bp, Artificial Sequence
  chemically synthesized
gcagcgatagatcataaaaaga

SEQ ID NO: 15423 - DNA, 22 bp, Artificial Sequence
  chemically synthesized
cagcgatagatcataaaaagac

SEQ ID NO: 15424 - DNA, 22 bp, Artificial Sequence
  chemically synthesized
atcaaatatgttgagtttttga

SEQ ID NO: 15425 - DNA, 22 bp, Artificial Sequence
  chemically synthesized
agtttttgaaatatgtcattaa

SEQ ID NO: 15426 - DNA, 22 bp, Artificial Sequence
  chemically synthesized
ttgaaatatgtcattaatttgg

SEQ ID NO: 15427 - DNA, 22 bp, Artificial Sequence
  chemically synthesized
tgaaatatgtcattaatttggc

SEQ ID NO: 15428 - DNA, 22 bp, Artificial Sequence
  chemically synthesized
gaaatatgtcattaatttggcc

SEQ ID NO: 15429 - DNA, 22 bp, Artificial Sequence
  chemically synthesized
aaatatgtcattaatttggccc

SEQ ID NO: 15430 - DNA, 22 bp, Artificial Sequence
  chemically synthesized
atttggcccttcgtcttatgga

SEQ ID NO: 15431 - DNA, 22 bp, Artificial Sequence
  chemically synthesized
ggcccttcgtcttatggacaaa

SEQ ID NO: 15432 - DNA, 22 bp, Artificial Sequence
  chemically synthesized
gcccttcgtcttatggacaaag

SEQ ID NO: 15433 - DNA, 22 bp, Artificial Sequence
  chemically synthesized
cgtcttatggacaaagtcttta

SEQ ID NO: 15434 - DNA, 22 bp, Artificial Sequence
  chemically synthesized
gtcttatggacaaagtctttaa

SEQ ID NO: 15435 - DNA, 22 bp, Artificial Sequence
  chemically synthesized
atggacaaagtctttaagacca

SEQ ID NO: 15436 - DNA, 22 bp, Artificial Sequence
  chemically synthesized
tggacaaagtctttaagaccat

SEQ ID NO: 15437 - DNA, 22 bp, Artificial Sequence
  chemically synthesized
taagaccatgtcccaactgaag

SEQ ID NO: 15438 - DNA, 22 bp, Artificial Sequence
  chemically synthesized
aagaccatgtcccaactgaagg

SEQ ID NO: 15439 - DNA, 22 bp, Artificial Sequence
  chemically synthesized
agaccatgtcccaactgaagga

SEQ ID NO: 15440 - DNA, 22 bp, Artificial Sequence
  chemically synthesized
aaggaggccattggctaaaatt

SEQ ID NO: 15441 - DNA, 22 bp, Artificial Sequence
  chemically synthesized
gctaaaatttttacatcgtcta

SEQ ID NO: 15442 - DNA, 22 bp, Artificial Sequence
  chemically synthesized
aaatttttacatcgtctaacat

SEQ ID NO: 15443 - DNA, 22 bp, Artificial Sequence
  chemically synthesized
ttacatcgtctaacatagcaaa

SEQ ID NO: 15444 - DNA, 22 bp, Artificial Sequence
  chemically synthesized
tacatcgtctaacatagcaaat

SEQ ID NO: 15445 - DNA, 22 bp, Artificial Sequence
  chemically synthesized
acatcgtctaacatagcaaatc

SEQ ID NO: 15446 - DNA, 22 bp, Artificial Sequence
  chemically synthesized
catcgtctaacatagcaaatct

SEQ ID NO: 15447 - DNA, 22 bp, Artificial Sequence
  chemically synthesized
acatagcaaatcttgattttgg

SEQ ID NO: 15448 - DNA, 22 bp, Artificial Sequence
  chemically synthesized
gattttggctctggagatagag

SEQ ID NO: 15449 - DNA, 22 bp, Artificial Sequence
  chemically synthesized
attttggctctggagatagaga

SEQ ID NO: 15450 - DNA, 22 bp, Artificial Sequence
  chemically synthesized
tggctctggagatagagaatca

SEQ ID NO: 15451 - DNA, 22 bp, Artificial Sequence
  chemically synthesized
ggctctggagatagagaatcaa

SEQ ID NO: 15452 - DNA, 22 bp, Artificial Sequence
  chemically synthesized
gctctggagatagagaatcaaa

SEQ ID NO: 15453 - DNA, 22 bp, Artificial Sequence
  chemically synthesized
tggagatagagaatcaaatgat

SEQ ID NO: 15454 - DNA, 22 bp, Artificial Sequence
  chemically synthesized
gagatagagaatcaaatgatga

SEQ ID NO: 15455 - DNA, 22 bp, Artificial Sequence
  chemically synthesized
tcttgatcaattctggaggaaa

SEQ ID NO: 15456 - DNA, 22 bp, Artificial Sequence
  chemically synthesized
gatcaattctggaggaaataac

SEQ ID NO: 15457 - DNA, 22 bp, Artificial Sequence
  chemically synthesized
atcaattctggaggaaataact

SEQ ID NO: 15458 - DNA, 22 bp, Artificial Sequence
  chemically synthesized
tggaggaaataactagaggaac

SEQ ID NO: 15459 - DNA, 22 bp, Artificial Sequence
  chemically synthesized
gaggaaataactagaggaacaa

SEQ ID NO: 15460 - DNA, 22 bp, Artificial Sequence
  chemically synthesized
gaggaacaataaaaagaaggag

SEQ ID NO: 15461 - DNA, 22 bp, Artificial Sequence
  chemically synthesized
aattgtgaacatttttatcttg

SEQ ID NO: 15462 - DNA, 22 bp, Artificial Sequence
  chemically synthesized
attgtgaacatttttatcttga

SEQ ID NO: 15463 - DNA, 22 bp, Artificial Sequence
  chemically synthesized
tgaacatttttatcttgatttt

SEQ ID NO: 15464 - DNA, 22 bp, Artificial Sequence
  chemically synthesized
ttatcttgattttcaatttcaa

SEQ ID NO: 15465 - DNA, 22 bp, Artificial Sequence
  chemically synthesized
tatcttgattttcaatttcaag

SEQ ID NO: 15466 - DNA, 22 bp, Artificial Sequence
  chemically synthesized
atcttgattttcaatttcaagc

SEQ ID NO: 15467 - DNA, 22 bp, Artificial Sequence
  chemically synthesized
tcttgattttcaatttcaagca

SEQ ID NO: 15468 - DNA, 22 bp, Artificial Sequence
  chemically synthesized
gattttcaatttcaagcaacgt

SEQ ID NO: 15469 - DNA, 22 bp, Artificial Sequence
  chemically synthesized
attttcaatttcaagcaacgtg

SEQ ID NO: 15470 - DNA, 22 bp, Artificial Sequence
  chemically synthesized
tcaatttcaagcaacgtggaac

SEQ ID NO: 15471 - DNA, 22 bp, Artificial Sequence
  chemically synthesized
caatttcaagcaacgtggaact

SEQ ID NO: 15472 - DNA, 22 bp, Artificial Sequence
  chemically synthesized
aatttcaagcaacgtggaactg

SEQ ID NO: 15473 - DNA, 22 bp, Artificial Sequence
  chemically synthesized
caagcaacgtggaactgttttc

SEQ ID NO: 15474 - DNA, 22 bp, Artificial Sequence
  chemically synthesized
aagcaacgtggaactgttttct

SEQ ID NO: 15475 - DNA, 22 bp, Artificial Sequence
  chemically synthesized
ttttcttctggaagcagaccta

SEQ ID NO: 15476 - DNA, 22 bp, Artificial Sequence
  chemically synthesized
tcttctggaagcagacctagac

SEQ ID NO: 15477 - DNA, 22 bp, Artificial Sequence
  chemically synthesized
cttctggaagcagacctagact

SEQ ID NO: 15478 - DNA, 22 bp, Artificial Sequence
  chemically synthesized
ttctggaagcagacctagactt

SEQ ID NO: 15479 - DNA, 22 bp, Artificial Sequence
  chemically synthesized
ctggaagcagacctagacttct

SEQ ID NO: 15480 - DNA, 22 bp, Artificial Sequence
  chemically synthesized
tggaagcagacctagacttctt

SEQ ID NO: 15481 - DNA, 22 bp, Artificial Sequence
  chemically synthesized
gaagcagacctagacttcttaa

SEQ ID NO: 15482 - DNA, 22 bp, Artificial Sequence
  chemically synthesized
gacttcttaactctatatatac

SEQ ID NO: 15483 - DNA, 22 bp, Artificial Sequence
  chemically synthesized
cttaactctatatataccaata

SEQ ID NO: 15484 - DNA, 22 bp, Artificial Sequence
  chemically synthesized
ttaactctatatataccaatat

SEQ ID NO: 15485 - DNA, 22 bp, Artificial Sequence
  chemically synthesized
aactctatatataccaatattt

SEQ ID NO: 15486 - DNA, 22 bp, Artificial Sequence
  chemically synthesized
actctatatataccaatatttg

SEQ ID NO: 15487 - DNA, 22 bp, Artificial Sequence
  chemically synthesized
tatatataccaatatttgccca

SEQ ID NO: 15488 - DNA, 22 bp, Artificial Sequence
  chemically synthesized
tatataccaatatttgcccaga

SEQ ID NO: 15489 - DNA, 22 bp, Artificial Sequence
  chemically synthesized
gcccagaaaaggtaaggttggt

SEQ ID NO: 15490 - DNA, 22 bp, Artificial Sequence
  chemically synthesized
cccagaaaaggtaaggttggta

SEQ ID NO: 15491 - DNA, 22 bp, Artificial Sequence
  chemically synthesized
gtaggtgaacatagttaatcat

SEQ ID NO: 15492 - DNA, 22 bp, Artificial Sequence
  chemically synthesized
atcattaagccgtgttaacttg

SEQ ID NO: 15493 - DNA, 22 bp, Artificial Sequence
  chemically synthesized
agccgtgttaacttgcacgaat

SEQ ID NO: 15494 - DNA, 22 bp, Artificial Sequence
  chemically synthesized
acttgcacgaatgtaaccttct

SEQ ID NO: 15495 - DNA, 22 bp, Artificial Sequence
  chemically synthesized
gcacgaatgtaaccttcttcca

SEQ ID NO: 15496 - DNA, 22 bp, Artificial Sequence
  chemically synthesized
cacgaatgtaaccttcttccac

SEQ ID NO: 15497 - DNA, 22 bp, Artificial Sequence
  chemically synthesized
cttccacattgagttagatcaa

SEQ ID NO: 15498 - DNA, 22 bp, Artificial Sequence
  chemically synthesized
ttccacattgagttagatcaat

SEQ ID NO: 15499 - DNA, 22 bp, Artificial Sequence
  chemically synthesized
ccacattgagttagatcaatgc

SEQ ID NO: 15500 - DNA, 22 bp, Artificial Sequence
  chemically synthesized
cacattgagttagatcaatgct

SEQ ID NO: 15501 - DNA, 22 bp, Artificial Sequence
  chemically synthesized
agttagatcaatgctaaatgaa

SEQ ID NO: 15502 - DNA, 22 bp, Artificial Sequence
  chemically synthesized
gatcaatgctaaatgaaatcaa

SEQ ID NO: 15503 - DNA, 22 bp, Artificial Sequence
  chemically synthesized
aatgaaatcaaagaaatgagca

SEQ ID NO: 15504 - DNA, 22 bp, Artificial Sequence
  chemically synthesized
acttaataggtaatttgaaatt

SEQ ID NO: 15505 - DNA, 22 bp, Artificial Sequence
  chemically synthesized
aataggtaatttgaaattgtat

SEQ ID NO: 15506 - DNA, 22 bp, Artificial Sequence
  chemically synthesized
ataggtaatttgaaattgtatt

SEQ ID NO: 15507 - DNA, 22 bp, Artificial Sequence
  chemically synthesized
gaaattgtatttaactttgctg

SEQ ID NO: 15508 - DNA, 22 bp, Artificial Sequence
  chemically synthesized
aaattgtatttaactttgctgt

SEQ ID NO: 15509 - DNA, 22 bp, Artificial Sequence
  chemically synthesized
tatttaactttgctgtattata

SEQ ID NO: 15510 - DNA, 22 bp, Artificial Sequence
  chemically synthesized
aactttgctgtattataaacta

SEQ ID NO: 15511 - DNA, 22 bp, Artificial Sequence
  chemically synthesized
actttgctgtattataaactac

SEQ ID NO: 15512 - DNA, 22 bp, Artificial Sequence
  chemically synthesized
tgctgtattataaactacacat

SEQ ID NO: 15513 - DNA, 22 bp, Artificial Sequence
  chemically synthesized
gctgtattataaactacacatt

SEQ ID NO: 15514 - DNA, 22 bp, Artificial Sequence
  chemically synthesized
ctgtattataaactacacattc

SEQ ID NO: 15515 - DNA, 22 bp, Artificial Sequence
  chemically synthesized
tattataaactacacattcaat

SEQ ID NO: 15516 - DNA, 22 bp, Artificial Sequence
  chemically synthesized
taaactacacattcaatgctat

SEQ ID NO: 15517 - DNA, 22 bp, Artificial Sequence
  chemically synthesized
cacattcaatgctatggtgact

SEQ ID NO: 15518 - DNA, 22 bp, Artificial Sequence
  chemically synthesized
aatgctatggtgactacctgtt

SEQ ID NO: 15519 - DNA, 22 bp, Artificial Sequence
  chemically synthesized
tggtgactacctgtttttaaaa

SEQ ID NO: 15520 - DNA, 22 bp, Artificial Sequence
  chemically synthesized
cctgtttttaaaagctaatttt

SEQ ID NO: 15521 - DNA, 22 bp, Artificial Sequence
  chemically synthesized
tttttaaaagctaattttactt

SEQ ID NO: 15522 - DNA, 22 bp, Artificial Sequence
  chemically synthesized
ttaaaagctaattttacttttt

SEQ ID NO: 15523 - DNA, 22 bp, Artificial Sequence
  chemically synthesized
taaaagctaattttactttttt

SEQ ID NO: 15524 - DNA, 22 bp, Artificial Sequence
  chemically synthesized
aaaagctaattttactttttta

SEQ ID NO: 15525 - DNA, 22 bp, Artificial Sequence
  chemically synthesized
aaagctaattttacttttttat

SEQ ID NO: 15526 - DNA, 22 bp, Artificial Sequence
  chemically synthesized
attttacttttttatgatttta

SEQ ID NO: 15527 - DNA, 22 bp, Artificial Sequence
  chemically synthesized
tacttttttatgattttaagag

SEQ ID NO: 15528 - DNA, 22 bp, Artificial Sequence
  chemically synthesized
acttttttatgattttaagaga

SEQ ID NO: 15529 - DNA, 22 bp, Artificial Sequence
  chemically synthesized
cttttttatgattttaagagat

SEQ ID NO: 15530 - DNA, 22 bp, Artificial Sequence
  chemically synthesized
ttttatgattttaagagattta

SEQ ID NO: 15531 - DNA, 22 bp, Artificial Sequence
  chemically synthesized
tttatgattttaagagatttac

SEQ ID NO: 15532 - DNA, 22 bp, Artificial Sequence
  chemically synthesized
ttatgattttaagagatttaca

SEQ ID NO: 15533 - DNA, 22 bp, Artificial Sequence
  chemically synthesized
tatgattttaagagatttacaa

SEQ ID NO: 15534 - DNA, 22 bp, Artificial Sequence
  chemically synthesized
atgattttaagagatttacaag

SEQ ID NO: 15535 - DNA, 22 bp, Artificial Sequence
  chemically synthesized
tgattttaagagatttacaagt

SEQ ID NO: 15536 - DNA, 22 bp, Artificial Sequence
  chemically synthesized
taagagatttacaagtcaaaaa

SEQ ID NO: 15537 - DNA, 22 bp, Artificial Sequence
  chemically synthesized
aagagatttacaagtcaaaaat

SEQ ID NO: 15538 - DNA, 22 bp, Artificial Sequence
  chemically synthesized
agagatttacaagtcaaaaata

SEQ ID NO: 15539 - DNA, 22 bp, Artificial Sequence
  chemically synthesized
acaagtcaaaaataaacttttt

SEQ ID NO: 15540 - DNA, 22 bp, Artificial Sequence
  chemically synthesized
caagtcaaaaataaactttttt

SEQ ID NO: 15541 - DNA, 22 bp, Artificial Sequence
  chemically synthesized
ttttgttgggtaaatttattat

SEQ ID NO: 15542 - DNA, 22 bp, Artificial Sequence
  chemically synthesized
tttgttgggtaaatttattatt

SEQ ID NO: 15543 - DNA, 22 bp, Artificial Sequence
  chemically synthesized
ttgttgggtaaatttattatta

SEQ ID NO: 15544 - DNA, 22 bp, Artificial Sequence
  chemically synthesized
tgttgggtaaatttattattaa

SEQ ID NO: 15545 - DNA, 22 bp, Artificial Sequence
  chemically synthesized
gttgggtaaatttattattaaa

SEQ ID NO: 15546 - DNA, 22 bp, Artificial Sequence
  chemically synthesized
ttgggtaaatttattattaaag

SEQ ID NO: 15547 - DNA, 22 bp, Artificial Sequence
  chemically synthesized
ggtaaatttattattaaagttg

SEQ ID NO: 15548 - DNA, 22 bp, Artificial Sequence
  chemically synthesized
attattaaagttgaggggaaaa

SEQ ID NO: 15549 - DNA, 22 bp, Artificial Sequence
  chemically synthesized
ttattaaagttgaggggaaaaa

SEQ ID NO: 15550 - DNA, 22 bp, Artificial Sequence
  chemically synthesized
ttaaagttgaggggaaaaaagt

SEQ ID NO: 15551 - DNA, 22 bp, Artificial Sequence
  chemically synthesized
aagttgaggggaaaaaagtaat

SEQ ID NO: 15552 - DNA, 22 bp, Artificial Sequence
  chemically synthesized
aggggaaaaaagtaatgaatta

SEQ ID NO: 15553 - DNA, 20 bp, Artificial Sequence
  chemically synthesized
tcccgcccgcttgctgcatc

SEQ ID NO: 15554 - DNA, 20 bp, Artificial Sequence
  chemically synthesized
tgcatctggacaccctgcct

SEQ ID NO: 15555 - DNA, 20 bp, Artificial Sequence
  chemically synthesized
gcatctggacaccctgcctc

SEQ ID NO: 15556 - DNA, 20 bp, Artificial Sequence
  chemically synthesized
cctcaggccctcatctccac

SEQ ID NO: 15557 - DNA, 20 bp, Artificial Sequence
  chemically synthesized
aggccctcatctccactggt

SEQ ID NO: 15558 - DNA, 20 bp, Artificial Sequence
  chemically synthesized
ccctcatctccactggtcag

SEQ ID NO: 15559 - DNA, 20 bp, Artificial Sequence
  chemically synthesized
cctcatctccactggtcagc

SEQ ID NO: 15560 - DNA, 20 bp, Artificial Sequence
  chemically synthesized
gtcagcaggtgacctttgcc

SEQ ID NO: 15561 - DNA, 20 bp, Artificial Sequence
  chemically synthesized
gtgacctttgcccagcgccc

SEQ ID NO: 15562 - DNA, 20 bp, Artificial Sequence
  chemically synthesized
tgacctttgcccagcgccct

SEQ ID NO: 15563 - DNA, 20 bp, Artificial Sequence
  chemically synthesized
tgcccagcgccctgggtcct

SEQ ID NO: 15564 - DNA, 20 bp, Artificial Sequence
  chemically synthesized
gtcctcagtgcctgctgccc

SEQ ID NO: 15565 - DNA, 20 bp, Artificial Sequence
  chemically synthesized
cctcagtgcctgctgccctg

SEQ ID NO: 15566 - DNA, 20 bp, Artificial Sequence
  chemically synthesized
gccctggagatgatataaaa

SEQ ID NO: 15567 - DNA, 20 bp, Artificial Sequence
  chemically synthesized
ccctggagatgatataaaac

SEQ ID NO: 15568 - DNA, 20 bp, Artificial Sequence
  chemically synthesized
ggagatgatataaaacaggt

SEQ ID NO: 15569 - DNA, 20 bp, Artificial Sequence
  chemically synthesized
aaccctcctgcctgtctgct

SEQ ID NO: 15570 - DNA, 20 bp, Artificial Sequence
  chemically synthesized
ctgtctgctcagttcatccc

SEQ ID NO: 15571 - DNA, 20 bp, Artificial Sequence
  chemically synthesized
gtctgctcagttcatcccta

SEQ ID NO: 15572 - DNA, 20 bp, Artificial Sequence
  chemically synthesized
tctgctcagttcatccctag

SEQ ID NO: 15573 - DNA, 20 bp, Artificial Sequence
  chemically synthesized
gctcagttcatccctagagg

SEQ ID NO: 15574 - DNA, 20 bp, Artificial Sequence
  chemically synthesized
atccctagaggcagctgctc

SEQ ID NO: 15575 - DNA, 20 bp, Artificial Sequence
  chemically synthesized
tccctagaggcagctgctcc

SEQ ID NO: 15576 - DNA, 20 bp, Artificial Sequence
  chemically synthesized
ctgctccaggtaatgccctc

SEQ ID NO: 15577 - DNA, 20 bp, Artificial Sequence
  chemically synthesized
tgctccaggtaatgccctct

SEQ ID NO: 15578 - DNA, 20 bp, Artificial Sequence
  chemically synthesized
gctccaggtaatgccctctg

SEQ ID NO: 15579 - DNA, 20 bp, Artificial Sequence
  chemically synthesized
tccaggtaatgccctctggg

SEQ ID NO: 15580 - DNA, 20 bp, Artificial Sequence
  chemically synthesized
ccaggtaatgccctctgggg

SEQ ID NO: 15581 - DNA, 20 bp, Artificial Sequence
  chemically synthesized
caggtaatgccctctgggga

SEQ ID NO: 15582 - DNA, 20 bp, Artificial Sequence
  chemically synthesized
aggtaatgccctctggggag

SEQ ID NO: 15583 - DNA, 20 bp, Artificial Sequence
  chemically synthesized
aatgccctctggggagggga

SEQ ID NO: 15584 - DNA, 20 bp, Artificial Sequence
  chemically synthesized
tgccctctggggaggggaaa

SEQ ID NO: 15585 - DNA, 20 bp, Artificial Sequence
  chemically synthesized
gccctctggggaggggaaag

SEQ ID NO: 15586 - DNA, 20 bp, Artificial Sequence
  chemically synthesized
cctctggggaggggaaagag

SEQ ID NO: 15587 - DNA, 20 bp, Artificial Sequence
  chemically synthesized
ctctggggaggggaaagagg

SEQ ID NO: 15588 - DNA, 20 bp, Artificial Sequence
  chemically synthesized
tctggggaggggaaagagga

SEQ ID NO: 15589 - DNA, 20 bp, Artificial Sequence
  chemically synthesized
ctggggaggggaaagaggag

SEQ ID NO: 15590 - DNA, 20 bp, Artificial Sequence
  chemically synthesized
ggggaggggaaagaggaggg

SEQ ID NO: 15591 - DNA, 20 bp, Artificial Sequence
  chemically synthesized
gggaggggaaagaggagggg

SEQ ID NO: 15592 - DNA, 20 bp, Artificial Sequence
  chemically synthesized
gaggggaaagaggaggggag

SEQ ID NO: 15593 - DNA, 20 bp, Artificial Sequence
  chemically synthesized
aggggaaagaggaggggagg

SEQ ID NO: 15594 - DNA, 20 bp, Artificial Sequence
  chemically synthesized
aagaggaggggaggaggatg

SEQ ID NO: 15595 - DNA, 20 bp, Artificial Sequence
  chemically synthesized
gaggaggggaggaggatgaa

SEQ ID NO: 15596 - DNA, 20 bp, Artificial Sequence
  chemically synthesized
aggaggggaggaggatgaag

SEQ ID NO: 15597 - DNA, 20 bp, Artificial Sequence
  chemically synthesized
ggaggggaggaggatgaaga

SEQ ID NO: 15598 - DNA, 20 bp, Artificial Sequence
  chemically synthesized
gaggggaggaggatgaagag

SEQ ID NO: 15599 - DNA, 20 bp, Artificial Sequence
  chemically synthesized
ggaggaggatgaagaggggc

SEQ ID NO: 15600 - DNA, 20 bp, Artificial Sequence
  chemically synthesized
aggaggatgaagaggggcaa

SEQ ID NO: 15601 - DNA, 20 bp, Artificial Sequence
  chemically synthesized
ggaggatgaagaggggcaag

SEQ ID NO: 15602 - DNA, 20 bp, Artificial Sequence
  chemically synthesized
aggatgaagaggggcaagag

SEQ ID NO: 15603 - DNA, 20 bp, Artificial Sequence
  chemically synthesized
ggcaagaggagctccctgcc

SEQ ID NO: 15604 - DNA, 20 bp, Artificial Sequence
  chemically synthesized
gaggagctccctgcccagcc

SEQ ID NO: 15605 - DNA, 20 bp, Artificial Sequence
  chemically synthesized
agctccctgcccagcccagc

SEQ ID NO: 15606 - DNA, 20 bp, Artificial Sequence
  chemically synthesized
ccctgcccagcccagccagc

SEQ ID NO: 15607 - DNA, 20 bp, Artificial Sequence
  chemically synthesized
cccagcccagccagcaagcc

SEQ ID NO: 15608 - DNA, 20 bp, Artificial Sequence
  chemically synthesized
cagcccagccagcaagcctg

SEQ ID NO: 15609 - DNA, 20 bp, Artificial Sequence
  chemically synthesized
cccagccagcaagcctggag

SEQ ID NO: 15610 - DNA, 20 bp, Artificial Sequence
  chemically synthesized
aagcctggagaagcacttgc

SEQ ID NO: 15611 - DNA, 20 bp, Artificial Sequence
  chemically synthesized
gcctggagaagcacttgcta

SEQ ID NO: 15612 - DNA, 20 bp, Artificial Sequence
  chemically synthesized
gagaagcacttgctagagct

SEQ ID NO: 15613 - DNA, 20 bp, Artificial Sequence
  chemically synthesized
agaagcacttgctagagcta

SEQ ID NO: 15614 - DNA, 20 bp, Artificial Sequence
  chemically synthesized
agcacttgctagagctaagg

SEQ ID NO: 15615 - DNA, 20 bp, Artificial Sequence
  chemically synthesized
tgctagagctaaggaagcct

SEQ ID NO: 15616 - DNA, 20 bp, Artificial Sequence
  chemically synthesized
ctagagctaaggaagcctcg

SEQ ID NO: 15617 - DNA, 20 bp, Artificial Sequence
  chemically synthesized
agctaaggaagcctcggagc

SEQ ID NO: 15618 - DNA, 20 bp, Artificial Sequence
  chemically synthesized
aaggaagcctcggagctgga

SEQ ID NO: 15619 - DNA, 20 bp, Artificial Sequence
  chemically synthesized
aggaagcctcggagctggac

SEQ ID NO: 15620 - DNA, 20 bp, Artificial Sequence
  chemically synthesized
ccacccctcatcataacctg

SEQ ID NO: 15621 - DNA, 20 bp, Artificial Sequence
  chemically synthesized
tcatcataacctgaagaaca

SEQ ID NO: 15622 - DNA, 20 bp, Artificial Sequence
  chemically synthesized
atcataacctgaagaacatg

SEQ ID NO: 15623 - DNA, 20 bp, Artificial Sequence
  chemically synthesized
tcataacctgaagaacatgg

SEQ ID NO: 15624 - DNA, 20 bp, Artificial Sequence
  chemically synthesized
acctgaagaacatggaggcc

SEQ ID NO: 15625 - DNA, 20 bp, Artificial Sequence
  chemically synthesized
cctgaagaacatggaggccc

SEQ ID NO: 15626 - DNA, 20 bp, Artificial Sequence
  chemically synthesized
tgaagaacatggaggcccgg

SEQ ID NO: 15627 - DNA, 20 bp, Artificial Sequence
  chemically synthesized
gaagaacatggaggcccggg

SEQ ID NO: 15628 - DNA, 20 bp, Artificial Sequence
  chemically synthesized
aagaacatggaggcccggga

SEQ ID NO: 15629 - DNA, 20 bp, Artificial Sequence
  chemically synthesized
agaacatggaggcccgggag

SEQ ID NO: 15630 - DNA, 20 bp, Artificial Sequence
  chemically synthesized
ggaggggtgtcacttgccca

SEQ ID NO: 15631 - DNA, 20 bp, Artificial Sequence
  chemically synthesized
gtcacttgcccaaagctaca

SEQ ID NO: 15632 - DNA, 20 bp, Artificial Sequence
  chemically synthesized
tcacttgcccaaagctacac

SEQ ID NO: 15633 - DNA, 20 bp, Artificial Sequence
  chemically synthesized
cacttgcccaaagctacaca

SEQ ID NO: 15634 - DNA, 20 bp, Artificial Sequence
  chemically synthesized
acttgcccaaagctacacag

SEQ ID NO: 15635 - DNA, 20 bp, Artificial Sequence
  chemically synthesized
cttgcccaaagctacacagg

SEQ ID NO: 15636 - DNA, 20 bp, Artificial Sequence
  chemically synthesized
gcccaaagctacacaggggg

SEQ ID NO: 15637 - DNA, 20 bp, Artificial Sequence
  chemically synthesized
cccaaagctacacagggggt

SEQ ID NO: 15638 - DNA, 20 bp, Artificial Sequence
  chemically synthesized
ccaaagctacacagggggtg

SEQ ID NO: 15639 - DNA, 20 bp, Artificial Sequence
  chemically synthesized
agctacacagggggtggggc

SEQ ID NO: 15640 - DNA, 20 bp, Artificial Sequence
  chemically synthesized
tacacagggggtggggctgg

SEQ ID NO: 15641 - DNA, 20 bp, Artificial Sequence
  chemically synthesized
acagggggtggggctggaag

SEQ ID NO: 15642 - DNA, 20 bp, Artificial Sequence
  chemically synthesized
gtggggctggaagtggctcc

SEQ ID NO: 15643 - DNA, 20 bp, Artificial Sequence
  chemically synthesized
gctggaagtggctccaagtg

SEQ ID NO: 15644 - DNA, 20 bp, Artificial Sequence
  chemically synthesized
ctggaagtggctccaagtgc

SEQ ID NO: 15645 - DNA, 20 bp, Artificial Sequence
  chemically synthesized
caggttcccccctcattctt

SEQ ID NO: 15646 - DNA, 20 bp, Artificial Sequence
  chemically synthesized
aggttcccccctcattcttc

SEQ ID NO: 15647 - DNA, 20 bp, Artificial Sequence
  chemically synthesized
cccccctcattcttcaggct

SEQ ID NO: 15648 - DNA, 20 bp, Artificial Sequence
  chemically synthesized
ccccctcattcttcaggctt

SEQ ID NO: 15649 - DNA, 20 bp, Artificial Sequence
  chemically synthesized
cccctcattcttcaggctta

SEQ ID NO: 15650 - DNA, 20 bp, Artificial Sequence
  chemically synthesized
tcattcttcaggcttagggc

SEQ ID NO: 15651 - DNA, 20 bp, Artificial Sequence
  chemically synthesized
attcttcaggcttagggctg

SEQ ID NO: 15652 - DNA, 20 bp, Artificial Sequence
  chemically synthesized
ttcttcaggcttagggctgg

SEQ ID NO: 15653 - DNA, 20 bp, Artificial Sequence
  chemically synthesized
ttcaggcttagggctggagg

SEQ ID NO: 15654 - DNA, 20 bp, Artificial Sequence
  chemically synthesized
cttagggctggaggaagcct

SEQ ID NO: 15655 - DNA, 20 bp, Artificial Sequence
  chemically synthesized
gggctggaggaagccttaga

SEQ ID NO: 15656 - DNA, 20 bp, Artificial Sequence
  chemically synthesized
ggaggaagccttagacagcc

SEQ ID NO: 15657 - DNA, 20 bp, Artificial Sequence
  chemically synthesized
tagacagcccagtcctaccc

SEQ ID NO: 15658 - DNA, 20 bp, Artificial Sequence
  chemically synthesized
cagcccagtcctaccccaga

SEQ ID NO: 15659 - DNA, 20 bp, Artificial Sequence
  chemically synthesized
agcccagtcctaccccagac

SEQ ID NO: 15660 - DNA, 20 bp, Artificial Sequence
  chemically synthesized
gcccagtcctaccccagaca

SEQ ID NO: 15661 - DNA, 20 bp, Artificial Sequence
  chemically synthesized
ctaccccagacagggaaact

SEQ ID NO: 15662 - DNA, 20 bp, Artificial Sequence
  chemically synthesized
taccccagacagggaaactg

SEQ ID NO: 15663 - DNA, 20 bp, Artificial Sequence
  chemically synthesized
cagacagggaaactgaggcc

SEQ ID NO: 15664 - DNA, 20 bp, Artificial Sequence
  chemically synthesized
gacagggaaactgaggcctg

SEQ ID NO: 15665 - DNA, 20 bp, Artificial Sequence
  chemically synthesized
cagggaaactgaggcctgga

SEQ ID NO: 15666 - DNA, 20 bp, Artificial Sequence
  chemically synthesized
agggaaactgaggcctggag

SEQ ID NO: 15667 - DNA, 20 bp, Artificial Sequence
  chemically synthesized
gggaaactgaggcctggaga

SEQ ID NO: 15668 - DNA, 20 bp, Artificial Sequence
  chemically synthesized
aactgaggcctggagagggc

SEQ ID NO: 15669 - DNA, 20 bp, Artificial Sequence
  chemically synthesized
agagggccagaaatcaccca

SEQ ID NO: 15670 - DNA, 20 bp, Artificial Sequence
  chemically synthesized
agaaatcacccaaagacaca

SEQ ID NO: 15671 - DNA, 20 bp, Artificial Sequence
  chemically synthesized
cccaaagacacacagcatgt

SEQ ID NO: 15672 - DNA, 20 bp, Artificial Sequence
  chemically synthesized
aagacacacagcatgttggc

SEQ ID NO: 15673 - DNA, 20 bp, Artificial Sequence
  chemically synthesized
acacagcatgttggctggac

SEQ ID NO: 15674 - DNA, 20 bp, Artificial Sequence
  chemically synthesized
agcatgttggctggactgga

SEQ ID NO: 15675 - DNA, 20 bp, Artificial Sequence
  chemically synthesized
catgttggctggactggacg

SEQ ID NO: 15676 - DNA, 20 bp, Artificial Sequence
  chemically synthesized
tggctggactggacggagat

SEQ ID NO: 15677 - DNA, 20 bp, Artificial Sequence
  chemically synthesized
ggactggacggagatcagtc

SEQ ID NO: 15678 - DNA, 20 bp, Artificial Sequence
  chemically synthesized
acggagatcagtccagaccg

SEQ ID NO: 15679 - DNA, 20 bp, Artificial Sequence
  chemically synthesized
cggagatcagtccagaccgc

SEQ ID NO: 15680 - DNA, 20 bp, Artificial Sequence
  chemically synthesized
accgcaggtgccttgatgtt

SEQ ID NO: 15681 - DNA, 20 bp, Artificial Sequence
  chemically synthesized
aggtgccttgatgttcagtc

SEQ ID NO: 15682 - DNA, 20 bp, Artificial Sequence
  chemically synthesized
tgccttgatgttcagtctgg

SEQ ID NO: 15683 - DNA, 20 bp, Artificial Sequence
  chemically synthesized
gccttgatgttcagtctggt

SEQ ID NO: 15684 - DNA, 20 bp, Artificial Sequence
  chemically synthesized
ccatcccacccacctccctt

SEQ ID NO: 15685 - DNA, 20 bp, Artificial Sequence
  chemically synthesized
catcccacccacctcccttt

SEQ ID NO: 15686 - DNA, 20 bp, Artificial Sequence
  chemically synthesized
ctcgatccctcgcccctcac

SEQ ID NO: 15687 - DNA, 20 bp, Artificial Sequence
  chemically synthesized
ccctcaccagtcccccttct

SEQ ID NO: 15688 - DNA, 20 bp, Artificial Sequence
  chemically synthesized
ctcaccagtcccccttctga

SEQ ID NO: 15689 - DNA, 20 bp, Artificial Sequence
  chemically synthesized
ccccttctgagagcccgtat

SEQ ID NO: 15690 - DNA, 20 bp, Artificial Sequence
  chemically synthesized
cttctgagagcccgtattag

SEQ ID NO: 15691 - DNA, 20 bp, Artificial Sequence
  chemically synthesized
ttctgagagcccgtattagc

SEQ ID NO: 15692 - DNA, 20 bp, Artificial Sequence
  chemically synthesized
tctgagagcccgtattagca

SEQ ID NO: 15693 - DNA, 20 bp, Artificial Sequence
  chemically synthesized
tgagagcccgtattagcagg

SEQ ID NO: 15694 - DNA, 20 bp, Artificial Sequence
  chemically synthesized
agcccgtattagcagggagc

SEQ ID NO: 15695 - DNA, 20 bp, Artificial Sequence
  chemically synthesized
gagccggcccctactccttc

SEQ ID NO: 15696 - DNA, 20 bp, Artificial Sequence
  chemically synthesized
ccggcccctactccttctgg

SEQ ID NO: 15697 - DNA, 20 bp, Artificial Sequence
  chemically synthesized
cctactccttctggcagacc

SEQ ID NO: 15698 - DNA, 20 bp, Artificial Sequence
  chemically synthesized
tccttctggcagacccagct

SEQ ID NO: 15699 - DNA, 20 bp, Artificial Sequence
  chemically synthesized
ccttctggcagacccagcta

SEQ ID NO: 15700 - DNA, 20 bp, Artificial Sequence
  chemically synthesized
acccagctaaggttctacct

SEQ ID NO: 15701 - DNA, 20 bp, Artificial Sequence
  chemically synthesized
cccagctaaggttctacctt

SEQ ID NO: 15702 - DNA, 20 bp, Artificial Sequence
  chemically synthesized
ccagctaaggttctacctta

SEQ ID NO: 15703 - DNA, 20 bp, Artificial Sequence
  chemically synthesized
cagctaaggttctaccttag

SEQ ID NO: 15704 - DNA, 20 bp, Artificial Sequence
  chemically synthesized
taggggccacgccacctccc

SEQ ID NO: 15705 - DNA, 20 bp, Artificial Sequence
  chemically synthesized
aggggccacgccacctcccc

SEQ ID NO: 15706 - DNA, 20 bp, Artificial Sequence
  chemically synthesized
ggggccacgccacctcccca

SEQ ID NO: 15707 - DNA, 20 bp, Artificial Sequence
  chemically synthesized
ggccacgccacctccccagg

SEQ ID NO: 15708 - DNA, 20 bp, Artificial Sequence
  chemically synthesized
gccacgccacctccccaggg

SEQ ID NO: 15709 - DNA, 20 bp, Artificial Sequence
  chemically synthesized
ccacgccacctccccaggga

SEQ ID NO: 15710 - DNA, 20 bp, Artificial Sequence
  chemically synthesized
cacgccacctccccagggag

SEQ ID NO: 15711 - DNA, 20 bp, Artificial Sequence
  chemically synthesized
cacctccccagggaggggtc

SEQ ID NO: 15712 - DNA, 20 bp, Artificial Sequence
  chemically synthesized
cctccccagggaggggtcca

SEQ ID NO: 15713 - DNA, 20 bp, Artificial Sequence
  chemically synthesized
ctccccagggaggggtccag

SEQ ID NO: 15714 - DNA, 20 bp, Artificial Sequence
  chemically synthesized
cagggaggggtccagaggca

SEQ ID NO: 15715 - DNA, 20 bp, Artificial Sequence
  chemically synthesized
agggaggggtccagaggcat

SEQ ID NO: 15716 - DNA, 20 bp, Artificial Sequence
  chemically synthesized
gggaggggtccagaggcatg

SEQ ID NO: 15717 - DNA, 20 bp, Artificial Sequence
  chemically synthesized
ggtccagaggcatggggacc

SEQ ID NO: 15718 - DNA, 20 bp, Artificial Sequence
  chemically synthesized
gtccagaggcatggggacct

SEQ ID NO: 15719 - DNA, 20 bp, Artificial Sequence
  chemically synthesized
tccagaggcatggggacctg

SEQ ID NO: 15720 - DNA, 20 bp, Artificial Sequence
  chemically synthesized
gggacctggggtgcccctca

SEQ ID NO: 15721 - DNA, 20 bp, Artificial Sequence
  chemically synthesized
ggacctggggtgcccctcac

SEQ ID NO: 15722 - DNA, 20 bp, Artificial Sequence
  chemically synthesized
cctcacaggacacttccttg

SEQ ID NO: 15723 - DNA, 20 bp, Artificial Sequence
  chemically synthesized
ctcacaggacacttccttgc

SEQ ID NO: 15724 - DNA, 20 bp, Artificial Sequence
  chemically synthesized
aggacacttccttgcaggaa

SEQ ID NO: 15725 - DNA, 20 bp, Artificial Sequence
  chemically synthesized
gacacttccttgcaggaaca

SEQ ID NO: 15726 - DNA, 20 bp, Artificial Sequence
  chemically synthesized
acacttccttgcaggaacag

SEQ ID NO: 15727 - DNA, 20 bp, Artificial Sequence
  chemically synthesized
gcaggaacagaggtgccatg

SEQ ID NO: 15728 - DNA, 20 bp, Artificial Sequence
  chemically synthesized
acagaggtgccatgcagccc

SEQ ID NO: 15729 - DNA, 20 bp, Artificial Sequence
  chemically synthesized
cagaggtgccatgcagcccc

SEQ ID NO: 15730 - DNA, 20 bp, Artificial Sequence
  chemically synthesized
actccttgttgttgccctcc

SEQ ID NO: 15731 - DNA, 20 bp, Artificial Sequence
  chemically synthesized
tgttgccctcctggcgctcc

SEQ ID NO: 15732 - DNA, 20 bp, Artificial Sequence
  chemically synthesized
cgctcctggcctctgcccgt

SEQ ID NO: 15733 - DNA, 20 bp, Artificial Sequence
  chemically synthesized
ggcctctgcccgtaagcact

SEQ ID NO: 15734 - DNA, 20 bp, Artificial Sequence
  chemically synthesized
ctctgcccgtaagcacttgg

SEQ ID NO: 15735 - DNA, 20 bp, Artificial Sequence
  chemically synthesized
tctgcccgtaagcacttggt

SEQ ID NO: 15736 - DNA, 20 bp, Artificial Sequence
  chemically synthesized
ccgtaagcacttggtgggac

SEQ ID NO: 15737 - DNA, 20 bp, Artificial Sequence
  chemically synthesized
cgtaagcacttggtgggact

SEQ ID NO: 15738 - DNA, 20 bp, Artificial Sequence
  chemically synthesized
agcacttggtgggactgggc

SEQ ID NO: 15739 - DNA, 20 bp, Artificial Sequence
  chemically synthesized
gcacttggtgggactgggct

SEQ ID NO: 15740 - DNA, 20 bp, Artificial Sequence
  chemically synthesized
cacttggtgggactgggctg

SEQ ID NO: 15741 - DNA, 20 bp, Artificial Sequence
  chemically synthesized
acttggtgggactgggctgg

SEQ ID NO: 15742 - DNA, 20 bp, Artificial Sequence
  chemically synthesized
tggtgggactgggctggggg

SEQ ID NO: 15743 - DNA, 20 bp, Artificial Sequence
  chemically synthesized
ggtgggactgggctgggggc

SEQ ID NO: 15744 - DNA, 20 bp, Artificial Sequence
  chemically synthesized
gtgggactgggctgggggca

SEQ ID NO: 15745 - DNA, 20 bp, Artificial Sequence
  chemically synthesized
gcccccagcccagtcccacc

SEQ ID NO: 15746 - DNA, 20 bp, Artificial Sequence
  chemically synthesized
ccagtcccaccaagtgctta

SEQ ID NO: 15747 - DNA, 20 bp, Artificial Sequence
  chemically synthesized
cagtcccaccaagtgcttac

SEQ ID NO: 15748 - DNA, 20 bp, Artificial Sequence
  chemically synthesized
tcccaccaagtgcttacggg

SEQ ID NO: 15749 - DNA, 20 bp, Artificial Sequence
  chemically synthesized
ccaccaagtgcttacgggca

SEQ ID NO: 15750 - DNA, 20 bp, Artificial Sequence
  chemically synthesized
caccaagtgcttacgggcag

SEQ ID NO: 15751 - DNA, 20 bp, Artificial Sequence
  chemically synthesized
aagtgcttacgggcagaggc

SEQ ID NO: 15752 - DNA, 20 bp, Artificial Sequence
  chemically synthesized
agtgcttacgggcagaggcc

SEQ ID NO: 15753 - DNA, 20 bp, Artificial Sequence
  chemically synthesized
tgcttacgggcagaggccag

SEQ ID NO: 15754 - DNA, 20 bp, Artificial Sequence
  chemically synthesized
cgggcagaggccaggagcgc

SEQ ID NO: 15755 - DNA, 20 bp, Artificial Sequence
  chemically synthesized
gggcagaggccaggagcgcc

SEQ ID NO: 15756 - DNA, 20 bp, Artificial Sequence
  chemically synthesized
gcagaggccaggagcgccag

SEQ ID NO: 15757 - DNA, 20 bp, Artificial Sequence
  chemically synthesized
cagaggccaggagcgccagg

SEQ ID NO: 15758 - DNA, 20 bp, Artificial Sequence
  chemically synthesized
agaggccaggagcgccagga

SEQ ID NO: 15759 - DNA, 20 bp, Artificial Sequence
  chemically synthesized
agcgccaggagggcaacaac

SEQ ID NO: 15760 - DNA, 20 bp, Artificial Sequence
  chemically synthesized
gcgccaggagggcaacaaca

SEQ ID NO: 15761 - DNA, 20 bp, Artificial Sequence
  chemically synthesized
gccaggagggcaacaacaag

SEQ ID NO: 15762 - DNA, 20 bp, Artificial Sequence
  chemically synthesized
gggcaacaacaaggagtacc

SEQ ID NO: 15763 - DNA, 20 bp, Artificial Sequence
  chemically synthesized
ggcaacaacaaggagtaccc

SEQ ID NO: 15764 - DNA, 20 bp, Artificial Sequence
  chemically synthesized
gcaacaacaaggagtacccg

SEQ ID NO: 15765 - DNA, 20 bp, Artificial Sequence
  chemically synthesized
aaggagtacccggggctgca

SEQ ID NO: 15766 - DNA, 20 bp, Artificial Sequence
  chemically synthesized
catggcacctctgttcctgc

SEQ ID NO: 15767 - DNA, 20 bp, Artificial Sequence
  chemically synthesized
atggcacctctgttcctgca

SEQ ID NO: 15768 - DNA, 20 bp, Artificial Sequence
  chemically synthesized
gcacctctgttcctgcaagg

SEQ ID NO: 15769 - DNA, 20 bp, Artificial Sequence
  chemically synthesized
cctgcaaggaagtgtcctgt

SEQ ID NO: 15770 - DNA, 20 bp, Artificial Sequence
  chemically synthesized
ctgcaaggaagtgtcctgtg

SEQ ID NO: 15771 - DNA, 20 bp, Artificial Sequence
  chemically synthesized
tgcaaggaagtgtcctgtga

SEQ ID NO: 15772 - DNA, 20 bp, Artificial Sequence
  chemically synthesized
gcaaggaagtgtcctgtgag

SEQ ID NO: 15773 - DNA, 20 bp, Artificial Sequence
  chemically synthesized
gtgtcctgtgaggggcaccc

SEQ ID NO: 15774 - DNA, 20 bp, Artificial Sequence
  chemically synthesized
tgtcctgtgaggggcacccc

SEQ ID NO: 15775 - DNA, 20 bp, Artificial Sequence
  chemically synthesized
accccaggtccccatgcctc

SEQ ID NO: 15776 - DNA, 20 bp, Artificial Sequence
  chemically synthesized
catgcctctggacccctccc

SEQ ID NO: 15777 - DNA, 20 bp, Artificial Sequence
  chemically synthesized
atgcctctggacccctccct

SEQ ID NO: 15778 - DNA, 20 bp, Artificial Sequence
  chemically synthesized
tgcctctggacccctccctg

SEQ ID NO: 15779 - DNA, 20 bp, Artificial Sequence
  chemically synthesized
cctctggacccctccctggg

SEQ ID NO: 15780 - DNA, 20 bp, Artificial Sequence
  chemically synthesized
ctctggacccctccctgggg

SEQ ID NO: 15781 - DNA, 20 bp, Artificial Sequence
  chemically synthesized
tggacccctccctggggagg

SEQ ID NO: 15782 - DNA, 20 bp, Artificial Sequence
  chemically synthesized
ccctccctggggaggtggcg

SEQ ID NO: 15783 - DNA, 20 bp, Artificial Sequence
  chemically synthesized
ggggaggtggcgtggcccct

SEQ ID NO: 15784 - DNA, 20 bp, Artificial Sequence
  chemically synthesized
gggaggtggcgtggccccta

SEQ ID NO: 15785 - DNA, 20 bp, Artificial Sequence
  chemically synthesized
aggtggcgtggcccctaagg

SEQ ID NO: 15786 - DNA, 20 bp, Artificial Sequence
  chemically synthesized
tggcccctaaggtagaacct

SEQ ID NO: 15787 - DNA, 20 bp, Artificial Sequence
  chemically synthesized
ccctaaggtagaaccttagc

SEQ ID NO: 15788 - DNA, 20 bp, Artificial Sequence
  chemically synthesized
cctaaggtagaaccttagct

SEQ ID NO: 15789 - DNA, 20 bp, Artificial Sequence
  chemically synthesized
agaaccttagctgggtctgc

SEQ ID NO: 15790 - DNA, 20 bp, Artificial Sequence
  chemically synthesized
accttagctgggtctgccag

SEQ ID NO: 15791 - DNA, 20 bp, Artificial Sequence
  chemically synthesized
ccttagctgggtctgccaga

SEQ ID NO: 15792 - DNA, 20 bp, Artificial Sequence
  chemically synthesized
ttagctgggtctgccagaag

SEQ ID NO: 15793 - DNA, 20 bp, Artificial Sequence
  chemically synthesized
gctgggtctgccagaaggag

SEQ ID NO: 15794 - DNA, 20 bp, Artificial Sequence
  chemically synthesized
ctgggtctgccagaaggagt

SEQ ID NO: 15795 - DNA, 20 bp, Artificial Sequence
  chemically synthesized
tgggtctgccagaaggagta

SEQ ID NO: 15796 - DNA, 20 bp, Artificial Sequence
  chemically synthesized
gggtctgccagaaggagtag

SEQ ID NO: 15797 - DNA, 20 bp, Artificial Sequence
  chemically synthesized
ctgccagaaggagtaggggc

SEQ ID NO: 15798 - DNA, 20 bp, Artificial Sequence
  chemically synthesized
gggccggctccctgctaata

SEQ ID NO: 15799 - DNA, 20 bp, Artificial Sequence
  chemically synthesized
ggccggctccctgctaatac

SEQ ID NO: 15800 - DNA, 20 bp, Artificial Sequence
  chemically synthesized
tccctgctaatacgggctct

SEQ ID NO: 15801 - DNA, 20 bp, Artificial Sequence
  chemically synthesized
ctgctaatacgggctctcag

SEQ ID NO: 15802 - DNA, 20 bp, Artificial Sequence
  chemically synthesized
tgctaatacgggctctcaga

SEQ ID NO: 15803 - DNA, 20 bp, Artificial Sequence
  chemically synthesized
gctaatacgggctctcagaa

SEQ ID NO: 15804 - DNA, 20 bp, Artificial Sequence
  chemically synthesized
ctaatacgggctctcagaag

SEQ ID NO: 15805 - DNA, 20 bp, Artificial Sequence
  chemically synthesized
taatacgggctctcagaagg

SEQ ID NO: 15806 - DNA, 20 bp, Artificial Sequence
  chemically synthesized
cgggctctcagaagggggac

SEQ ID NO: 15807 - DNA, 20 bp, Artificial Sequence
  chemically synthesized
ctctcagaagggggactggt

SEQ ID NO: 15808 - DNA, 20 bp, Artificial Sequence
  chemically synthesized
tctcagaagggggactggtg

SEQ ID NO: 15809 - DNA, 20 bp, Artificial Sequence
  chemically synthesized
ctcagaagggggactggtga

SEQ ID NO: 15810 - DNA, 20 bp, Artificial Sequence
  chemically synthesized
tcagaagggggactggtgag

SEQ ID NO: 15811 - DNA, 20 bp, Artificial Sequence
  chemically synthesized
aagggggactggtgaggggc

SEQ ID NO: 15812 - DNA, 20 bp, Artificial Sequence
  chemically synthesized
agggggactggtgaggggcg

SEQ ID NO: 15813 - DNA, 20 bp, Artificial Sequence
  chemically synthesized
gggggactggtgaggggcga

SEQ ID NO: 15814 - DNA, 20 bp, Artificial Sequence
  chemically synthesized
ctggtgaggggcgagggatc

SEQ ID NO: 15815 - DNA, 20 bp, Artificial Sequence
  chemically synthesized
tggtgaggggcgagggatcg

SEQ ID NO: 15816 - DNA, 20 bp, Artificial Sequence
  chemically synthesized
gggcgagggatcgaggccca

SEQ ID NO: 15817 - DNA, 20 bp, Artificial Sequence
  chemically synthesized
ggcgagggatcgaggcccaa

SEQ ID NO: 15818 - DNA, 20 bp, Artificial Sequence
  chemically synthesized
gcgagggatcgaggcccaaa

SEQ ID NO: 15819 - DNA, 20 bp, Artificial Sequence
  chemically synthesized
gagggatcgaggcccaaagg

SEQ ID NO: 15820 - DNA, 20 bp, Artificial Sequence
  chemically synthesized
agggatcgaggcccaaaggg

SEQ ID NO: 15821 - DNA, 20 bp, Artificial Sequence
  chemically synthesized
gatcgaggcccaaagggagg

SEQ ID NO: 15822 - DNA, 20 bp, Artificial Sequence
  chemically synthesized
atcgaggcccaaagggaggt

SEQ ID NO: 15823 - DNA, 20 bp, Artificial Sequence
  chemically synthesized
gaggcccaaagggaggtggg

SEQ ID NO: 15824 - DNA, 20 bp, Artificial Sequence
  chemically synthesized
aggcccaaagggaggtgggt

SEQ ID NO: 15825 - DNA, 20 bp, Artificial Sequence
  chemically synthesized
ccaaagggaggtgggtggga

SEQ ID NO: 15826 - DNA, 20 bp, Artificial Sequence
  chemically synthesized
aaagggaggtgggtgggatg

SEQ ID NO: 15827 - DNA, 20 bp, Artificial Sequence
  chemically synthesized
gggaggtgggtgggatggag

SEQ ID NO: 15828 - DNA, 20 bp, Artificial Sequence
  chemically synthesized
ggatggagcagaaaacccac

SEQ ID NO: 15829 - DNA, 20 bp, Artificial Sequence
  chemically synthesized
aacccaccagactgaacatc

SEQ ID NO: 15830 - DNA, 20 bp, Artificial Sequence
  chemically synthesized
acccaccagactgaacatca

SEQ ID NO: 15831 - DNA, 20 bp, Artificial Sequence
  chemically synthesized
actgaacatcaaggcacctg

SEQ ID NO: 15832 - DNA, 20 bp, Artificial Sequence
  chemically synthesized
acatcaaggcacctgcggtc

SEQ ID NO: 15833 - DNA, 20 bp, Artificial Sequence
  chemically synthesized
ggtctggactgatctccgtc

SEQ ID NO: 15834 - DNA, 20 bp, Artificial Sequence
  chemically synthesized
ggactgatctccgtccagtc

SEQ ID NO: 15835 - DNA, 20 bp, Artificial Sequence
  chemically synthesized
gccaacatgctgtgtgtctt

SEQ ID NO: 15836 - DNA, 20 bp, Artificial Sequence
  chemically synthesized
ccaacatgctgtgtgtcttt

SEQ ID NO: 15837 - DNA, 20 bp, Artificial Sequence
  chemically synthesized
gtgtgtctttgggtgatttc

SEQ ID NO: 15838 - DNA, 20 bp, Artificial Sequence
  chemically synthesized
gggtgatttctggccctctc

SEQ ID NO: 15839 - DNA, 20 bp, Artificial Sequence
  chemically synthesized
ggtgatttctggccctctcc

SEQ ID NO: 15840 - DNA, 20 bp, Artificial Sequence
  chemically synthesized
ttctggccctctccaggcct

SEQ ID NO: 15841 - DNA, 20 bp, Artificial Sequence
  chemically synthesized
caggcctcagtttccctgtc

SEQ ID NO: 15842 - DNA, 20 bp, Artificial Sequence
  chemically synthesized
aggcctcagtttccctgtct

SEQ ID NO: 15843 - DNA, 20 bp, Artificial Sequence
  chemically synthesized
ggcctcagtttccctgtctg

SEQ ID NO: 15844 - DNA, 20 bp, Artificial Sequence
  chemically synthesized
ctcagtttccctgtctgggg

SEQ ID NO: 15845 - DNA, 20 bp, Artificial Sequence
  chemically synthesized
tcagtttccctgtctggggt

SEQ ID NO: 15846 - DNA, 20 bp, Artificial Sequence
  chemically synthesized
ttccctgtctggggtaggac

SEQ ID NO: 15847 - DNA, 20 bp, Artificial Sequence
  chemically synthesized
tccctgtctggggtaggact

SEQ ID NO: 15848 - DNA, 20 bp, Artificial Sequence
  chemically synthesized
ggggtaggactgggctgtct

SEQ ID NO: 15849 - DNA, 20 bp, Artificial Sequence
  chemically synthesized
gggtaggactgggctgtcta

SEQ ID NO: 15850 - DNA, 20 bp, Artificial Sequence
  chemically synthesized
gggctgtctaaggcttcctc

SEQ ID NO: 15851 - DNA, 20 bp, Artificial Sequence
  chemically synthesized
ctaaggcttcctccagccct

SEQ ID NO: 15852 - DNA, 20 bp, Artificial Sequence
  chemically synthesized
ttcctccagccctaagcctg

SEQ ID NO: 15853 - DNA, 20 bp, Artificial Sequence
  chemically synthesized
cagccctaagcctgaagaat

SEQ ID NO: 15854 - DNA, 20 bp, Artificial Sequence
  chemically synthesized
agccctaagcctgaagaatg

SEQ ID NO: 15855 - DNA, 20 bp, Artificial Sequence
  chemically synthesized
gccctaagcctgaagaatga

SEQ ID NO: 15856 - DNA, 20 bp, Artificial Sequence
  chemically synthesized
ccctaagcctgaagaatgag

SEQ ID NO: 15857 - DNA, 20 bp, Artificial Sequence
  chemically synthesized
cctaagcctgaagaatgagg

SEQ ID NO: 15858 - DNA, 20 bp, Artificial Sequence
  chemically synthesized
ctaagcctgaagaatgaggg

SEQ ID NO: 15859 - DNA, 20 bp, Artificial Sequence
  chemically synthesized
atgaggggggaacctgcact

SEQ ID NO: 15860 - DNA, 20 bp, Artificial Sequence
  chemically synthesized
gaggggggaacctgcacttg

SEQ ID NO: 15861 - DNA, 20 bp, Artificial Sequence
  chemically synthesized
cctgcacttggagccacttc

SEQ ID NO: 15862 - DNA, 20 bp, Artificial Sequence
  chemically synthesized
ttccagccccaccccctgtg

SEQ ID NO: 15863 - DNA, 20 bp, Artificial Sequence
  chemically synthesized
ccccaccccctgtgtagctt

SEQ ID NO: 15864 - DNA, 20 bp, Artificial Sequence
  chemically synthesized
cccaccccctgtgtagcttt

SEQ ID NO: 15865 - DNA, 20 bp, Artificial Sequence
  chemically synthesized
ccccctgtgtagctttgggc

SEQ ID NO: 15866 - DNA, 20 bp, Artificial Sequence
  chemically synthesized
tgggcaagtgacacccctcc

SEQ ID NO: 15867 - DNA, 20 bp, Artificial Sequence
  chemically synthesized
gggcaagtgacacccctccc

SEQ ID NO: 15868 - DNA, 20 bp, Artificial Sequence
  chemically synthesized
tcccgggcctccatgttctt

SEQ ID NO: 15869 - DNA, 20 bp, Artificial Sequence
  chemically synthesized
cccgggcctccatgttcttc

SEQ ID NO: 15870 - DNA, 20 bp, Artificial Sequence
  chemically synthesized
catgttcttcaggttatgat

SEQ ID NO: 15871 - DNA, 20 bp, Artificial Sequence
  chemically synthesized
atgttcttcaggttatgatg

SEQ ID NO: 15872 - DNA, 20 bp, Artificial Sequence
  chemically synthesized
tgttcttcaggttatgatga

SEQ ID NO: 15873 - DNA, 20 bp, Artificial Sequence
  chemically synthesized
gttcttcaggttatgatgag

SEQ ID NO: 15874 - DNA, 20 bp, Artificial Sequence
  chemically synthesized
cttcaggttatgatgagggg

SEQ ID NO: 15875 - DNA, 20 bp, Artificial Sequence
  chemically synthesized
ttcaggttatgatgaggggt

SEQ ID NO: 15876 - DNA, 20 bp, Artificial Sequence
  chemically synthesized
tcaggttatgatgaggggtg

SEQ ID NO: 15877 - DNA, 20 bp, Artificial Sequence
  chemically synthesized
caggttatgatgaggggtgg

SEQ ID NO: 15878 - DNA, 20 bp, Artificial Sequence
  chemically synthesized
aggttatgatgaggggtggg

SEQ ID NO: 15879 - DNA, 20 bp, Artificial Sequence
  chemically synthesized
aggggtggggggcacccgtc

SEQ ID NO: 15880 - DNA, 20 bp, Artificial Sequence
  chemically synthesized
gggggcacccgtccagctcc

SEQ ID NO: 15881 - DNA, 20 bp, Artificial Sequence
  chemically synthesized
ggggcacccgtccagctccg

SEQ ID NO: 15882 - DNA, 20 bp, Artificial Sequence
  chemically synthesized
gtccagctccgaggcttcct

SEQ ID NO: 15883 - DNA, 20 bp, Artificial Sequence
  chemically synthesized
ctccgaggcttccttagctc

SEQ ID NO: 15884 - DNA, 20 bp, Artificial Sequence
  chemically synthesized
gaggcttccttagctctagc

SEQ ID NO: 15885 - DNA, 20 bp, Artificial Sequence
  chemically synthesized
agctctagcaagtgcttctc

SEQ ID NO: 15886 - DNA, 20 bp, Artificial Sequence
  chemically synthesized
gctctagcaagtgcttctcc

SEQ ID NO: 15887 - DNA, 20 bp, Artificial Sequence
  chemically synthesized
aagtgcttctccaggcttgc

SEQ ID NO: 15888 - DNA, 20 bp, Artificial Sequence
  chemically synthesized
gcttctccaggcttgctggc

SEQ ID NO: 15889 - DNA, 20 bp, Artificial Sequence
  chemically synthesized
cttctccaggcttgctggct

SEQ ID NO: 15890 - DNA, 20 bp, Artificial Sequence
  chemically synthesized
tccaggcttgctggctgggc

SEQ ID NO: 15891 - DNA, 20 bp, Artificial Sequence
  chemically synthesized
ccaggcttgctggctgggct

SEQ ID NO: 15892 - DNA, 20 bp, Artificial Sequence
  chemically synthesized
ggcttgctggctgggctggg

SEQ ID NO: 15893 - DNA, 20 bp, Artificial Sequence
  chemically synthesized
gcttgctggctgggctgggc

SEQ ID NO: 15894 - DNA, 20 bp, Artificial Sequence
  chemically synthesized
cttgctggctgggctgggca

SEQ ID NO: 15895 - DNA, 20 bp, Artificial Sequence
  chemically synthesized
tgctggctgggctgggcagg

SEQ ID NO: 15896 - DNA, 20 bp, Artificial Sequence
  chemically synthesized
cccctcctctttcccctccc

SEQ ID NO: 15897 - DNA, 20 bp, Artificial Sequence
  chemically synthesized
cctcctctttcccctcccca

SEQ ID NO: 15898 - DNA, 20 bp, Artificial Sequence
  chemically synthesized
ctcctctttcccctccccag

SEQ ID NO: 15899 - DNA, 20 bp, Artificial Sequence
  chemically synthesized
tcctctttcccctccccaga

SEQ ID NO: 15900 - DNA, 20 bp, Artificial Sequence
  chemically synthesized
cctccccagagggcattacc

SEQ ID NO: 15901 - DNA, 20 bp, Artificial Sequence
  chemically synthesized
tccccagagggcattacctg

SEQ ID NO: 15902 - DNA, 20 bp, Artificial Sequence
  chemically synthesized
ccagagggcattacctggag

SEQ ID NO: 15903 - DNA, 20 bp, Artificial Sequence
  chemically synthesized
ttacctggagcagctgcctc

SEQ ID NO: 15904 - DNA, 20 bp, Artificial Sequence
  chemically synthesized
tacctggagcagctgcctct

SEQ ID NO: 15905 - DNA, 20 bp, Artificial Sequence
  chemically synthesized
acctggagcagctgcctcta

SEQ ID NO: 15906 - DNA, 20 bp, Artificial Sequence
  chemically synthesized
gctgcctctagggatgaact

SEQ ID NO: 15907 - DNA, 20 bp, Artificial Sequence
  chemically synthesized
gcctctagggatgaactgag

SEQ ID NO: 15908 - DNA, 20 bp, Artificial Sequence
  chemically synthesized
ctagggatgaactgagcaga

SEQ ID NO: 15909 - DNA, 20 bp, Artificial Sequence
  chemically synthesized
tagggatgaactgagcagac

SEQ ID NO: 15910 - DNA, 20 bp, Artificial Sequence
  chemically synthesized
ggatgaactgagcagacagg

SEQ ID NO: 15911 - DNA, 20 bp, Artificial Sequence
  chemically synthesized
gatgaactgagcagacaggc

SEQ ID NO: 15912 - DNA, 20 bp, Artificial Sequence
  chemically synthesized
tgaactgagcagacaggcag

SEQ ID NO: 15913 - DNA, 20 bp, Artificial Sequence
  chemically synthesized
gaactgagcagacaggcagg

SEQ ID NO: 15914 - DNA, 20 bp, Artificial Sequence
  chemically synthesized
aactgagcagacaggcagga

SEQ ID NO: 15915 - DNA, 20 bp, Artificial Sequence
  chemically synthesized
gacctgttttatatcatctc

SEQ ID NO: 15916 - DNA, 20 bp, Artificial Sequence
  chemically synthesized
acctgttttatatcatctcc

SEQ ID NO: 15917 - DNA, 20 bp, Artificial Sequence
  chemically synthesized
cctgttttatatcatctcca

SEQ ID NO: 15918 - DNA, 20 bp, Artificial Sequence
  chemically synthesized
gttttatatcatctccaggg

SEQ ID NO: 15919 - DNA, 20 bp, Artificial Sequence
  chemically synthesized
ttatatcatctccagggcag

SEQ ID NO: 15920 - DNA, 20 bp, Artificial Sequence
  chemically synthesized
tatatcatctccagggcagc

SEQ ID NO: 15921 - DNA, 20 bp, Artificial Sequence
  chemically synthesized
tctccagggcagcaggcact

SEQ ID NO: 15922 - DNA, 20 bp, Artificial Sequence
  chemically synthesized
ctccagggcagcaggcactg

SEQ ID NO: 15923 - DNA, 20 bp, Artificial Sequence
  chemically synthesized
ggcagcaggcactgaggacc

SEQ ID NO: 15924 - DNA, 20 bp, Artificial Sequence
  chemically synthesized
gcagcaggcactgaggaccc

SEQ ID NO: 15925 - DNA, 20 bp, Artificial Sequence
  chemically synthesized
cagcaggcactgaggaccca

SEQ ID NO: 15926 - DNA, 20 bp, Artificial Sequence
  chemically synthesized
gcactgaggacccagggcgc

SEQ ID NO: 15927 - DNA, 20 bp, Artificial Sequence
  chemically synthesized
cactgaggacccagggcgct

SEQ ID NO: 15928 - DNA, 20 bp, Artificial Sequence
  chemically synthesized
aggacccagggcgctgggca

SEQ ID NO: 15929 - DNA, 20 bp, Artificial Sequence
  chemically synthesized
ggacccagggcgctgggcaa

SEQ ID NO: 15930 - DNA, 20 bp, Artificial Sequence
  chemically synthesized
ggcaaaggtcacctgctgac

SEQ ID NO: 15931 - DNA, 20 bp, Artificial Sequence
  chemically synthesized
aaaggtcacctgctgaccag

SEQ ID NO: 15932 - DNA, 20 bp, Artificial Sequence
  chemically synthesized
aggtcacctgctgaccagtg

SEQ ID NO: 15933 - DNA, 20 bp, Artificial Sequence
  chemically synthesized
acctgctgaccagtggagat

SEQ ID NO: 15934 - DNA, 20 bp, Artificial Sequence
  chemically synthesized
cctgctgaccagtggagatg

SEQ ID NO: 15935 - DNA, 20 bp, Artificial Sequence
  chemically synthesized
ctgctgaccagtggagatga

SEQ ID NO: 15936 - DNA, 20 bp, Artificial Sequence
  chemically synthesized
accagtggagatgagggcct

SEQ ID NO: 15937 - DNA, 20 bp, Artificial Sequence
  chemically synthesized
ccagtggagatgagggcctg

SEQ ID NO: 15938 - DNA, 20 bp, Artificial Sequence
  chemically synthesized
gtggagatgagggcctgagg

SEQ ID NO: 15939 - DNA, 20 bp, Artificial Sequence
  chemically synthesized
tggagatgagggcctgaggc

SEQ ID NO: 15940 - DNA, 20 bp, Artificial Sequence
  chemically synthesized
ggagatgagggcctgaggca

SEQ ID NO: 15941 - DNA, 20 bp, Artificial Sequence
  chemically synthesized
agggcctgaggcagggtgtc

SEQ ID NO: 15942 - DNA, 20 bp, Artificial Sequence
  chemically synthesized
tgaggcagggtgtccagatg

SEQ ID NO: 15943 - DNA, 20 bp, Artificial Sequence
  chemically synthesized
gcagggtgtccagatgcagc

SEQ ID NO: 15944 - DNA, 20 bp, Artificial Sequence
  chemically synthesized
gggtgtccagatgcagcaag

SEQ ID NO: 15945 - DNA, 20 bp, Artificial Sequence
  chemically synthesized
ggtgtccagatgcagcaagc

SEQ ID NO: 15946 - DNA, 20 bp, Artificial Sequence
  chemically synthesized
gtccagatgcagcaagcggg

SEQ ID NO: 15947 - DNA, 20 bp, Artificial Sequence
  chemically synthesized
tccagatgcagcaagcgggc

SEQ ID NO: 15948 - DNA, 20 bp, Artificial Sequence
  chemically synthesized
cagatgcagcaagcgggcgg

SEQ ID NO: 15949 - DNA, 20 bp, Artificial Sequence
  chemically synthesized
gatgcagcaagcgggcggga

SEQ ID NO: 15950 - DNA, 20 bp, Artificial Sequence
  chemically synthesized
cagcaagcgggcgggagagt

SEQ ID NO: 15951 - DNA, 20 bp, Artificial Sequence
  chemically synthesized
agcaagcgggcgggagagtt

SEQ ID NO: 15952 - DNA, 20 bp, Artificial Sequence
  chemically synthesized
cgggagagttgggaaatccc

SEQ ID NO: 15953 - DNA, 20 bp, Artificial Sequence
  chemically synthesized
gggagagttgggaaatccct

SEQ ID NO: 15954 - DNA, 20 bp, Artificial Sequence
  chemically synthesized
gagagttgggaaatccctag

SEQ ID NO: 15955 - DNA, 20 bp, Artificial Sequence
  chemically synthesized
tgggaaatccctaggagact

SEQ ID NO: 15956 - DNA, 20 bp, Artificial Sequence
  chemically synthesized
ggtgacctttgcccagcgcc

SEQ ID NO: 15957 - DNA, 20 bp, Artificial Sequence
  chemically synthesized
gaggggaaagaggaggggag

SEQ ID NO: 15958 - DNA, 20 bp, Artificial Sequence
  chemically synthesized
taaggaagcctcggagctgg

SEQ ID NO: 15959 - DNA, 20 bp, Artificial Sequence
  chemically synthesized
gaagaacatggaggcccggg

SEQ ID NO: 15960 - DNA, 20 bp, Artificial Sequence
  chemically synthesized
cacttgcccaaagctacaca

SEQ ID NO: 15961 - DNA, 20 bp, Artificial Sequence
  chemically synthesized
gtgccttgatgttcagtctg

SEQ ID NO: 15962 - DNA, 20 bp, Artificial Sequence
  chemically synthesized
gccacgccacctccccaggg

SEQ ID NO: 15963 - DNA, 20 bp, Artificial Sequence
  chemically synthesized
ggtccagaggcatggggacc

SEQ ID NO: 15964 - DNA, 20 bp, Artificial Sequence
  chemically synthesized
aacagaggtgccatgcagcc

SEQ ID NO: 15965 - DNA, 20 bp, Artificial Sequence
  chemically synthesized
tggtgggactgggctggggg

SEQ ID NO: 15966 - DNA, 20 bp, Artificial Sequence
  chemically synthesized
gcgccaggagggcaacaaca

SEQ ID NO: 15967 - DNA, 20 bp, Artificial Sequence
  chemically synthesized
cccctaaggtagaaccttag

SEQ ID NO: 15968 - DNA, 20 bp, Artificial Sequence
  chemically synthesized
ccttagctgggtctgccaga

SEQ ID NO: 15969 - DNA, 20 bp, Artificial Sequence
  chemically synthesized
agggggactggtgaggggcg

SEQ ID NO: 15970 - DNA, 20 bp, Artificial Sequence
  chemically synthesized
ggatcgaggcccaaagggag

SEQ ID NO: 15971 - DNA, 20 bp, Artificial Sequence
  chemically synthesized
gaggcccaaagggaggtggg

SEQ ID NO: 15972 - DNA, 20 bp, Artificial Sequence
  chemically synthesized
agccaacatgctgtgtgtct

SEQ ID NO: 15973 - DNA, 20 bp, Artificial Sequence
  chemically synthesized
caggcctcagtttccctgtc

SEQ ID NO: 15974 - DNA, 20 bp, Artificial Sequence
  chemically synthesized
ttcctccagccctaagcctg

SEQ ID NO: 15975 - DNA, 20 bp, Artificial Sequence
  chemically synthesized
atgttcttcaggttatgatg

SEQ ID NO: 15976 - DNA, 20 bp, Artificial Sequence
  chemically synthesized
tacctggagcagctgcctct

SEQ ID NO: 15977 - DNA, 20 bp, Artificial Sequence
  chemically synthesized
tgaactgagcagacaggcag

SEQ ID NO: 15978 - DNA, 20 bp, Artificial Sequence
  chemically synthesized
gtggagatgagggcctgagg

SEQ ID NO: 15979 - DNA, 20 bp, Artificial Sequence
  chemically synthesized
cagatgcagcaagcgggcgg

SEQ ID NO: 15980 - DNA, 20 bp, Artificial Sequence
  chemically synthesized
gttgggaaatccctaggaga

SEQ ID NO: 15981 - DNA, 20 bp, Artificial Sequence
  chemically synthesized
aaactgaggcctggagaggg

SEQ ID NO: 15982 - DNA, 20 bp, Artificial Sequence
  chemically synthesized
agggaggtgggtgggatgga

SEQ ID NO: 15983 - DNA, 20 bp, Artificial Sequence
  chemically synthesized
cttcctccagccctaagcct

SEQ ID NO: 15984 - DNA, 20 bp, Artificial Sequence
  chemically synthesized
ctgctgccctggagatgata

SEQ ID NO: 15985 - DNA, 20 bp, Artificial Sequence
  chemically synthesized
gaggtgggtgggatggagca

SEQ ID NO: 15986 - DNA, 20 bp, Artificial Sequence
  chemically synthesized
agggatttcccaactctccc

SEQ ID NO: 15987 - DNA, 20 bp, Artificial Sequence
  chemically synthesized
gcaggttcccccctcattct

SEQ ID NO: 15988 - DNA, 20 bp, Artificial Sequence
  chemically synthesized
gtgccttgatgttcagtctg

SEQ ID NO: 15989 - DNA, 20 bp, Artificial Sequence
  chemically synthesized
gcccccagcccagtcccacc

SEQ ID NO: 15990 - DNA, 20 bp, Artificial Sequence
  chemically synthesized
ccaacatgctgtgtgtcttt

SEQ ID NO: 15991 - DNA, 20 bp, Artificial Sequence
  chemically synthesized
atttctggccctctccaggc

SEQ ID NO: 15992 - DNA, 20 bp, Artificial Sequence
  chemically synthesized
tggggtaggactgggctgtc

SEQ ID NO: 15993 - DNA, 20 bp, Artificial Sequence
  chemically synthesized
acttccagccccaccccctg

SEQ ID NO: 15994 - DNA, 20 bp, Artificial Sequence
  chemically synthesized
ggggggcacccgtccagctc

SEQ ID NO: 15995 - DNA, 20 bp, Artificial Sequence
  chemically synthesized
gaggcttccttagctctagc

SEQ ID NO: 15996 - DNA, 20 bp, Artificial Sequence
  chemically synthesized
tagctctagcaagtgcttct

SEQ ID NO: 15997 - DNA, 20 bp, Artificial Sequence
  chemically synthesized
agacaggcaggagggttctg

SEQ ID NO: 15998 - DNA, 22 bp, Artificial Sequence
  chemically synthesized
agtctcctagggatttcccaac

SEQ ID NO: 15999 - DNA, 22 bp, Artificial Sequence
  chemically synthesized
ctagggatttcccaactctccc

SEQ ID NO: 16000 - DNA, 22 bp, Artificial Sequence
  chemically synthesized
gggatttcccaactctcccgcc

SEQ ID NO: 16001 - DNA, 22 bp, Artificial Sequence
  chemically synthesized
cccaactctcccgcccgcttgc

SEQ ID NO: 16002 - DNA, 22 bp, Artificial Sequence
  chemically synthesized
ccaactctcccgcccgcttgct

SEQ ID NO: 16003 - DNA, 22 bp, Artificial Sequence
  chemically synthesized
tcccgcccgcttgctgcatctg

SEQ ID NO: 16004 - DNA, 22 bp, Artificial Sequence
  chemically synthesized
ccgcccgcttgctgcatctgga

SEQ ID NO: 16005 - DNA, 22 bp, Artificial Sequence
  chemically synthesized
gctgcatctggacaccctgcct

SEQ ID NO: 16006 - DNA, 22 bp, Artificial Sequence
  chemically synthesized
ctgcatctggacaccctgcctc

SEQ ID NO: 16007 - DNA, 22 bp, Artificial Sequence
  chemically synthesized
catctggacaccctgcctcagg

SEQ ID NO: 16008 - DNA, 22 bp, Artificial Sequence
  chemically synthesized
gacaccctgcctcaggccctca

SEQ ID NO: 16009 - DNA, 22 bp, Artificial Sequence
  chemically synthesized
cctcaggccctcatctccactg

SEQ ID NO: 16010 - DNA, 22 bp, Artificial Sequence
  chemically synthesized
aggccctcatctccactggtca

SEQ ID NO: 16011 - DNA, 22 bp, Artificial Sequence
  chemically synthesized
atctccactggtcagcaggtga

SEQ ID NO: 16012 - DNA, 22 bp, Artificial Sequence
  chemically synthesized
cactggtcagcaggtgaccttt

SEQ ID NO: 16013 - DNA, 22 bp, Artificial Sequence
  chemically synthesized
gtcagcaggtgacctttgccca

SEQ ID NO: 16014 - DNA, 22 bp, Artificial Sequence
  chemically synthesized
tgcccagcgccctgggtcctca

SEQ ID NO: 16015 - DNA, 22 bp, Artificial Sequence
  chemically synthesized
gcccagcgccctgggtcctcag

SEQ ID NO: 16016 - DNA, 22 bp, Artificial Sequence
  chemically synthesized
cccagcgccctgggtcctcagt

SEQ ID NO: 16017 - DNA, 22 bp, Artificial Sequence
  chemically synthesized
ggtcctcagtgcctgctgccct

SEQ ID NO: 16018 - DNA, 22 bp, Artificial Sequence
  chemically synthesized
agtgcctgctgccctggagatg

SEQ ID NO: 16019 - DNA, 22 bp, Artificial Sequence
  chemically synthesized
ctgccctggagatgatataaaa

SEQ ID NO: 16020 - DNA, 22 bp, Artificial Sequence
  chemically synthesized
ccctggagatgatataaaacag

SEQ ID NO: 16021 - DNA, 22 bp, Artificial Sequence
  chemically synthesized
gagatgatataaaacaggtcag

SEQ ID NO: 16022 - DNA, 22 bp, Artificial Sequence
  chemically synthesized
ctgcctgtctgctcagttcatc

SEQ ID NO: 16023 - DNA, 22 bp, Artificial Sequence
  chemically synthesized
cctgtctgctcagttcatccct

SEQ ID NO: 16024 - DNA, 22 bp, Artificial Sequence
  chemically synthesized
tctgctcagttcatccctagag

SEQ ID NO: 16025 - DNA, 22 bp, Artificial Sequence
  chemically synthesized
ctcagttcatccctagaggcag

SEQ ID NO: 16026 - DNA, 22 bp, Artificial Sequence
  chemically synthesized
agttcatccctagaggcagctg

SEQ ID NO: 16027 - DNA, 22 bp, Artificial Sequence
  chemically synthesized
atccctagaggcagctgctcca

SEQ ID NO: 16028 - DNA, 22 bp, Artificial Sequence
  chemically synthesized
gaggcagctgctccaggtaatg

SEQ ID NO: 16029 - DNA, 22 bp, Artificial Sequence
  chemically synthesized
ctccaggtaatgccctctgggg

SEQ ID NO: 16030 - DNA, 22 bp, Artificial Sequence
  chemically synthesized
caggtaatgccctctggggagg

SEQ ID NO: 16031 - DNA, 22 bp, Artificial Sequence
  chemically synthesized
tggggaggggaaagaggagggg

SEQ ID NO: 16032 - DNA, 22 bp, Artificial Sequence
  chemically synthesized
gggaggggaaagaggaggggag

SEQ ID NO: 16033 - DNA, 22 bp, Artificial Sequence
  chemically synthesized
cctgcccagcccagccagcaag

SEQ ID NO: 16034 - DNA, 22 bp, Artificial Sequence
  chemically synthesized
cccagcccagccagcaagcctg

SEQ ID NO: 16035 - DNA, 22 bp, Artificial Sequence
  chemically synthesized
gagaagcacttgctagagctaa

SEQ ID NO: 16036 - DNA, 22 bp, Artificial Sequence
  chemically synthesized
gctagagctaaggaagcctcgg

SEQ ID NO: 16037 - DNA, 22 bp, Artificial Sequence
  chemically synthesized
ctagagctaaggaagcctcgga

SEQ ID NO: 16038 - DNA, 22 bp, Artificial Sequence
  chemically synthesized
gagctaaggaagcctcggagct

SEQ ID NO: 16039 - DNA, 22 bp, Artificial Sequence
  chemically synthesized
aggaagcctcggagctggacgg

SEQ ID NO: 16040 - DNA, 22 bp, Artificial Sequence
  chemically synthesized
ggagctggacgggtgcccccca

SEQ ID NO: 16041 - DNA, 22 bp, Artificial Sequence
  chemically synthesized
gacgggtgccccccacccctca

SEQ ID NO: 16042 - DNA, 22 bp, Artificial Sequence
  chemically synthesized
atcataacctgaagaacatgga

SEQ ID NO: 16043 - DNA, 22 bp, Artificial Sequence
  chemically synthesized
aagaacatggaggcccgggagg

SEQ ID NO: 16044 - DNA, 22 bp, Artificial Sequence
  chemically synthesized
gcccaaagctacacagggggtg

SEQ ID NO: 16045 - DNA, 22 bp, Artificial Sequence
  chemically synthesized
cccaaagctacacagggggtgg

SEQ ID NO: 16046 - DNA, 22 bp, Artificial Sequence
  chemically synthesized
cacagggggtggggctggaagt

SEQ ID NO: 16047 - DNA, 22 bp, Artificial Sequence
  chemically synthesized
gaagtggctccaagtgcaggtt

SEQ ID NO: 16048 - DNA, 22 bp, Artificial Sequence
  chemically synthesized
caagtgcaggttcccccctcat

SEQ ID NO: 16049 - DNA, 22 bp, Artificial Sequence
  chemically synthesized
ccccctcattcttcaggcttag

SEQ ID NO: 16050 - DNA, 22 bp, Artificial Sequence
  chemically synthesized
attcttcaggcttagggctgga

SEQ ID NO: 16051 - DNA, 22 bp, Artificial Sequence
  chemically synthesized
ttcaggcttagggctggaggaa

SEQ ID NO: 16052 - DNA, 22 bp, Artificial Sequence
  chemically synthesized
caggcttagggctggaggaagc

SEQ ID NO: 16053 - DNA, 22 bp, Artificial Sequence
  chemically synthesized
aggcttagggctggaggaagcc

SEQ ID NO: 16054 - DNA, 22 bp, Artificial Sequence
  chemically synthesized
agggctggaggaagccttagac

SEQ ID NO: 16055 - DNA, 22 bp, Artificial Sequence
  chemically synthesized
gggctggaggaagccttagaca

SEQ ID NO: 16056 - DNA, 22 bp, Artificial Sequence
  chemically synthesized
gaggaagccttagacagcccag

SEQ ID NO: 16057 - DNA, 22 bp, Artificial Sequence
  chemically synthesized
agacagcccagtcctaccccag

SEQ ID NO: 16058 - DNA, 22 bp, Artificial Sequence
  chemically synthesized
gacagcccagtcctaccccaga

SEQ ID NO: 16059 - DNA, 22 bp, Artificial Sequence
  chemically synthesized
ccccagacagggaaactgaggc

SEQ ID NO: 16060 - DNA, 22 bp, Artificial Sequence
  chemically synthesized
aggcctggagagggccagaaat

SEQ ID NO: 16061 - DNA, 22 bp, Artificial Sequence
  chemically synthesized
gagagggccagaaatcacccaa

SEQ ID NO: 16062 - DNA, 22 bp, Artificial Sequence
  chemically synthesized
gctggactggacggagatcagt

SEQ ID NO: 16063 - DNA, 22 bp, Artificial Sequence
  chemically synthesized
gactggacggagatcagtccag

SEQ ID NO: 16064 - DNA, 22 bp, Artificial Sequence
  chemically synthesized
gacggagatcagtccagaccgc

SEQ ID NO: 16065 - DNA, 22 bp, Artificial Sequence
  chemically synthesized
gatgttcagtctggtgggtttt

SEQ ID NO: 16066 - DNA, 22 bp, Artificial Sequence
  chemically synthesized
atgttcagtctggtgggttttc

SEQ ID NO: 16067 - DNA, 22 bp, Artificial Sequence
  chemically synthesized
agtctggtgggttttctgctcc

SEQ ID NO: 16068 - DNA, 22 bp, Artificial Sequence
  chemically synthesized
gtgggttttctgctccatccca

SEQ ID NO: 16069 - DNA, 22 bp, Artificial Sequence
  chemically synthesized
tctgctccatcccacccacctc

SEQ ID NO: 16070 - DNA, 22 bp, Artificial Sequence
  chemically synthesized
ctgctccatcccacccacctcc

SEQ ID NO: 16071 - DNA, 22 bp, Artificial Sequence
  chemically synthesized
tgctccatcccacccacctccc

SEQ ID NO: 16072 - DNA, 22 bp, Artificial Sequence
  chemically synthesized
ctccatcccacccacctccctt

SEQ ID NO: 16073 - DNA, 22 bp, Artificial Sequence
  chemically synthesized
catcccacccacctccctttgg

SEQ ID NO: 16074 - DNA, 22 bp, Artificial Sequence
  chemically synthesized
cctttgggcctcgatccctcgc

SEQ ID NO: 16075 - DNA, 22 bp, Artificial Sequence
  chemically synthesized
tgggcctcgatccctcgcccct

SEQ ID NO: 16076 - DNA, 22 bp, Artificial Sequence
  chemically synthesized
gggcctcgatccctcgcccctc

SEQ ID NO: 16077 - DNA, 22 bp, Artificial Sequence
  chemically synthesized
ggcctcgatccctcgcccctca

SEQ ID NO: 16078 - DNA, 22 bp, Artificial Sequence
  chemically synthesized
gatccctcgcccctcaccagtc

SEQ ID NO: 16079 - DNA, 22 bp, Artificial Sequence
  chemically synthesized
gcccctcaccagtcccccttct

SEQ ID NO: 16080 - DNA, 22 bp, Artificial Sequence
  chemically synthesized
accagtcccccttctgagagcc

SEQ ID NO: 16081 - DNA, 22 bp, Artificial Sequence
  chemically synthesized
ctgagagcccgtattagcaggg

SEQ ID NO: 16082 - DNA, 22 bp, Artificial Sequence
  chemically synthesized
tgagagcccgtattagcaggga

SEQ ID NO: 16083 - DNA, 22 bp, Artificial Sequence
  chemically synthesized
agagcccgtattagcagggagc

SEQ ID NO: 16084 - DNA, 22 bp, Artificial Sequence
  chemically synthesized
gcagggagccggcccctactcc

SEQ ID NO: 16085 - DNA, 22 bp, Artificial Sequence
  chemically synthesized
ctccttctggcagacccagcta

SEQ ID NO: 16086 - DNA, 22 bp, Artificial Sequence
  chemically synthesized
cttctggcagacccagctaagg

SEQ ID NO: 16087 - DNA, 22 bp, Artificial Sequence
  chemically synthesized
ctggcagacccagctaaggttc

SEQ ID NO: 16088 - DNA, 22 bp, Artificial Sequence
  chemically synthesized
tggcagacccagctaaggttct

SEQ ID NO: 16089 - DNA, 22 bp, Artificial Sequence
  chemically synthesized
gcagacccagctaaggttctac

SEQ ID NO: 16090 - DNA, 22 bp, Artificial Sequence
  chemically synthesized
aggttctaccttaggggccacg

SEQ ID NO: 16091 - DNA, 22 bp, Artificial Sequence
  chemically synthesized
taccttaggggccacgccacct

SEQ ID NO: 16092 - DNA, 22 bp, Artificial Sequence
  chemically synthesized
ccttaggggccacgccacctcc

SEQ ID NO: 16093 - DNA, 22 bp, Artificial Sequence
  chemically synthesized
aggggccacgccacctccccag

SEQ ID NO: 16094 - DNA, 22 bp, Artificial Sequence
  chemically synthesized
ggggccacgccacctccccagg

SEQ ID NO: 16095 - DNA, 22 bp, Artificial Sequence
  chemically synthesized
cccagggaggggtccagaggca

SEQ ID NO: 16096 - DNA, 22 bp, Artificial Sequence
  chemically synthesized
gggtgcccctcacaggacactt

SEQ ID NO: 16097 - DNA, 22 bp, Artificial Sequence
  chemically synthesized
acaggacacttccttgcaggaa

SEQ ID NO: 16098 - DNA, 22 bp, Artificial Sequence
  chemically synthesized
ccttgcaggaacagaggtgcca

SEQ ID NO: 16099 - DNA, 22 bp, Artificial Sequence
  chemically synthesized
cttgcaggaacagaggtgccat

SEQ ID NO: 16100 - DNA, 22 bp, Artificial Sequence
  chemically synthesized
gcaggaacagaggtgccatgca

SEQ ID NO: 16101 - DNA, 22 bp, Artificial Sequence
  chemically synthesized
caggaacagaggtgccatgcag

SEQ ID NO: 16102 - DNA, 22 bp, Artificial Sequence
  chemically synthesized
cttgttgttgccctcctggcgc

SEQ ID NO: 16103 - DNA, 22 bp, Artificial Sequence
  chemically synthesized
gttgttgccctcctggcgctcc

SEQ ID NO: 16104 - DNA, 22 bp, Artificial Sequence
  chemically synthesized
ttgttgccctcctggcgctcct

SEQ ID NO: 16105 - DNA, 22 bp, Artificial Sequence
  chemically synthesized
ttgccctcctggcgctcctggc

SEQ ID NO: 16106 - DNA, 22 bp, Artificial Sequence
  chemically synthesized
ccctcctggcgctcctggcctc

SEQ ID NO: 16107 - DNA, 22 bp, Artificial Sequence
  chemically synthesized
ctggcgctcctggcctctgccc

SEQ ID NO: 16108 - DNA, 22 bp, Artificial Sequence
  chemically synthesized
gcgctcctggcctctgcccgta

SEQ ID NO: 16109 - DNA, 22 bp, Artificial Sequence
  chemically synthesized
ctggcctctgcccgtaagcact

SEQ ID NO: 16110 - DNA, 22 bp, Artificial Sequence
  chemically synthesized
gcctctgcccgtaagcacttgg

SEQ ID NO: 16111 - DNA, 22 bp, Artificial Sequence
  chemically synthesized
tgcccgtaagcacttggtggga

SEQ ID NO: 16112 - DNA, 22 bp, Artificial Sequence
  chemically synthesized
cccgtaagcacttggtgggact

SEQ ID NO: 16113 - DNA, 22 bp, Artificial Sequence
  chemically synthesized
ggtgggactgggctgggggcag

SEQ ID NO: 16114 - DNA, 22 bp, Artificial Sequence
  chemically synthesized
gtgggactgggctgggggcagg

SEQ ID NO: 16115 - DNA, 22 bp, Artificial Sequence
  chemically synthesized
cccccagcccagtcccaccaag

SEQ ID NO: 16116 - DNA, 22 bp, Artificial Sequence
  chemically synthesized
acgggcagaggccaggagcgcc

SEQ ID NO: 16117 - DNA, 22 bp, Artificial Sequence
  chemically synthesized
cgggcagaggccaggagcgcca

SEQ ID NO: 16118 - DNA, 22 bp, Artificial Sequence
  chemically synthesized
catggcacctctgttcctgcaa

SEQ ID NO: 16119 - DNA, 22 bp, Artificial Sequence
  chemically synthesized
tgttcctgcaaggaagtgtcct

SEQ ID NO: 16120 - DNA, 22 bp, Artificial Sequence
  chemically synthesized
ttcctgcaaggaagtgtcctgt

SEQ ID NO: 16121 - DNA, 22 bp, Artificial Sequence
  chemically synthesized
ctgcaaggaagtgtcctgtgag

SEQ ID NO: 16122 - DNA, 22 bp, Artificial Sequence
  chemically synthesized
caaggaagtgtcctgtgagggg

SEQ ID NO: 16123 - DNA, 22 bp, Artificial Sequence
  chemically synthesized
tgaggggcaccccaggtcccca

SEQ ID NO: 16124 - DNA, 22 bp, Artificial Sequence
  chemically synthesized
tggacccctccctggggaggtg

SEQ ID NO: 16125 - DNA, 22 bp, Artificial Sequence
  chemically synthesized
gacccctccctggggaggtggc

SEQ ID NO: 16126 - DNA, 22 bp, Artificial Sequence
  chemically synthesized
cctggggaggtggcgtggcccc

SEQ ID NO: 16127 - DNA, 22 bp, Artificial Sequence
  chemically synthesized
gggaggtggcgtggcccctaag

SEQ ID NO: 16128 - DNA, 22 bp, Artificial Sequence
  chemically synthesized
aggtagaaccttagctgggtct

SEQ ID NO: 16129 - DNA, 22 bp, Artificial Sequence
  chemically synthesized
agctgggtctgccagaaggagt

SEQ ID NO: 16130 - DNA, 22 bp, Artificial Sequence
  chemically synthesized
gctgggtctgccagaaggagta

SEQ ID NO: 16131 - DNA, 22 bp, Artificial Sequence
  chemically synthesized
ggtctgccagaaggagtagggg

SEQ ID NO: 16132 - DNA, 22 bp, Artificial Sequence
  chemically synthesized
ccagaaggagtaggggccggct

SEQ ID NO: 16133 - DNA, 22 bp, Artificial Sequence
  chemically synthesized
cctgctaatacgggctctcaga

SEQ ID NO: 16134 - DNA, 22 bp, Artificial Sequence
  chemically synthesized
ctaatacgggctctcagaaggg

SEQ ID NO: 16135 - DNA, 22 bp, Artificial Sequence
  chemically synthesized
atacgggctctcagaaggggga

SEQ ID NO: 16136 - DNA, 22 bp, Artificial Sequence
  chemically synthesized
tcagaagggggactggtgaggg

SEQ ID NO: 16137 - DNA, 22 bp, Artificial Sequence
  chemically synthesized
agaagggggactggtgaggggc

SEQ ID NO: 16138 - DNA, 22 bp, Artificial Sequence
  chemically synthesized
gtgaggggcgagggatcgaggc

SEQ ID NO: 16139 - DNA, 22 bp, Artificial Sequence
  chemically synthesized
aacatcaaggcacctgcggtct

SEQ ID NO: 16140 - DNA, 22 bp, Artificial Sequence
  chemically synthesized
cggtctggactgatctccgtcc

SEQ ID NO: 16141 - DNA, 22 bp, Artificial Sequence
  chemically synthesized
gactgatctccgtccagtccag

SEQ ID NO: 16142 - DNA, 22 bp, Artificial Sequence
  chemically synthesized
atctccgtccagtccagccaac

SEQ ID NO: 16143 - DNA, 22 bp, Artificial Sequence
  chemically synthesized
cgtccagtccagccaacatgct

SEQ ID NO: 16144 - DNA, 22 bp, Artificial Sequence
  chemically synthesized
tgtgtctttgggtgatttctgg

SEQ ID NO: 16145 - DNA, 22 bp, Artificial Sequence
  chemically synthesized
tgggtgatttctggccctctcc

SEQ ID NO: 16146 - DNA, 22 bp, Artificial Sequence
  chemically synthesized
gggtgatttctggccctctcca

SEQ ID NO: 16147 - DNA, 22 bp, Artificial Sequence
  chemically synthesized
ggtgatttctggccctctccag

SEQ ID NO: 16148 - DNA, 22 bp, Artificial Sequence
  chemically synthesized
ctggccctctccaggcctcagt

SEQ ID NO: 16149 - DNA, 22 bp, Artificial Sequence
  chemically synthesized
tggccctctccaggcctcagtt

SEQ ID NO: 16150 - DNA, 22 bp, Artificial Sequence
  chemically synthesized
gccctctccaggcctcagtttc

SEQ ID NO: 16151 - DNA, 22 bp, Artificial Sequence
  chemically synthesized
tccaggcctcagtttccctgtc

SEQ ID NO: 16152 - DNA, 22 bp, Artificial Sequence
  chemically synthesized
caggcctcagtttccctgtctg

SEQ ID NO: 16153 - DNA, 22 bp, Artificial Sequence
  chemically synthesized
agtttccctgtctggggtagga

SEQ ID NO: 16154 - DNA, 22 bp, Artificial Sequence
  chemically synthesized
ccctgtctggggtaggactggg

SEQ ID NO: 16155 - DNA, 22 bp, Artificial Sequence
  chemically synthesized
cctgtctggggtaggactgggc

SEQ ID NO: 16156 - DNA, 22 bp, Artificial Sequence
  chemically synthesized
tctggggtaggactgggctgtc

SEQ ID NO: 16157 - DNA, 22 bp, Artificial Sequence
  chemically synthesized
gggtaggactgggctgtctaag

SEQ ID NO: 16158 - DNA, 22 bp, Artificial Sequence
  chemically synthesized
ggctgtctaaggcttcctccag

SEQ ID NO: 16159 - DNA, 22 bp, Artificial Sequence
  chemically synthesized
tctaaggcttcctccagcccta

SEQ ID NO: 16160 - DNA, 22 bp, Artificial Sequence
  chemically synthesized
aggcttcctccagccctaagcc

SEQ ID NO: 16161 - DNA, 22 bp, Artificial Sequence
  chemically synthesized
cctccagccctaagcctgaaga

SEQ ID NO: 16162 - DNA, 22 bp, Artificial Sequence
  chemically synthesized
ctccagccctaagcctgaagaa

SEQ ID NO: 16163 - DNA, 22 bp, Artificial Sequence
  chemically synthesized
cagccctaagcctgaagaatga

SEQ ID NO: 16164 - DNA, 22 bp, Artificial Sequence
  chemically synthesized
agcctgaagaatgaggggggaa

SEQ ID NO: 16165 - DNA, 22 bp, Artificial Sequence
  chemically synthesized
aagaatgaggggggaacctgca

SEQ ID NO: 16166 - DNA, 22 bp, Artificial Sequence
  chemically synthesized
cacttggagccacttccagccc

SEQ ID NO: 16167 - DNA, 22 bp, Artificial Sequence
  chemically synthesized
ggagccacttccagccccaccc

SEQ ID NO: 16168 - DNA, 22 bp, Artificial Sequence
  chemically synthesized
gagccacttccagccccacccc

SEQ ID NO: 16169 - DNA, 22 bp, Artificial Sequence
  chemically synthesized
ccagccccaccccctgtgtagc

SEQ ID NO: 16170 - DNA, 22 bp, Artificial Sequence
  chemically synthesized
cagccccaccccctgtgtagct

SEQ ID NO: 16171 - DNA, 22 bp, Artificial Sequence
  chemically synthesized
tgtagctttgggcaagtgacac

SEQ ID NO: 16172 - DNA, 22 bp, Artificial Sequence
  chemically synthesized
tgggcaagtgacacccctcccg

SEQ ID NO: 16173 - DNA, 22 bp, Artificial Sequence
  chemically synthesized
gggcaagtgacacccctcccgg

SEQ ID NO: 16174 - DNA, 22 bp, Artificial Sequence
  chemically synthesized
ggcaagtgacacccctcccggg

SEQ ID NO: 16175 - DNA, 22 bp, Artificial Sequence
  chemically synthesized
ccgggcctccatgttcttcagg

SEQ ID NO: 16176 - DNA, 22 bp, Artificial Sequence
  chemically synthesized
catgttcttcaggttatgatga

SEQ ID NO: 16177 - DNA, 22 bp, Artificial Sequence
  chemically synthesized
ttcaggttatgatgaggggtgg

SEQ ID NO: 16178 - DNA, 22 bp, Artificial Sequence
  chemically synthesized
caggttatgatgaggggtgggg

SEQ ID NO: 16179 - DNA, 22 bp, Artificial Sequence
  chemically synthesized
aggttatgatgaggggtggggg

SEQ ID NO: 16180 - DNA, 22 bp, Artificial Sequence
  chemically synthesized
tgatgaggggtggggggcaccc

SEQ ID NO: 16181 - DNA, 22 bp, Artificial Sequence
  chemically synthesized
cgaggcttccttagctctagca

SEQ ID NO: 16182 - DNA, 22 bp, Artificial Sequence
  chemically synthesized
ccttagctctagcaagtgcttc

SEQ ID NO: 16183 - DNA, 22 bp, Artificial Sequence
  chemically synthesized
cttagctctagcaagtgcttct

SEQ ID NO: 16184 - DNA, 22 bp, Artificial Sequence
  chemically synthesized
agctctagcaagtgcttctcca

SEQ ID NO: 16185 - DNA, 22 bp, Artificial Sequence
  chemically synthesized
gctctagcaagtgcttctccag

SEQ ID NO: 16186 - DNA, 22 bp, Artificial Sequence
  chemically synthesized
tagcaagtgcttctccaggctt

SEQ ID NO: 16187 - DNA, 22 bp, Artificial Sequence
  chemically synthesized
gcaagtgcttctccaggcttgc

SEQ ID NO: 16188 - DNA, 22 bp, Artificial Sequence
  chemically synthesized
ctccaggcttgctggctgggct

SEQ ID NO: 16189 - DNA, 22 bp, Artificial Sequence
  chemically synthesized
tccaggcttgctggctgggctg

SEQ ID NO: 16190 - DNA, 22 bp, Artificial Sequence
  chemically synthesized
caggcttgctggctgggctggg

SEQ ID NO: 16191 - DNA, 22 bp, Artificial Sequence
  chemically synthesized
gctggctgggctgggcagggag

SEQ ID NO: 16192 - DNA, 22 bp, Artificial Sequence
  chemically synthesized
ctggctgggctgggcagggagc

SEQ ID NO: 16193 - DNA, 22 bp, Artificial Sequence
  chemically synthesized
gctgggctgggcagggagctcc

SEQ ID NO: 16194 - DNA, 22 bp, Artificial Sequence
  chemically synthesized
ggctgggcagggagctcctctt

SEQ ID NO: 16195 - DNA, 22 bp, Artificial Sequence
  chemically synthesized
ggcagggagctcctcttgcccc

SEQ ID NO: 16196 - DNA, 22 bp, Artificial Sequence
  chemically synthesized
ctcttgcccctcttcatcctcc

SEQ ID NO: 16197 - DNA, 22 bp, Artificial Sequence
  chemically synthesized
ttgcccctcttcatcctcctcc

SEQ ID NO: 16198 - DNA, 22 bp, Artificial Sequence
  chemically synthesized
gcccctcttcatcctcctcccc

SEQ ID NO: 16199 - DNA, 22 bp, Artificial Sequence
  chemically synthesized
cccctcttcatcctcctcccct

SEQ ID NO: 16200 - DNA, 22 bp, Artificial Sequence
  chemically synthesized
ttcatcctcctcccctcctctt

SEQ ID NO: 16201 - DNA, 22 bp, Artificial Sequence
  chemically synthesized
catcctcctcccctcctctttc

SEQ ID NO: 16202 - DNA, 22 bp, Artificial Sequence
  chemically synthesized
atcctcctcccctcctctttcc

SEQ ID NO: 16203 - DNA, 22 bp, Artificial Sequence
  chemically synthesized
ctcccctcctctttcccctccc

SEQ ID NO: 16204 - DNA, 22 bp, Artificial Sequence
  chemically synthesized
ccctcctctttcccctccccag

SEQ ID NO: 16205 - DNA, 22 bp, Artificial Sequence
  chemically synthesized
ctctttcccctccccagagggc

SEQ ID NO: 16206 - DNA, 22 bp, Artificial Sequence
  chemically synthesized
tttcccctccccagagggcatt

SEQ ID NO: 16207 - DNA, 22 bp, Artificial Sequence
  chemically synthesized
tcccctccccagagggcattac

SEQ ID NO: 16208 - DNA, 22 bp, Artificial Sequence
  chemically synthesized
cccctccccagagggcattacc

SEQ ID NO: 16209 - DNA, 22 bp, Artificial Sequence
  chemically synthesized
ccctccccagagggcattacct

SEQ ID NO: 16210 - DNA, 22 bp, Artificial Sequence
  chemically synthesized
cccagagggcattacctggagc

SEQ ID NO: 16211 - DNA, 22 bp, Artificial Sequence
  chemically synthesized
cctggagcagctgcctctaggg

SEQ ID NO: 16212 - DNA, 22 bp, Artificial Sequence
  chemically synthesized
gagcagctgcctctagggatga

SEQ ID NO: 16213 - DNA, 22 bp, Artificial Sequence
  chemically synthesized
cctctagggatgaactgagcag

SEQ ID NO: 16214 - DNA, 22 bp, Artificial Sequence
  chemically synthesized
tagggatgaactgagcagacag

SEQ ID NO: 16215 - DNA, 22 bp, Artificial Sequence
  chemically synthesized
gggatgaactgagcagacaggc

SEQ ID NO: 16216 - DNA, 22 bp, Artificial Sequence
  chemically synthesized
agcagacaggcaggagggttct

SEQ ID NO: 16217 - DNA, 22 bp, Artificial Sequence
  chemically synthesized
tgacctgttttatatcatctcc

SEQ ID NO: 16218 - DNA, 22 bp, Artificial Sequence
  chemically synthesized
acctgttttatatcatctccag

SEQ ID NO: 16219 - DNA, 22 bp, Artificial Sequence
  chemically synthesized
ttttatatcatctccagggcag

SEQ ID NO: 16220 - DNA, 22 bp, Artificial Sequence
  chemically synthesized
tatatcatctccagggcagcag

SEQ ID NO: 16221 - DNA, 22 bp, Artificial Sequence
  chemically synthesized
atatcatctccagggcagcagg

SEQ ID NO: 16222 - DNA, 22 bp, Artificial Sequence
  chemically synthesized
tatcatctccagggcagcaggc

SEQ ID NO: 16223 - DNA, 22 bp, Artificial Sequence
  chemically synthesized
cagggcagcaggcactgaggac

SEQ ID NO: 16224 - DNA, 22 bp, Artificial Sequence
  chemically synthesized
aggacccagggcgctgggcaaa

SEQ ID NO: 16225 - DNA, 22 bp, Artificial Sequence
  chemically synthesized
ggcaaaggtcacctgctgacca

SEQ ID NO: 16226 - DNA, 22 bp, Artificial Sequence
  chemically synthesized
ctgaccagtggagatgagggcc

SEQ ID NO: 16227 - DNA, 22 bp, Artificial Sequence
  chemically synthesized
accagtggagatgagggcctga

SEQ ID NO: 16228 - DNA, 22 bp, Artificial Sequence
  chemically synthesized
aggcagggtgtccagatgcagc

SEQ ID NO: 16229 - DNA, 22 bp, Artificial Sequence
  chemically synthesized
ggaaatccctaggagactgagt

SEQ ID NO: 16230 - DNA, 20 bp, Artificial Sequence
  chemically synthesized
taccccttgcccatccctgc

SEQ ID NO: 16231 - DNA, 20 bp, Artificial Sequence
  chemically synthesized
ggcccccgtgaccctcactt

SEQ ID NO: 16232 - DNA, 20 bp, Artificial Sequence
  chemically synthesized
gcccccgtgaccctcacttt

SEQ ID NO: 16233 - DNA, 20 bp, Artificial Sequence
  chemically synthesized
gtgaccctcactttgggacc

SEQ ID NO: 16234 - DNA, 20 bp, Artificial Sequence
  chemically synthesized
cactttgggacccagtcaca

SEQ ID NO: 16235 - DNA, 20 bp, Artificial Sequence
  chemically synthesized
ccagtcacacagatgaccac

SEQ ID NO: 16236 - DNA, 20 bp, Artificial Sequence
  chemically synthesized
gtcacacagatgaccaccag

SEQ ID NO: 16237 - DNA, 20 bp, Artificial Sequence
  chemically synthesized
acacagatgaccaccagcag

SEQ ID NO: 16238 - DNA, 20 bp, Artificial Sequence
  chemically synthesized
cacagatgaccaccagcagc

SEQ ID NO: 16239 - DNA, 20 bp, Artificial Sequence
  chemically synthesized
ccaccagcagcaggatgttg

SEQ ID NO: 16240 - DNA, 20 bp, Artificial Sequence
  chemically synthesized
agcagcaggatgttgaagct

SEQ ID NO: 16241 - DNA, 20 bp, Artificial Sequence
  chemically synthesized
gcagcaggatgttgaagctc

SEQ ID NO: 16242 - DNA, 20 bp, Artificial Sequence
  chemically synthesized
cagcaggatgttgaagctca

SEQ ID NO: 16243 - DNA, 20 bp, Artificial Sequence
  chemically synthesized
aggatgttgaagctcagggc

SEQ ID NO: 16244 - DNA, 20 bp, Artificial Sequence
  chemically synthesized
atgttgaagctcagggcaag

SEQ ID NO: 16245 - DNA, 20 bp, Artificial Sequence
  chemically synthesized
agctcagggcaagcagactg

SEQ ID NO: 16246 - DNA, 20 bp, Artificial Sequence
  chemically synthesized
tcagggcaagcagactgaag

SEQ ID NO: 16247 - DNA, 20 bp, Artificial Sequence
  chemically synthesized
aagcagactgaagcagacca

SEQ ID NO: 16248 - DNA, 20 bp, Artificial Sequence
  chemically synthesized
gcagactgaagcagaccatg

SEQ ID NO: 16249 - DNA, 20 bp, Artificial Sequence
  chemically synthesized
gactgaagcagaccatggag

SEQ ID NO: 16250 - DNA, 20 bp, Artificial Sequence
  chemically synthesized
ctgaagcagaccatggagca

SEQ ID NO: 16251 - DNA, 20 bp, Artificial Sequence
  chemically synthesized
atggagcagagacgctgtgc

SEQ ID NO: 16252 - DNA, 20 bp, Artificial Sequence
  chemically synthesized
tggagcagagacgctgtgcc

SEQ ID NO: 16253 - DNA, 20 bp, Artificial Sequence
  chemically synthesized
ggagcagagacgctgtgcca

SEQ ID NO: 16254 - DNA, 20 bp, Artificial Sequence
  chemically synthesized
gagcagagacgctgtgccag

SEQ ID NO: 16255 - DNA, 20 bp, Artificial Sequence
  chemically synthesized
agagacgctgtgccaggggc

SEQ ID NO: 16256 - DNA, 20 bp, Artificial Sequence
  chemically synthesized
gagacgctgtgccaggggct

SEQ ID NO: 16257 - DNA, 20 bp, Artificial Sequence
  chemically synthesized
acgctgtgccaggggctggg

SEQ ID NO: 16258 - DNA, 20 bp, Artificial Sequence
  chemically synthesized
cgctgtgccaggggctgggc

SEQ ID NO: 16259 - DNA, 20 bp, Artificial Sequence
  chemically synthesized
ctgtgccaggggctgggcag

SEQ ID NO: 16260 - DNA, 20 bp, Artificial Sequence
  chemically synthesized
tgtgccaggggctgggcagg

SEQ ID NO: 16261 - DNA, 20 bp, Artificial Sequence
  chemically synthesized
gccaggggctgggcaggagg

SEQ ID NO: 16262 - DNA, 20 bp, Artificial Sequence
  chemically synthesized
ctgggcaggaggtggccctg

SEQ ID NO: 16263 - DNA, 20 bp, Artificial Sequence
  chemically synthesized
tgggcaggaggtggccctgt

SEQ ID NO: 16264 - DNA, 20 bp, Artificial Sequence
  chemically synthesized
ggcaggaggtggccctgtgg

SEQ ID NO: 16265 - DNA, 20 bp, Artificial Sequence
  chemically synthesized
caggaggtggccctgtggga

SEQ ID NO: 16266 - DNA, 20 bp, Artificial Sequence
  chemically synthesized
aggaggtggccctgtgggag

SEQ ID NO: 16267 - DNA, 20 bp, Artificial Sequence
  chemically synthesized
ggaggtggccctgtgggaga

SEQ ID NO: 16268 - DNA, 20 bp, Artificial Sequence
  chemically synthesized
gaggtggccctgtgggagag

SEQ ID NO: 16269 - DNA, 20 bp, Artificial Sequence
  chemically synthesized
gccctgtgggagaggggcat

SEQ ID NO: 16270 - DNA, 20 bp, Artificial Sequence
  chemically synthesized
ccctgtgggagaggggcatc

SEQ ID NO: 16271 - DNA, 20 bp, Artificial Sequence
  chemically synthesized
ctgtgggagaggggcatcag

SEQ ID NO: 16272 - DNA, 20 bp, Artificial Sequence
  chemically synthesized
gggagaggggcatcaggagc

SEQ ID NO: 16273 - DNA, 20 bp, Artificial Sequence
  chemically synthesized
agaggggcatcaggagccgg

SEQ ID NO: 16274 - DNA, 20 bp, Artificial Sequence
  chemically synthesized
ggcatcaggagccggcagcc

SEQ ID NO: 16275 - DNA, 20 bp, Artificial Sequence
  chemically synthesized
gcatcaggagccggcagcct

SEQ ID NO: 16276 - DNA, 20 bp, Artificial Sequence
  chemically synthesized
aggagccggcagcctgggtg

SEQ ID NO: 16277 - DNA, 20 bp, Artificial Sequence
  chemically synthesized
ggagccggcagcctgggtgt

SEQ ID NO: 16278 - DNA, 20 bp, Artificial Sequence
  chemically synthesized
gagccggcagcctgggtgtg

SEQ ID NO: 16279 - DNA, 20 bp, Artificial Sequence
  chemically synthesized
gccggcagcctgggtgtggg

SEQ ID NO: 16280 - DNA, 20 bp, Artificial Sequence
  chemically synthesized
gcagcctgggtgtggggagc

SEQ ID NO: 16281 - DNA, 20 bp, Artificial Sequence
  chemically synthesized
agcctgggtgtggggagccg

SEQ ID NO: 16282 - DNA, 20 bp, Artificial Sequence
  chemically synthesized
gcctgggtgtggggagccgg

SEQ ID NO: 16283 - DNA, 20 bp, Artificial Sequence
  chemically synthesized
cctgggtgtggggagccgga

SEQ ID NO: 16284 - DNA, 20 bp, Artificial Sequence
  chemically synthesized
gtgtggggagccggagggta

SEQ ID NO: 16285 - DNA, 20 bp, Artificial Sequence
  chemically synthesized
ggggagccggagggtaaaga

SEQ ID NO: 16286 - DNA, 20 bp, Artificial Sequence
  chemically synthesized
gggagccggagggtaaagac

SEQ ID NO: 16287 - DNA, 20 bp, Artificial Sequence
  chemically synthesized
ggagccggagggtaaagaca

SEQ ID NO: 16288 - DNA, 20 bp, Artificial Sequence
  chemically synthesized
agggtaaagacagggcaccg

SEQ ID NO: 16289 - DNA, 20 bp, Artificial Sequence
  chemically synthesized
aagacagggcaccgaagcct

SEQ ID NO: 16290 - DNA, 20 bp, Artificial Sequence
  chemically synthesized
agacagggcaccgaagcctg

SEQ ID NO: 16291 - DNA, 20 bp, Artificial Sequence
  chemically synthesized
acagggcaccgaagcctgag

SEQ ID NO: 16292 - DNA, 20 bp, Artificial Sequence
  chemically synthesized
cagggcaccgaagcctgagg

SEQ ID NO: 16293 - DNA, 20 bp, Artificial Sequence
  chemically synthesized
aagcctgaggaggcataacc

SEQ ID NO: 16294 - DNA, 20 bp, Artificial Sequence
  chemically synthesized
agcctgaggaggcataacct

SEQ ID NO: 16295 - DNA, 20 bp, Artificial Sequence
  chemically synthesized
ctgaggaggcataacctggg

SEQ ID NO: 16296 - DNA, 20 bp, Artificial Sequence
  chemically synthesized
tgaggaggcataacctgggc

SEQ ID NO: 16297 - DNA, 20 bp, Artificial Sequence
  chemically synthesized
gaggaggcataacctgggcg

SEQ ID NO: 16298 - DNA, 20 bp, Artificial Sequence
  chemically synthesized
aggaggcataacctgggcgg

SEQ ID NO: 16299 - DNA, 20 bp, Artificial Sequence
  chemically synthesized
ggaggcataacctgggcggg

SEQ ID NO: 16300 - DNA, 20 bp, Artificial Sequence
  chemically synthesized
cataacctgggcggggggat

SEQ ID NO: 16301 - DNA, 20 bp, Artificial Sequence
  chemically synthesized
acctgggcggggggattggt

SEQ ID NO: 16302 - DNA, 20 bp, Artificial Sequence
  chemically synthesized
cctgggcggggggattggtt

SEQ ID NO: 16303 - DNA, 20 bp, Artificial Sequence
  chemically synthesized
ctgggcggggggattggttg

SEQ ID NO: 16304 - DNA, 20 bp, Artificial Sequence
  chemically synthesized
ggggggattggttggggcca

SEQ ID NO: 16305 - DNA, 20 bp, Artificial Sequence
  chemically synthesized
gggggattggttggggccat

SEQ ID NO: 16306 - DNA, 20 bp, Artificial Sequence
  chemically synthesized
ggggattggttggggccatg

SEQ ID NO: 16307 - DNA, 20 bp, Artificial Sequence
  chemically synthesized
gggattggttggggccatgg

SEQ ID NO: 16308 - DNA, 20 bp, Artificial Sequence
  chemically synthesized
ggattggttggggccatggg

SEQ ID NO: 16309 - DNA, 20 bp, Artificial Sequence
  chemically synthesized
gattggttggggccatgggg

SEQ ID NO: 16310 - DNA, 20 bp, Artificial Sequence
  chemically synthesized
attggttggggccatggggg

SEQ ID NO: 16311 - DNA, 20 bp, Artificial Sequence
  chemically synthesized
ttggttggggccatgggggg

SEQ ID NO: 16312 - DNA, 20 bp, Artificial Sequence
  chemically synthesized
gccatgggggggggtcatca

SEQ ID NO: 16313 - DNA, 20 bp, Artificial Sequence
  chemically synthesized
ccatgggggggggtcatcat

SEQ ID NO: 16314 - DNA, 20 bp, Artificial Sequence
  chemically synthesized
gtcatcataggctttgaccc

SEQ ID NO: 16315 - DNA, 20 bp, Artificial Sequence
  chemically synthesized
aggctttgaccccagcattt

SEQ ID NO: 16316 - DNA, 20 bp, Artificial Sequence
  chemically synthesized
catgtataaatatacacacg

SEQ ID NO: 16317 - DNA, 20 bp, Artificial Sequence
  chemically synthesized
atatacacacgcagctaatc

SEQ ID NO: 16318 - DNA, 20 bp, Artificial Sequence
  chemically synthesized
acacacccatgcacacgact

SEQ ID NO: 16319 - DNA, 20 bp, Artificial Sequence
  chemically synthesized
cacacccatgcacacgactc

SEQ ID NO: 16320 - DNA, 20 bp, Artificial Sequence
  chemically synthesized
acgactcaggatattcacat

SEQ ID NO: 16321 - DNA, 20 bp, Artificial Sequence
  chemically synthesized
attcacatcagctgtgtgca

SEQ ID NO: 16322 - DNA, 20 bp, Artificial Sequence
  chemically synthesized
catcagctgtgtgcaaagcc

SEQ ID NO: 16323 - DNA, 20 bp, Artificial Sequence
  chemically synthesized
tgtgtgcaaagcccggatcc

SEQ ID NO: 16324 - DNA, 20 bp, Artificial Sequence
  chemically synthesized
tgtgcaaagcccggatcctg

SEQ ID NO: 16325 - DNA, 20 bp, Artificial Sequence
  chemically synthesized
caaagcccggatcctggagc

SEQ ID NO: 16326 - DNA, 20 bp, Artificial Sequence
  chemically synthesized
aaagcccggatcctggagct

SEQ ID NO: 16327 - DNA, 20 bp, Artificial Sequence
  chemically synthesized
aagcccggatcctggagctg

SEQ ID NO: 16328 - DNA, 20 bp, Artificial Sequence
  chemically synthesized
agcccggatcctggagctgg

SEQ ID NO: 16329 - DNA, 20 bp, Artificial Sequence
  chemically synthesized
ggatcctggagctgggggac

SEQ ID NO: 16330 - DNA, 20 bp, Artificial Sequence
  chemically synthesized
gatcctggagctgggggact

SEQ ID NO: 16331 - DNA, 20 bp, Artificial Sequence
  chemically synthesized
tcctggagctgggggactgg

SEQ ID NO: 16332 - DNA, 20 bp, Artificial Sequence
  chemically synthesized
ctgggggactgggagacgca

SEQ ID NO: 16333 - DNA, 20 bp, Artificial Sequence
  chemically synthesized
tgggggactgggagacgcac

SEQ ID NO: 16334 - DNA, 20 bp, Artificial Sequence
  chemically synthesized
gggggactgggagacgcaca

SEQ ID NO: 16335 - DNA, 20 bp, Artificial Sequence
  chemically synthesized
ggggactgggagacgcacag

SEQ ID NO: 16336 - DNA, 20 bp, Artificial Sequence
  chemically synthesized
gggactgggagacgcacagg

SEQ ID NO: 16337 - DNA, 20 bp, Artificial Sequence
  chemically synthesized
actgggagacgcacaggggg

SEQ ID NO: 16338 - DNA, 20 bp, Artificial Sequence
  chemically synthesized
ctgggagacgcacagggggc

SEQ ID NO: 16339 - DNA, 20 bp, Artificial Sequence
  chemically synthesized
tgggagacgcacagggggcg

SEQ ID NO: 16340 - DNA, 20 bp, Artificial Sequence
  chemically synthesized
gggagacgcacagggggcgg

SEQ ID NO: 16341 - DNA, 20 bp, Artificial Sequence
  chemically synthesized
ggagacgcacagggggcggg

SEQ ID NO: 16342 - DNA, 20 bp, Artificial Sequence
  chemically synthesized
gagacgcacagggggcgggg

SEQ ID NO: 16343 - DNA, 20 bp, Artificial Sequence
  chemically synthesized
acgcacagggggcggggggg

SEQ ID NO: 16344 - DNA, 20 bp, Artificial Sequence
  chemically synthesized
agggggcgggggggcagacc

SEQ ID NO: 16345 - DNA, 20 bp, Artificial Sequence
  chemically synthesized
ggggcagacccggccctgcc

SEQ ID NO: 16346 - DNA, 20 bp, Artificial Sequence
  chemically synthesized
gggcagacccggccctgcct

SEQ ID NO: 16347 - DNA, 20 bp, Artificial Sequence
  chemically synthesized
cctgcctaggcacacatcct

SEQ ID NO: 16348 - DNA, 20 bp, Artificial Sequence
  chemically synthesized
gcctaggcacacatcctgag

SEQ ID NO: 16349 - DNA, 20 bp, Artificial Sequence
  chemically synthesized
cctaggcacacatcctgaga

SEQ ID NO: 16350 - DNA, 20 bp, Artificial Sequence
  chemically synthesized
ctaggcacacatcctgagaa

SEQ ID NO: 16351 - DNA, 20 bp, Artificial Sequence
  chemically synthesized
taggcacacatcctgagaag

SEQ ID NO: 16352 - DNA, 20 bp, Artificial Sequence
  chemically synthesized
aggcacacatcctgagaagg

SEQ ID NO: 16353 - DNA, 20 bp, Artificial Sequence
  chemically synthesized
tgagaagggggatctgtgaa

SEQ ID NO: 16354 - DNA, 20 bp, Artificial Sequence
  chemically synthesized
tgaatggttttcctcccatc

SEQ ID NO: 16355 - DNA, 20 bp, Artificial Sequence
  chemically synthesized
tggttttcctcccatccagc

SEQ ID NO: 16356 - DNA, 20 bp, Artificial Sequence
  chemically synthesized
ttttcctcccatccagccag

SEQ ID NO: 16357 - DNA, 20 bp, Artificial Sequence
  chemically synthesized
tcctcccatccagccagtgg

SEQ ID NO: 16358 - DNA, 20 bp, Artificial Sequence
  chemically synthesized
ctcccatccagccagtggca

SEQ ID NO: 16359 - DNA, 20 bp, Artificial Sequence
  chemically synthesized
tcccatccagccagtggcag

SEQ ID NO: 16360 - DNA, 20 bp, Artificial Sequence
  chemically synthesized
cagccagtggcagaggcctc

SEQ ID NO: 16361 - DNA, 20 bp, Artificial Sequence
  chemically synthesized
cagaggcctccagatcacct

SEQ ID NO: 16362 - DNA, 20 bp, Artificial Sequence
  chemically synthesized
agaggcctccagatcacctc

SEQ ID NO: 16363 - DNA, 20 bp, Artificial Sequence
  chemically synthesized
ctccagatcacctcgggcct

SEQ ID NO: 16364 - DNA, 20 bp, Artificial Sequence
  chemically synthesized
atcacctcgggccttagtct

SEQ ID NO: 16365 - DNA, 20 bp, Artificial Sequence
  chemically synthesized
gccttagtctcagctcttct

SEQ ID NO: 16366 - DNA, 20 bp, Artificial Sequence
  chemically synthesized
ccttagtctcagctcttcta

SEQ ID NO: 16367 - DNA, 20 bp, Artificial Sequence
  chemically synthesized
ttctaaggctcctgtcccct

SEQ ID NO: 16368 - DNA, 20 bp, Artificial Sequence
  chemically synthesized
aggctcctgtcccctcagat

SEQ ID NO: 16369 - DNA, 20 bp, Artificial Sequence
  chemically synthesized
gctcctgtcccctcagattg

SEQ ID NO: 16370 - DNA, 20 bp, Artificial Sequence
  chemically synthesized
tcccctcagattggagactc

SEQ ID NO: 16371 - DNA, 20 bp, Artificial Sequence
  chemically synthesized
cctcagattggagactccag

SEQ ID NO: 16372 - DNA, 20 bp, Artificial Sequence
  chemically synthesized
agattggagactccagaagc

SEQ ID NO: 16373 - DNA, 20 bp, Artificial Sequence
  chemically synthesized
gattggagactccagaagct

SEQ ID NO: 16374 - DNA, 20 bp, Artificial Sequence
  chemically synthesized
gttcttcctaaaatccatac

SEQ ID NO: 16375 - DNA, 20 bp, Artificial Sequence
  chemically synthesized
tcctaaaatccatactggaa

SEQ ID NO: 16376 - DNA, 20 bp, Artificial Sequence
  chemically synthesized
tcccctgccaaaattccatt

SEQ ID NO: 16377 - DNA, 20 bp, Artificial Sequence
  chemically synthesized
tccattgagatccttaaatc

SEQ ID NO: 16378 - DNA, 20 bp, Artificial Sequence
  chemically synthesized
ccattgagatccttaaatct

SEQ ID NO: 16379 - DNA, 20 bp, Artificial Sequence
  chemically synthesized
aaatctgggtcattccacca

SEQ ID NO: 16380 - DNA, 20 bp, Artificial Sequence
  chemically synthesized
tccaccatagcccactctcc

SEQ ID NO: 16381 - DNA, 20 bp, Artificial Sequence
  chemically synthesized
actctccaagcacaaccctc

SEQ ID NO: 16382 - DNA, 20 bp, Artificial Sequence
  chemically synthesized
ctctccaagcacaaccctcc

SEQ ID NO: 16383 - DNA, 20 bp, Artificial Sequence
  chemically synthesized
gtcctcatcccccaccacgc

SEQ ID NO: 16384 - DNA, 20 bp, Artificial Sequence
  chemically synthesized
tcctcatcccccaccacgca

SEQ ID NO: 16385 - DNA, 20 bp, Artificial Sequence
  chemically synthesized
accacgcaaggcctcctccc

SEQ ID NO: 16386 - DNA, 20 bp, Artificial Sequence
  chemically synthesized
gccctttgccctcgcttccc

SEQ ID NO: 16387 - DNA, 20 bp, Artificial Sequence
  chemically synthesized
cacactaaatttgctcccct

SEQ ID NO: 16388 - DNA, 20 bp, Artificial Sequence
  chemically synthesized
aaatttgctcccctcagccc

SEQ ID NO: 16389 - DNA, 20 bp, Artificial Sequence
  chemically synthesized
aatttgctcccctcagcccg

SEQ ID NO: 16390 - DNA, 20 bp, Artificial Sequence
  chemically synthesized
ctcagcccgaggtcatctca

SEQ ID NO: 16391 - DNA, 20 bp, Artificial Sequence
  chemically synthesized
tcagcccgaggtcatctcac

SEQ ID NO: 16392 - DNA, 20 bp, Artificial Sequence
  chemically synthesized
ttgatccatctgcaccctga

SEQ ID NO: 16393 - DNA, 20 bp, Artificial Sequence
  chemically synthesized
cacccacgtcttcctgcaca

SEQ ID NO: 16394 - DNA, 20 bp, Artificial Sequence
  chemically synthesized
cccacgtcttcctgcacaca

SEQ ID NO: 16395 - DNA, 20 bp, Artificial Sequence
  chemically synthesized
cgtcttcctgcacacagagc

SEQ ID NO: 16396 - DNA, 20 bp, Artificial Sequence
  chemically synthesized
gtcttcctgcacacagagct

SEQ ID NO: 16397 - DNA, 20 bp, Artificial Sequence
  chemically synthesized
ggctccctctctgctgcctc

SEQ ID NO: 16398 - DNA, 20 bp, Artificial Sequence
  chemically synthesized
ctctctgctgcctccagacc

SEQ ID NO: 16399 - DNA, 20 bp, Artificial Sequence
  chemically synthesized
ctctgctgcctccagaccca

SEQ ID NO: 16400 - DNA, 20 bp, Artificial Sequence
  chemically synthesized
tgctgcctccagacccagag

SEQ ID NO: 16401 - DNA, 20 bp, Artificial Sequence
  chemically synthesized
ctccagacccagagcagctc

SEQ ID NO: 16402 - DNA, 20 bp, Artificial Sequence
  chemically synthesized
cagagcagctccagttgtcc

SEQ ID NO: 16403 - DNA, 20 bp, Artificial Sequence
  chemically synthesized
gctccagttgtcccagccct

SEQ ID NO: 16404 - DNA, 20 bp, Artificial Sequence
  chemically synthesized
gccctgagctcctctctttg

SEQ ID NO: 16405 - DNA, 20 bp, Artificial Sequence
  chemically synthesized
ttgcagcatccacctgcaaa

SEQ ID NO: 16406 - DNA, 20 bp, Artificial Sequence
  chemically synthesized
cctgcaaacagaacaccttc

SEQ ID NO: 16407 - DNA, 20 bp, Artificial Sequence
  chemically synthesized
ctgcaaacagaacaccttct

SEQ ID NO: 16408 - DNA, 20 bp, Artificial Sequence
  chemically synthesized
acagaacaccttctaggcct

SEQ ID NO: 16409 - DNA, 20 bp, Artificial Sequence
  chemically synthesized
ggccttggaccctgactctg

SEQ ID NO: 16410 - DNA, 20 bp, Artificial Sequence
  chemically synthesized
attcctatcaccccccgacc

SEQ ID NO: 16411 - DNA, 20 bp, Artificial Sequence
  chemically synthesized
cctatcaccccccgacccag

SEQ ID NO: 16412 - DNA, 20 bp, Artificial Sequence
  chemically synthesized
ctatcaccccccgacccagc

SEQ ID NO: 16413 - DNA, 20 bp, Artificial Sequence
  chemically synthesized
gacccagcaggaccacatcc

SEQ ID NO: 16414 - DNA, 20 bp, Artificial Sequence
  chemically synthesized
acccagcaggaccacatcct

SEQ ID NO: 16415 - DNA, 20 bp, Artificial Sequence
  chemically synthesized
cccagcaggaccacatcctg

SEQ ID NO: 16416 - DNA, 20 bp, Artificial Sequence
  chemically synthesized
cagcaggaccacatcctggg

SEQ ID NO: 16417 - DNA, 20 bp, Artificial Sequence
  chemically synthesized
agcaggaccacatcctgggg

SEQ ID NO: 16418 - DNA, 20 bp, Artificial Sequence
  chemically synthesized
gaccacatcctggggaggct

SEQ ID NO: 16419 - DNA, 20 bp, Artificial Sequence
  chemically synthesized
acatcctggggaggctcagt

SEQ ID NO: 16420 - DNA, 20 bp, Artificial Sequence
  chemically synthesized
catcctggggaggctcagtc

SEQ ID NO: 16421 - DNA, 20 bp, Artificial Sequence
  chemically synthesized
atcctggggaggctcagtca

SEQ ID NO: 16422 - DNA, 20 bp, Artificial Sequence
  chemically synthesized
tcctggggaggctcagtcag

SEQ ID NO: 16423 - DNA, 20 bp, Artificial Sequence
  chemically synthesized
gggaggctcagtcaggggcc

SEQ ID NO: 16424 - DNA, 20 bp, Artificial Sequence
  chemically synthesized
gggcccagaatcttcctccc

SEQ ID NO: 16425 - DNA, 20 bp, Artificial Sequence
  chemically synthesized
ggcccagaatcttcctcccc

SEQ ID NO: 16426 - DNA, 20 bp, Artificial Sequence
  chemically synthesized
tcacttcctgccactgtcct

SEQ ID NO: 16427 - DNA, 20 bp, Artificial Sequence
  chemically synthesized
ttcctgccactgtcctgagt

SEQ ID NO: 16428 - DNA, 20 bp, Artificial Sequence
  chemically synthesized
gagtcagacactgcccctgt

SEQ ID NO: 16429 - DNA, 20 bp, Artificial Sequence
  chemically synthesized
actcttcatctttttcacac

SEQ ID NO: 16430 - DNA, 20 bp, Artificial Sequence
  chemically synthesized
gacttccaccttccccactg

SEQ ID NO: 16431 - DNA, 20 bp, Artificial Sequence
  chemically synthesized
ttccccactgcagccacact

SEQ ID NO: 16432 - DNA, 20 bp, Artificial Sequence
  chemically synthesized
tccccactgcagccacactc

SEQ ID NO: 16433 - DNA, 20 bp, Artificial Sequence
  chemically synthesized
actcaggaccccatttgacc

SEQ ID NO: 16434 - DNA, 20 bp, Artificial Sequence
  chemically synthesized
ctcaggaccccatttgaccc

SEQ ID NO: 16435 - DNA, 20 bp, Artificial Sequence
  chemically synthesized
tcaggaccccatttgaccca

SEQ ID NO: 16436 - DNA, 20 bp, Artificial Sequence
  chemically synthesized
aggaccccatttgacccagg

SEQ ID NO: 16437 - DNA, 20 bp, Artificial Sequence
  chemically synthesized
ggaccccatttgacccaggg

SEQ ID NO: 16438 - DNA, 20 bp, Artificial Sequence
  chemically synthesized
ccactgcccactcccgctct

SEQ ID NO: 16439 - DNA, 20 bp, Artificial Sequence
  chemically synthesized
gcccactcccgctctgagca

SEQ ID NO: 16440 - DNA, 20 bp, Artificial Sequence
  chemically synthesized
ctgcccccaccccttcctcc

SEQ ID NO: 16441 - DNA, 20 bp, Artificial Sequence
  chemically synthesized
tgcccccaccccttcctcca

SEQ ID NO: 16442 - DNA, 20 bp, Artificial Sequence
  chemically synthesized
cctttgcattcctctccatc

SEQ ID NO: 16443 - DNA, 20 bp, Artificial Sequence
  chemically synthesized
ttgcattcctctccatccag

SEQ ID NO: 16444 - DNA, 20 bp, Artificial Sequence
  chemically synthesized
ccagaagcgctccatgacca

SEQ ID NO: 16445 - DNA, 20 bp, Artificial Sequence
  chemically synthesized
tgaccacggtgttccccacc

SEQ ID NO: 16446 - DNA, 20 bp, Artificial Sequence
  chemically synthesized
cacggtgttccccaccaagc

SEQ ID NO: 16447 - DNA, 20 bp, Artificial Sequence
  chemically synthesized
cccaccaagctggccctcca

SEQ ID NO: 16448 - DNA, 20 bp, Artificial Sequence
  chemically synthesized
caagctggccctccatggct

SEQ ID NO: 16449 - DNA, 20 bp, Artificial Sequence
  chemically synthesized
gagtccctgactgctgtctt

SEQ ID NO: 16450 - DNA, 20 bp, Artificial Sequence
  chemically synthesized
tgtcttcagcaccctccact

SEQ ID NO: 16451 - DNA, 20 bp, Artificial Sequence
  chemically synthesized
tcttcagcaccctccactca

SEQ ID NO: 16452 - DNA, 20 bp, Artificial Sequence
  chemically synthesized
cttcagcaccctccactcag

SEQ ID NO: 16453 - DNA, 20 bp, Artificial Sequence
  chemically synthesized
ttcagcaccctccactcaga

SEQ ID NO: 16454 - DNA, 20 bp, Artificial Sequence
  chemically synthesized
gagggtcctgtcctgcttcc

SEQ ID NO: 16455 - DNA, 20 bp, Artificial Sequence
  chemically synthesized
gacttatcaactcccaatgc

SEQ ID NO: 16456 - DNA, 20 bp, Artificial Sequence
  chemically synthesized
acttatcaactcccaatgct

SEQ ID NO: 16457 - DNA, 20 bp, Artificial Sequence
  chemically synthesized
atcaactcccaatgctgggt

SEQ ID NO: 16458 - DNA, 20 bp, Artificial Sequence
  chemically synthesized
ctcccaatgctgggtcagcc

SEQ ID NO: 16459 - DNA, 20 bp, Artificial Sequence
  chemically synthesized
ctgtatatccaccctgaaac

SEQ ID NO: 16460 - DNA, 20 bp, Artificial Sequence
  chemically synthesized
ccctgaaaccagactgccca

SEQ ID NO: 16461 - DNA, 20 bp, Artificial Sequence
  chemically synthesized
cctgaaaccagactgcccac

SEQ ID NO: 16462 - DNA, 20 bp, Artificial Sequence
  chemically synthesized
ctgaaaccagactgcccaca

SEQ ID NO: 16463 - DNA, 20 bp, Artificial Sequence
  chemically synthesized
aaaccagactgcccacaggg

SEQ ID NO: 16464 - DNA, 20 bp, Artificial Sequence
  chemically synthesized
agactgcccacagggtagcc

SEQ ID NO: 16465 - DNA, 20 bp, Artificial Sequence
  chemically synthesized
gggtagcccagctgtgcctc

SEQ ID NO: 16466 - DNA, 20 bp, Artificial Sequence
  chemically synthesized
ggtagcccagctgtgcctcc

SEQ ID NO: 16467 - DNA, 20 bp, Artificial Sequence
  chemically synthesized
agcccagctgtgcctccagg

SEQ ID NO: 16468 - DNA, 20 bp, Artificial Sequence
  chemically synthesized
ctgtgcctccaggtagctct

SEQ ID NO: 16469 - DNA, 20 bp, Artificial Sequence
  chemically synthesized
gtagctctgagatcatgcac

SEQ ID NO: 16470 - DNA, 20 bp, Artificial Sequence
  chemically synthesized
ccattttctcgtgtgtaaaa

SEQ ID NO: 16471 - DNA, 20 bp, Artificial Sequence
  chemically synthesized
attttctcgtgtgtaaaatg

SEQ ID NO: 16472 - DNA, 20 bp, Artificial Sequence
  chemically synthesized
cgtgtgtaaaatggagatca

SEQ ID NO: 16473 - DNA, 20 bp, Artificial Sequence
  chemically synthesized
taaaatggagatcacagtcg

SEQ ID NO: 16474 - DNA, 20 bp, Artificial Sequence
  chemically synthesized
cacagtcgtagctacccgat

SEQ ID NO: 16475 - DNA, 20 bp, Artificial Sequence
  chemically synthesized
agctacccgattggattgct

SEQ ID NO: 16476 - DNA, 20 bp, Artificial Sequence
  chemically synthesized
gattggattgctcggataat

SEQ ID NO: 16477 - DNA, 20 bp, Artificial Sequence
  chemically synthesized
gattgctcggataattagat

SEQ ID NO: 16478 - DNA, 20 bp, Artificial Sequence
  chemically synthesized
aaaatatgtaatgtgcttct

SEQ ID NO: 16479 - DNA, 20 bp, Artificial Sequence
  chemically synthesized
aaatatgtaatgtgcttctt

SEQ ID NO: 16480 - DNA, 20 bp, Artificial Sequence
  chemically synthesized
gtaatgtgcttcttaggcaa

SEQ ID NO: 16481 - DNA, 20 bp, Artificial Sequence
  chemically synthesized
aggcaaaagtttgaacataa

SEQ ID NO: 16482 - DNA, 20 bp, Artificial Sequence
  chemically synthesized
aaaagtttgaacataaaaga

SEQ ID NO: 16483 - DNA, 20 bp, Artificial Sequence
  chemically synthesized
aaagtttgaacataaaagac

SEQ ID NO: 16484 - DNA, 20 bp, Artificial Sequence
  chemically synthesized
aagtttgaacataaaagaca

SEQ ID NO: 16485 - DNA, 20 bp, Artificial Sequence
  chemically synthesized
ataaaagacagggtctgccc

SEQ ID NO: 16486 - DNA, 20 bp, Artificial Sequence
  chemically synthesized
aagacagggtctgcccaaga

SEQ ID NO: 16487 - DNA, 20 bp, Artificial Sequence
  chemically synthesized
agacagggtctgcccaagat

SEQ ID NO: 16488 - DNA, 20 bp, Artificial Sequence
  chemically synthesized
cagggtctgcccaagatggg

SEQ ID NO: 16489 - DNA, 20 bp, Artificial Sequence
  chemically synthesized
gggtctgcccaagatgggaa

SEQ ID NO: 16490 - DNA, 20 bp, Artificial Sequence
  chemically synthesized
gggaagagttcttctctccc

SEQ ID NO: 16491 - DNA, 20 bp, Artificial Sequence
  chemically synthesized
agaaacaatcaaaacaaaaa

SEQ ID NO: 16492 - DNA, 20 bp, Artificial Sequence
  chemically synthesized
aaaacaaaaacagacaacta

SEQ ID NO: 16493 - DNA, 20 bp, Artificial Sequence
  chemically synthesized
aaacagacaactatagaaca

SEQ ID NO: 16494 - DNA, 20 bp, Artificial Sequence
  chemically synthesized
cagacaactatagaacatgg

SEQ ID NO: 16495 - DNA, 20 bp, Artificial Sequence
  chemically synthesized
tatagaacatggcagctttc

SEQ ID NO: 16496 - DNA, 20 bp, Artificial Sequence
  chemically synthesized
catggcagctttcaagactc

SEQ ID NO: 16497 - DNA, 20 bp, Artificial Sequence
  chemically synthesized
gctttcaagactctggacat

SEQ ID NO: 16498 - DNA, 20 bp, Artificial Sequence
  chemically synthesized
ctttcaagactctggacatc

SEQ ID NO: 16499 - DNA, 20 bp, Artificial Sequence
  chemically synthesized
caagactctggacatcaggc

SEQ ID NO: 16500 - DNA, 20 bp, Artificial Sequence
  chemically synthesized
aagactctggacatcaggca

SEQ ID NO: 16501 - DNA, 20 bp, Artificial Sequence
  chemically synthesized
gactctggacatcaggcaag

SEQ ID NO: 16502 - DNA, 20 bp, Artificial Sequence
  chemically synthesized
actctggacatcaggcaagg

SEQ ID NO: 16503 - DNA, 20 bp, Artificial Sequence
  chemically synthesized
tctggacatcaggcaaggag

SEQ ID NO: 16504 - DNA, 20 bp, Artificial Sequence
  chemically synthesized
acatcaggcaaggaggagta

SEQ ID NO: 16505 - DNA, 20 bp, Artificial Sequence
  chemically synthesized
aaggaggagtaaagatccct

SEQ ID NO: 16506 - DNA, 20 bp, Artificial Sequence
  chemically synthesized
aggaggagtaaagatccctg

SEQ ID NO: 16507 - DNA, 20 bp, Artificial Sequence
  chemically synthesized
ggaggagtaaagatccctga

SEQ ID NO: 16508 - DNA, 20 bp, Artificial Sequence
  chemically synthesized
agtaaagatccctgagggat

SEQ ID NO: 16509 - DNA, 20 bp, Artificial Sequence
  chemically synthesized
aaagatccctgagggataag

SEQ ID NO: 16510 - DNA, 20 bp, Artificial Sequence
  chemically synthesized
gagggataagaagcaaacaa

SEQ ID NO: 16511 - DNA, 20 bp, Artificial Sequence
  chemically synthesized
agggataagaagcaaacaac

SEQ ID NO: 16512 - DNA, 20 bp, Artificial Sequence
  chemically synthesized
caggaaccctccgatcaccc

SEQ ID NO: 16513 - DNA, 20 bp, Artificial Sequence
  chemically synthesized
gatcaccccagcttactgtt

SEQ ID NO: 16514 - DNA, 20 bp, Artificial Sequence
  chemically synthesized
tcaccccagcttactgtttg

SEQ ID NO: 16515 - DNA, 20 bp, Artificial Sequence
  chemically synthesized
accccagcttactgtttgga

SEQ ID NO: 16516 - DNA, 20 bp, Artificial Sequence
  chemically synthesized
cccagcttactgtttggaga

SEQ ID NO: 16517 - DNA, 20 bp, Artificial Sequence
  chemically synthesized
tactgtttggagagagtctg

SEQ ID NO: 16518 - DNA, 20 bp, Artificial Sequence
  chemically synthesized
actgtttggagagagtctgc

SEQ ID NO: 16519 - DNA, 20 bp, Artificial Sequence
  chemically synthesized
tggagagagtctgcaggtta

SEQ ID NO: 16520 - DNA, 20 bp, Artificial Sequence
  chemically synthesized
ggagagagtctgcaggttac

SEQ ID NO: 16521 - DNA, 20 bp, Artificial Sequence
  chemically synthesized
agagtctgcaggttacaggc

SEQ ID NO: 16522 - DNA, 20 bp, Artificial Sequence
  chemically synthesized
gagtctgcaggttacaggcc

SEQ ID NO: 16523 - DNA, 20 bp, Artificial Sequence
  chemically synthesized
ctgcaggttacaggccagga

SEQ ID NO: 16524 - DNA, 20 bp, Artificial Sequence
  chemically synthesized
tgcaggttacaggccaggaa

SEQ ID NO: 16525 - DNA, 20 bp, Artificial Sequence
  chemically synthesized
gcaggttacaggccaggaaa

SEQ ID NO: 16526 - DNA, 20 bp, Artificial Sequence
  chemically synthesized
ggttacaggccaggaaaggg

SEQ ID NO: 16527 - DNA, 20 bp, Artificial Sequence
  chemically synthesized
caggccaggaaagggaagtc

SEQ ID NO: 16528 - DNA, 20 bp, Artificial Sequence
  chemically synthesized
aggccaggaaagggaagtcc

SEQ ID NO: 16529 - DNA, 20 bp, Artificial Sequence
  chemically synthesized
ccaggaaagggaagtccagg

SEQ ID NO: 16530 - DNA, 20 bp, Artificial Sequence
  chemically synthesized
aggaaagggaagtccaggca

SEQ ID NO: 16531 - DNA, 20 bp, Artificial Sequence
  chemically synthesized
gggaagtccaggcagagccc

SEQ ID NO: 16532 - DNA, 20 bp, Artificial Sequence
  chemically synthesized
gaagtccaggcagagcccaa

SEQ ID NO: 16533 - DNA, 20 bp, Artificial Sequence
  chemically synthesized
cccaagagactccccacgtt

SEQ ID NO: 16534 - DNA, 20 bp, Artificial Sequence
  chemically synthesized
ccaagagactccccacgttg

SEQ ID NO: 16535 - DNA, 20 bp, Artificial Sequence
  chemically synthesized
aagagactccccacgttgag

SEQ ID NO: 16536 - DNA, 20 bp, Artificial Sequence
  chemically synthesized
gactccccacgttgaggaga

SEQ ID NO: 16537 - DNA, 20 bp, Artificial Sequence
  chemically synthesized
ctccccacgttgaggagatg

SEQ ID NO: 16538 - DNA, 20 bp, Artificial Sequence
  chemically synthesized
cacgttgaggagatggagct

SEQ ID NO: 16539 - DNA, 20 bp, Artificial Sequence
  chemically synthesized
cgttgaggagatggagctga

SEQ ID NO: 16540 - DNA, 20 bp, Artificial Sequence
  chemically synthesized
ggagatggagctgagagtcc

SEQ ID NO: 16541 - DNA, 20 bp, Artificial Sequence
  chemically synthesized
gagatggagctgagagtccg

SEQ ID NO: 16542 - DNA, 20 bp, Artificial Sequence
  chemically synthesized
gatggagctgagagtccgag

SEQ ID NO: 16543 - DNA, 20 bp, Artificial Sequence
  chemically synthesized
ccgaggagaccaaaacaatt

SEQ ID NO: 16544 - DNA, 20 bp, Artificial Sequence
  chemically synthesized
gaggagaccaaaacaattaa

SEQ ID NO: 16545 - DNA, 20 bp, Artificial Sequence
  chemically synthesized
caaacgatcaaactgactct

SEQ ID NO: 16546 - DNA, 20 bp, Artificial Sequence
  chemically synthesized
taagttgcttaactgcatcc

SEQ ID NO: 16547 - DNA, 20 bp, Artificial Sequence
  chemically synthesized
agttgcttaactgcatcccg

SEQ ID NO: 16548 - DNA, 20 bp, Artificial Sequence
  chemically synthesized
cttaactgcatcccggagca

SEQ ID NO: 16549 - DNA, 20 bp, Artificial Sequence
  chemically synthesized
tgcatcccggagcaaagctc

SEQ ID NO: 16550 - DNA, 20 bp, Artificial Sequence
  chemically synthesized
gagcaaagctcaagaacatt

SEQ ID NO: 16551 - DNA, 20 bp, Artificial Sequence
  chemically synthesized
gcaaagctcaagaacattta

SEQ ID NO: 16552 - DNA, 20 bp, Artificial Sequence
  chemically synthesized
caaagctcaagaacatttag

SEQ ID NO: 16553 - DNA, 20 bp, Artificial Sequence
  chemically synthesized
tagaggaatacaaaaatatc

SEQ ID NO: 16554 - DNA, 20 bp, Artificial Sequence
  chemically synthesized
aaaaatatccagcacccaac

SEQ ID NO: 16555 - DNA, 20 bp, Artificial Sequence
  chemically synthesized
aaaatatccagcacccaaca

SEQ ID NO: 16556 - DNA, 20 bp, Artificial Sequence
  chemically synthesized
aaggtgaaattgacaatgtc

SEQ ID NO: 16557 - DNA, 20 bp, Artificial Sequence
  chemically synthesized
gtgaaattgacaatgtctgg

SEQ ID NO: 16558 - DNA, 20 bp, Artificial Sequence
  chemically synthesized
caatgtctggcagccaatca

SEQ ID NO: 16559 - DNA, 20 bp, Artificial Sequence
  chemically synthesized
ggcagccaatcaaagattac

SEQ ID NO: 16560 - DNA, 20 bp, Artificial Sequence
  chemically synthesized
gcagccaatcaaagattaca

SEQ ID NO: 16561 - DNA, 20 bp, Artificial Sequence
  chemically synthesized
ttacaaggcatgcaatgaaa

SEQ ID NO: 16562 - DNA, 20 bp, Artificial Sequence
  chemically synthesized
tacaaggcatgcaatgaaac

SEQ ID NO: 16563 - DNA, 20 bp, Artificial Sequence
  chemically synthesized
gggaaaacacaatgcataac

SEQ ID NO: 16564 - DNA, 20 bp, Artificial Sequence
  chemically synthesized
ggaaaacacaatgcataacg

SEQ ID NO: 16565 - DNA, 20 bp, Artificial Sequence
  chemically synthesized
aaaacacaatgcataacgag

SEQ ID NO: 16566 - DNA, 20 bp, Artificial Sequence
  chemically synthesized
aaacacaatgcataacgagg

SEQ ID NO: 16567 - DNA, 20 bp, Artificial Sequence
  chemically synthesized
aggaggttcataaatatcaa

SEQ ID NO: 16568 - DNA, 20 bp, Artificial Sequence
  chemically synthesized
gaggttcataaatatcaaaa

SEQ ID NO: 16569 - DNA, 20 bp, Artificial Sequence
  chemically synthesized
cataaatatcaaaagagatc

SEQ ID NO: 16570 - DNA, 20 bp, Artificial Sequence
  chemically synthesized
aaagagatccagaactgaca

SEQ ID NO: 16571 - DNA, 20 bp, Artificial Sequence
  chemically synthesized
tccagaactgacacggatgc

SEQ ID NO: 16572 - DNA, 20 bp, Artificial Sequence
  chemically synthesized
actgacacggatgctagaat

SEQ ID NO: 16573 - DNA, 20 bp, Artificial Sequence
  chemically synthesized
gacacggatgctagaattag

SEQ ID NO: 16574 - DNA, 20 bp, Artificial Sequence
  chemically synthesized
acacggatgctagaattagc

SEQ ID NO: 16575 - DNA, 20 bp, Artificial Sequence
  chemically synthesized
ggatgctagaattagcaggc

SEQ ID NO: 16576 - DNA, 20 bp, Artificial Sequence
  chemically synthesized
gatgctagaattagcaggca

SEQ ID NO: 16577 - DNA, 20 bp, Artificial Sequence
  chemically synthesized
ctagaattagcaggcaagga

SEQ ID NO: 16578 - DNA, 20 bp, Artificial Sequence
  chemically synthesized
agcaggcaaggatggtaaaa

SEQ ID NO: 16579 - DNA, 20 bp, Artificial Sequence
  chemically synthesized
ggatggtaaaacagatatta

SEQ ID NO: 16580 - DNA, 20 bp, Artificial Sequence
  chemically synthesized
cccattatgttcaaaaaatt

SEQ ID NO: 16581 - DNA, 20 bp, Artificial Sequence
  chemically synthesized
attatgttcaaaaaattaag

SEQ ID NO: 16582 - DNA, 20 bp, Artificial Sequence
  chemically synthesized
caaaaaattaagtagaattg

SEQ ID NO: 16583 - DNA, 20 bp, Artificial Sequence
  chemically synthesized
aaaaattaagtagaattgtg

SEQ ID NO: 16584 - DNA, 20 bp, Artificial Sequence
  chemically synthesized
aaaattaagtagaattgtgg

SEQ ID NO: 16585 - DNA, 20 bp, Artificial Sequence
  chemically synthesized
tagaattgtggaggatattt

SEQ ID NO: 16586 - DNA, 20 bp, Artificial Sequence
  chemically synthesized
gaattgtggaggatatttaa

SEQ ID NO: 16587 - DNA, 20 bp, Artificial Sequence
  chemically synthesized
ggaggatatttaagagtccc

SEQ ID NO: 16588 - DNA, 20 bp, Artificial Sequence
  chemically synthesized
gaggatatttaagagtcccc

SEQ ID NO: 16589 - DNA, 20 bp, Artificial Sequence
  chemically synthesized
agagtccccaggtgaacttc

SEQ ID NO: 16590 - DNA, 20 bp, Artificial Sequence
  chemically synthesized
agtccccaggtgaacttcta

SEQ ID NO: 16591 - DNA, 20 bp, Artificial Sequence
  chemically synthesized
tctgaaatgaaaaaacacac

SEQ ID NO: 16592 - DNA, 20 bp, Artificial Sequence
  chemically synthesized
aaatgaaaaaacacactggc

SEQ ID NO: 16593 - DNA, 20 bp, Artificial Sequence
  chemically synthesized
aatgaaaaaacacactggcc

SEQ ID NO: 16594 - DNA, 20 bp, Artificial Sequence
  chemically synthesized
aacacactggccaggcgccg

SEQ ID NO: 16595 - DNA, 20 bp, Artificial Sequence
  chemically synthesized
caggcgccgtggctcacgcc

SEQ ID NO: 16596 - DNA, 20 bp, Artificial Sequence
  chemically synthesized
gtggctcacgcctggaatcc

SEQ ID NO: 16597 - DNA, 20 bp, Artificial Sequence
  chemically synthesized
cgcctggaatcccagcactg

SEQ ID NO: 16598 - DNA, 20 bp, Artificial Sequence
  chemically synthesized
gcctggaatcccagcactgt

SEQ ID NO: 16599 - DNA, 20 bp, Artificial Sequence
  chemically synthesized
ctggaatcccagcactgtgg

SEQ ID NO: 16600 - DNA, 20 bp, Artificial Sequence
  chemically synthesized
tggaatcccagcactgtggg

SEQ ID NO: 16601 - DNA, 20 bp, Artificial Sequence
  chemically synthesized
tcccagcactgtgggaggcc

SEQ ID NO: 16602 - DNA, 20 bp, Artificial Sequence
  chemically synthesized
cccagcactgtgggaggcca

SEQ ID NO: 16603 - DNA, 20 bp, Artificial Sequence
  chemically synthesized
agcactgtgggaggccaagg

SEQ ID NO: 16604 - DNA, 20 bp, Artificial Sequence
  chemically synthesized
gcactgtgggaggccaaggc

SEQ ID NO: 16605 - DNA, 20 bp, Artificial Sequence
  chemically synthesized
ctgtgggaggccaaggcggg

SEQ ID NO: 16606 - DNA, 20 bp, Artificial Sequence
  chemically synthesized
ggccaaggcgggcagatcat

SEQ ID NO: 16607 - DNA, 20 bp, Artificial Sequence
  chemically synthesized
gccaaggcgggcagatcatg

SEQ ID NO: 16608 - DNA, 20 bp, Artificial Sequence
  chemically synthesized
aggcgggcagatcatgaggt

SEQ ID NO: 16609 - DNA, 20 bp, Artificial Sequence
  chemically synthesized
ggcgggcagatcatgaggtc

SEQ ID NO: 16610 - DNA, 20 bp, Artificial Sequence
  chemically synthesized
cgggcagatcatgaggtcag

SEQ ID NO: 16611 - DNA, 20 bp, Artificial Sequence
  chemically synthesized
tcaggagatcgacaccatcc

SEQ ID NO: 16612 - DNA, 20 bp, Artificial Sequence
  chemically synthesized
cgacaccatcctggctaaca

SEQ ID NO: 16613 - DNA, 20 bp, Artificial Sequence
  chemically synthesized
ctactaaaaatacaaaaaat

SEQ ID NO: 16614 - DNA, 20 bp, Artificial Sequence
  chemically synthesized
taaaaatacaaaaaattagc

SEQ ID NO: 16615 - DNA, 20 bp, Artificial Sequence
  chemically synthesized
tacaaaaaattagccagacg

SEQ ID NO: 16616 - DNA, 20 bp, Artificial Sequence
  chemically synthesized
aaaaaattagccagacgtgg

SEQ ID NO: 16617 - DNA, 20 bp, Artificial Sequence
  chemically synthesized
aaattagccagacgtggtgg

SEQ ID NO: 16618 - DNA, 20 bp, Artificial Sequence
  chemically synthesized
aattagccagacgtggtggc

SEQ ID NO: 16619 - DNA, 20 bp, Artificial Sequence
  chemically synthesized
gacgtggtggcaggcgcctg

SEQ ID NO: 16620 - DNA, 20 bp, Artificial Sequence
  chemically synthesized
gtggcaggcgcctgtagtcc

SEQ ID NO: 16621 - DNA, 20 bp, Artificial Sequence
  chemically synthesized
cgcctgtagtcccagctact

SEQ ID NO: 16622 - DNA, 20 bp, Artificial Sequence
  chemically synthesized
gcctgtagtcccagctactc

SEQ ID NO: 16623 - DNA, 20 bp, Artificial Sequence
  chemically synthesized
ctgtagtcccagctactcgg

SEQ ID NO: 16624 - DNA, 20 bp, Artificial Sequence
  chemically synthesized
tgtagtcccagctactcggg

SEQ ID NO: 16625 - DNA, 20 bp, Artificial Sequence
  chemically synthesized
tcccagctactcgggaggct

SEQ ID NO: 16626 - DNA, 20 bp, Artificial Sequence
  chemically synthesized
cccagctactcgggaggctg

SEQ ID NO: 16627 - DNA, 20 bp, Artificial Sequence
  chemically synthesized
agctactcgggaggctgagg

SEQ ID NO: 16628 - DNA, 20 bp, Artificial Sequence
  chemically synthesized
gctactcgggaggctgaggc

SEQ ID NO: 16629 - DNA, 20 bp, Artificial Sequence
  chemically synthesized
tactcgggaggctgaggcag

SEQ ID NO: 16630 - DNA, 20 bp, Artificial Sequence
  chemically synthesized
gggaggctgaggcaggagaa

SEQ ID NO: 16631 - DNA, 20 bp, Artificial Sequence
  chemically synthesized
gcaggagaatggcatgaacc

SEQ ID NO: 16632 - DNA, 20 bp, Artificial Sequence
  chemically synthesized
caggagaatggcatgaaccc

SEQ ID NO: 16633 - DNA, 20 bp, Artificial Sequence
  chemically synthesized
ggagaatggcatgaacccgg

SEQ ID NO: 16634 - DNA, 20 bp, Artificial Sequence
  chemically synthesized
gagaatggcatgaacccggg

SEQ ID NO: 16635 - DNA, 20 bp, Artificial Sequence
  chemically synthesized
aatggcatgaacccgggagg

SEQ ID NO: 16636 - DNA, 20 bp, Artificial Sequence
  chemically synthesized
tggcatgaacccgggaggca

SEQ ID NO: 16637 - DNA, 20 bp, Artificial Sequence
  chemically synthesized
aacccgggaggcagagcttg

SEQ ID NO: 16638 - DNA, 20 bp, Artificial Sequence
  chemically synthesized
cgggaggcagagcttgcagt

SEQ ID NO: 16639 - DNA, 20 bp, Artificial Sequence
  chemically synthesized
ggcagagcttgcagtgagcc

SEQ ID NO: 16640 - DNA, 20 bp, Artificial Sequence
  chemically synthesized
aagatcgcgccactgcactc

SEQ ID NO: 16641 - DNA, 20 bp, Artificial Sequence
  chemically synthesized
cgcgccactgcactccggcc

SEQ ID NO: 16642 - DNA, 20 bp, Artificial Sequence
  chemically synthesized
gcgccactgcactccggcct

SEQ ID NO: 16643 - DNA, 20 bp, Artificial Sequence
  chemically synthesized
ctgcactccggcctgggcaa

SEQ ID NO: 16644 - DNA, 20 bp, Artificial Sequence
  chemically synthesized
gcactccggcctgggcaaca

SEQ ID NO: 16645 - DNA, 20 bp, Artificial Sequence
  chemically synthesized
tccggcctgggcaacagagc

SEQ ID NO: 16646 - DNA, 20 bp, Artificial Sequence
  chemically synthesized
ccgcctccaaaaaaaaaaaa

SEQ ID NO: 16647 - DNA, 20 bp, Artificial Sequence
  chemically synthesized
tccaaaaaaaaaaaaaagaa

SEQ ID NO: 16648 - DNA, 20 bp, Artificial Sequence
  chemically synthesized
aaaaaaaaaaaaagaaaaga

SEQ ID NO: 16649 - DNA, 20 bp, Artificial Sequence
  chemically synthesized
aaaaaaaagaaaagaaagaa

SEQ ID NO: 16650 - DNA, 20 bp, Artificial Sequence
  chemically synthesized
aaagaaaagaaaaaacacac

SEQ ID NO: 16651 - DNA, 20 bp, Artificial Sequence
  chemically synthesized
aaaagaaaaaacacactgga

SEQ ID NO: 16652 - DNA, 20 bp, Artificial Sequence
  chemically synthesized
aacacactggatggaaataa

SEQ ID NO: 16653 - DNA, 20 bp, Artificial Sequence
  chemically synthesized
acactggatggaaataatgg

SEQ ID NO: 16654 - DNA, 20 bp, Artificial Sequence
  chemically synthesized
ggatggaaataatggaagat

SEQ ID NO: 16655 - DNA, 20 bp, Artificial Sequence
  chemically synthesized
atggaagatgagaaatgcgt

SEQ ID NO: 16656 - DNA, 20 bp, Artificial Sequence
  chemically synthesized
agaaatgcgtaagaaaaatt

SEQ ID NO: 16657 - DNA, 20 bp, Artificial Sequence
  chemically synthesized
gaaatgcgtaagaaaaattt

SEQ ID NO: 16658 - DNA, 20 bp, Artificial Sequence
  chemically synthesized
aaatgcgtaagaaaaattta

SEQ ID NO: 16659 - DNA, 20 bp, Artificial Sequence
  chemically synthesized
gcgtaagaaaaatttagggc

SEQ ID NO: 16660 - DNA, 20 bp, Artificial Sequence
  chemically synthesized
cgtaagaaaaatttagggcc

SEQ ID NO: 16661 - DNA, 20 bp, Artificial Sequence
  chemically synthesized
aaatttagggccaggcactg

SEQ ID NO: 16662 - DNA, 20 bp, Artificial Sequence
  chemically synthesized
gtggatcacatctgtaatcc

SEQ ID NO: 16663 - DNA, 20 bp, Artificial Sequence
  chemically synthesized
catctgtaatcccagcactt

SEQ ID NO: 16664 - DNA, 20 bp, Artificial Sequence
  chemically synthesized
atctgtaatcccagcacttt

SEQ ID NO: 16665 - DNA, 20 bp, Artificial Sequence
  chemically synthesized
ctgtaatcccagcactttgg

SEQ ID NO: 16666 - DNA, 20 bp, Artificial Sequence
  chemically synthesized
tgtaatcccagcactttggg

SEQ ID NO: 16667 - DNA, 20 bp, Artificial Sequence
  chemically synthesized
agcactttgggaggtcgaca

SEQ ID NO: 16668 - DNA, 20 bp, Artificial Sequence
  chemically synthesized
gcactttgggaggtcgacac

SEQ ID NO: 16669 - DNA, 20 bp, Artificial Sequence
  chemically synthesized
cactttgggaggtcgacacg

SEQ ID NO: 16670 - DNA, 20 bp, Artificial Sequence
  chemically synthesized
actttgggaggtcgacacgg

SEQ ID NO: 16671 - DNA, 20 bp, Artificial Sequence
  chemically synthesized
ctttgggaggtcgacacggg

SEQ ID NO: 16672 - DNA, 20 bp, Artificial Sequence
  chemically synthesized
cgacacggggggaatcactt

SEQ ID NO: 16673 - DNA, 20 bp, Artificial Sequence
  chemically synthesized
cggggggaatcacttgagcc

SEQ ID NO: 16674 - DNA, 20 bp, Artificial Sequence
  chemically synthesized
ggggggaatcacttgagccc

SEQ ID NO: 16675 - DNA, 20 bp, Artificial Sequence
  chemically synthesized
ggggaatcacttgagcccag

SEQ ID NO: 16676 - DNA, 20 bp, Artificial Sequence
  chemically synthesized
tcacttgagcccaggagctc

SEQ ID NO: 16677 - DNA, 20 bp, Artificial Sequence
  chemically synthesized
tgagcccaggagctcaagac

SEQ ID NO: 16678 - DNA, 20 bp, Artificial Sequence
  chemically synthesized
ccaggagctcaagactagtc

SEQ ID NO: 16679 - DNA, 20 bp, Artificial Sequence
  chemically synthesized
caggagctcaagactagtct

SEQ ID NO: 16680 - DNA, 20 bp, Artificial Sequence
  chemically synthesized
gagctcaagactagtctggg

SEQ ID NO: 16681 - DNA, 20 bp, Artificial Sequence
  chemically synthesized
caagactagtctgggcagca

SEQ ID NO: 16682 - DNA, 20 bp, Artificial Sequence
  chemically synthesized
catggcaaaacccctctaca

SEQ ID NO: 16683 - DNA, 20 bp, Artificial Sequence
  chemically synthesized
tacaaaaaaaaatttttaat

SEQ ID NO: 16684 - DNA, 20 bp, Artificial Sequence
  chemically synthesized
aaaaaaaatttttaattagc

SEQ ID NO: 16685 - DNA, 20 bp, Artificial Sequence
  chemically synthesized
aaaaaaatttttaattagcc

SEQ ID NO: 16686 - DNA, 20 bp, Artificial Sequence
  chemically synthesized
aatttttaattagccaggtg

SEQ ID NO: 16687 - DNA, 20 bp, Artificial Sequence
  chemically synthesized
ggtgtggtgccacatgccta

SEQ ID NO: 16688 - DNA, 20 bp, Artificial Sequence
  chemically synthesized
gtgccacatgcctatagtcc

SEQ ID NO: 16689 - DNA, 20 bp, Artificial Sequence
  chemically synthesized
tgcctatagtcccagctacc

SEQ ID NO: 16690 - DNA, 20 bp, Artificial Sequence
  chemically synthesized
gcctatagtcccagctacct

SEQ ID NO: 16691 - DNA, 20 bp, Artificial Sequence
  chemically synthesized
ctatagtcccagctacctgg

SEQ ID NO: 16692 - DNA, 20 bp, Artificial Sequence
  chemically synthesized
tatagtcccagctacctggg

SEQ ID NO: 16693 - DNA, 20 bp, Artificial Sequence
  chemically synthesized
cccagctacctgggaggctg

SEQ ID NO: 16694 - DNA, 20 bp, Artificial Sequence
  chemically synthesized
agctacctgggaggctgaag

SEQ ID NO: 16695 - DNA, 20 bp, Artificial Sequence
  chemically synthesized
tacctgggaggctgaagtgg

SEQ ID NO: 16696 - DNA, 20 bp, Artificial Sequence
  chemically synthesized
acctgggaggctgaagtgga

SEQ ID NO: 16697 - DNA, 20 bp, Artificial Sequence
  chemically synthesized
ctgaagtggaaggatcgcct

SEQ ID NO: 16698 - DNA, 20 bp, Artificial Sequence
  chemically synthesized
gtggaaggatcgcctgagcc

SEQ ID NO: 16699 - DNA, 20 bp, Artificial Sequence
  chemically synthesized
tggaaggatcgcctgagccc

SEQ ID NO: 16700 - DNA, 20 bp, Artificial Sequence
  chemically synthesized
gaaggatcgcctgagcccag

SEQ ID NO: 16701 - DNA, 20 bp, Artificial Sequence
  chemically synthesized
aaggatcgcctgagcccagg

SEQ ID NO: 16702 - DNA, 20 bp, Artificial Sequence
  chemically synthesized
gatcgcctgagcccaggagg

SEQ ID NO: 16703 - DNA, 20 bp, Artificial Sequence
  chemically synthesized
tcgcctgagcccaggaggtg

SEQ ID NO: 16704 - DNA, 20 bp, Artificial Sequence
  chemically synthesized
cgcctgagcccaggaggtgg

SEQ ID NO: 16705 - DNA, 20 bp, Artificial Sequence
  chemically synthesized
agcccaggaggtggaggcca

SEQ ID NO: 16706 - DNA, 20 bp, Artificial Sequence
  chemically synthesized
caggaggtggaggccacagt

SEQ ID NO: 16707 - DNA, 20 bp, Artificial Sequence
  chemically synthesized
aggccacagtgagttgtgac

SEQ ID NO: 16708 - DNA, 20 bp, Artificial Sequence
  chemically synthesized
tgtgacaagctactgcattc

SEQ ID NO: 16709 - DNA, 20 bp, Artificial Sequence
  chemically synthesized
caagctactgcattccagcc

SEQ ID NO: 16710 - DNA, 20 bp, Artificial Sequence
  chemically synthesized
aagctactgcattccagcct

SEQ ID NO: 16711 - DNA, 20 bp, Artificial Sequence
  chemically synthesized
ctgcattccagcctgggcaa

SEQ ID NO: 16712 - DNA, 20 bp, Artificial Sequence
  chemically synthesized
gcattccagcctgggcaaca

SEQ ID NO: 16713 - DNA, 20 bp, Artificial Sequence
  chemically synthesized
tccagcctgggcaacagagt

SEQ ID NO: 16714 - DNA, 20 bp, Artificial Sequence
  chemically synthesized
cctgggcaacagagtgagat

SEQ ID NO: 16715 - DNA, 20 bp, Artificial Sequence
  chemically synthesized
tgggcaacagagtgagatga

SEQ ID NO: 16716 - DNA, 20 bp, Artificial Sequence
  chemically synthesized
ggcaacagagtgagatgaga

SEQ ID NO: 16717 - DNA, 20 bp, Artificial Sequence
  chemically synthesized
caacagagtgagatgagaga

SEQ ID NO: 16718 - DNA, 20 bp, Artificial Sequence
  chemically synthesized
acagagtgagatgagagaga

SEQ ID NO: 16719 - DNA, 20 bp, Artificial Sequence
  chemically synthesized
agagtgagatgagagagaga

SEQ ID NO: 16720 - DNA, 20 bp, Artificial Sequence
  chemically synthesized
gagtgagatgagagagagag

SEQ ID NO: 16721 - DNA, 20 bp, Artificial Sequence
  chemically synthesized
agtgagatgagagagagaga

SEQ ID NO: 16722 - DNA, 20 bp, Artificial Sequence
  chemically synthesized
gtgagatgagagagagagag

SEQ ID NO: 16723 - DNA, 20 bp, Artificial Sequence
  chemically synthesized
gagatgagagagagagaggg

SEQ ID NO: 16724 - DNA, 20 bp, Artificial Sequence
  chemically synthesized
agatgagagagagagagggg

SEQ ID NO: 16725 - DNA, 20 bp, Artificial Sequence
  chemically synthesized
gatgagagagagagagggga

SEQ ID NO: 16726 - DNA, 20 bp, Artificial Sequence
  chemically synthesized
atgagagagagagaggggag

SEQ ID NO: 16727 - DNA, 20 bp, Artificial Sequence
  chemically synthesized
agagagagagaggggagggg

SEQ ID NO: 16728 - DNA, 20 bp, Artificial Sequence
  chemically synthesized
agagagaggggaggggaagc

SEQ ID NO: 16729 - DNA, 20 bp, Artificial Sequence
  chemically synthesized
gagagaggggaggggaagcg

SEQ ID NO: 16730 - DNA, 20 bp, Artificial Sequence
  chemically synthesized
agagaggggaggggaagcga

SEQ ID NO: 16731 - DNA, 20 bp, Artificial Sequence
  chemically synthesized
gaggggaggggaagcgaggg

SEQ ID NO: 16732 - DNA, 20 bp, Artificial Sequence
  chemically synthesized
aggggaggggaagcgaggga

SEQ ID NO: 16733 - DNA, 20 bp, Artificial Sequence
  chemically synthesized
gaggggaagcgagggaagga

SEQ ID NO: 16734 - DNA, 20 bp, Artificial Sequence
  chemically synthesized
aggggaagcgagggaaggaa

SEQ ID NO: 16735 - DNA, 20 bp, Artificial Sequence
  chemically synthesized
gggaagcgagggaaggaaag

SEQ ID NO: 16736 - DNA, 20 bp, Artificial Sequence
  chemically synthesized
ggaagcgagggaaggaaagg

SEQ ID NO: 16737 - DNA, 20 bp, Artificial Sequence
  chemically synthesized
gaagcgagggaaggaaagga

SEQ ID NO: 16738 - DNA, 20 bp, Artificial Sequence
  chemically synthesized
aagcgagggaaggaaaggag

SEQ ID NO: 16739 - DNA, 20 bp, Artificial Sequence
  chemically synthesized
gcgagggaaggaaaggaggg

SEQ ID NO: 16740 - DNA, 20 bp, Artificial Sequence
  chemically synthesized
cgagggaaggaaaggagggg

SEQ ID NO: 16741 - DNA, 20 bp, Artificial Sequence
  chemically synthesized
gagggaaggaaaggagggga

SEQ ID NO: 16742 - DNA, 20 bp, Artificial Sequence
  chemically synthesized
agggaaggaaaggaggggag

SEQ ID NO: 16743 - DNA, 20 bp, Artificial Sequence
  chemically synthesized
ggaaggaaaggaggggaggg

SEQ ID NO: 16744 - DNA, 20 bp, Artificial Sequence
  chemically synthesized
gaaggaaaggaggggagggg

SEQ ID NO: 16745 - DNA, 20 bp, Artificial Sequence
  chemically synthesized
aaggaaaggaggggagggga

SEQ ID NO: 16746 - DNA, 20 bp, Artificial Sequence
  chemically synthesized
aggaaaggaggggaggggag

SEQ ID NO: 16747 - DNA, 20 bp, Artificial Sequence
  chemically synthesized
ggaaaggaggggaggggagg

SEQ ID NO: 16748 - DNA, 20 bp, Artificial Sequence
  chemically synthesized
aaaggaggggaggggagggg

SEQ ID NO: 16749 - DNA, 20 bp, Artificial Sequence
  chemically synthesized
aaggaggggaggggaggggg

SEQ ID NO: 16750 - DNA, 20 bp, Artificial Sequence
  chemically synthesized
aggaggggaggggaggggga

SEQ ID NO: 16751 - DNA, 20 bp, Artificial Sequence
  chemically synthesized
ggaggggaggggagggggag

SEQ ID NO: 16752 - DNA, 20 bp, Artificial Sequence
  chemically synthesized
ggggaggggagggggagggg

SEQ ID NO: 16753 - DNA, 20 bp, Artificial Sequence
  chemically synthesized
gggaggggagggggagggga

SEQ ID NO: 16754 - DNA, 20 bp, Artificial Sequence
  chemically synthesized
ggaggggagggggaggggaa

SEQ ID NO: 16755 - DNA, 20 bp, Artificial Sequence
  chemically synthesized
gaggggagggggaggggaag

SEQ ID NO: 16756 - DNA, 20 bp, Artificial Sequence
  chemically synthesized
ggaggggaaggggaaaattt

SEQ ID NO: 16757 - DNA, 20 bp, Artificial Sequence
  chemically synthesized
attttagttaacttaatgaa

SEQ ID NO: 16758 - DNA, 20 bp, Artificial Sequence
  chemically synthesized
aactctataaaatgaaacac

SEQ ID NO: 16759 - DNA, 20 bp, Artificial Sequence
  chemically synthesized
actctataaaatgaaacact

SEQ ID NO: 16760 - DNA, 20 bp, Artificial Sequence
  chemically synthesized
tctataaaatgaaacactgg

SEQ ID NO: 16761 - DNA, 20 bp, Artificial Sequence
  chemically synthesized
aatgaaacactgggagaaaa

SEQ ID NO: 16762 - DNA, 20 bp, Artificial Sequence
  chemically synthesized
gagaaaaaagaattaaaaaa

SEQ ID NO: 16763 - DNA, 20 bp, Artificial Sequence
  chemically synthesized
aaaaagaattaaaaaatgga

SEQ ID NO: 16764 - DNA, 20 bp, Artificial Sequence
  chemically synthesized
aaagaattaaaaaatggaaa

SEQ ID NO: 16765 - DNA, 20 bp, Artificial Sequence
  chemically synthesized
ttaaaaaatggaaagagaat

SEQ ID NO: 16766 - DNA, 20 bp, Artificial Sequence
  chemically synthesized
aaaatggaaagagaatgagt

SEQ ID NO: 16767 - DNA, 20 bp, Artificial Sequence
  chemically synthesized
gaaagagaatgagtgagctg

SEQ ID NO: 16768 - DNA, 20 bp, Artificial Sequence
  chemically synthesized
aaagagaatgagtgagctgt

SEQ ID NO: 16769 - DNA, 20 bp, Artificial Sequence
  chemically synthesized
tgcataattgaaatctttaa

SEQ ID NO: 16770 - DNA, 20 bp, Artificial Sequence
  chemically synthesized
attgaaatctttaaaagaaa

SEQ ID NO: 16771 - DNA, 20 bp, Artificial Sequence
  chemically synthesized
ttgaaatctttaaaagaaaa

SEQ ID NO: 16772 - DNA, 20 bp, Artificial Sequence
  chemically synthesized
tgaaatctttaaaagaaaaa

SEQ ID NO: 16773 - DNA, 20 bp, Artificial Sequence
  chemically synthesized
gaaatctttaaaagaaaaag

SEQ ID NO: 16774 - DNA, 20 bp, Artificial Sequence
  chemically synthesized
aaatctttaaaagaaaaagg

SEQ ID NO: 16775 - DNA, 20 bp, Artificial Sequence
  chemically synthesized
tctttaaaagaaaaaggggg

SEQ ID NO: 16776 - DNA, 20 bp, Artificial Sequence
  chemically synthesized
ttaaaagaaaaagggggtag

SEQ ID NO: 16777 - DNA, 20 bp, Artificial Sequence
  chemically synthesized
gggggtagcagaaaaaaatc

SEQ ID NO: 16778 - DNA, 20 bp, Artificial Sequence
  chemically synthesized
gcagaaaaaaatcaagtgct

SEQ ID NO: 16779 - DNA, 20 bp, Artificial Sequence
  chemically synthesized
aaaaaatcaagtgctgagac

SEQ ID NO: 16780 - DNA, 20 bp, Artificial Sequence
  chemically synthesized
aaatcaagtgctgagacaag

SEQ ID NO: 16781 - DNA, 20 bp, Artificial Sequence
  chemically synthesized
tcaagtgctgagacaagtgg

SEQ ID NO: 16782 - DNA, 20 bp, Artificial Sequence
  chemically synthesized
gtgctgagacaagtggaaga

SEQ ID NO: 16783 - DNA, 20 bp, Artificial Sequence
  chemically synthesized
tgctgagacaagtggaagat

SEQ ID NO: 16784 - DNA, 20 bp, Artificial Sequence
  chemically synthesized
gacaagtggaagatgggccc

SEQ ID NO: 16785 - DNA, 20 bp, Artificial Sequence
  chemically synthesized
agtggaagatgggccccggt

SEQ ID NO: 16786 - DNA, 20 bp, Artificial Sequence
  chemically synthesized
ggaagatgggccccggtgag

SEQ ID NO: 16787 - DNA, 20 bp, Artificial Sequence
  chemically synthesized
ggccccggtgagcagctgat

SEQ ID NO: 16788 - DNA, 20 bp, Artificial Sequence
  chemically synthesized
ggtgagcagctgatcagtgt

SEQ ID NO: 16789 - DNA, 20 bp, Artificial Sequence
  chemically synthesized
ctcccatgatgacgttcccc

SEQ ID NO: 16790 - DNA, 20 bp, Artificial Sequence
  chemically synthesized
ttcccccagcccccaccacc

SEQ ID NO: 16791 - DNA, 20 bp, Artificial Sequence
  chemically synthesized
tcccccagcccccaccaccc

SEQ ID NO: 16792 - DNA, 20 bp, Artificial Sequence
  chemically synthesized
gcccccaccacccgggctgc

SEQ ID NO: 16793 - DNA, 20 bp, Artificial Sequence
  chemically synthesized
ccccaccacccgggctgctg

SEQ ID NO: 16794 - DNA, 20 bp, Artificial Sequence
  chemically synthesized
cccaccacccgggctgctgg

SEQ ID NO: 16795 - DNA, 20 bp, Artificial Sequence
  chemically synthesized
ccaccacccgggctgctgga

SEQ ID NO: 16796 - DNA, 20 bp, Artificial Sequence
  chemically synthesized
cgggctgctggagggaaatg

SEQ ID NO: 16797 - DNA, 20 bp, Artificial Sequence
  chemically synthesized
gtgactttgctacatccctt

SEQ ID NO: 16798 - DNA, 20 bp, Artificial Sequence
  chemically synthesized
ctttgctacatcccttcaga

SEQ ID NO: 16799 - DNA, 20 bp, Artificial Sequence
  chemically synthesized
cccttcagacggtccctcac

SEQ ID NO: 16800 - DNA, 20 bp, Artificial Sequence
  chemically synthesized
ggtccctcactggtgtccct

SEQ ID NO: 16801 - DNA, 20 bp, Artificial Sequence
  chemically synthesized
gtccctcagcccattcgcgt

SEQ ID NO: 16802 - DNA, 20 bp, Artificial Sequence
  chemically synthesized
gctcactctcccattaattt

SEQ ID NO: 16803 - DNA, 20 bp, Artificial Sequence
  chemically synthesized
cccattaatttcagaaatcc

SEQ ID NO: 16804 - DNA, 20 bp, Artificial Sequence
  chemically synthesized
agaaatcctggcctctctcc

SEQ ID NO: 16805 - DNA, 20 bp, Artificial Sequence
  chemically synthesized
actctaaattctgtcaccct

SEQ ID NO: 16806 - DNA, 20 bp, Artificial Sequence
  chemically synthesized
ctaaattctgtcaccctcag

SEQ ID NO: 16807 - DNA, 20 bp, Artificial Sequence
  chemically synthesized
tctgtcaccctcagaagatt

SEQ ID NO: 16808 - DNA, 20 bp, Artificial Sequence
  chemically synthesized
gtcaccctcagaagattcag

SEQ ID NO: 16809 - DNA, 20 bp, Artificial Sequence
  chemically synthesized
cagcatcccgtattctctct

SEQ ID NO: 16810 - DNA, 20 bp, Artificial Sequence
  chemically synthesized
tctgagtgttcactatgtac

SEQ ID NO: 16811 - DNA, 20 bp, Artificial Sequence
  chemically synthesized
ctgagtgttcactatgtacc

SEQ ID NO: 16812 - DNA, 20 bp, Artificial Sequence
  chemically synthesized
actatgtaccgggtgccgtg

SEQ ID NO: 16813 - DNA, 20 bp, Artificial Sequence
  chemically synthesized
ctatgtaccgggtgccgtgt

SEQ ID NO: 16814 - DNA, 20 bp, Artificial Sequence
  chemically synthesized
accgggtgccgtgtgggcac

SEQ ID NO: 16815 - DNA, 20 bp, Artificial Sequence
  chemically synthesized
cgggtgccgtgtgggcactg

SEQ ID NO: 16816 - DNA, 20 bp, Artificial Sequence
  chemically synthesized
ccgtgtgggcactggagttg

SEQ ID NO: 16817 - DNA, 20 bp, Artificial Sequence
  chemically synthesized
gtgtgggcactggagttgca

SEQ ID NO: 16818 - DNA, 20 bp, Artificial Sequence
  chemically synthesized
tgtgggcactggagttgcag

SEQ ID NO: 16819 - DNA, 20 bp, Artificial Sequence
  chemically synthesized
tgggcactggagttgcagag

SEQ ID NO: 16820 - DNA, 20 bp, Artificial Sequence
  chemically synthesized
ggcactggagttgcagagga

SEQ ID NO: 16821 - DNA, 20 bp, Artificial Sequence
  chemically synthesized
ctggagttgcagaggagagt

SEQ ID NO: 16822 - DNA, 20 bp, Artificial Sequence
  chemically synthesized
tggagttgcagaggagagtg

SEQ ID NO: 16823 - DNA, 20 bp, Artificial Sequence
  chemically synthesized
agttgcagaggagagtgagg

SEQ ID NO: 16824 - DNA, 20 bp, Artificial Sequence
  chemically synthesized
gcagaggagagtgaggcgga

SEQ ID NO: 16825 - DNA, 20 bp, Artificial Sequence
  chemically synthesized
cagaggagagtgaggcggac

SEQ ID NO: 16826 - DNA, 20 bp, Artificial Sequence
  chemically synthesized
agaggagagtgaggcggaca

SEQ ID NO: 16827 - DNA, 20 bp, Artificial Sequence
  chemically synthesized
gcggacagggcctctgcctg

SEQ ID NO: 16828 - DNA, 20 bp, Artificial Sequence
  chemically synthesized
cggacagggcctctgcctgt

SEQ ID NO: 16829 - DNA, 20 bp, Artificial Sequence
  chemically synthesized
ggacagggcctctgcctgtg

SEQ ID NO: 16830 - DNA, 20 bp, Artificial Sequence
  chemically synthesized
ctgcctgtggggacaccgcc

SEQ ID NO: 16831 - DNA, 20 bp, Artificial Sequence
  chemically synthesized
cctgtggggacaccgcctgg

SEQ ID NO: 16832 - DNA, 20 bp, Artificial Sequence
  chemically synthesized
ctgtggggacaccgcctggt

SEQ ID NO: 16833 - DNA, 20 bp, Artificial Sequence
  chemically synthesized
tggggacaccgcctggtggg

SEQ ID NO: 16834 - DNA, 20 bp, Artificial Sequence
  chemically synthesized
acaccgcctggtgggaagtc

SEQ ID NO: 16835 - DNA, 20 bp, Artificial Sequence
  chemically synthesized
cgcctggtgggaagtccagc

SEQ ID NO: 16836 - DNA, 20 bp, Artificial Sequence
  chemically synthesized
gaagtccagccagcccccta

SEQ ID NO: 16837 - DNA, 20 bp, Artificial Sequence
  chemically synthesized
agtccagccagccccctaca

SEQ ID NO: 16838 - DNA, 20 bp, Artificial Sequence
  chemically synthesized
tccagccagccccctacaga

SEQ ID NO: 16839 - DNA, 20 bp, Artificial Sequence
  chemically synthesized
cagccagccccctacagaga

SEQ ID NO: 16840 - DNA, 20 bp, Artificial Sequence
  chemically synthesized
agccagccccctacagagag

SEQ ID NO: 16841 - DNA, 20 bp, Artificial Sequence
  chemically synthesized
ccagccccctacagagagag

SEQ ID NO: 16842 - DNA, 20 bp, Artificial Sequence
  chemically synthesized
acagagagaggagatgctac

SEQ ID NO: 16843 - DNA, 20 bp, Artificial Sequence
  chemically synthesized
gagatgctactggtgttcct

SEQ ID NO: 16844 - DNA, 20 bp, Artificial Sequence
  chemically synthesized
atgctactggtgttcctgag

SEQ ID NO: 16845 - DNA, 20 bp, Artificial Sequence
  chemically synthesized
tggtgttcctgagtggtcct

SEQ ID NO: 16846 - DNA, 20 bp, Artificial Sequence
  chemically synthesized
ggtgttcctgagtggtcctc

SEQ ID NO: 16847 - DNA, 20 bp, Artificial Sequence
  chemically synthesized
tgttcctgagtggtcctcgg

SEQ ID NO: 16848 - DNA, 20 bp, Artificial Sequence
  chemically synthesized
gttcctgagtggtcctcggg

SEQ ID NO: 16849 - DNA, 20 bp, Artificial Sequence
  chemically synthesized
ttcctgagtggtcctcggga

SEQ ID NO: 16850 - DNA, 20 bp, Artificial Sequence
  chemically synthesized
gtcccctgccctgccctgcc

SEQ ID NO: 16851 - DNA, 20 bp, Artificial Sequence
  chemically synthesized
tgccctgccctgcccagcac

SEQ ID NO: 16852 - DNA, 20 bp, Artificial Sequence
  chemically synthesized
gcccagcaccggccctccct

SEQ ID NO: 16853 - DNA, 20 bp, Artificial Sequence
  chemically synthesized
agcaccggccctccctcggt

SEQ ID NO: 16854 - DNA, 20 bp, Artificial Sequence
  chemically synthesized
ccggccctccctcggttggc

SEQ ID NO: 16855 - DNA, 20 bp, Artificial Sequence
  chemically synthesized
ctccctcggttggccagcct

SEQ ID NO: 16856 - DNA, 20 bp, Artificial Sequence
  chemically synthesized
tccctcggttggccagcctc

SEQ ID NO: 16857 - DNA, 20 bp, Artificial Sequence
  chemically synthesized
ggttggccagcctcaggaat

SEQ ID NO: 16858 - DNA, 20 bp, Artificial Sequence
  chemically synthesized
gttggccagcctcaggaatg

SEQ ID NO: 16859 - DNA, 20 bp, Artificial Sequence
  chemically synthesized
tggccagcctcaggaatgag

SEQ ID NO: 16860 - DNA, 20 bp, Artificial Sequence
  chemically synthesized
gaatgaggagtccctcattc

SEQ ID NO: 16861 - DNA, 20 bp, Artificial Sequence
  chemically synthesized
aggagtccctcattccagcc

SEQ ID NO: 16862 - DNA, 20 bp, Artificial Sequence
  chemically synthesized
agctaaccaatccccttcct

SEQ ID NO: 16863 - DNA, 20 bp, Artificial Sequence
  chemically synthesized
caatccccttcctaagctcc

SEQ ID NO: 16864 - DNA, 20 bp, Artificial Sequence
  chemically synthesized
ccctgctcctcctgcctcca

SEQ ID NO: 16865 - DNA, 20 bp, Artificial Sequence
  chemically synthesized
cctcctgcctccatggaacc

SEQ ID NO: 16866 - DNA, 20 bp, Artificial Sequence
  chemically synthesized
atggaacccggctccaccac

SEQ ID NO: 16867 - DNA, 20 bp, Artificial Sequence
  chemically synthesized
acctgacactcctccattcc

SEQ ID NO: 16868 - DNA, 20 bp, Artificial Sequence
  chemically synthesized
ctggctcttgcccttctgcc

SEQ ID NO: 16869 - DNA, 20 bp, Artificial Sequence
  chemically synthesized
cccttctgcctagcactgct

SEQ ID NO: 16870 - DNA, 20 bp, Artificial Sequence
  chemically synthesized
accttaaaatcttttcccac

SEQ ID NO: 16871 - DNA, 20 bp, Artificial Sequence
  chemically synthesized
aaaatcttttcccaccagcc

SEQ ID NO: 16872 - DNA, 20 bp, Artificial Sequence
  chemically synthesized
aaatcttttcccaccagcct

SEQ ID NO: 16873 - DNA, 20 bp, Artificial Sequence
  chemically synthesized
tcccaccagcctgggcaaca

SEQ ID NO: 16874 - DNA, 20 bp, Artificial Sequence
  chemically synthesized
accagcctgggcaacatagc

SEQ ID NO: 16875 - DNA, 20 bp, Artificial Sequence
  chemically synthesized
aaaaattttttttaatttgc

SEQ ID NO: 16876 - DNA, 20 bp, Artificial Sequence
  chemically synthesized
aaaattttttttaatttgcc

SEQ ID NO: 16877 - DNA, 20 bp, Artificial Sequence
  chemically synthesized
tttttttaatttgccaggca

SEQ ID NO: 16878 - DNA, 20 bp, Artificial Sequence
  chemically synthesized
ttttaatttgccaggcacag

SEQ ID NO: 16879 - DNA, 20 bp, Artificial Sequence
  chemically synthesized
gcacagtggtgcacacctgt

SEQ ID NO: 16880 - DNA, 20 bp, Artificial Sequence
  chemically synthesized
acctgtaagtcctaactact

SEQ ID NO: 16881 - DNA, 20 bp, Artificial Sequence
  chemically synthesized
cctgtaagtcctaactactt

SEQ ID NO: 16882 - DNA, 20 bp, Artificial Sequence
  chemically synthesized
tgtaagtcctaactacttgg

SEQ ID NO: 16883 - DNA, 20 bp, Artificial Sequence
  chemically synthesized
gtaagtcctaactacttggg

SEQ ID NO: 16884 - DNA, 20 bp, Artificial Sequence
  chemically synthesized
tcctaactacttgggaggct

SEQ ID NO: 16885 - DNA, 20 bp, Artificial Sequence
  chemically synthesized
cctaactacttgggaggctg

SEQ ID NO: 16886 - DNA, 20 bp, Artificial Sequence
  chemically synthesized
aactacttgggaggctgagg

SEQ ID NO: 16887 - DNA, 20 bp, Artificial Sequence
  chemically synthesized
actacttgggaggctgaggt

SEQ ID NO: 16888 - DNA, 20 bp, Artificial Sequence
  chemically synthesized
tacttgggaggctgaggtgg

SEQ ID NO: 16889 - DNA, 20 bp, Artificial Sequence
  chemically synthesized
acttgggaggctgaggtggg

SEQ ID NO: 16890 - DNA, 20 bp, Artificial Sequence
  chemically synthesized
gggaggctgaggtgggagga

SEQ ID NO: 16891 - DNA, 20 bp, Artificial Sequence
  chemically synthesized
ctgaggtgggaggatggctt

SEQ ID NO: 16892 - DNA, 20 bp, Artificial Sequence
  chemically synthesized
gtgggaggatggcttgagcc

SEQ ID NO: 16893 - DNA, 20 bp, Artificial Sequence
  chemically synthesized
tgggaggatggcttgagccc

SEQ ID NO: 16894 - DNA, 20 bp, Artificial Sequence
  chemically synthesized
ggaggatggcttgagcccag

SEQ ID NO: 16895 - DNA, 20 bp, Artificial Sequence
  chemically synthesized
tggcttgagcccaggagttc

SEQ ID NO: 16896 - DNA, 20 bp, Artificial Sequence
  chemically synthesized
ggcttgagcccaggagttcg

SEQ ID NO: 16897 - DNA, 20 bp, Artificial Sequence
  chemically synthesized
agcccaggagttcgaggttg

SEQ ID NO: 16898 - DNA, 20 bp, Artificial Sequence
  chemically synthesized
caggagttcgaggttgcagt

SEQ ID NO: 16899 - DNA, 20 bp, Artificial Sequence
  chemically synthesized
tctctaaaaaaaaaatgtcc

SEQ ID NO: 16900 - DNA, 20 bp, Artificial Sequence
  chemically synthesized
aaaaaaatgtccaagatact

SEQ ID NO: 16901 - DNA, 20 bp, Artificial Sequence
  chemically synthesized
aaaaaatgtccaagatactt

SEQ ID NO: 16902 - DNA, 20 bp, Artificial Sequence
  chemically synthesized
tccaagatacttaggtcctt

SEQ ID NO: 16903 - DNA, 20 bp, Artificial Sequence
  chemically synthesized
gatacttaggtccttcagtc

SEQ ID NO: 16904 - DNA, 20 bp, Artificial Sequence
  chemically synthesized
ccttcagtcaagatttatta

SEQ ID NO: 16905 - DNA, 20 bp, Artificial Sequence
  chemically synthesized
tcagtcaagatttattacag

SEQ ID NO: 16906 - DNA, 20 bp, Artificial Sequence
  chemically synthesized
cagtcaagatttattacaga

SEQ ID NO: 16907 - DNA, 20 bp, Artificial Sequence
  chemically synthesized
agatttattacagaaggatc

SEQ ID NO: 16908 - DNA, 20 bp, Artificial Sequence
  chemically synthesized
gatttattacagaaggatcc

SEQ ID NO: 16909 - DNA, 20 bp, Artificial Sequence
  chemically synthesized
atttattacagaaggatcca

SEQ ID NO: 16910 - DNA, 20 bp, Artificial Sequence
  chemically synthesized
tattacagaaggatccaggg

SEQ ID NO: 16911 - DNA, 20 bp, Artificial Sequence
  chemically synthesized
attacagaaggatccaggga

SEQ ID NO: 16912 - DNA, 20 bp, Artificial Sequence
  chemically synthesized
ttacagaaggatccagggaa

SEQ ID NO: 16913 - DNA, 20 bp, Artificial Sequence
  chemically synthesized
aaggatccagggaagggtct

SEQ ID NO: 16914 - DNA, 20 bp, Artificial Sequence
  chemically synthesized
aggatccagggaagggtctt

SEQ ID NO: 16915 - DNA, 20 bp, Artificial Sequence
  chemically synthesized
gatccagggaagggtcttgg

SEQ ID NO: 16916 - DNA, 20 bp, Artificial Sequence
  chemically synthesized
agggaagggtcttgggagat

SEQ ID NO: 16917 - DNA, 20 bp, Artificial Sequence
  chemically synthesized
ggaagggtcttgggagatga

SEQ ID NO: 16918 - DNA, 20 bp, Artificial Sequence
  chemically synthesized
gaagggtcttgggagatgag

SEQ ID NO: 16919 - DNA, 20 bp, Artificial Sequence
  chemically synthesized
agggtcttgggagatgagag

SEQ ID NO: 16920 - DNA, 20 bp, Artificial Sequence
  chemically synthesized
gtcttgggagatgagaggag

SEQ ID NO: 16921 - DNA, 20 bp, Artificial Sequence
  chemically synthesized
tcttgggagatgagaggagc

SEQ ID NO: 16922 - DNA, 20 bp, Artificial Sequence
  chemically synthesized
cttgggagatgagaggagca

SEQ ID NO: 16923 - DNA, 20 bp, Artificial Sequence
  chemically synthesized
tgagaggagcagggatcttc

SEQ ID NO: 16924 - DNA, 20 bp, Artificial Sequence
  chemically synthesized
gagaggagcagggatcttcc

SEQ ID NO: 16925 - DNA, 20 bp, Artificial Sequence
  chemically synthesized
cacaacatacacacatgcac

SEQ ID NO: 16926 - DNA, 20 bp, Artificial Sequence
  chemically synthesized
cacaacatacactcacacac

SEQ ID NO: 16927 - DNA, 20 bp, Artificial Sequence
  chemically synthesized
cattcactcacacacacaca

SEQ ID NO: 16928 - DNA, 20 bp, Artificial Sequence
  chemically synthesized
ttcactcacacacacacaca

SEQ ID NO: 16929 - DNA, 20 bp, Artificial Sequence
  chemically synthesized
cacacacacacacagagtcc

SEQ ID NO: 16930 - DNA, 20 bp, Artificial Sequence
  chemically synthesized
atacgtgcacacgcacatac

SEQ ID NO: 16931 - DNA, 20 bp, Artificial Sequence
  chemically synthesized
tacgtgcacacgcacatacg

SEQ ID NO: 16932 - DNA, 20 bp, Artificial Sequence
  chemically synthesized
atacgaggcacatgtgttct

SEQ ID NO: 16933 - DNA, 20 bp, Artificial Sequence
  chemically synthesized
tacgaggcacatgtgttctt

SEQ ID NO: 16934 - DNA, 20 bp, Artificial Sequence
  chemically synthesized
aggcacatgtgttcttgggt

SEQ ID NO: 16935 - DNA, 20 bp, Artificial Sequence
  chemically synthesized
ggcacatgtgttcttgggtt

SEQ ID NO: 16936 - DNA, 20 bp, Artificial Sequence
  chemically synthesized
cacatgtgttcttgggttgg

SEQ ID NO: 16937 - DNA, 20 bp, Artificial Sequence
  chemically synthesized
acatgtgttcttgggttggg

SEQ ID NO: 16938 - DNA, 20 bp, Artificial Sequence
  chemically synthesized
atgtgttcttgggttgggag

SEQ ID NO: 16939 - DNA, 20 bp, Artificial Sequence
  chemically synthesized
tgttcttgggttgggaggag

SEQ ID NO: 16940 - DNA, 20 bp, Artificial Sequence
  chemically synthesized
gttcttgggttgggaggaga

SEQ ID NO: 16941 - DNA, 20 bp, Artificial Sequence
  chemically synthesized
ttcttgggttgggaggagaa

SEQ ID NO: 16942 - DNA, 20 bp, Artificial Sequence
  chemically synthesized
ttgggttgggaggagaaggg

SEQ ID NO: 16943 - DNA, 20 bp, Artificial Sequence
  chemically synthesized
tgggttgggaggagaagggc

SEQ ID NO: 16944 - DNA, 20 bp, Artificial Sequence
  chemically synthesized
gttgggaggagaagggcagg

SEQ ID NO: 16945 - DNA, 20 bp, Artificial Sequence
  chemically synthesized
aagggcaggcagttatcttc

SEQ ID NO: 16946 - DNA, 20 bp, Artificial Sequence
  chemically synthesized
tccagatctccccacacctc

SEQ ID NO: 16947 - DNA, 20 bp, Artificial Sequence
  chemically synthesized
cctctggcacatgcctttcc

SEQ ID NO: 16948 - DNA, 20 bp, Artificial Sequence
  chemically synthesized
ctctggcacatgcctttcct

SEQ ID NO: 16949 - DNA, 20 bp, Artificial Sequence
  chemically synthesized
tctggcacatgcctttcctg

SEQ ID NO: 16950 - DNA, 20 bp, Artificial Sequence
  chemically synthesized
acatgcctttcctggggtcc

SEQ ID NO: 16951 - DNA, 20 bp, Artificial Sequence
  chemically synthesized
catgcctttcctggggtcct

SEQ ID NO: 16952 - DNA, 20 bp, Artificial Sequence
  chemically synthesized
atgcctttcctggggtcctg

SEQ ID NO: 16953 - DNA, 20 bp, Artificial Sequence
  chemically synthesized
cctttcctggggtcctgggg

SEQ ID NO: 16954 - DNA, 20 bp, Artificial Sequence
  chemically synthesized
tcctggggtcctggggtaga

SEQ ID NO: 16955 - DNA, 20 bp, Artificial Sequence
  chemically synthesized
cctggggtcctggggtagac

SEQ ID NO: 16956 - DNA, 20 bp, Artificial Sequence
  chemically synthesized
ggggtcctggggtagacagg

SEQ ID NO: 16957 - DNA, 20 bp, Artificial Sequence
  chemically synthesized
gggtcctggggtagacagga

SEQ ID NO: 16958 - DNA, 20 bp, Artificial Sequence
  chemically synthesized
cctggggtagacaggaaggt

SEQ ID NO: 16959 - DNA, 20 bp, Artificial Sequence
  chemically synthesized
ctggggtagacaggaaggtg

SEQ ID NO: 16960 - DNA, 20 bp, Artificial Sequence
  chemically synthesized
ggtagacaggaaggtgaggt

SEQ ID NO: 16961 - DNA, 20 bp, Artificial Sequence
  chemically synthesized
gtagacaggaaggtgaggtg

SEQ ID NO: 16962 - DNA, 20 bp, Artificial Sequence
  chemically synthesized
tagacaggaaggtgaggtga

SEQ ID NO: 16963 - DNA, 20 bp, Artificial Sequence
  chemically synthesized
ggaaggtgaggtgagggaac

SEQ ID NO: 16964 - DNA, 20 bp, Artificial Sequence
  chemically synthesized
aggtgaggtgagggaacaag

SEQ ID NO: 16965 - DNA, 20 bp, Artificial Sequence
  chemically synthesized
ggtgaggtgagggaacaagc

SEQ ID NO: 16966 - DNA, 20 bp, Artificial Sequence
  chemically synthesized
gtgaggtgagggaacaagcg

SEQ ID NO: 16967 - DNA, 20 bp, Artificial Sequence
  chemically synthesized
tgaggtgagggaacaagcgg

SEQ ID NO: 16968 - DNA, 20 bp, Artificial Sequence
  chemically synthesized
gagggaacaagcgggggtgt

SEQ ID NO: 16969 - DNA, 20 bp, Artificial Sequence
  chemically synthesized
agggaacaagcgggggtgtc

SEQ ID NO: 16970 - DNA, 20 bp, Artificial Sequence
  chemically synthesized
cgggggtgtcgggccctcct

SEQ ID NO: 16971 - DNA, 20 bp, Artificial Sequence
  chemically synthesized
ccctcctcagtccctgttca

SEQ ID NO: 16972 - DNA, 20 bp, Artificial Sequence
  chemically synthesized
ctcctcagtccctgttcaca

SEQ ID NO: 16973 - DNA, 20 bp, Artificial Sequence
  chemically synthesized
ctcagtccctgttcacagag

SEQ ID NO: 16974 - DNA, 20 bp, Artificial Sequence
  chemically synthesized
tcagtccctgttcacagagt

SEQ ID NO: 16975 - DNA, 20 bp, Artificial Sequence
  chemically synthesized
ccctgttcacagagtgggtg

SEQ ID NO: 16976 - DNA, 20 bp, Artificial Sequence
  chemically synthesized
tgttcacagagtgggtgcgg

SEQ ID NO: 16977 - DNA, 20 bp, Artificial Sequence
  chemically synthesized
ttcacagagtgggtgcggca

SEQ ID NO: 16978 - DNA, 20 bp, Artificial Sequence
  chemically synthesized
tgggtgcggcagagacctca

SEQ ID NO: 16979 - DNA, 20 bp, Artificial Sequence
  chemically synthesized
gggtgcggcagagacctcaa

SEQ ID NO: 16980 - DNA, 20 bp, Artificial Sequence
  chemically synthesized
ggtgcggcagagacctcaaa

SEQ ID NO: 16981 - DNA, 20 bp, Artificial Sequence
  chemically synthesized
cggcagagacctcaaaggga

SEQ ID NO: 16982 - DNA, 20 bp, Artificial Sequence
  chemically synthesized
gcagagacctcaaagggaca

SEQ ID NO: 16983 - DNA, 20 bp, Artificial Sequence
  chemically synthesized
caaagggacagagcaatcat

SEQ ID NO: 16984 - DNA, 20 bp, Artificial Sequence
  chemically synthesized
ggacagagcaatcatgagct

SEQ ID NO: 16985 - DNA, 20 bp, Artificial Sequence
  chemically synthesized
agagcaatcatgagctgaga

SEQ ID NO: 16986 - DNA, 20 bp, Artificial Sequence
  chemically synthesized
agcaatcatgagctgagaca

SEQ ID NO: 16987 - DNA, 20 bp, Artificial Sequence
  chemically synthesized
gcaatcatgagctgagacag

SEQ ID NO: 16988 - DNA, 20 bp, Artificial Sequence
  chemically synthesized
caatcatgagctgagacaga

SEQ ID NO: 16989 - DNA, 20 bp, Artificial Sequence
  chemically synthesized
aatcatgagctgagacagag

SEQ ID NO: 16990 - DNA, 20 bp, Artificial Sequence
  chemically synthesized
atcatgagctgagacagagg

SEQ ID NO: 16991 - DNA, 20 bp, Artificial Sequence
  chemically synthesized
catgagctgagacagagggg

SEQ ID NO: 16992 - DNA, 20 bp, Artificial Sequence
  chemically synthesized
gctgagacagagggggagca

SEQ ID NO: 16993 - DNA, 20 bp, Artificial Sequence
  chemically synthesized
acagagggggagcaaagccg

SEQ ID NO: 16994 - DNA, 20 bp, Artificial Sequence
  chemically synthesized
gcacacttgcctttcaaaaa

SEQ ID NO: 16995 - DNA, 20 bp, Artificial Sequence
  chemically synthesized
caaaaatggatttcctctcc

SEQ ID NO: 16996 - DNA, 20 bp, Artificial Sequence
  chemically synthesized
aaaaatggatttcctctcct

SEQ ID NO: 16997 - DNA, 20 bp, Artificial Sequence
  chemically synthesized
ggatttcctctcctgggatt

SEQ ID NO: 16998 - DNA, 20 bp, Artificial Sequence
  chemically synthesized
tctcctgggattcagcctgc

SEQ ID NO: 16999 - DNA, 20 bp, Artificial Sequence
  chemically synthesized
ggattcagcctgcgagtgcc

SEQ ID NO: 17000 - DNA, 20 bp, Artificial Sequence
  chemically synthesized
tgcctggcccctcaccttga

SEQ ID NO: 17001 - DNA, 20 bp, Artificial Sequence
  chemically synthesized
tggcccctcaccttgatgga

SEQ ID NO: 17002 - DNA, 20 bp, Artificial Sequence
  chemically synthesized
ggcccctcaccttgatggaa

SEQ ID NO: 17003 - DNA, 20 bp, Artificial Sequence
  chemically synthesized
cctcaccttgatggaaagga

SEQ ID NO: 17004 - DNA, 20 bp, Artificial Sequence
  chemically synthesized
aaggatggtcattttcctcc

SEQ ID NO: 17005 - DNA, 20 bp, Artificial Sequence
  chemically synthesized
tggtcattttcctccgagct

SEQ ID NO: 17006 - DNA, 20 bp, Artificial Sequence
  chemically synthesized
tttcctccgagctcagctgc

SEQ ID NO: 17007 - DNA, 20 bp, Artificial Sequence
  chemically synthesized
tcagctgctggatatcttga

SEQ ID NO: 17008 - DNA, 20 bp, Artificial Sequence
  chemically synthesized
ctggatatcttgaaagtcct

SEQ ID NO: 17009 - DNA, 20 bp, Artificial Sequence
  chemically synthesized
ttgaaagtccttggccatga

SEQ ID NO: 17010 - DNA, 20 bp, Artificial Sequence
  chemically synthesized
tgaaagtccttggccatgat

SEQ ID NO: 17011 - DNA, 20 bp, Artificial Sequence
  chemically synthesized
gaaagtccttggccatgatg

SEQ ID NO: 17012 - DNA, 20 bp, Artificial Sequence
  chemically synthesized
tccttggccatgatggggcc

SEQ ID NO: 17013 - DNA, 20 bp, Artificial Sequence
  chemically synthesized
ccttggccatgatggggccc

SEQ ID NO: 17014 - DNA, 20 bp, Artificial Sequence
  chemically synthesized
ggccatgatggggcccgggc

SEQ ID NO: 17015 - DNA, 20 bp, Artificial Sequence
  chemically synthesized
ccatgatggggcccgggctg

SEQ ID NO: 17016 - DNA, 20 bp, Artificial Sequence
  chemically synthesized
gatggggcccgggctggagc

SEQ ID NO: 17017 - DNA, 20 bp, Artificial Sequence
  chemically synthesized
tggggcccgggctggagctg

SEQ ID NO: 17018 - DNA, 20 bp, Artificial Sequence
  chemically synthesized
gcccgggctggagctggagc

SEQ ID NO: 17019 - DNA, 20 bp, Artificial Sequence
  chemically synthesized
ccgggctggagctggagctg

SEQ ID NO: 17020 - DNA, 20 bp, Artificial Sequence
  chemically synthesized
gctggagctggagctggagc

SEQ ID NO: 17021 - DNA, 20 bp, Artificial Sequence
  chemically synthesized
ctggagctggagctggagct

SEQ ID NO: 17022 - DNA, 20 bp, Artificial Sequence
  chemically synthesized
agctggagctggagctgggc

SEQ ID NO: 17023 - DNA, 20 bp, Artificial Sequence
  chemically synthesized
gctggagctggagctgggct

SEQ ID NO: 17024 - DNA, 20 bp, Artificial Sequence
  chemically synthesized
gagctggagctgggctgggc

SEQ ID NO: 17025 - DNA, 20 bp, Artificial Sequence
  chemically synthesized
agctggagctgggctgggct

SEQ ID NO: 17026 - DNA, 20 bp, Artificial Sequence
  chemically synthesized
gagctgggctgggctgggct

SEQ ID NO: 17027 - DNA, 20 bp, Artificial Sequence
  chemically synthesized
agctgggctgggctgggctg

SEQ ID NO: 17028 - DNA, 20 bp, Artificial Sequence
  chemically synthesized
ggctgggctgaggttgctct

SEQ ID NO: 17029 - DNA, 20 bp, Artificial Sequence
  chemically synthesized
gctgggctgaggttgctctg

SEQ ID NO: 17030 - DNA, 20 bp, Artificial Sequence
  chemically synthesized
ctgggctgaggttgctctga

SEQ ID NO: 17031 - DNA, 20 bp, Artificial Sequence
  chemically synthesized
gctgaggttgctctgagggc

SEQ ID NO: 17032 - DNA, 20 bp, Artificial Sequence
  chemically synthesized
ctgaggttgctctgagggct

SEQ ID NO: 17033 - DNA, 20 bp, Artificial Sequence
  chemically synthesized
tgaggttgctctgagggctg

SEQ ID NO: 17034 - DNA, 20 bp, Artificial Sequence
  chemically synthesized
gttgctctgagggctggggc

SEQ ID NO: 17035 - DNA, 20 bp, Artificial Sequence
  chemically synthesized
ttgctctgagggctggggct

SEQ ID NO: 17036 - DNA, 20 bp, Artificial Sequence
  chemically synthesized
tgctctgagggctggggctg

SEQ ID NO: 17037 - DNA, 20 bp, Artificial Sequence
  chemically synthesized
tctgagggctggggctgggg

SEQ ID NO: 17038 - DNA, 20 bp, Artificial Sequence
  chemically synthesized
tgagggctggggctggggca

SEQ ID NO: 17039 - DNA, 20 bp, Artificial Sequence
  chemically synthesized
gagggctggggctggggcag

SEQ ID NO: 17040 - DNA, 20 bp, Artificial Sequence
  chemically synthesized
ctggggctggggcagaggtg

SEQ ID NO: 17041 - DNA, 20 bp, Artificial Sequence
  chemically synthesized
ggcagaggtgcagattcacg

SEQ ID NO: 17042 - DNA, 20 bp, Artificial Sequence
  chemically synthesized
cagaggtgcagattcacgtg

SEQ ID NO: 17043 - DNA, 20 bp, Artificial Sequence
  chemically synthesized
agaggtgcagattcacgtgg

SEQ ID NO: 17044 - DNA, 20 bp, Artificial Sequence
  chemically synthesized
cagattcacgtggaggttga

SEQ ID NO: 17045 - DNA, 20 bp, Artificial Sequence
  chemically synthesized
attcacgtggaggttgatgg

SEQ ID NO: 17046 - DNA, 20 bp, Artificial Sequence
  chemically synthesized
ttcacgtggaggttgatggt

SEQ ID NO: 17047 - DNA, 20 bp, Artificial Sequence
  chemically synthesized
cgtggaggttgatggtggga

SEQ ID NO: 17048 - DNA, 20 bp, Artificial Sequence
  chemically synthesized
gttgatggtgggatggaacg

SEQ ID NO: 17049 - DNA, 20 bp, Artificial Sequence
  chemically synthesized
ttgatggtgggatggaacgc

SEQ ID NO: 17050 - DNA, 20 bp, Artificial Sequence
  chemically synthesized
tgatggtgggatggaacgca

SEQ ID NO: 17051 - DNA, 20 bp, Artificial Sequence
  chemically synthesized
ggtgggatggaacgcagggt

SEQ ID NO: 17052 - DNA, 20 bp, Artificial Sequence
  chemically synthesized
tgggatggaacgcagggtcg

SEQ ID NO: 17053 - DNA, 20 bp, Artificial Sequence
  chemically synthesized
gggatggaacgcagggtcgg

SEQ ID NO: 17054 - DNA, 20 bp, Artificial Sequence
  chemically synthesized
ggatggaacgcagggtcgga

SEQ ID NO: 17055 - DNA, 20 bp, Artificial Sequence
  chemically synthesized
gatggaacgcagggtcggag

SEQ ID NO: 17056 - DNA, 20 bp, Artificial Sequence
  chemically synthesized
aacgcagggtcggaggggtt

SEQ ID NO: 17057 - DNA, 20 bp, Artificial Sequence
  chemically synthesized
acgcagggtcggaggggttc

SEQ ID NO: 17058 - DNA, 20 bp, Artificial Sequence
  chemically synthesized
cgcagggtcggaggggttcg

SEQ ID NO: 17059 - DNA, 20 bp, Artificial Sequence
  chemically synthesized
agggtcggaggggttcgggg

SEQ ID NO: 17060 - DNA, 20 bp, Artificial Sequence
  chemically synthesized
gtcggaggggttcggggtgg

SEQ ID NO: 17061 - DNA, 20 bp, Artificial Sequence
  chemically synthesized
aggggttcggggtggtggcc

SEQ ID NO: 17062 - DNA, 20 bp, Artificial Sequence
  chemically synthesized
ggggttcggggtggtggcct

SEQ ID NO: 17063 - DNA, 20 bp, Artificial Sequence
  chemically synthesized
gttcggggtggtggcctggg

SEQ ID NO: 17064 - DNA, 20 bp, Artificial Sequence
  chemically synthesized
ttcggggtggtggcctgggt

SEQ ID NO: 17065 - DNA, 20 bp, Artificial Sequence
  chemically synthesized
tggtggcctgggtaggatct

SEQ ID NO: 17066 - DNA, 20 bp, Artificial Sequence
  chemically synthesized
ggtggcctgggtaggatctg

SEQ ID NO: 17067 - DNA, 20 bp, Artificial Sequence
  chemically synthesized
gcctgggtaggatctgaggt

SEQ ID NO: 17068 - DNA, 20 bp, Artificial Sequence
  chemically synthesized
tgccaacctcagatcctacc

SEQ ID NO: 17069 - DNA, 20 bp, Artificial Sequence
  chemically synthesized
gccaacctcagatcctaccc

SEQ ID NO: 17070 - DNA, 20 bp, Artificial Sequence
  chemically synthesized
gtgaatctgcacctctgccc

SEQ ID NO: 17071 - DNA, 20 bp, Artificial Sequence
  chemically synthesized
ctgcacctctgccccagccc

SEQ ID NO: 17072 - DNA, 20 bp, Artificial Sequence
  chemically synthesized
tctgccccagccccagccct

SEQ ID NO: 17073 - DNA, 20 bp, Artificial Sequence
  chemically synthesized
tgccccagccccagccctca

SEQ ID NO: 17074 - DNA, 20 bp, Artificial Sequence
  chemically synthesized
cccagccctcagagcaacct

SEQ ID NO: 17075 - DNA, 20 bp, Artificial Sequence
  chemically synthesized
ccctcagagcaacctcagcc

SEQ ID NO: 17076 - DNA, 20 bp, Artificial Sequence
  chemically synthesized
agagcaacctcagcccagcc

SEQ ID NO: 17077 - DNA, 20 bp, Artificial Sequence
  chemically synthesized
aacctcagcccagcccagcc

SEQ ID NO: 17078 - DNA, 20 bp, Artificial Sequence
  chemically synthesized
agcccagcccagcccagctc

SEQ ID NO: 17079 - DNA, 20 bp, Artificial Sequence
  chemically synthesized
gcccagcccagctccagctc

SEQ ID NO: 17080 - DNA, 20 bp, Artificial Sequence
  chemically synthesized
cccagctccagctccagctc

SEQ ID NO: 17081 - DNA, 20 bp, Artificial Sequence
  chemically synthesized
ctccagctccagctccagcc

SEQ ID NO: 17082 - DNA, 20 bp, Artificial Sequence
  chemically synthesized
tccagctccagctccagccc

SEQ ID NO: 17083 - DNA, 20 bp, Artificial Sequence
  chemically synthesized
ctccagcccgggccccatca

SEQ ID NO: 17084 - DNA, 20 bp, Artificial Sequence
  chemically synthesized
gcccgggccccatcatggcc

SEQ ID NO: 17085 - DNA, 20 bp, Artificial Sequence
  chemically synthesized
cccgggccccatcatggcca

SEQ ID NO: 17086 - DNA, 20 bp, Artificial Sequence
  chemically synthesized
catcatggccaaggactttc

SEQ ID NO: 17087 - DNA, 20 bp, Artificial Sequence
  chemically synthesized
ccaaggactttcaagatatc

SEQ ID NO: 17088 - DNA, 20 bp, Artificial Sequence
  chemically synthesized
aggactttcaagatatccag

SEQ ID NO: 17089 - DNA, 20 bp, Artificial Sequence
  chemically synthesized
tttcaagatatccagcagct

SEQ ID NO: 17090 - DNA, 20 bp, Artificial Sequence
  chemically synthesized
agatatccagcagctgagct

SEQ ID NO: 17091 - DNA, 20 bp, Artificial Sequence
  chemically synthesized
atatccagcagctgagctcg

SEQ ID NO: 17092 - DNA, 20 bp, Artificial Sequence
  chemically synthesized
tatccagcagctgagctcgg

SEQ ID NO: 17093 - DNA, 20 bp, Artificial Sequence
  chemically synthesized
aaatgaccatcctttccatc

SEQ ID NO: 17094 - DNA, 20 bp, Artificial Sequence
  chemically synthesized
aatgaccatcctttccatca

SEQ ID NO: 17095 - DNA, 20 bp, Artificial Sequence
  chemically synthesized
accatcctttccatcaaggt

SEQ ID NO: 17096 - DNA, 20 bp, Artificial Sequence
  chemically synthesized
ccatcctttccatcaaggtg

SEQ ID NO: 17097 - DNA, 20 bp, Artificial Sequence
  chemically synthesized
catcctttccatcaaggtga

SEQ ID NO: 17098 - DNA, 20 bp, Artificial Sequence
  chemically synthesized
atcctttccatcaaggtgag

SEQ ID NO: 17099 - DNA, 20 bp, Artificial Sequence
  chemically synthesized
tttccatcaaggtgaggggc

SEQ ID NO: 17100 - DNA, 20 bp, Artificial Sequence
  chemically synthesized
ttccatcaaggtgaggggcc

SEQ ID NO: 17101 - DNA, 20 bp, Artificial Sequence
  chemically synthesized
ggtgaggggccaggcactcg

SEQ ID NO: 17102 - DNA, 20 bp, Artificial Sequence
  chemically synthesized
gtgaggggccaggcactcgc

SEQ ID NO: 17103 - DNA, 20 bp, Artificial Sequence
  chemically synthesized
ggcactcgcaggctgaatcc

SEQ ID NO: 17104 - DNA, 20 bp, Artificial Sequence
  chemically synthesized
gcactcgcaggctgaatccc

SEQ ID NO: 17105 - DNA, 20 bp, Artificial Sequence
  chemically synthesized
actcgcaggctgaatcccag

SEQ ID NO: 17106 - DNA, 20 bp, Artificial Sequence
  chemically synthesized
tcgcaggctgaatcccagga

SEQ ID NO: 17107 - DNA, 20 bp, Artificial Sequence
  chemically synthesized
cgcaggctgaatcccaggag

SEQ ID NO: 17108 - DNA, 20 bp, Artificial Sequence
  chemically synthesized
gagaggaaatccatttttga

SEQ ID NO: 17109 - DNA, 20 bp, Artificial Sequence
  chemically synthesized
agaggaaatccatttttgaa

SEQ ID NO: 17110 - DNA, 20 bp, Artificial Sequence
  chemically synthesized
gaaatccatttttgaaaggc

SEQ ID NO: 17111 - DNA, 20 bp, Artificial Sequence
  chemically synthesized
atttttgaaaggcaagtgtg

SEQ ID NO: 17112 - DNA, 20 bp, Artificial Sequence
  chemically synthesized
aggcaagtgtgcagtttctg

SEQ ID NO: 17113 - DNA, 20 bp, Artificial Sequence
  chemically synthesized
gctttgctccccctctgtct

SEQ ID NO: 17114 - DNA, 20 bp, Artificial Sequence
  chemically synthesized
catgattgctctgtcccttt

SEQ ID NO: 17115 - DNA, 20 bp, Artificial Sequence
  chemically synthesized
atgattgctctgtccctttg

SEQ ID NO: 17116 - DNA, 20 bp, Artificial Sequence
  chemically synthesized
tgccgcacccactctgtgaa

SEQ ID NO: 17117 - DNA, 20 bp, Artificial Sequence
  chemically synthesized
gccgcacccactctgtgaac

SEQ ID NO: 17118 - DNA, 20 bp, Artificial Sequence
  chemically synthesized
ccgcacccactctgtgaaca

SEQ ID NO: 17119 - DNA, 20 bp, Artificial Sequence
  chemically synthesized
ccactctgtgaacagggact

SEQ ID NO: 17120 - DNA, 20 bp, Artificial Sequence
  chemically synthesized
cactctgtgaacagggactg

SEQ ID NO: 17121 - DNA, 20 bp, Artificial Sequence
  chemically synthesized
ctctgtgaacagggactgag

SEQ ID NO: 17122 - DNA, 20 bp, Artificial Sequence
  chemically synthesized
tctgtgaacagggactgagg

SEQ ID NO: 17123 - DNA, 20 bp, Artificial Sequence
  chemically synthesized
ctgtgaacagggactgagga

SEQ ID NO: 17124 - DNA, 20 bp, Artificial Sequence
  chemically synthesized
cctcaccttcctgtctaccc

SEQ ID NO: 17125 - DNA, 20 bp, Artificial Sequence
  chemically synthesized
ctcaccttcctgtctacccc

SEQ ID NO: 17126 - DNA, 20 bp, Artificial Sequence
  chemically synthesized
tcctgtctaccccaggaccc

SEQ ID NO: 17127 - DNA, 20 bp, Artificial Sequence
  chemically synthesized
cctgtctaccccaggacccc

SEQ ID NO: 17128 - DNA, 20 bp, Artificial Sequence
  chemically synthesized
tctaccccaggaccccagga

SEQ ID NO: 17129 - DNA, 20 bp, Artificial Sequence
  chemically synthesized
ctaccccaggaccccaggaa

SEQ ID NO: 17130 - DNA, 20 bp, Artificial Sequence
  chemically synthesized
accccaggaaaggcatgtgc

SEQ ID NO: 17131 - DNA, 20 bp, Artificial Sequence
  chemically synthesized
cccaggaaaggcatgtgcca

SEQ ID NO: 17132 - DNA, 20 bp, Artificial Sequence
  chemically synthesized
ccaggaaaggcatgtgccag

SEQ ID NO: 17133 - DNA, 20 bp, Artificial Sequence
  chemically synthesized
aaaggcatgtgccagaggtg

SEQ ID NO: 17134 - DNA, 20 bp, Artificial Sequence
  chemically synthesized
aaggcatgtgccagaggtgt

SEQ ID NO: 17135 - DNA, 20 bp, Artificial Sequence
  chemically synthesized
aggcatgtgccagaggtgtg

SEQ ID NO: 17136 - DNA, 20 bp, Artificial Sequence
  chemically synthesized
gcatgtgccagaggtgtggg

SEQ ID NO: 17137 - DNA, 20 bp, Artificial Sequence
  chemically synthesized
gccagaggtgtggggagatc

SEQ ID NO: 17138 - DNA, 20 bp, Artificial Sequence
  chemically synthesized
agaggtgtggggagatctgg

SEQ ID NO: 17139 - DNA, 20 bp, Artificial Sequence
  chemically synthesized
tgcccttctcctcccaaccc

SEQ ID NO: 17140 - DNA, 20 bp, Artificial Sequence
  chemically synthesized
gtgtgcacgtatgtgcatat

SEQ ID NO: 17141 - DNA, 20 bp, Artificial Sequence
  chemically synthesized
tgtgcacgtatgtgcatatg

SEQ ID NO: 17142 - DNA, 20 bp, Artificial Sequence
  chemically synthesized
gtatgtgcatatgaggaatg

SEQ ID NO: 17143 - DNA, 20 bp, Artificial Sequence
  chemically synthesized
gcatatgaggaatgcagatt

SEQ ID NO: 17144 - DNA, 20 bp, Artificial Sequence
  chemically synthesized
atgaggaatgcagattcagc

SEQ ID NO: 17145 - DNA, 20 bp, Artificial Sequence
  chemically synthesized
tgaggaatgcagattcagct

SEQ ID NO: 17146 - DNA, 20 bp, Artificial Sequence
  chemically synthesized
gggactctgtgtgtgtgtgt

SEQ ID NO: 17147 - DNA, 20 bp, Artificial Sequence
  chemically synthesized
gtgtgtgtgtatatgtgcgc

SEQ ID NO: 17148 - DNA, 20 bp, Artificial Sequence
  chemically synthesized
gtgtgtgtatatgtgcgcga

SEQ ID NO: 17149 - DNA, 20 bp, Artificial Sequence
  chemically synthesized
tgtgtgtatgtcgtgtatgt

SEQ ID NO: 17150 - DNA, 20 bp, Artificial Sequence
  chemically synthesized
tgtgtatgtcgtgtatgtga

SEQ ID NO: 17151 - DNA, 20 bp, Artificial Sequence
  chemically synthesized
gtgtatgtcgtgtatgtgag

SEQ ID NO: 17152 - DNA, 20 bp, Artificial Sequence
  chemically synthesized
tgtatgtcgtgtatgtgaga

SEQ ID NO: 17153 - DNA, 20 bp, Artificial Sequence
  chemically synthesized
tgagagggtatgttgtgtgt

SEQ ID NO: 17154 - DNA, 20 bp, Artificial Sequence
  chemically synthesized
agagggtatgttgtgtgtga

SEQ ID NO: 17155 - DNA, 20 bp, Artificial Sequence
  chemically synthesized
gttgtgtgtgtatgttgtgt

SEQ ID NO: 17156 - DNA, 20 bp, Artificial Sequence
  chemically synthesized
gttgtgtgtatcttgtgtgt

SEQ ID NO: 17157 - DNA, 20 bp, Artificial Sequence
  chemically synthesized
tgcatgtgtgtatgttgtgc

SEQ ID NO: 17158 - DNA, 20 bp, Artificial Sequence
  chemically synthesized
cgagtgtatgttgtgtatgt

SEQ ID NO: 17159 - DNA, 20 bp, Artificial Sequence
  chemically synthesized
tgtgtatgtatgttgtgtat

SEQ ID NO: 17160 - DNA, 20 bp, Artificial Sequence
  chemically synthesized
gttgtgtgtgtgtattgtgt

SEQ ID NO: 17161 - DNA, 20 bp, Artificial Sequence
  chemically synthesized
tgtatgtttgtgtgttgtgt

SEQ ID NO: 17162 - DNA, 20 bp, Artificial Sequence
  chemically synthesized
tgcgtgtgtgtatgttgtgc

SEQ ID NO: 17163 - DNA, 20 bp, Artificial Sequence
  chemically synthesized
gtgttgtgtgtgtatgttgt

SEQ ID NO: 17164 - DNA, 20 bp, Artificial Sequence
  chemically synthesized
gttatgtatgttgtgtgtgt

SEQ ID NO: 17165 - DNA, 20 bp, Artificial Sequence
  chemically synthesized
tgtgtgtgagtgtgttgcgt

SEQ ID NO: 17166 - DNA, 20 bp, Artificial Sequence
  chemically synthesized
tgttgcgtgagtgtgtgtgt

SEQ ID NO: 17167 - DNA, 20 bp, Artificial Sequence
  chemically synthesized
tgtgtgtgtgtgtgtgtgtg

SEQ ID NO: 17168 - DNA, 20 bp, Artificial Sequence
  chemically synthesized
tgtgtgtgtgtgtgtgtgta

SEQ ID NO: 17169 - DNA, 20 bp, Artificial Sequence
  chemically synthesized
gtgtgtgtgtgtgtgtgtag

SEQ ID NO: 17170 - DNA, 20 bp, Artificial Sequence
  chemically synthesized
tgtgtgtgtgtgtgtagagg

SEQ ID NO: 17171 - DNA, 20 bp, Artificial Sequence
  chemically synthesized
gtgtgtgtgtgtgtagaggt

SEQ ID NO: 17172 - DNA, 20 bp, Artificial Sequence
  chemically synthesized
tgtgtgtgtgtgtagaggtg

SEQ ID NO: 17173 - DNA, 20 bp, Artificial Sequence
  chemically synthesized
tgtgtgtgtagaggtggggt

SEQ ID NO: 17174 - DNA, 20 bp, Artificial Sequence
  chemically synthesized
tgtgtagaggtggggtgagt

SEQ ID NO: 17175 - DNA, 20 bp, Artificial Sequence
  chemically synthesized
gtgtagaggtggggtgagtt

SEQ ID NO: 17176 - DNA, 20 bp, Artificial Sequence
  chemically synthesized
agaggtggggtgagttggga

SEQ ID NO: 17177 - DNA, 20 bp, Artificial Sequence
  chemically synthesized
gaggtggggtgagttgggat

SEQ ID NO: 17178 - DNA, 20 bp, Artificial Sequence
  chemically synthesized
gtggggtgagttgggatggg

SEQ ID NO: 17179 - DNA, 20 bp, Artificial Sequence
  chemically synthesized
tggggtgagttgggatgggt

SEQ ID NO: 17180 - DNA, 20 bp, Artificial Sequence
  chemically synthesized
ggggtgagttgggatgggtg

SEQ ID NO: 17181 - DNA, 20 bp, Artificial Sequence
  chemically synthesized
gggtgagttgggatgggtgg

SEQ ID NO: 17182 - DNA, 20 bp, Artificial Sequence
  chemically synthesized
ttgggatgggtgggggacgt

SEQ ID NO: 17183 - DNA, 20 bp, Artificial Sequence
  chemically synthesized
atgggtgggggacgtgagca

SEQ ID NO: 17184 - DNA, 20 bp, Artificial Sequence
  chemically synthesized
gggtgggggacgtgagcaca

SEQ ID NO: 17185 - DNA, 20 bp, Artificial Sequence
  chemically synthesized
gtgggggacgtgagcacaga

SEQ ID NO: 17186 - DNA, 20 bp, Artificial Sequence
  chemically synthesized
acgtgagcacagagagatcc

SEQ ID NO: 17187 - DNA, 20 bp, Artificial Sequence
  chemically synthesized
tgagcacagagagatcctgg

SEQ ID NO: 17188 - DNA, 20 bp, Artificial Sequence
  chemically synthesized
ccctgctcctctcatctccc

SEQ ID NO: 17189 - DNA, 20 bp, Artificial Sequence
  chemically synthesized
catctcccaagacccttccc

SEQ ID NO: 17190 - DNA, 20 bp, Artificial Sequence
  chemically synthesized
tctgtaataaatcttgactg

SEQ ID NO: 17191 - DNA, 20 bp, Artificial Sequence
  chemically synthesized
ctgtaataaatcttgactga

SEQ ID NO: 17192 - DNA, 20 bp, Artificial Sequence
  chemically synthesized
aaatcttgactgaaggacct

SEQ ID NO: 17193 - DNA, 20 bp, Artificial Sequence
  chemically synthesized
actgaaggacctaagtatct

SEQ ID NO: 17194 - DNA, 20 bp, Artificial Sequence
  chemically synthesized
tatcttggacattttttttt

SEQ ID NO: 17195 - DNA, 20 bp, Artificial Sequence
  chemically synthesized
tcttggacatttttttttta

SEQ ID NO: 17196 - DNA, 20 bp, Artificial Sequence
  chemically synthesized
ggacattttttttttagaga

SEQ ID NO: 17197 - DNA, 20 bp, Artificial Sequence
  chemically synthesized
gacattttttttttagagac

SEQ ID NO: 17198 - DNA, 20 bp, Artificial Sequence
  chemically synthesized
cattttttttttagagacag

SEQ ID NO: 17199 - DNA, 20 bp, Artificial Sequence
  chemically synthesized
tttttttagagacaggagtg

SEQ ID NO: 17200 - DNA, 20 bp, Artificial Sequence
  chemically synthesized
ttttagagacaggagtgtag

SEQ ID NO: 17201 - DNA, 20 bp, Artificial Sequence
  chemically synthesized
tagagacaggagtgtagtgg

SEQ ID NO: 17202 - DNA, 20 bp, Artificial Sequence
  chemically synthesized
agagacaggagtgtagtggc

SEQ ID NO: 17203 - DNA, 20 bp, Artificial Sequence
  chemically synthesized
ggagtgtagtggcaggatca

SEQ ID NO: 17204 - DNA, 20 bp, Artificial Sequence
  chemically synthesized
tcactgcaacctcgaactcc

SEQ ID NO: 17205 - DNA, 20 bp, Artificial Sequence
  chemically synthesized
cactgcaacctcgaactcct

SEQ ID NO: 17206 - DNA, 20 bp, Artificial Sequence
  chemically synthesized
aacctcgaactcctgggctc

SEQ ID NO: 17207 - DNA, 20 bp, Artificial Sequence
  chemically synthesized
ctcaagccatcctcccacct

SEQ ID NO: 17208 - DNA, 20 bp, Artificial Sequence
  chemically synthesized
tcctcccacctcagcctccc

SEQ ID NO: 17209 - DNA, 20 bp, Artificial Sequence
  chemically synthesized
tcccacctcagcctcccaag

SEQ ID NO: 17210 - DNA, 20 bp, Artificial Sequence
  chemically synthesized
acctcagcctcccaagtagt

SEQ ID NO: 17211 - DNA, 20 bp, Artificial Sequence
  chemically synthesized
cctcagcctcccaagtagtt

SEQ ID NO: 17212 - DNA, 20 bp, Artificial Sequence
  chemically synthesized
tcccaagtagttaggactta

SEQ ID NO: 17213 - DNA, 20 bp, Artificial Sequence
  chemically synthesized
cccaagtagttaggacttac

SEQ ID NO: 17214 - DNA, 20 bp, Artificial Sequence
  chemically synthesized
caggtgtgcaccactgtgcc

SEQ ID NO: 17215 - DNA, 20 bp, Artificial Sequence
  chemically synthesized
gcaaattaaaaaaaattttt

SEQ ID NO: 17216 - DNA, 20 bp, Artificial Sequence
  chemically synthesized
aaattaaaaaaaatttttta

SEQ ID NO: 17217 - DNA, 20 bp, Artificial Sequence
  chemically synthesized
aaaaaaattttttagagaaa

SEQ ID NO: 17218 - DNA, 20 bp, Artificial Sequence
  chemically synthesized
aaaaaattttttagagaaat

SEQ ID NO: 17219 - DNA, 20 bp, Artificial Sequence
  chemically synthesized
aaaaattttttagagaaatg

SEQ ID NO: 17220 - DNA, 20 bp, Artificial Sequence
  chemically synthesized
tggggtcttgctatgttgcc

SEQ ID NO: 17221 - DNA, 20 bp, Artificial Sequence
  chemically synthesized
ggggtcttgctatgttgccc

SEQ ID NO: 17222 - DNA, 20 bp, Artificial Sequence
  chemically synthesized
tcttgctatgttgcccaggc

SEQ ID NO: 17223 - DNA, 20 bp, Artificial Sequence
  chemically synthesized
tgctatgttgcccaggctgg

SEQ ID NO: 17224 - DNA, 20 bp, Artificial Sequence
  chemically synthesized
gctatgttgcccaggctggt

SEQ ID NO: 17225 - DNA, 20 bp, Artificial Sequence
  chemically synthesized
gttgcccaggctggtgggaa

SEQ ID NO: 17226 - DNA, 20 bp, Artificial Sequence
  chemically synthesized
ggctggtgggaaaagatttt

SEQ ID NO: 17227 - DNA, 20 bp, Artificial Sequence
  chemically synthesized
gctggtgggaaaagatttta

SEQ ID NO: 17228 - DNA, 20 bp, Artificial Sequence
  chemically synthesized
gtgggaaaagattttaaggt

SEQ ID NO: 17229 - DNA, 20 bp, Artificial Sequence
  chemically synthesized
gggaaaagattttaaggtga

SEQ ID NO: 17230 - DNA, 20 bp, Artificial Sequence
  chemically synthesized
gaaaagattttaaggtgaga

SEQ ID NO: 17231 - DNA, 20 bp, Artificial Sequence
  chemically synthesized
ttttaaggtgagagagatct

SEQ ID NO: 17232 - DNA, 20 bp, Artificial Sequence
  chemically synthesized
taaggtgagagagatctgag

SEQ ID NO: 17233 - DNA, 20 bp, Artificial Sequence
  chemically synthesized
gagagagatctgagcagtgc

SEQ ID NO: 17234 - DNA, 20 bp, Artificial Sequence
  chemically synthesized
agagagatctgagcagtgct

SEQ ID NO: 17235 - DNA, 20 bp, Artificial Sequence
  chemically synthesized
gagatctgagcagtgctagg

SEQ ID NO: 17236 - DNA, 20 bp, Artificial Sequence
  chemically synthesized
atctgagcagtgctaggcag

SEQ ID NO: 17237 - DNA, 20 bp, Artificial Sequence
  chemically synthesized
tctgagcagtgctaggcaga

SEQ ID NO: 17238 - DNA, 20 bp, Artificial Sequence
  chemically synthesized
ctgagcagtgctaggcagaa

SEQ ID NO: 17239 - DNA, 20 bp, Artificial Sequence
  chemically synthesized
gcagtgctaggcagaagggc

SEQ ID NO: 17240 - DNA, 20 bp, Artificial Sequence
  chemically synthesized
agtgctaggcagaagggcaa

SEQ ID NO: 17241 - DNA, 20 bp, Artificial Sequence
  chemically synthesized
ctaggcagaagggcaagagc

SEQ ID NO: 17242 - DNA, 20 bp, Artificial Sequence
  chemically synthesized
taggcagaagggcaagagcc

SEQ ID NO: 17243 - DNA, 20 bp, Artificial Sequence
  chemically synthesized
agaagggcaagagccaggaa

SEQ ID NO: 17244 - DNA, 20 bp, Artificial Sequence
  chemically synthesized
aagggcaagagccaggaatg

SEQ ID NO: 17245 - DNA, 20 bp, Artificial Sequence
  chemically synthesized
agggcaagagccaggaatgg

SEQ ID NO: 17246 - DNA, 20 bp, Artificial Sequence
  chemically synthesized
ggcaagagccaggaatggag

SEQ ID NO: 17247 - DNA, 20 bp, Artificial Sequence
  chemically synthesized
agccaggaatggaggagtgt

SEQ ID NO: 17248 - DNA, 20 bp, Artificial Sequence
  chemically synthesized
gccaggaatggaggagtgtc

SEQ ID NO: 17249 - DNA, 20 bp, Artificial Sequence
  chemically synthesized
atggaggagtgtcaggtgtg

SEQ ID NO: 17250 - DNA, 20 bp, Artificial Sequence
  chemically synthesized
tggaggagtgtcaggtgtgt

SEQ ID NO: 17251 - DNA, 20 bp, Artificial Sequence
  chemically synthesized
agtgtcaggtgtgtgggtgc

SEQ ID NO: 17252 - DNA, 20 bp, Artificial Sequence
  chemically synthesized
gtcaggtgtgtgggtgctgg

SEQ ID NO: 17253 - DNA, 20 bp, Artificial Sequence
  chemically synthesized
aggtgtgtgggtgctggtgg

SEQ ID NO: 17254 - DNA, 20 bp, Artificial Sequence
  chemically synthesized
gtgtgtgggtgctggtggtg

SEQ ID NO: 17255 - DNA, 20 bp, Artificial Sequence
  chemically synthesized
gtgggtgctggtggtggagc

SEQ ID NO: 17256 - DNA, 20 bp, Artificial Sequence
  chemically synthesized
tgggtgctggtggtggagcc

SEQ ID NO: 17257 - DNA, 20 bp, Artificial Sequence
  chemically synthesized
ggtggtggagccgggttcca

SEQ ID NO: 17258 - DNA, 20 bp, Artificial Sequence
  chemically synthesized
tggtggagccgggttccatg

SEQ ID NO: 17259 - DNA, 20 bp, Artificial Sequence
  chemically synthesized
ggtggagccgggttccatgg

SEQ ID NO: 17260 - DNA, 20 bp, Artificial Sequence
  chemically synthesized
ggagccgggttccatggagg

SEQ ID NO: 17261 - DNA, 20 bp, Artificial Sequence
  chemically synthesized
gagccgggttccatggaggc

SEQ ID NO: 17262 - DNA, 20 bp, Artificial Sequence
  chemically synthesized
gccgggttccatggaggcag

SEQ ID NO: 17263 - DNA, 20 bp, Artificial Sequence
  chemically synthesized
ccgggttccatggaggcagg

SEQ ID NO: 17264 - DNA, 20 bp, Artificial Sequence
  chemically synthesized
gggttccatggaggcaggag

SEQ ID NO: 17265 - DNA, 20 bp, Artificial Sequence
  chemically synthesized
ttccatggaggcaggaggag

SEQ ID NO: 17266 - DNA, 20 bp, Artificial Sequence
  chemically synthesized
tccatggaggcaggaggagc

SEQ ID NO: 17267 - DNA, 20 bp, Artificial Sequence
  chemically synthesized
ccatggaggcaggaggagca

SEQ ID NO: 17268 - DNA, 20 bp, Artificial Sequence
  chemically synthesized
catggaggcaggaggagcag

SEQ ID NO: 17269 - DNA, 20 bp, Artificial Sequence
  chemically synthesized
aggcaggaggagcaggggct

SEQ ID NO: 17270 - DNA, 20 bp, Artificial Sequence
  chemically synthesized
gcaggaggagcaggggcttg

SEQ ID NO: 17271 - DNA, 20 bp, Artificial Sequence
  chemically synthesized
aggagcaggggcttggagct

SEQ ID NO: 17272 - DNA, 20 bp, Artificial Sequence
  chemically synthesized
ggagcaggggcttggagctt

SEQ ID NO: 17273 - DNA, 20 bp, Artificial Sequence
  chemically synthesized
gcaggggcttggagcttagg

SEQ ID NO: 17274 - DNA, 20 bp, Artificial Sequence
  chemically synthesized
caggggcttggagcttagga

SEQ ID NO: 17275 - DNA, 20 bp, Artificial Sequence
  chemically synthesized
aggggcttggagcttaggaa

SEQ ID NO: 17276 - DNA, 20 bp, Artificial Sequence
  chemically synthesized
ggggcttggagcttaggaag

SEQ ID NO: 17277 - DNA, 20 bp, Artificial Sequence
  chemically synthesized
ttggagcttaggaaggggat

SEQ ID NO: 17278 - DNA, 20 bp, Artificial Sequence
  chemically synthesized
agcttaggaaggggattggt

SEQ ID NO: 17279 - DNA, 20 bp, Artificial Sequence
  chemically synthesized
taggaaggggattggttagc

SEQ ID NO: 17280 - DNA, 20 bp, Artificial Sequence
  chemically synthesized
aggaaggggattggttagct

SEQ ID NO: 17281 - DNA, 20 bp, Artificial Sequence
  chemically synthesized
aggggattggttagctgggc

SEQ ID NO: 17282 - DNA, 20 bp, Artificial Sequence
  chemically synthesized
ttggttagctgggctggaat

SEQ ID NO: 17283 - DNA, 20 bp, Artificial Sequence
  chemically synthesized
tggttagctgggctggaatg

SEQ ID NO: 17284 - DNA, 20 bp, Artificial Sequence
  chemically synthesized
ggttagctgggctggaatga

SEQ ID NO: 17285 - DNA, 20 bp, Artificial Sequence
  chemically synthesized
atgagggactcctcattcct

SEQ ID NO: 17286 - DNA, 20 bp, Artificial Sequence
  chemically synthesized
tgagggactcctcattcctg

SEQ ID NO: 17287 - DNA, 20 bp, Artificial Sequence
  chemically synthesized
ggactcctcattcctgaggc

SEQ ID NO: 17288 - DNA, 20 bp, Artificial Sequence
  chemically synthesized
attcctgaggctggccaacc

SEQ ID NO: 17289 - DNA, 20 bp, Artificial Sequence
  chemically synthesized
ttcctgaggctggccaaccg

SEQ ID NO: 17290 - DNA, 20 bp, Artificial Sequence
  chemically synthesized
tcctgaggctggccaaccga

SEQ ID NO: 17291 - DNA, 20 bp, Artificial Sequence
  chemically synthesized
ctgaggctggccaaccgagg

SEQ ID NO: 17292 - DNA, 20 bp, Artificial Sequence
  chemically synthesized
tgaggctggccaaccgaggg

SEQ ID NO: 17293 - DNA, 20 bp, Artificial Sequence
  chemically synthesized
gaggctggccaaccgaggga

SEQ ID NO: 17294 - DNA, 20 bp, Artificial Sequence
  chemically synthesized
ctggccaaccgagggagggc

SEQ ID NO: 17295 - DNA, 20 bp, Artificial Sequence
  chemically synthesized
aaccgagggagggccggtgc

SEQ ID NO: 17296 - DNA, 20 bp, Artificial Sequence
  chemically synthesized
accgagggagggccggtgct

SEQ ID NO: 17297 - DNA, 20 bp, Artificial Sequence
  chemically synthesized
gagggagggccggtgctggg

SEQ ID NO: 17298 - DNA, 20 bp, Artificial Sequence
  chemically synthesized
agggagggccggtgctgggc

SEQ ID NO: 17299 - DNA, 20 bp, Artificial Sequence
  chemically synthesized
gggagggccggtgctgggca

SEQ ID NO: 17300 - DNA, 20 bp, Artificial Sequence
  chemically synthesized
agggccggtgctgggcaggg

SEQ ID NO: 17301 - DNA, 20 bp, Artificial Sequence
  chemically synthesized
gggccggtgctgggcagggc

SEQ ID NO: 17302 - DNA, 20 bp, Artificial Sequence
  chemically synthesized
ggccggtgctgggcagggca

SEQ ID NO: 17303 - DNA, 20 bp, Artificial Sequence
  chemically synthesized
cggtgctgggcagggcaggg

SEQ ID NO: 17304 - DNA, 20 bp, Artificial Sequence
  chemically synthesized
ggtgctgggcagggcagggc

SEQ ID NO: 17305 - DNA, 20 bp, Artificial Sequence
  chemically synthesized
gtgctgggcagggcagggca

SEQ ID NO: 17306 - DNA, 20 bp, Artificial Sequence
  chemically synthesized
tgctgggcagggcagggcag

SEQ ID NO: 17307 - DNA, 20 bp, Artificial Sequence
  chemically synthesized
gggcagggcagggcagggga

SEQ ID NO: 17308 - DNA, 20 bp, Artificial Sequence
  chemically synthesized
ggcagggcagggcaggggac

SEQ ID NO: 17309 - DNA, 20 bp, Artificial Sequence
  chemically synthesized
cagggcagggcaggggacag

SEQ ID NO: 17310 - DNA, 20 bp, Artificial Sequence
  chemically synthesized
agggcagggcaggggacagg

SEQ ID NO: 17311 - DNA, 20 bp, Artificial Sequence
  chemically synthesized
gggcagggcaggggacagga

SEQ ID NO: 17312 - DNA, 20 bp, Artificial Sequence
  chemically synthesized
agggcaggggacaggaggga

SEQ ID NO: 17313 - DNA, 20 bp, Artificial Sequence
  chemically synthesized
gggcaggggacaggagggat

SEQ ID NO: 17314 - DNA, 20 bp, Artificial Sequence
  chemically synthesized
gcaggggacaggagggatag

SEQ ID NO: 17315 - DNA, 20 bp, Artificial Sequence
  chemically synthesized
caggggacaggagggatagg

SEQ ID NO: 17316 - DNA, 20 bp, Artificial Sequence
  chemically synthesized
agggataggaggtccctccc

SEQ ID NO: 17317 - DNA, 20 bp, Artificial Sequence
  chemically synthesized
gggataggaggtccctcccg

SEQ ID NO: 17318 - DNA, 20 bp, Artificial Sequence
  chemically synthesized
ggtccctcccgaggaccact

SEQ ID NO: 17319 - DNA, 20 bp, Artificial Sequence
  chemically synthesized
gtccctcccgaggaccactc

SEQ ID NO: 17320 - DNA, 20 bp, Artificial Sequence
  chemically synthesized
cgaggaccactcaggaacac

SEQ ID NO: 17321 - DNA, 20 bp, Artificial Sequence
  chemically synthesized
ggaccactcaggaacaccag

SEQ ID NO: 17322 - DNA, 20 bp, Artificial Sequence
  chemically synthesized
agtagcatctcctctctctg

SEQ ID NO: 17323 - DNA, 20 bp, Artificial Sequence
  chemically synthesized
gtagcatctcctctctctgt

SEQ ID NO: 17324 - DNA, 20 bp, Artificial Sequence
  chemically synthesized
tagcatctcctctctctgta

SEQ ID NO: 17325 - DNA, 20 bp, Artificial Sequence
  chemically synthesized
agcatctcctctctctgtag

SEQ ID NO: 17326 - DNA, 20 bp, Artificial Sequence
  chemically synthesized
gcatctcctctctctgtagg

SEQ ID NO: 17327 - DNA, 20 bp, Artificial Sequence
  chemically synthesized
ctcctctctctgtagggggc

SEQ ID NO: 17328 - DNA, 20 bp, Artificial Sequence
  chemically synthesized
tctctctgtagggggctggc

SEQ ID NO: 17329 - DNA, 20 bp, Artificial Sequence
  chemically synthesized
gggctggctggacttcccac

SEQ ID NO: 17330 - DNA, 20 bp, Artificial Sequence
  chemically synthesized
ggctggctggacttcccacc

SEQ ID NO: 17331 - DNA, 20 bp, Artificial Sequence
  chemically synthesized
tggctggacttcccaccagg

SEQ ID NO: 17332 - DNA, 20 bp, Artificial Sequence
  chemically synthesized
cccaccaggcggtgtcccca

SEQ ID NO: 17333 - DNA, 20 bp, Artificial Sequence
  chemically synthesized
ccaccaggcggtgtccccac

SEQ ID NO: 17334 - DNA, 20 bp, Artificial Sequence
  chemically synthesized
ccaggcggtgtccccacagg

SEQ ID NO: 17335 - DNA, 20 bp, Artificial Sequence
  chemically synthesized
aggcggtgtccccacaggca

SEQ ID NO: 17336 - DNA, 20 bp, Artificial Sequence
  chemically synthesized
ggcggtgtccccacaggcag

SEQ ID NO: 17337 - DNA, 20 bp, Artificial Sequence
  chemically synthesized
ctcactctcctctgcaactc

SEQ ID NO: 17338 - DNA, 20 bp, Artificial Sequence
  chemically synthesized
ctgcaactccagtgcccaca

SEQ ID NO: 17339 - DNA, 20 bp, Artificial Sequence
  chemically synthesized
tccagtgcccacacggcacc

SEQ ID NO: 17340 - DNA, 20 bp, Artificial Sequence
  chemically synthesized
cccacacggcacccggtaca

SEQ ID NO: 17341 - DNA, 20 bp, Artificial Sequence
  chemically synthesized
cccggtacatagtgaacact

SEQ ID NO: 17342 - DNA, 20 bp, Artificial Sequence
  chemically synthesized
cggtacatagtgaacactca

SEQ ID NO: 17343 - DNA, 20 bp, Artificial Sequence
  chemically synthesized
gtacatagtgaacactcaga

SEQ ID NO: 17344 - DNA, 20 bp, Artificial Sequence
  chemically synthesized
gtgaacactcagagagaata

SEQ ID NO: 17345 - DNA, 20 bp, Artificial Sequence
  chemically synthesized
tgaacactcagagagaatac

SEQ ID NO: 17346 - DNA, 20 bp, Artificial Sequence
  chemically synthesized
gggatgctgctgaatcttct

SEQ ID NO: 17347 - DNA, 20 bp, Artificial Sequence
  chemically synthesized
ggatgctgctgaatcttctg

SEQ ID NO: 17348 - DNA, 20 bp, Artificial Sequence
  chemically synthesized
gatgctgctgaatcttctga

SEQ ID NO: 17349 - DNA, 20 bp, Artificial Sequence
  chemically synthesized
gctgaatcttctgagggtga

SEQ ID NO: 17350 - DNA, 20 bp, Artificial Sequence
  chemically synthesized
cttctgagggtgacagaatt

SEQ ID NO: 17351 - DNA, 20 bp, Artificial Sequence
  chemically synthesized
tctgagggtgacagaattta

SEQ ID NO: 17352 - DNA, 20 bp, Artificial Sequence
  chemically synthesized
ggtgacagaatttagagttt

SEQ ID NO: 17353 - DNA, 20 bp, Artificial Sequence
  chemically synthesized
gacagaatttagagtttgag

SEQ ID NO: 17354 - DNA, 20 bp, Artificial Sequence
  chemically synthesized
acagaatttagagtttgagc

SEQ ID NO: 17355 - DNA, 20 bp, Artificial Sequence
  chemically synthesized
agaatttagagtttgagcag

SEQ ID NO: 17356 - DNA, 20 bp, Artificial Sequence
  chemically synthesized
gaatttagagtttgagcagg

SEQ ID NO: 17357 - DNA, 20 bp, Artificial Sequence
  chemically synthesized
tagagtttgagcaggaggct

SEQ ID NO: 17358 - DNA, 20 bp, Artificial Sequence
  chemically synthesized
gagtttgagcaggaggcttg

SEQ ID NO: 17359 - DNA, 20 bp, Artificial Sequence
  chemically synthesized
gtttgagcaggaggcttgga

SEQ ID NO: 17360 - DNA, 20 bp, Artificial Sequence
  chemically synthesized
ttgagcaggaggcttggaga

SEQ ID NO: 17361 - DNA, 20 bp, Artificial Sequence
  chemically synthesized
tgagcaggaggcttggagag

SEQ ID NO: 17362 - DNA, 20 bp, Artificial Sequence
  chemically synthesized
caggaggcttggagagaggc

SEQ ID NO: 17363 - DNA, 20 bp, Artificial Sequence
  chemically synthesized
aggaggcttggagagaggcc

SEQ ID NO: 17364 - DNA, 20 bp, Artificial Sequence
  chemically synthesized
gccaggatttctgaaattaa

SEQ ID NO: 17365 - DNA, 20 bp, Artificial Sequence
  chemically synthesized
ccaggatttctgaaattaat

SEQ ID NO: 17366 - DNA, 20 bp, Artificial Sequence
  chemically synthesized
aggatttctgaaattaatgg

SEQ ID NO: 17367 - DNA, 20 bp, Artificial Sequence
  chemically synthesized
gatttctgaaattaatggga

SEQ ID NO: 17368 - DNA, 20 bp, Artificial Sequence
  chemically synthesized
tctgaaattaatgggagagt

SEQ ID NO: 17369 - DNA, 20 bp, Artificial Sequence
  chemically synthesized
ggagagtgagctcacgcgaa

SEQ ID NO: 17370 - DNA, 20 bp, Artificial Sequence
  chemically synthesized
gagagtgagctcacgcgaat

SEQ ID NO: 17371 - DNA, 20 bp, Artificial Sequence
  chemically synthesized
tgagctcacgcgaatgggct

SEQ ID NO: 17372 - DNA, 20 bp, Artificial Sequence
  chemically synthesized
gagctcacgcgaatgggctg

SEQ ID NO: 17373 - DNA, 20 bp, Artificial Sequence
  chemically synthesized
agctcacgcgaatgggctga

SEQ ID NO: 17374 - DNA, 20 bp, Artificial Sequence
  chemically synthesized
gcgaatgggctgagggacac

SEQ ID NO: 17375 - DNA, 20 bp, Artificial Sequence
  chemically synthesized
atgggctgagggacaccagt

SEQ ID NO: 17376 - DNA, 20 bp, Artificial Sequence
  chemically synthesized
tgggctgagggacaccagtg

SEQ ID NO: 17377 - DNA, 20 bp, Artificial Sequence
  chemically synthesized
gggctgagggacaccagtga

SEQ ID NO: 17378 - DNA, 20 bp, Artificial Sequence
  chemically synthesized
caccagtgagggaccgtctg

SEQ ID NO: 17379 - DNA, 20 bp, Artificial Sequence
  chemically synthesized
accagtgagggaccgtctga

SEQ ID NO: 17380 - DNA, 20 bp, Artificial Sequence
  chemically synthesized
ccagtgagggaccgtctgaa

SEQ ID NO: 17381 - DNA, 20 bp, Artificial Sequence
  chemically synthesized
agggaccgtctgaagggatg

SEQ ID NO: 17382 - DNA, 20 bp, Artificial Sequence
  chemically synthesized
ccgtctgaagggatgtagca

SEQ ID NO: 17383 - DNA, 20 bp, Artificial Sequence
  chemically synthesized
aaagtcaccgcatttccctc

SEQ ID NO: 17384 - DNA, 20 bp, Artificial Sequence
  chemically synthesized
gtcaccgcatttccctccag

SEQ ID NO: 17385 - DNA, 20 bp, Artificial Sequence
  chemically synthesized
cgcatttccctccagcagcc

SEQ ID NO: 17386 - DNA, 20 bp, Artificial Sequence
  chemically synthesized
gcatttccctccagcagccc

SEQ ID NO: 17387 - DNA, 20 bp, Artificial Sequence
  chemically synthesized
tttccctccagcagcccggg

SEQ ID NO: 17388 - DNA, 20 bp, Artificial Sequence
  chemically synthesized
ccctccagcagcccgggtgg

SEQ ID NO: 17389 - DNA, 20 bp, Artificial Sequence
  chemically synthesized
cctccagcagcccgggtggt

SEQ ID NO: 17390 - DNA, 20 bp, Artificial Sequence
  chemically synthesized
ctccagcagcccgggtggtg

SEQ ID NO: 17391 - DNA, 20 bp, Artificial Sequence
  chemically synthesized
tccagcagcccgggtggtgg

SEQ ID NO: 17392 - DNA, 20 bp, Artificial Sequence
  chemically synthesized
gcagcccgggtggtgggggc

SEQ ID NO: 17393 - DNA, 20 bp, Artificial Sequence
  chemically synthesized
cagcccgggtggtgggggct

SEQ ID NO: 17394 - DNA, 20 bp, Artificial Sequence
  chemically synthesized
agcccgggtggtgggggctg

SEQ ID NO: 17395 - DNA, 20 bp, Artificial Sequence
  chemically synthesized
gcccgggtggtgggggctgg

SEQ ID NO: 17396 - DNA, 20 bp, Artificial Sequence
  chemically synthesized
gggctgggggaacgtcatca

SEQ ID NO: 17397 - DNA, 20 bp, Artificial Sequence
  chemically synthesized
ggctgggggaacgtcatcat

SEQ ID NO: 17398 - DNA, 20 bp, Artificial Sequence
  chemically synthesized
ctgggggaacgtcatcatgg

SEQ ID NO: 17399 - DNA, 20 bp, Artificial Sequence
  chemically synthesized
tcatgggagctgacactgat

SEQ ID NO: 17400 - DNA, 20 bp, Artificial Sequence
  chemically synthesized
gacactgatcagctgctcac

SEQ ID NO: 17401 - DNA, 20 bp, Artificial Sequence
  chemically synthesized
acactgatcagctgctcacc

SEQ ID NO: 17402 - DNA, 20 bp, Artificial Sequence
  chemically synthesized
cactgatcagctgctcaccg

SEQ ID NO: 17403 - DNA, 20 bp, Artificial Sequence
  chemically synthesized
ggcccatcttccacttgtct

SEQ ID NO: 17404 - DNA, 20 bp, Artificial Sequence
  chemically synthesized
gctaccccctttttctttta

SEQ ID NO: 17405 - DNA, 20 bp, Artificial Sequence
  chemically synthesized
atttcaattatgcatgtatt

SEQ ID NO: 17406 - DNA, 20 bp, Artificial Sequence
  chemically synthesized
tttcaattatgcatgtatta

SEQ ID NO: 17407 - DNA, 20 bp, Artificial Sequence
  chemically synthesized
ttcaattatgcatgtattaa

SEQ ID NO: 17408 - DNA, 20 bp, Artificial Sequence
  chemically synthesized
tgcatgtattaagggtccca

SEQ ID NO: 17409 - DNA, 20 bp, Artificial Sequence
  chemically synthesized
tttttaattcttttttctcc

SEQ ID NO: 17410 - DNA, 20 bp, Artificial Sequence
  chemically synthesized
tctcccagtgtttcatttta

SEQ ID NO: 17411 - DNA, 20 bp, Artificial Sequence
  chemically synthesized
tcccagtgtttcattttata

SEQ ID NO: 17412 - DNA, 20 bp, Artificial Sequence
  chemically synthesized
tagagttattgctgttcatt

SEQ ID NO: 17413 - DNA, 20 bp, Artificial Sequence
  chemically synthesized
tctcatctcactctgttgcc

SEQ ID NO: 17414 - DNA, 20 bp, Artificial Sequence
  chemically synthesized
ctcatctcactctgttgccc

SEQ ID NO: 17415 - DNA, 20 bp, Artificial Sequence
  chemically synthesized
tctcactctgttgcccaggc

SEQ ID NO: 17416 - DNA, 20 bp, Artificial Sequence
  chemically synthesized
ctgttgcccaggctggaatg

SEQ ID NO: 17417 - DNA, 20 bp, Artificial Sequence
  chemically synthesized
ttgcccaggctggaatgcag

SEQ ID NO: 17418 - DNA, 20 bp, Artificial Sequence
  chemically synthesized
tagcttgtcacaactcactg

SEQ ID NO: 17419 - DNA, 20 bp, Artificial Sequence
  chemically synthesized
tcactgtggcctccacctcc

SEQ ID NO: 17420 - DNA, 20 bp, Artificial Sequence
  chemically synthesized
cactgtggcctccacctcct

SEQ ID NO: 17421 - DNA, 20 bp, Artificial Sequence
  chemically synthesized
tggcctccacctcctgggct

SEQ ID NO: 17422 - DNA, 20 bp, Artificial Sequence
  chemically synthesized
ggcctccacctcctgggctc

SEQ ID NO: 17423 - DNA, 20 bp, Artificial Sequence
  chemically synthesized
ctcaggcgatccttccactt

SEQ ID NO: 17424 - DNA, 20 bp, Artificial Sequence
  chemically synthesized
atccttccacttcagcctcc

SEQ ID NO: 17425 - DNA, 20 bp, Artificial Sequence
  chemically synthesized
tccttccacttcagcctccc

SEQ ID NO: 17426 - DNA, 20 bp, Artificial Sequence
  chemically synthesized
ttccacttcagcctcccagg

SEQ ID NO: 17427 - DNA, 20 bp, Artificial Sequence
  chemically synthesized
acttcagcctcccaggtagc

SEQ ID NO: 17428 - DNA, 20 bp, Artificial Sequence
  chemically synthesized
cttcagcctcccaggtagct

SEQ ID NO: 17429 - DNA, 20 bp, Artificial Sequence
  chemically synthesized
ctcccaggtagctgggacta

SEQ ID NO: 17430 - DNA, 20 bp, Artificial Sequence
  chemically synthesized
tcccaggtagctgggactat

SEQ ID NO: 17431 - DNA, 20 bp, Artificial Sequence
  chemically synthesized
tagctgggactataggcatg

SEQ ID NO: 17432 - DNA, 20 bp, Artificial Sequence
  chemically synthesized
taggcatgtggcaccacacc

SEQ ID NO: 17433 - DNA, 20 bp, Artificial Sequence
  chemically synthesized
taattaaaaatttttttttg

SEQ ID NO: 17434 - DNA, 20 bp, Artificial Sequence
  chemically synthesized
attaaaaatttttttttgta

SEQ ID NO: 17435 - DNA, 20 bp, Artificial Sequence
  chemically synthesized
aaaatttttttttgtagaga

SEQ ID NO: 17436 - DNA, 20 bp, Artificial Sequence
  chemically synthesized
gtagagacggttttgccatg

SEQ ID NO: 17437 - DNA, 20 bp, Artificial Sequence
  chemically synthesized
agagacggttttgccatgta

SEQ ID NO: 17438 - DNA, 20 bp, Artificial Sequence
  chemically synthesized
gagacggttttgccatgtag

SEQ ID NO: 17439 - DNA, 20 bp, Artificial Sequence
  chemically synthesized
agacggttttgccatgtaga

SEQ ID NO: 17440 - DNA, 20 bp, Artificial Sequence
  chemically synthesized
gacggttttgccatgtagag

SEQ ID NO: 17441 - DNA, 20 bp, Artificial Sequence
  chemically synthesized
aggggttttgccatgctgcc

SEQ ID NO: 17442 - DNA, 20 bp, Artificial Sequence
  chemically synthesized
ttttgccatgctgcccagac

SEQ ID NO: 17443 - DNA, 20 bp, Artificial Sequence
  chemically synthesized
atgctgcccagactagtctt

SEQ ID NO: 17444 - DNA, 20 bp, Artificial Sequence
  chemically synthesized
ccagactagtcttgagctcc

SEQ ID NO: 17445 - DNA, 20 bp, Artificial Sequence
  chemically synthesized
cagactagtcttgagctcct

SEQ ID NO: 17446 - DNA, 20 bp, Artificial Sequence
  chemically synthesized
agtcttgagctcctgggctc

SEQ ID NO: 17447 - DNA, 20 bp, Artificial Sequence
  chemically synthesized
ccccccgtgtcgacctccca

SEQ ID NO: 17448 - DNA, 20 bp, Artificial Sequence
  chemically synthesized
gtgtcgacctcccaaagtgc

SEQ ID NO: 17449 - DNA, 20 bp, Artificial Sequence
  chemically synthesized
tgtcgacctcccaaagtgct

SEQ ID NO: 17450 - DNA, 20 bp, Artificial Sequence
  chemically synthesized
ctcccaaagtgctgggatta

SEQ ID NO: 17451 - DNA, 20 bp, Artificial Sequence
  chemically synthesized
gggattacagatgtgatcca

SEQ ID NO: 17452 - DNA, 20 bp, Artificial Sequence
  chemically synthesized
cagatgtgatccacagtgcc

SEQ ID NO: 17453 - DNA, 20 bp, Artificial Sequence
  chemically synthesized
catcttccattatttccatc

SEQ ID NO: 17454 - DNA, 20 bp, Artificial Sequence
  chemically synthesized
tcttttcttttttttttttt

SEQ ID NO: 17455 - DNA, 20 bp, Artificial Sequence
  chemically synthesized
ttttcttttttttttttttg

SEQ ID NO: 17456 - DNA, 20 bp, Artificial Sequence
  chemically synthesized
tttcttttttttttttttgg

SEQ ID NO: 17457 - DNA, 20 bp, Artificial Sequence
  chemically synthesized
cttttttttttttttggagg

SEQ ID NO: 17458 - DNA, 20 bp, Artificial Sequence
  chemically synthesized
tttttttttttttggaggcg

SEQ ID NO: 17459 - DNA, 20 bp, Artificial Sequence
  chemically synthesized
cggagtctcgctctgttgcc

SEQ ID NO: 17460 - DNA, 20 bp, Artificial Sequence
  chemically synthesized
ggagtctcgctctgttgccc

SEQ ID NO: 17461 - DNA, 20 bp, Artificial Sequence
  chemically synthesized
tctcgctctgttgcccaggc

SEQ ID NO: 17462 - DNA, 20 bp, Artificial Sequence
  chemically synthesized
tcgctctgttgcccaggccg

SEQ ID NO: 17463 - DNA, 20 bp, Artificial Sequence
  chemically synthesized
ctgttgcccaggccggagtg

SEQ ID NO: 17464 - DNA, 20 bp, Artificial Sequence
  chemically synthesized
ttgcccaggccggagtgcag

SEQ ID NO: 17465 - DNA, 20 bp, Artificial Sequence
  chemically synthesized
ggagtgcagtggcgcgatct

SEQ ID NO: 17466 - DNA, 20 bp, Artificial Sequence
  chemically synthesized
gcgcgatcttggctcactgc

SEQ ID NO: 17467 - DNA, 20 bp, Artificial Sequence
  chemically synthesized
tcactgcaagctctgcctcc

SEQ ID NO: 17468 - DNA, 20 bp, Artificial Sequence
  chemically synthesized
cactgcaagctctgcctccc

SEQ ID NO: 17469 - DNA, 20 bp, Artificial Sequence
  chemically synthesized
ttcatgccattctcctgcct

SEQ ID NO: 17470 - DNA, 20 bp, Artificial Sequence
  chemically synthesized
ttctcctgcctcagcctccc

SEQ ID NO: 17471 - DNA, 20 bp, Artificial Sequence
  chemically synthesized
tcctgcctcagcctcccgag

SEQ ID NO: 17472 - DNA, 20 bp, Artificial Sequence
  chemically synthesized
gcctcagcctcccgagtagc

SEQ ID NO: 17473 - DNA, 20 bp, Artificial Sequence
  chemically synthesized
cctcagcctcccgagtagct

SEQ ID NO: 17474 - DNA, 20 bp, Artificial Sequence
  chemically synthesized
ctcccgagtagctgggacta

SEQ ID NO: 17475 - DNA, 20 bp, Artificial Sequence
  chemically synthesized
tcccgagtagctgggactac

SEQ ID NO: 17476 - DNA, 20 bp, Artificial Sequence
  chemically synthesized
caggcgcctgccaccacgtc

SEQ ID NO: 17477 - DNA, 20 bp, Artificial Sequence
  chemically synthesized
tggctaattttttgtatttt

SEQ ID NO: 17478 - DNA, 20 bp, Artificial Sequence
  chemically synthesized
ctaattttttgtatttttag

SEQ ID NO: 17479 - DNA, 20 bp, Artificial Sequence
  chemically synthesized
aattttttgtatttttagta

SEQ ID NO: 17480 - DNA, 20 bp, Artificial Sequence
  chemically synthesized
ttttgtatttttagtagaga

SEQ ID NO: 17481 - DNA, 20 bp, Artificial Sequence
  chemically synthesized
tttgtatttttagtagagat

SEQ ID NO: 17482 - DNA, 20 bp, Artificial Sequence
  chemically synthesized
ttgtatttttagtagagatg

SEQ ID NO: 17483 - DNA, 20 bp, Artificial Sequence
  chemically synthesized
gagatggggtttcaccatgt

SEQ ID NO: 17484 - DNA, 20 bp, Artificial Sequence
  chemically synthesized
tggggtttcaccatgttagc

SEQ ID NO: 17485 - DNA, 20 bp, Artificial Sequence
  chemically synthesized
ggggtttcaccatgttagcc

SEQ ID NO: 17486 - DNA, 20 bp, Artificial Sequence
  chemically synthesized
tttcaccatgttagccagga

SEQ ID NO: 17487 - DNA, 20 bp, Artificial Sequence
  chemically synthesized
acctcatgatctgcccgcct

SEQ ID NO: 17488 - DNA, 20 bp, Artificial Sequence
  chemically synthesized
ctgcccgccttggcctccca

SEQ ID NO: 17489 - DNA, 20 bp, Artificial Sequence
  chemically synthesized
gccttggcctcccacagtgc

SEQ ID NO: 17490 - DNA, 20 bp, Artificial Sequence
  chemically synthesized
ccttggcctcccacagtgct

SEQ ID NO: 17491 - DNA, 20 bp, Artificial Sequence
  chemically synthesized
ctcccacagtgctgggattc

SEQ ID NO: 17492 - DNA, 20 bp, Artificial Sequence
  chemically synthesized
tcccacagtgctgggattcc

SEQ ID NO: 17493 - DNA, 20 bp, Artificial Sequence
  chemically synthesized
agtgctgggattccaggcgt

SEQ ID NO: 17494 - DNA, 20 bp, Artificial Sequence
  chemically synthesized
gggattccaggcgtgagcca

SEQ ID NO: 17495 - DNA, 20 bp, Artificial Sequence
  chemically synthesized
caggcgtgagccacggcgcc

SEQ ID NO: 17496 - DNA, 20 bp, Artificial Sequence
  chemically synthesized
cgtgagccacggcgcctggc

SEQ ID NO: 17497 - DNA, 20 bp, Artificial Sequence
  chemically synthesized
gccagtgtgttttttcattt

SEQ ID NO: 17498 - DNA, 20 bp, Artificial Sequence
  chemically synthesized
ttttttcatttcagacattg

SEQ ID NO: 17499 - DNA, 20 bp, Artificial Sequence
  chemically synthesized
gacattgtagtttttatctc

SEQ ID NO: 17500 - DNA, 20 bp, Artificial Sequence
  chemically synthesized
attgtagtttttatctctag

SEQ ID NO: 17501 - DNA, 20 bp, Artificial Sequence
  chemically synthesized
tttatctctagaagttcacc

SEQ ID NO: 17502 - DNA, 20 bp, Artificial Sequence
  chemically synthesized
ttatctctagaagttcacct

SEQ ID NO: 17503 - DNA, 20 bp, Artificial Sequence
  chemically synthesized
tatctctagaagttcacctg

SEQ ID NO: 17504 - DNA, 20 bp, Artificial Sequence
  chemically synthesized
acttaattttttgaacataa

SEQ ID NO: 17505 - DNA, 20 bp, Artificial Sequence
  chemically synthesized
cttaattttttgaacataat

SEQ ID NO: 17506 - DNA, 20 bp, Artificial Sequence
  chemically synthesized
tttttgaacataatgggata

SEQ ID NO: 17507 - DNA, 20 bp, Artificial Sequence
  chemically synthesized
ccatccttgcctgctaattc

SEQ ID NO: 17508 - DNA, 20 bp, Artificial Sequence
  chemically synthesized
gctaattctagcatccgtgt

SEQ ID NO: 17509 - DNA, 20 bp, Artificial Sequence
  chemically synthesized
tctagcatccgtgtcagttc

SEQ ID NO: 17510 - DNA, 20 bp, Artificial Sequence
  chemically synthesized
catgccttgtaatctttgat

SEQ ID NO: 17511 - DNA, 20 bp, Artificial Sequence
  chemically synthesized
tgtaatctttgattggctgc

SEQ ID NO: 17512 - DNA, 20 bp, Artificial Sequence
  chemically synthesized
cattgtcaatttcaccttgt

SEQ ID NO: 17513 - DNA, 20 bp, Artificial Sequence
  chemically synthesized
attgtcaatttcaccttgtt

SEQ ID NO: 17514 - DNA, 20 bp, Artificial Sequence
  chemically synthesized
aatttcaccttgttgggtgc

SEQ ID NO: 17515 - DNA, 20 bp, Artificial Sequence
  chemically synthesized
gtattcctctaaatgttctt

SEQ ID NO: 17516 - DNA, 20 bp, Artificial Sequence
  chemically synthesized
aatgttcttgagctttgctc

SEQ ID NO: 17517 - DNA, 20 bp, Artificial Sequence
  chemically synthesized
atgttcttgagctttgctcc

SEQ ID NO: 17518 - DNA, 20 bp, Artificial Sequence
  chemically synthesized
ttgagctttgctccgggatg

SEQ ID NO: 17519 - DNA, 20 bp, Artificial Sequence
  chemically synthesized
ctttgctccgggatgcagtt

SEQ ID NO: 17520 - DNA, 20 bp, Artificial Sequence
  chemically synthesized
cgggatgcagttaagcaact

SEQ ID NO: 17521 - DNA, 20 bp, Artificial Sequence
  chemically synthesized
ggatgcagttaagcaactta

SEQ ID NO: 17522 - DNA, 20 bp, Artificial Sequence
  chemically synthesized
gcagttaagcaacttagagt

SEQ ID NO: 17523 - DNA, 20 bp, Artificial Sequence
  chemically synthesized
gtttgaactcttaattgttt

SEQ ID NO: 17524 - DNA, 20 bp, Artificial Sequence
  chemically synthesized
cttaattgttttggtctcct

SEQ ID NO: 17525 - DNA, 20 bp, Artificial Sequence
  chemically synthesized
ttttggtctcctcggactct

SEQ ID NO: 17526 - DNA, 20 bp, Artificial Sequence
  chemically synthesized
tcagctccatctcctcaacg

SEQ ID NO: 17527 - DNA, 20 bp, Artificial Sequence
  chemically synthesized
cagctccatctcctcaacgt

SEQ ID NO: 17528 - DNA, 20 bp, Artificial Sequence
  chemically synthesized
agctccatctcctcaacgtg

SEQ ID NO: 17529 - DNA, 20 bp, Artificial Sequence
  chemically synthesized
ctccatctcctcaacgtggg

SEQ ID NO: 17530 - DNA, 20 bp, Artificial Sequence
  chemically synthesized
cctcaacgtggggagtctct

SEQ ID NO: 17531 - DNA, 20 bp, Artificial Sequence
  chemically synthesized
ctcaacgtggggagtctctt

SEQ ID NO: 17532 - DNA, 20 bp, Artificial Sequence
  chemically synthesized
ggagtctcttgggctctgcc

SEQ ID NO: 17533 - DNA, 20 bp, Artificial Sequence
  chemically synthesized
ctgcctggacttccctttcc

SEQ ID NO: 17534 - DNA, 20 bp, Artificial Sequence
  chemically synthesized
ctttcctggcctgtaacctg

SEQ ID NO: 17535 - DNA, 20 bp, Artificial Sequence
  chemically synthesized
acctgcagactctctccaaa

SEQ ID NO: 17536 - DNA, 20 bp, Artificial Sequence
  chemically synthesized
gcagactctctccaaacagt

SEQ ID NO: 17537 - DNA, 20 bp, Artificial Sequence
  chemically synthesized
actctctccaaacagtaagc

SEQ ID NO: 17538 - DNA, 20 bp, Artificial Sequence
  chemically synthesized
ctctctccaaacagtaagct

SEQ ID NO: 17539 - DNA, 20 bp, Artificial Sequence
  chemically synthesized
tctctccaaacagtaagctg

SEQ ID NO: 17540 - DNA, 20 bp, Artificial Sequence
  chemically synthesized
aaacagtaagctggggtgat

SEQ ID NO: 17541 - DNA, 20 bp, Artificial Sequence
  chemically synthesized
acagtaagctggggtgatcg

SEQ ID NO: 17542 - DNA, 20 bp, Artificial Sequence
  chemically synthesized
cagtaagctggggtgatcgg

SEQ ID NO: 17543 - DNA, 20 bp, Artificial Sequence
  chemically synthesized
agtaagctggggtgatcgga

SEQ ID NO: 17544 - DNA, 20 bp, Artificial Sequence
  chemically synthesized
gttgtttgcttcttatccct

SEQ ID NO: 17545 - DNA, 20 bp, Artificial Sequence
  chemically synthesized
ttgtttgcttcttatccctc

SEQ ID NO: 17546 - DNA, 20 bp, Artificial Sequence
  chemically synthesized
tgtttgcttcttatccctca

SEQ ID NO: 17547 - DNA, 20 bp, Artificial Sequence
  chemically synthesized
actcctccttgcctgatgtc

SEQ ID NO: 17548 - DNA, 20 bp, Artificial Sequence
  chemically synthesized
tcctccttgcctgatgtcca

SEQ ID NO: 17549 - DNA, 20 bp, Artificial Sequence
  chemically synthesized
cctgatgtccagagtcttga

SEQ ID NO: 17550 - DNA, 20 bp, Artificial Sequence
  chemically synthesized
ttgaaagctgccatgttcta

SEQ ID NO: 17551 - DNA, 20 bp, Artificial Sequence
  chemically synthesized
gtttttgttttgattgtttc

SEQ ID NO: 17552 - DNA, 20 bp, Artificial Sequence
  chemically synthesized
tttttgttttgattgtttct

SEQ ID NO: 17553 - DNA, 20 bp, Artificial Sequence
  chemically synthesized
ttttgttttgattgtttctg

SEQ ID NO: 17554 - DNA, 20 bp, Artificial Sequence
  chemically synthesized
ttgttttgattgtttctggg

SEQ ID NO: 17555 - DNA, 20 bp, Artificial Sequence
  chemically synthesized
gttttgattgtttctgggga

SEQ ID NO: 17556 - DNA, 20 bp, Artificial Sequence
  chemically synthesized
ttgattgtttctggggagag

SEQ ID NO: 17557 - DNA, 20 bp, Artificial Sequence
  chemically synthesized
gagaagaactcttcccatct

SEQ ID NO: 17558 - DNA, 20 bp, Artificial Sequence
  chemically synthesized
agaagaactcttcccatctt

SEQ ID NO: 17559 - DNA, 20 bp, Artificial Sequence
  chemically synthesized
agaactcttcccatcttggg

SEQ ID NO: 17560 - DNA, 20 bp, Artificial Sequence
  chemically synthesized
ttatgttcaaacttttgcct

SEQ ID NO: 17561 - DNA, 20 bp, Artificial Sequence
  chemically synthesized
tgttcaaacttttgcctaag

SEQ ID NO: 17562 - DNA, 20 bp, Artificial Sequence
  chemically synthesized
tttaactcatctaattatcc

SEQ ID NO: 17563 - DNA, 20 bp, Artificial Sequence
  chemically synthesized
aattatccgagcaatccaat

SEQ ID NO: 17564 - DNA, 20 bp, Artificial Sequence
  chemically synthesized
attatccgagcaatccaatc

SEQ ID NO: 17565 - DNA, 20 bp, Artificial Sequence
  chemically synthesized
atccgagcaatccaatcggg

SEQ ID NO: 17566 - DNA, 20 bp, Artificial Sequence
  chemically synthesized
gtgatctccattttacacac

SEQ ID NO: 17567 - DNA, 20 bp, Artificial Sequence
  chemically synthesized
ccattttacacacgagaaaa

SEQ ID NO: 17568 - DNA, 20 bp, Artificial Sequence
  chemically synthesized
ttttacacacgagaaaatgg

SEQ ID NO: 17569 - DNA, 20 bp, Artificial Sequence
  chemically synthesized
cacacgagaaaatggaagca

SEQ ID NO: 17570 - DNA, 20 bp, Artificial Sequence
  chemically synthesized
cacgagaaaatggaagcatg

SEQ ID NO: 17571 - DNA, 20 bp, Artificial Sequence
  chemically synthesized
agcatggagaaattgaatgc

SEQ ID NO: 17572 - DNA, 20 bp, Artificial Sequence
  chemically synthesized
tgaatgctggtgcatgatct

SEQ ID NO: 17573 - DNA, 20 bp, Artificial Sequence
  chemically synthesized
aatgctggtgcatgatctca

SEQ ID NO: 17574 - DNA, 20 bp, Artificial Sequence
  chemically synthesized
tgcatgatctcagagctacc

SEQ ID NO: 17575 - DNA, 20 bp, Artificial Sequence
  chemically synthesized
catgatctcagagctacctg

SEQ ID NO: 17576 - DNA, 20 bp, Artificial Sequence
  chemically synthesized
atgatctcagagctacctgg

SEQ ID NO: 17577 - DNA, 20 bp, Artificial Sequence
  chemically synthesized
ctcagagctacctggaggca

SEQ ID NO: 17578 - DNA, 20 bp, Artificial Sequence
  chemically synthesized
gagctacctggaggcacagc

SEQ ID NO: 17579 - DNA, 20 bp, Artificial Sequence
  chemically synthesized
agctacctggaggcacagct

SEQ ID NO: 17580 - DNA, 20 bp, Artificial Sequence
  chemically synthesized
ggcacagctgggctaccctg

SEQ ID NO: 17581 - DNA, 20 bp, Artificial Sequence
  chemically synthesized
gcacagctgggctaccctgt

SEQ ID NO: 17582 - DNA, 20 bp, Artificial Sequence
  chemically synthesized
cagctgggctaccctgtggg

SEQ ID NO: 17583 - DNA, 20 bp, Artificial Sequence
  chemically synthesized
gggctaccctgtgggcagtc

SEQ ID NO: 17584 - DNA, 20 bp, Artificial Sequence
  chemically synthesized
ccctgtgggcagtctggttt

SEQ ID NO: 17585 - DNA, 20 bp, Artificial Sequence
  chemically synthesized
cctgtgggcagtctggtttc

SEQ ID NO: 17586 - DNA, 20 bp, Artificial Sequence
  chemically synthesized
ctgtgggcagtctggtttca

SEQ ID NO: 17587 - DNA, 20 bp, Artificial Sequence
  chemically synthesized
tgggcagtctggtttcaggg

SEQ ID NO: 17588 - DNA, 20 bp, Artificial Sequence
  chemically synthesized
ctggtttcagggtggatata

SEQ ID NO: 17589 - DNA, 20 bp, Artificial Sequence
  chemically synthesized
tggatatacagacacgttgc

SEQ ID NO: 17590 - DNA, 20 bp, Artificial Sequence
  chemically synthesized
ggatatacagacacgttgct

SEQ ID NO: 17591 - DNA, 20 bp, Artificial Sequence
  chemically synthesized
gacacgttgctgggctgacc

SEQ ID NO: 17592 - DNA, 20 bp, Artificial Sequence
  chemically synthesized
ttgctgggctgacccagcat

SEQ ID NO: 17593 - DNA, 20 bp, Artificial Sequence
  chemically synthesized
tgctgggctgacccagcatt

SEQ ID NO: 17594 - DNA, 20 bp, Artificial Sequence
  chemically synthesized
ctgggctgacccagcattgg

SEQ ID NO: 17595 - DNA, 20 bp, Artificial Sequence
  chemically synthesized
acccagcattgggagttgat

SEQ ID NO: 17596 - DNA, 20 bp, Artificial Sequence
  chemically synthesized
agcattgggagttgataagt

SEQ ID NO: 17597 - DNA, 20 bp, Artificial Sequence
  chemically synthesized
tgggagttgataagtcggac

SEQ ID NO: 17598 - DNA, 20 bp, Artificial Sequence
  chemically synthesized
gggagttgataagtcggact

SEQ ID NO: 17599 - DNA, 20 bp, Artificial Sequence
  chemically synthesized
agttgataagtcggactggg

SEQ ID NO: 17600 - DNA, 20 bp, Artificial Sequence
  chemically synthesized
tgataagtcggactgggaag

SEQ ID NO: 17601 - DNA, 20 bp, Artificial Sequence
  chemically synthesized
gataagtcggactgggaagc

SEQ ID NO: 17602 - DNA, 20 bp, Artificial Sequence
  chemically synthesized
agtcggactgggaagcagga

SEQ ID NO: 17603 - DNA, 20 bp, Artificial Sequence
  chemically synthesized
gtcggactgggaagcaggac

SEQ ID NO: 17604 - DNA, 20 bp, Artificial Sequence
  chemically synthesized
gaagcaggacaggaccctct

SEQ ID NO: 17605 - DNA, 20 bp, Artificial Sequence
  chemically synthesized
gcaggacaggaccctctgag

SEQ ID NO: 17606 - DNA, 20 bp, Artificial Sequence
  chemically synthesized
aggacaggaccctctgagtg

SEQ ID NO: 17607 - DNA, 20 bp, Artificial Sequence
  chemically synthesized
ggacaggaccctctgagtgg

SEQ ID NO: 17608 - DNA, 20 bp, Artificial Sequence
  chemically synthesized
gacaggaccctctgagtgga

SEQ ID NO: 17609 - DNA, 20 bp, Artificial Sequence
  chemically synthesized
cctctgagtggagggtgctg

SEQ ID NO: 17610 - DNA, 20 bp, Artificial Sequence
  chemically synthesized
tgagtggagggtgctgaaga

SEQ ID NO: 17611 - DNA, 20 bp, Artificial Sequence
  chemically synthesized
gtggagggtgctgaagacag

SEQ ID NO: 17612 - DNA, 20 bp, Artificial Sequence
  chemically synthesized
agggtgctgaagacagcagt

SEQ ID NO: 17613 - DNA, 20 bp, Artificial Sequence
  chemically synthesized
gggtgctgaagacagcagtc

SEQ ID NO: 17614 - DNA, 20 bp, Artificial Sequence
  chemically synthesized
ggtgctgaagacagcagtca

SEQ ID NO: 17615 - DNA, 20 bp, Artificial Sequence
  chemically synthesized
gaagacagcagtcagggact

SEQ ID NO: 17616 - DNA, 20 bp, Artificial Sequence
  chemically synthesized
agcagtcagggactcagcca

SEQ ID NO: 17617 - DNA, 20 bp, Artificial Sequence
  chemically synthesized
cagtcagggactcagccatg

SEQ ID NO: 17618 - DNA, 20 bp, Artificial Sequence
  chemically synthesized
agtcagggactcagccatgg

SEQ ID NO: 17619 - DNA, 20 bp, Artificial Sequence
  chemically synthesized
gtcagggactcagccatgga

SEQ ID NO: 17620 - DNA, 20 bp, Artificial Sequence
  chemically synthesized
gggactcagccatggagggc

SEQ ID NO: 17621 - DNA, 20 bp, Artificial Sequence
  chemically synthesized
tcagccatggagggccagct

SEQ ID NO: 17622 - DNA, 20 bp, Artificial Sequence
  chemically synthesized
gccatggagggccagcttgg

SEQ ID NO: 17623 - DNA, 20 bp, Artificial Sequence
  chemically synthesized
ccatggagggccagcttggt

SEQ ID NO: 17624 - DNA, 20 bp, Artificial Sequence
  chemically synthesized
catggagggccagcttggtg

SEQ ID NO: 17625 - DNA, 20 bp, Artificial Sequence
  chemically synthesized
cagcttggtggggaacaccg

SEQ ID NO: 17626 - DNA, 20 bp, Artificial Sequence
  chemically synthesized
ggtggggaacaccgtggtca

SEQ ID NO: 17627 - DNA, 20 bp, Artificial Sequence
  chemically synthesized
tggggaacaccgtggtcatg

SEQ ID NO: 17628 - DNA, 20 bp, Artificial Sequence
  chemically synthesized
ccgtggtcatggagcgcttc

SEQ ID NO: 17629 - DNA, 20 bp, Artificial Sequence
  chemically synthesized
ggtcatggagcgcttctgga

SEQ ID NO: 17630 - DNA, 20 bp, Artificial Sequence
  chemically synthesized
tcatggagcgcttctggatg

SEQ ID NO: 17631 - DNA, 20 bp, Artificial Sequence
  chemically synthesized
atggagcgcttctggatgga

SEQ ID NO: 17632 - DNA, 20 bp, Artificial Sequence
  chemically synthesized
tggagcgcttctggatggag

SEQ ID NO: 17633 - DNA, 20 bp, Artificial Sequence
  chemically synthesized
tctggatggagaggaatgca

SEQ ID NO: 17634 - DNA, 20 bp, Artificial Sequence
  chemically synthesized
ctggatggagaggaatgcaa

SEQ ID NO: 17635 - DNA, 20 bp, Artificial Sequence
  chemically synthesized
ggagaggaatgcaaaggcct

SEQ ID NO: 17636 - DNA, 20 bp, Artificial Sequence
  chemically synthesized
agaggaatgcaaaggccttg

SEQ ID NO: 17637 - DNA, 20 bp, Artificial Sequence
  chemically synthesized
gaggaatgcaaaggccttgg

SEQ ID NO: 17638 - DNA, 20 bp, Artificial Sequence
  chemically synthesized
gaatgcaaaggccttggagg

SEQ ID NO: 17639 - DNA, 20 bp, Artificial Sequence
  chemically synthesized
aatgcaaaggccttggagga

SEQ ID NO: 17640 - DNA, 20 bp, Artificial Sequence
  chemically synthesized
atgcaaaggccttggaggaa

SEQ ID NO: 17641 - DNA, 20 bp, Artificial Sequence
  chemically synthesized
tgcaaaggccttggaggaag

SEQ ID NO: 17642 - DNA, 20 bp, Artificial Sequence
  chemically synthesized
aaaggccttggaggaagggg

SEQ ID NO: 17643 - DNA, 20 bp, Artificial Sequence
  chemically synthesized
aaggccttggaggaaggggt

SEQ ID NO: 17644 - DNA, 20 bp, Artificial Sequence
  chemically synthesized
aggccttggaggaaggggtg

SEQ ID NO: 17645 - DNA, 20 bp, Artificial Sequence
  chemically synthesized
ggccttggaggaaggggtgg

SEQ ID NO: 17646 - DNA, 20 bp, Artificial Sequence
  chemically synthesized
cttggaggaaggggtggggg

SEQ ID NO: 17647 - DNA, 20 bp, Artificial Sequence
  chemically synthesized
gaggaaggggtgggggcagt

SEQ ID NO: 17648 - DNA, 20 bp, Artificial Sequence
  chemically synthesized
ggaaggggtgggggcagtga

SEQ ID NO: 17649 - DNA, 20 bp, Artificial Sequence
  chemically synthesized
gaaggggtgggggcagtgag

SEQ ID NO: 17650 - DNA, 20 bp, Artificial Sequence
  chemically synthesized
aaggggtgggggcagtgaga

SEQ ID NO: 17651 - DNA, 20 bp, Artificial Sequence
  chemically synthesized
ggggtgggggcagtgagagg

SEQ ID NO: 17652 - DNA, 20 bp, Artificial Sequence
  chemically synthesized
gggtgggggcagtgagaggg

SEQ ID NO: 17653 - DNA, 20 bp, Artificial Sequence
  chemically synthesized
ggtgggggcagtgagaggga

SEQ ID NO: 17654 - DNA, 20 bp, Artificial Sequence
  chemically synthesized
gggggcagtgagagggaggg

SEQ ID NO: 17655 - DNA, 20 bp, Artificial Sequence
  chemically synthesized
ggggcagtgagagggagggt

SEQ ID NO: 17656 - DNA, 20 bp, Artificial Sequence
  chemically synthesized
gggcagtgagagggagggtg

SEQ ID NO: 17657 - DNA, 20 bp, Artificial Sequence
  chemically synthesized
agggagggtggggctgtgct

SEQ ID NO: 17658 - DNA, 20 bp, Artificial Sequence
  chemically synthesized
ggagggtggggctgtgctca

SEQ ID NO: 17659 - DNA, 20 bp, Artificial Sequence
  chemically synthesized
gggtggggctgtgctcagag

SEQ ID NO: 17660 - DNA, 20 bp, Artificial Sequence
  chemically synthesized
ggtggggctgtgctcagagc

SEQ ID NO: 17661 - DNA, 20 bp, Artificial Sequence
  chemically synthesized
tggggctgtgctcagagcgg

SEQ ID NO: 17662 - DNA, 20 bp, Artificial Sequence
  chemically synthesized
ggctgtgctcagagcgggag

SEQ ID NO: 17663 - DNA, 20 bp, Artificial Sequence
  chemically synthesized
gctgtgctcagagcgggagt

SEQ ID NO: 17664 - DNA, 20 bp, Artificial Sequence
  chemically synthesized
gtgctcagagcgggagtggg

SEQ ID NO: 17665 - DNA, 20 bp, Artificial Sequence
  chemically synthesized
ctcagagcgggagtgggcag

SEQ ID NO: 17666 - DNA, 20 bp, Artificial Sequence
  chemically synthesized
cagagcgggagtgggcagtg

SEQ ID NO: 17667 - DNA, 20 bp, Artificial Sequence
  chemically synthesized
agagcgggagtgggcagtgg

SEQ ID NO: 17668 - DNA, 20 bp, Artificial Sequence
  chemically synthesized
ggagtgggcagtggaggtgt

SEQ ID NO: 17669 - DNA, 20 bp, Artificial Sequence
  chemically synthesized
agtgggcagtggaggtgtca

SEQ ID NO: 17670 - DNA, 20 bp, Artificial Sequence
  chemically synthesized
gtgggcagtggaggtgtcag

SEQ ID NO: 17671 - DNA, 20 bp, Artificial Sequence
  chemically synthesized
ggaggtgtcagaggcctccc

SEQ ID NO: 17672 - DNA, 20 bp, Artificial Sequence
  chemically synthesized
gaggtgtcagaggcctccct

SEQ ID NO: 17673 - DNA, 20 bp, Artificial Sequence
  chemically synthesized
agaggcctccctgggtcaaa

SEQ ID NO: 17674 - DNA, 20 bp, Artificial Sequence
  chemically synthesized
gaggcctccctgggtcaaat

SEQ ID NO: 17675 - DNA, 20 bp, Artificial Sequence
  chemically synthesized
aggcctccctgggtcaaatg

SEQ ID NO: 17676 - DNA, 20 bp, Artificial Sequence
  chemically synthesized
cctgggtcaaatggggtcct

SEQ ID NO: 17677 - DNA, 20 bp, Artificial Sequence
  chemically synthesized
gtcaaatggggtcctgagtg

SEQ ID NO: 17678 - DNA, 20 bp, Artificial Sequence
  chemically synthesized
tggggtcctgagtgtggctg

SEQ ID NO: 17679 - DNA, 20 bp, Artificial Sequence
  chemically synthesized
ggtcctgagtgtggctgcag

SEQ ID NO: 17680 - DNA, 20 bp, Artificial Sequence
  chemically synthesized
gtcctgagtgtggctgcagt

SEQ ID NO: 17681 - DNA, 20 bp, Artificial Sequence
  chemically synthesized
tcctgagtgtggctgcagtg

SEQ ID NO: 17682 - DNA, 20 bp, Artificial Sequence
  chemically synthesized
tgagtgtggctgcagtgggg

SEQ ID NO: 17683 - DNA, 20 bp, Artificial Sequence
  chemically synthesized
gagtgtggctgcagtgggga

SEQ ID NO: 17684 - DNA, 20 bp, Artificial Sequence
  chemically synthesized
tgtggctgcagtggggaagg

SEQ ID NO: 17685 - DNA, 20 bp, Artificial Sequence
  chemically synthesized
ggctgcagtggggaaggtgg

SEQ ID NO: 17686 - DNA, 20 bp, Artificial Sequence
  chemically synthesized
gtggggaaggtggaagtcac

SEQ ID NO: 17687 - DNA, 20 bp, Artificial Sequence
  chemically synthesized
tggaagtcactggtgtgaaa

SEQ ID NO: 17688 - DNA, 20 bp, Artificial Sequence
  chemically synthesized
tcactggtgtgaaaaagatg

SEQ ID NO: 17689 - DNA, 20 bp, Artificial Sequence
  chemically synthesized
actggtgtgaaaaagatgaa

SEQ ID NO: 17690 - DNA, 20 bp, Artificial Sequence
  chemically synthesized
gtgaaaaagatgaagagtta

SEQ ID NO: 17691 - DNA, 20 bp, Artificial Sequence
  chemically synthesized
aaaagatgaagagttatgga

SEQ ID NO: 17692 - DNA, 20 bp, Artificial Sequence
  chemically synthesized
gagttatggacagtcactta

SEQ ID NO: 17693 - DNA, 20 bp, Artificial Sequence
  chemically synthesized
agttatggacagtcacttac

SEQ ID NO: 17694 - DNA, 20 bp, Artificial Sequence
  chemically synthesized
gttatggacagtcacttaca

SEQ ID NO: 17695 - DNA, 20 bp, Artificial Sequence
  chemically synthesized
ttatggacagtcacttacag

SEQ ID NO: 17696 - DNA, 20 bp, Artificial Sequence
  chemically synthesized
tggacagtcacttacagggg

SEQ ID NO: 17697 - DNA, 20 bp, Artificial Sequence
  chemically synthesized
tacaggggcagtgtctgact

SEQ ID NO: 17698 - DNA, 20 bp, Artificial Sequence
  chemically synthesized
acaggggcagtgtctgactc

SEQ ID NO: 17699 - DNA, 20 bp, Artificial Sequence
  chemically synthesized
gggcagtgtctgactcagga

SEQ ID NO: 17700 - DNA, 20 bp, Artificial Sequence
  chemically synthesized
cagtgtctgactcaggacag

SEQ ID NO: 17701 - DNA, 20 bp, Artificial Sequence
  chemically synthesized
tgtctgactcaggacagtgg

SEQ ID NO: 17702 - DNA, 20 bp, Artificial Sequence
  chemically synthesized
gtctgactcaggacagtggc

SEQ ID NO: 17703 - DNA, 20 bp, Artificial Sequence
  chemically synthesized
tgactcaggacagtggcagg

SEQ ID NO: 17704 - DNA, 20 bp, Artificial Sequence
  chemically synthesized
gacagtggcaggaagtgacc

SEQ ID NO: 17705 - DNA, 20 bp, Artificial Sequence
  chemically synthesized
acagtggcaggaagtgacct

SEQ ID NO: 17706 - DNA, 20 bp, Artificial Sequence
  chemically synthesized
cagtggcaggaagtgacctg

SEQ ID NO: 17707 - DNA, 20 bp, Artificial Sequence
  chemically synthesized
gtggcaggaagtgacctggg

SEQ ID NO: 17708 - DNA, 20 bp, Artificial Sequence
  chemically synthesized
tggcaggaagtgacctgggg

SEQ ID NO: 17709 - DNA, 20 bp, Artificial Sequence
  chemically synthesized
caggaagtgacctggggagg

SEQ ID NO: 17710 - DNA, 20 bp, Artificial Sequence
  chemically synthesized
tgacctggggaggaagattc

SEQ ID NO: 17711 - DNA, 20 bp, Artificial Sequence
  chemically synthesized
gacctggggaggaagattct

SEQ ID NO: 17712 - DNA, 20 bp, Artificial Sequence
  chemically synthesized
aagattctgggcccctgact

SEQ ID NO: 17713 - DNA, 20 bp, Artificial Sequence
  chemically synthesized
ggcccctgactgagcctccc

SEQ ID NO: 17714 - DNA, 20 bp, Artificial Sequence
  chemically synthesized
gcccctgactgagcctcccc

SEQ ID NO: 17715 - DNA, 20 bp, Artificial Sequence
  chemically synthesized
gactgagcctccccaggatg

SEQ ID NO: 17716 - DNA, 20 bp, Artificial Sequence
  chemically synthesized
tccccaggatgtggtcctgc

SEQ ID NO: 17717 - DNA, 20 bp, Artificial Sequence
  chemically synthesized
ccccaggatgtggtcctgct

SEQ ID NO: 17718 - DNA, 20 bp, Artificial Sequence
  chemically synthesized
aggatgtggtcctgctgggt

SEQ ID NO: 17719 - DNA, 20 bp, Artificial Sequence
  chemically synthesized
ggatgtggtcctgctgggtc

SEQ ID NO: 17720 - DNA, 20 bp, Artificial Sequence
  chemically synthesized
gatgtggtcctgctgggtcg

SEQ ID NO: 17721 - DNA, 20 bp, Artificial Sequence
  chemically synthesized
atgtggtcctgctgggtcgg

SEQ ID NO: 17722 - DNA, 20 bp, Artificial Sequence
  chemically synthesized
tgtggtcctgctgggtcggg

SEQ ID NO: 17723 - DNA, 20 bp, Artificial Sequence
  chemically synthesized
cctgctgggtcggggggtga

SEQ ID NO: 17724 - DNA, 20 bp, Artificial Sequence
  chemically synthesized
ctgctgggtcggggggtgat

SEQ ID NO: 17725 - DNA, 20 bp, Artificial Sequence
  chemically synthesized
ggtcggggggtgataggaat

SEQ ID NO: 17726 - DNA, 20 bp, Artificial Sequence
  chemically synthesized
cggggggtgataggaatgag

SEQ ID NO: 17727 - DNA, 20 bp, Artificial Sequence
  chemically synthesized
ggtgataggaatgagaagac

SEQ ID NO: 17728 - DNA, 20 bp, Artificial Sequence
  chemically synthesized
gtgataggaatgagaagaca

SEQ ID NO: 17729 - DNA, 20 bp, Artificial Sequence
  chemically synthesized
ataggaatgagaagacaagg

SEQ ID NO: 17730 - DNA, 20 bp, Artificial Sequence
  chemically synthesized
tgagaagacaaggaagtcca

SEQ ID NO: 17731 - DNA, 20 bp, Artificial Sequence
  chemically synthesized
agaagacaaggaagtccaca

SEQ ID NO: 17732 - DNA, 20 bp, Artificial Sequence
  chemically synthesized
gacaaggaagtccacagagt

SEQ ID NO: 17733 - DNA, 20 bp, Artificial Sequence
  chemically synthesized
acaaggaagtccacagagtc

SEQ ID NO: 17734 - DNA, 20 bp, Artificial Sequence
  chemically synthesized
caaggaagtccacagagtca

SEQ ID NO: 17735 - DNA, 20 bp, Artificial Sequence
  chemically synthesized
agtccacagagtcagggtcc

SEQ ID NO: 17736 - DNA, 20 bp, Artificial Sequence
  chemically synthesized
gtccacagagtcagggtcca

SEQ ID NO: 17737 - DNA, 20 bp, Artificial Sequence
  chemically synthesized
cagagtcagggtccaaggcc

SEQ ID NO: 17738 - DNA, 20 bp, Artificial Sequence
  chemically synthesized
agtcagggtccaaggcctag

SEQ ID NO: 17739 - DNA, 20 bp, Artificial Sequence
  chemically synthesized
gtcagggtccaaggcctaga

SEQ ID NO: 17740 - DNA, 20 bp, Artificial Sequence
  chemically synthesized
cctagaaggtgttctgtttg

SEQ ID NO: 17741 - DNA, 20 bp, Artificial Sequence
  chemically synthesized
ctagaaggtgttctgtttgc

SEQ ID NO: 17742 - DNA, 20 bp, Artificial Sequence
  chemically synthesized
gaaggtgttctgtttgcagg

SEQ ID NO: 17743 - DNA, 20 bp, Artificial Sequence
  chemically synthesized
gtttgcaggtggatgctgca

SEQ ID NO: 17744 - DNA, 20 bp, Artificial Sequence
  chemically synthesized
ttgcaggtggatgctgcaaa

SEQ ID NO: 17745 - DNA, 20 bp, Artificial Sequence
  chemically synthesized
gcaggtggatgctgcaaaga

SEQ ID NO: 17746 - DNA, 20 bp, Artificial Sequence
  chemically synthesized
caggtggatgctgcaaagag

SEQ ID NO: 17747 - DNA, 20 bp, Artificial Sequence
  chemically synthesized
ggtggatgctgcaaagagag

SEQ ID NO: 17748 - DNA, 20 bp, Artificial Sequence
  chemically synthesized
atgctgcaaagagaggagct

SEQ ID NO: 17749 - DNA, 20 bp, Artificial Sequence
  chemically synthesized
tgctgcaaagagaggagctc

SEQ ID NO: 17750 - DNA, 20 bp, Artificial Sequence
  chemically synthesized
gctgcaaagagaggagctca

SEQ ID NO: 17751 - DNA, 20 bp, Artificial Sequence
  chemically synthesized
caaagagaggagctcagggc

SEQ ID NO: 17752 - DNA, 20 bp, Artificial Sequence
  chemically synthesized
aaagagaggagctcagggct

SEQ ID NO: 17753 - DNA, 20 bp, Artificial Sequence
  chemically synthesized
gagctcagggctgggacaac

SEQ ID NO: 17754 - DNA, 20 bp, Artificial Sequence
  chemically synthesized
gctcagggctgggacaactg

SEQ ID NO: 17755 - DNA, 20 bp, Artificial Sequence
  chemically synthesized
tgggacaactggagctgctc

SEQ ID NO: 17756 - DNA, 20 bp, Artificial Sequence
  chemically synthesized
gggacaactggagctgctct

SEQ ID NO: 17757 - DNA, 20 bp, Artificial Sequence
  chemically synthesized
aactggagctgctctgggtc

SEQ ID NO: 17758 - DNA, 20 bp, Artificial Sequence
  chemically synthesized
ctggagctgctctgggtctg

SEQ ID NO: 17759 - DNA, 20 bp, Artificial Sequence
  chemically synthesized
tggagctgctctgggtctgg

SEQ ID NO: 17760 - DNA, 20 bp, Artificial Sequence
  chemically synthesized
agctgctctgggtctggagg

SEQ ID NO: 17761 - DNA, 20 bp, Artificial Sequence
  chemically synthesized
tgctctgggtctggaggcag

SEQ ID NO: 17762 - DNA, 20 bp, Artificial Sequence
  chemically synthesized
ctctgggtctggaggcagca

SEQ ID NO: 17763 - DNA, 20 bp, Artificial Sequence
  chemically synthesized
ctgggtctggaggcagcaga

SEQ ID NO: 17764 - DNA, 20 bp, Artificial Sequence
  chemically synthesized
tgggtctggaggcagcagag

SEQ ID NO: 17765 - DNA, 20 bp, Artificial Sequence
  chemically synthesized
gggtctggaggcagcagaga

SEQ ID NO: 17766 - DNA, 20 bp, Artificial Sequence
  chemically synthesized
gtctggaggcagcagagagg

SEQ ID NO: 17767 - DNA, 20 bp, Artificial Sequence
  chemically synthesized
gaggcagcagagagggagcc

SEQ ID NO: 17768 - DNA, 20 bp, Artificial Sequence
  chemically synthesized
agggagcccagctctgtgtg

SEQ ID NO: 17769 - DNA, 20 bp, Artificial Sequence
  chemically synthesized
gggagcccagctctgtgtgc

SEQ ID NO: 17770 - DNA, 20 bp, Artificial Sequence
  chemically synthesized
agcccagctctgtgtgcagg

SEQ ID NO: 17771 - DNA, 20 bp, Artificial Sequence
  chemically synthesized
gctctgtgtgcaggaagacg

SEQ ID NO: 17772 - DNA, 20 bp, Artificial Sequence
  chemically synthesized
ctctgtgtgcaggaagacgt

SEQ ID NO: 17773 - DNA, 20 bp, Artificial Sequence
  chemically synthesized
gcaggaagacgtgggtgtgt

SEQ ID NO: 17774 - DNA, 20 bp, Artificial Sequence
  chemically synthesized
ggtgtgtgagtgtacgtgtg

SEQ ID NO: 17775 - DNA, 20 bp, Artificial Sequence
  chemically synthesized
gtgtgtgagtgtacgtgtgt

SEQ ID NO: 17776 - DNA, 20 bp, Artificial Sequence
  chemically synthesized
gtgtacgtgtgtgggtgtgt

SEQ ID NO: 17777 - DNA, 20 bp, Artificial Sequence
  chemically synthesized
tgtacgtgtgtgggtgtgtc

SEQ ID NO: 17778 - DNA, 20 bp, Artificial Sequence
  chemically synthesized
gtgtgtcaggtgtgtgtgtg

SEQ ID NO: 17779 - DNA, 20 bp, Artificial Sequence
  chemically synthesized
tgtgtcaggtgtgtgtgtgt

SEQ ID NO: 17780 - DNA, 20 bp, Artificial Sequence
  chemically synthesized
tgtcaggtgtgtgtgtgtgg

SEQ ID NO: 17781 - DNA, 20 bp, Artificial Sequence
  chemically synthesized
gtcaggtgtgtgtgtgtggg

SEQ ID NO: 17782 - DNA, 20 bp, Artificial Sequence
  chemically synthesized
tcaggtgtgtgtgtgtggga

SEQ ID NO: 17783 - DNA, 20 bp, Artificial Sequence
  chemically synthesized
aggtgtgtgtgtgtgggagg

SEQ ID NO: 17784 - DNA, 20 bp, Artificial Sequence
  chemically synthesized
gggagtatgaatgtgtgcat

SEQ ID NO: 17785 - DNA, 20 bp, Artificial Sequence
  chemically synthesized
tagcatgcatatgcacatgt

SEQ ID NO: 17786 - DNA, 20 bp, Artificial Sequence
  chemically synthesized
gcatgcatatgcacatgtga

SEQ ID NO: 17787 - DNA, 20 bp, Artificial Sequence
  chemically synthesized
tgcatatgcacatgtgagag

SEQ ID NO: 17788 - DNA, 20 bp, Artificial Sequence
  chemically synthesized
gcatatgcacatgtgagagt

SEQ ID NO: 17789 - DNA, 20 bp, Artificial Sequence
  chemically synthesized
tgcacatgtgagagtgggta

SEQ ID NO: 17790 - DNA, 20 bp, Artificial Sequence
  chemically synthesized
acatgtgagagtgggtacag

SEQ ID NO: 17791 - DNA, 20 bp, Artificial Sequence
  chemically synthesized
atgtgagagtgggtacagca

SEQ ID NO: 17792 - DNA, 20 bp, Artificial Sequence
  chemically synthesized
agagtgggtacagcagagcg

SEQ ID NO: 17793 - DNA, 20 bp, Artificial Sequence
  chemically synthesized
gtacagcagagcgtggtcat

SEQ ID NO: 17794 - DNA, 20 bp, Artificial Sequence
  chemically synthesized
gtgtgcaaatgtgtgttttt

SEQ ID NO: 17795 - DNA, 20 bp, Artificial Sequence
  chemically synthesized
caaatgtgtgtttttgagtg

SEQ ID NO: 17796 - DNA, 20 bp, Artificial Sequence
  chemically synthesized
tgtgtgtttttgagtgaagt

SEQ ID NO: 17797 - DNA, 20 bp, Artificial Sequence
  chemically synthesized
gagtgaagtgagcaatgtgt

SEQ ID NO: 17798 - DNA, 20 bp, Artificial Sequence
  chemically synthesized
tgagcaatgtgtgagtgtgt

SEQ ID NO: 17799 - DNA, 20 bp, Artificial Sequence
  chemically synthesized
gtgagtgtgtgagtgtgtgt

SEQ ID NO: 17800 - DNA, 20 bp, Artificial Sequence
  chemically synthesized
gtgagtgtgtgtgagtttgt

SEQ ID NO: 17801 - DNA, 20 bp, Artificial Sequence
  chemically synthesized
tgagtgtgtgtgagtttgtg

SEQ ID NO: 17802 - DNA, 20 bp, Artificial Sequence
  chemically synthesized
gagtgtgtgtgagtttgtga

SEQ ID NO: 17803 - DNA, 20 bp, Artificial Sequence
  chemically synthesized
gggcatgtgaatgtgtgtgt

SEQ ID NO: 17804 - DNA, 20 bp, Artificial Sequence
  chemically synthesized
aatgtgtgtgtcagtgctgt

SEQ ID NO: 17805 - DNA, 20 bp, Artificial Sequence
  chemically synthesized
atgtgtgtgtcagtgctgtc

SEQ ID NO: 17806 - DNA, 20 bp, Artificial Sequence
  chemically synthesized
tgtgtgtgtcagtgctgtca

SEQ ID NO: 17807 - DNA, 20 bp, Artificial Sequence
  chemically synthesized
gtgtcagtgctgtcagggtg

SEQ ID NO: 17808 - DNA, 20 bp, Artificial Sequence
  chemically synthesized
cagtgctgtcagggtgcaga

SEQ ID NO: 17809 - DNA, 20 bp, Artificial Sequence
  chemically synthesized
tgtcagggtgcagatggatc

SEQ ID NO: 17810 - DNA, 20 bp, Artificial Sequence
  chemically synthesized
gtcagggtgcagatggatca

SEQ ID NO: 17811 - DNA, 20 bp, Artificial Sequence
  chemically synthesized
tcagggtgcagatggatcaa

SEQ ID NO: 17812 - DNA, 20 bp, Artificial Sequence
  chemically synthesized
cagggtgcagatggatcaag

SEQ ID NO: 17813 - DNA, 20 bp, Artificial Sequence
  chemically synthesized
ggtgcagatggatcaagggg

SEQ ID NO: 17814 - DNA, 20 bp, Artificial Sequence
  chemically synthesized
gtgcagatggatcaaggggc

SEQ ID NO: 17815 - DNA, 20 bp, Artificial Sequence
  chemically synthesized
gcagatggatcaaggggcag

SEQ ID NO: 17816 - DNA, 20 bp, Artificial Sequence
  chemically synthesized
agatggatcaaggggcagga

SEQ ID NO: 17817 - DNA, 20 bp, Artificial Sequence
  chemically synthesized
gatggatcaaggggcaggag

SEQ ID NO: 17818 - DNA, 20 bp, Artificial Sequence
  chemically synthesized
ggggcaggagaggtacctgt

SEQ ID NO: 17819 - DNA, 20 bp, Artificial Sequence
  chemically synthesized
aggtacctgtgagatgacct

SEQ ID NO: 17820 - DNA, 20 bp, Artificial Sequence
  chemically synthesized
ggtacctgtgagatgacctc

SEQ ID NO: 17821 - DNA, 20 bp, Artificial Sequence
  chemically synthesized
ctgtgagatgacctcgggct

SEQ ID NO: 17822 - DNA, 20 bp, Artificial Sequence
  chemically synthesized
tgtgagatgacctcgggctg

SEQ ID NO: 17823 - DNA, 20 bp, Artificial Sequence
  chemically synthesized
gtgagatgacctcgggctga

SEQ ID NO: 17824 - DNA, 20 bp, Artificial Sequence
  chemically synthesized
tgagatgacctcgggctgag

SEQ ID NO: 17825 - DNA, 20 bp, Artificial Sequence
  chemically synthesized
agatgacctcgggctgaggg

SEQ ID NO: 17826 - DNA, 20 bp, Artificial Sequence
  chemically synthesized
cgggctgaggggagcaaatt

SEQ ID NO: 17827 - DNA, 20 bp, Artificial Sequence
  chemically synthesized
tgaggggagcaaatttagtg

SEQ ID NO: 17828 - DNA, 20 bp, Artificial Sequence
  chemically synthesized
gagcaaatttagtgtggaac

SEQ ID NO: 17829 - DNA, 20 bp, Artificial Sequence
  chemically synthesized
agcaaatttagtgtggaacg

SEQ ID NO: 17830 - DNA, 20 bp, Artificial Sequence
  chemically synthesized
ttagtgtggaacgaggtttc

SEQ ID NO: 17831 - DNA, 20 bp, Artificial Sequence
  chemically synthesized
tagtgtggaacgaggtttct

SEQ ID NO: 17832 - DNA, 20 bp, Artificial Sequence
  chemically synthesized
agtgtggaacgaggtttcta

SEQ ID NO: 17833 - DNA, 20 bp, Artificial Sequence
  chemically synthesized
gtggaacgaggtttctaggg

SEQ ID NO: 17834 - DNA, 20 bp, Artificial Sequence
  chemically synthesized
aacgaggtttctagggaagc

SEQ ID NO: 17835 - DNA, 20 bp, Artificial Sequence
  chemically synthesized
acgaggtttctagggaagcg

SEQ ID NO: 17836 - DNA, 20 bp, Artificial Sequence
  chemically synthesized
cgaggtttctagggaagcga

SEQ ID NO: 17837 - DNA, 20 bp, Artificial Sequence
  chemically synthesized
tttctagggaagcgagggca

SEQ ID NO: 17838 - DNA, 20 bp, Artificial Sequence
  chemically synthesized
ttctagggaagcgagggcaa

SEQ ID NO: 17839 - DNA, 20 bp, Artificial Sequence
  chemically synthesized
tctagggaagcgagggcaaa

SEQ ID NO: 17840 - DNA, 20 bp, Artificial Sequence
  chemically synthesized
gaagcgagggcaaagggcgc

SEQ ID NO: 17841 - DNA, 20 bp, Artificial Sequence
  chemically synthesized
aagcgagggcaaagggcgct

SEQ ID NO: 17842 - DNA, 20 bp, Artificial Sequence
  chemically synthesized
agcgagggcaaagggcgctg

SEQ ID NO: 17843 - DNA, 20 bp, Artificial Sequence
  chemically synthesized
cgagggcaaagggcgctggg

SEQ ID NO: 17844 - DNA, 20 bp, Artificial Sequence
  chemically synthesized
gagggcaaagggcgctgggg

SEQ ID NO: 17845 - DNA, 20 bp, Artificial Sequence
  chemically synthesized
gggcaaagggcgctggggag

SEQ ID NO: 17846 - DNA, 20 bp, Artificial Sequence
  chemically synthesized
ggcaaagggcgctggggagg

SEQ ID NO: 17847 - DNA, 20 bp, Artificial Sequence
  chemically synthesized
gctggggaggaggccttgcg

SEQ ID NO: 17848 - DNA, 20 bp, Artificial Sequence
  chemically synthesized
ggggaggaggccttgcgtgg

SEQ ID NO: 17849 - DNA, 20 bp, Artificial Sequence
  chemically synthesized
gggaggaggccttgcgtggt

SEQ ID NO: 17850 - DNA, 20 bp, Artificial Sequence
  chemically synthesized
ggaggaggccttgcgtggtg

SEQ ID NO: 17851 - DNA, 20 bp, Artificial Sequence
  chemically synthesized
gaggaggccttgcgtggtgg

SEQ ID NO: 17852 - DNA, 20 bp, Artificial Sequence
  chemically synthesized
ggccttgcgtggtgggggat

SEQ ID NO: 17853 - DNA, 20 bp, Artificial Sequence
  chemically synthesized
gccttgcgtggtgggggatg

SEQ ID NO: 17854 - DNA, 20 bp, Artificial Sequence
  chemically synthesized
gtggtgggggatgaggacaa

SEQ ID NO: 17855 - DNA, 20 bp, Artificial Sequence
  chemically synthesized
tggtgggggatgaggacaac

SEQ ID NO: 17856 - DNA, 20 bp, Artificial Sequence
  chemically synthesized
tgggggatgaggacaacagg

SEQ ID NO: 17857 - DNA, 20 bp, Artificial Sequence
  chemically synthesized
gggggatgaggacaacaggt

SEQ ID NO: 17858 - DNA, 20 bp, Artificial Sequence
  chemically synthesized
tgaggacaacaggtgggacc

SEQ ID NO: 17859 - DNA, 20 bp, Artificial Sequence
  chemically synthesized
aggacaacaggtgggacctg

SEQ ID NO: 17860 - DNA, 20 bp, Artificial Sequence
  chemically synthesized
ggacaacaggtgggacctgg

SEQ ID NO: 17861 - DNA, 20 bp, Artificial Sequence
  chemically synthesized
gacaacaggtgggacctgga

SEQ ID NO: 17862 - DNA, 20 bp, Artificial Sequence
  chemically synthesized
gggacctggagggttgtgct

SEQ ID NO: 17863 - DNA, 20 bp, Artificial Sequence
  chemically synthesized
gacctggagggttgtgcttg

SEQ ID NO: 17864 - DNA, 20 bp, Artificial Sequence
  chemically synthesized
cctggagggttgtgcttgga

SEQ ID NO: 17865 - DNA, 20 bp, Artificial Sequence
  chemically synthesized
ggagggttgtgcttggagag

SEQ ID NO: 17866 - DNA, 20 bp, Artificial Sequence
  chemically synthesized
gagggttgtgcttggagagt

SEQ ID NO: 17867 - DNA, 20 bp, Artificial Sequence
  chemically synthesized
tgtgcttggagagtgggcta

SEQ ID NO: 17868 - DNA, 20 bp, Artificial Sequence
  chemically synthesized
gcttggagagtgggctatgg

SEQ ID NO: 17869 - DNA, 20 bp, Artificial Sequence
  chemically synthesized
tgggctatggtggaatgacc

SEQ ID NO: 17870 - DNA, 20 bp, Artificial Sequence
  chemically synthesized
tggtggaatgacccagattt

SEQ ID NO: 17871 - DNA, 20 bp, Artificial Sequence
  chemically synthesized
ggtggaatgacccagattta

SEQ ID NO: 17872 - DNA, 20 bp, Artificial Sequence
  chemically synthesized
cccagatttaaggatctcaa

SEQ ID NO: 17873 - DNA, 20 bp, Artificial Sequence
  chemically synthesized
taaggatctcaatggaattt

SEQ ID NO: 17874 - DNA, 20 bp, Artificial Sequence
  chemically synthesized
ggatctcaatggaattttgg

SEQ ID NO: 17875 - DNA, 20 bp, Artificial Sequence
  chemically synthesized
gatctcaatggaattttggc

SEQ ID NO: 17876 - DNA, 20 bp, Artificial Sequence
  chemically synthesized
atctcaatggaattttggca

SEQ ID NO: 17877 - DNA, 20 bp, Artificial Sequence
  chemically synthesized
tctcaatggaattttggcag

SEQ ID NO: 17878 - DNA, 20 bp, Artificial Sequence
  chemically synthesized
tcaatggaattttggcaggg

SEQ ID NO: 17879 - DNA, 20 bp, Artificial Sequence
  chemically synthesized
caatggaattttggcagggg

SEQ ID NO: 17880 - DNA, 20 bp, Artificial Sequence
  chemically synthesized
aatggaattttggcagggga

SEQ ID NO: 17881 - DNA, 20 bp, Artificial Sequence
  chemically synthesized
tggcaggggagggactgttc

SEQ ID NO: 17882 - DNA, 20 bp, Artificial Sequence
  chemically synthesized
ggggagggactgttccagta

SEQ ID NO: 17883 - DNA, 20 bp, Artificial Sequence
  chemically synthesized
gactgttccagtatggattt

SEQ ID NO: 17884 - DNA, 20 bp, Artificial Sequence
  chemically synthesized
actgttccagtatggatttt

SEQ ID NO: 17885 - DNA, 20 bp, Artificial Sequence
  chemically synthesized
gttccagtatggattttagg

SEQ ID NO: 17886 - DNA, 20 bp, Artificial Sequence
  chemically synthesized
tatggattttaggaagaaca

SEQ ID NO: 17887 - DNA, 20 bp, Artificial Sequence
  chemically synthesized
atggattttaggaagaacac

SEQ ID NO: 17888 - DNA, 20 bp, Artificial Sequence
  chemically synthesized
tggattttaggaagaacaca

SEQ ID NO: 17889 - DNA, 20 bp, Artificial Sequence
  chemically synthesized
tttaggaagaacacagggcc

SEQ ID NO: 17890 - DNA, 20 bp, Artificial Sequence
  chemically synthesized
agaacacagggcccagcttc

SEQ ID NO: 17891 - DNA, 20 bp, Artificial Sequence
  chemically synthesized
aacacagggcccagcttctg

SEQ ID NO: 17892 - DNA, 20 bp, Artificial Sequence
  chemically synthesized
gcttctggagtctccaatct

SEQ ID NO: 17893 - DNA, 20 bp, Artificial Sequence
  chemically synthesized
cttctggagtctccaatctg

SEQ ID NO: 17894 - DNA, 20 bp, Artificial Sequence
  chemically synthesized
ttctggagtctccaatctga

SEQ ID NO: 17895 - DNA, 20 bp, Artificial Sequence
  chemically synthesized
tctggagtctccaatctgag

SEQ ID NO: 17896 - DNA, 20 bp, Artificial Sequence
  chemically synthesized
gagtctccaatctgagggga

SEQ ID NO: 17897 - DNA, 20 bp, Artificial Sequence
  chemically synthesized
agtctccaatctgaggggac

SEQ ID NO: 17898 - DNA, 20 bp, Artificial Sequence
  chemically synthesized
tctccaatctgaggggacag

SEQ ID NO: 17899 - DNA, 20 bp, Artificial Sequence
  chemically synthesized
atctgaggggacaggagcct

SEQ ID NO: 17900 - DNA, 20 bp, Artificial Sequence
  chemically synthesized
tgaggggacaggagccttag

SEQ ID NO: 17901 - DNA, 20 bp, Artificial Sequence
  chemically synthesized
aggggacaggagccttagaa

SEQ ID NO: 17902 - DNA, 20 bp, Artificial Sequence
  chemically synthesized
acaggagccttagaagagct

SEQ ID NO: 17903 - DNA, 20 bp, Artificial Sequence
  chemically synthesized
gccttagaagagctgagact

SEQ ID NO: 17904 - DNA, 20 bp, Artificial Sequence
  chemically synthesized
ccttagaagagctgagacta

SEQ ID NO: 17905 - DNA, 20 bp, Artificial Sequence
  chemically synthesized
aagagctgagactaaggccc

SEQ ID NO: 17906 - DNA, 20 bp, Artificial Sequence
  chemically synthesized
agagctgagactaaggcccg

SEQ ID NO: 17907 - DNA, 20 bp, Artificial Sequence
  chemically synthesized
gactaaggcccgaggtgatc

SEQ ID NO: 17908 - DNA, 20 bp, Artificial Sequence
  chemically synthesized
ctaaggcccgaggtgatctg

SEQ ID NO: 17909 - DNA, 20 bp, Artificial Sequence
  chemically synthesized
taaggcccgaggtgatctgg

SEQ ID NO: 17910 - DNA, 20 bp, Artificial Sequence
  chemically synthesized
gatctggaggcctctgccac

SEQ ID NO: 17911 - DNA, 20 bp, Artificial Sequence
  chemically synthesized
tggaggcctctgccactggc

SEQ ID NO: 17912 - DNA, 20 bp, Artificial Sequence
  chemically synthesized
ggcctctgccactggctgga

SEQ ID NO: 17913 - DNA, 20 bp, Artificial Sequence
  chemically synthesized
gcctctgccactggctggat

SEQ ID NO: 17914 - DNA, 20 bp, Artificial Sequence
  chemically synthesized
ctctgccactggctggatgg

SEQ ID NO: 17915 - DNA, 20 bp, Artificial Sequence
  chemically synthesized
tctgccactggctggatggg

SEQ ID NO: 17916 - DNA, 20 bp, Artificial Sequence
  chemically synthesized
gatgggaggaaaaccattca

SEQ ID NO: 17917 - DNA, 20 bp, Artificial Sequence
  chemically synthesized
cattcacagatcccccttct

SEQ ID NO: 17918 - DNA, 20 bp, Artificial Sequence
  chemically synthesized
attcacagatcccccttctc

SEQ ID NO: 17919 - DNA, 20 bp, Artificial Sequence
  chemically synthesized
cccttctcaggatgtgtgcc

SEQ ID NO: 17920 - DNA, 20 bp, Artificial Sequence
  chemically synthesized
ccttctcaggatgtgtgcct

SEQ ID NO: 17921 - DNA, 20 bp, Artificial Sequence
  chemically synthesized
tctcaggatgtgtgcctagg

SEQ ID NO: 17922 - DNA, 20 bp, Artificial Sequence
  chemically synthesized
ctcaggatgtgtgcctaggc

SEQ ID NO: 17923 - DNA, 20 bp, Artificial Sequence
  chemically synthesized
tcaggatgtgtgcctaggca

SEQ ID NO: 17924 - DNA, 20 bp, Artificial Sequence
  chemically synthesized
gatgtgtgcctaggcagggc

SEQ ID NO: 17925 - DNA, 20 bp, Artificial Sequence
  chemically synthesized
atgtgtgcctaggcagggcc

SEQ ID NO: 17926 - DNA, 20 bp, Artificial Sequence
  chemically synthesized
cccgccccctgtgcgtctcc

SEQ ID NO: 17927 - DNA, 20 bp, Artificial Sequence
  chemically synthesized
ctgtgcgtctcccagtcccc

SEQ ID NO: 17928 - DNA, 20 bp, Artificial Sequence
  chemically synthesized
gtctcccagtcccccagctc

SEQ ID NO: 17929 - DNA, 20 bp, Artificial Sequence
  chemically synthesized
tctcccagtcccccagctcc

SEQ ID NO: 17930 - DNA, 20 bp, Artificial Sequence
  chemically synthesized
agtcccccagctccaggatc

SEQ ID NO: 17931 - DNA, 20 bp, Artificial Sequence
  chemically synthesized
gtcccccagctccaggatcc

SEQ ID NO: 17932 - DNA, 20 bp, Artificial Sequence
  chemically synthesized
caggatccgggctttgcaca

SEQ ID NO: 17933 - DNA, 20 bp, Artificial Sequence
  chemically synthesized
acagctgatgtgaatatcct

SEQ ID NO: 17934 - DNA, 20 bp, Artificial Sequence
  chemically synthesized
aatatcctgagtcgtgtgca

SEQ ID NO: 17935 - DNA, 20 bp, Artificial Sequence
  chemically synthesized
atatcctgagtcgtgtgcat

SEQ ID NO: 17936 - DNA, 20 bp, Artificial Sequence
  chemically synthesized
gtgcatgggtgtgtgtgcac

SEQ ID NO: 17937 - DNA, 20 bp, Artificial Sequence
  chemically synthesized
tgggtgtgtgtgcaccagat

SEQ ID NO: 17938 - DNA, 20 bp, Artificial Sequence
  chemically synthesized
tgcgtgtgtatatttataca

SEQ ID NO: 17939 - DNA, 20 bp, Artificial Sequence
  chemically synthesized
tatatttatacatggtaata

SEQ ID NO: 17940 - DNA, 20 bp, Artificial Sequence
  chemically synthesized
atatttatacatggtaatat

SEQ ID NO: 17941 - DNA, 20 bp, Artificial Sequence
  chemically synthesized
atacatggtaatatgggtgc

SEQ ID NO: 17942 - DNA, 20 bp, Artificial Sequence
  chemically synthesized
taatatgggtgcgagtgtgt

SEQ ID NO: 17943 - DNA, 20 bp, Artificial Sequence
  chemically synthesized
atatgggtgcgagtgtgtaa

SEQ ID NO: 17944 - DNA, 20 bp, Artificial Sequence
  chemically synthesized
tgtgtgtaatgctcaaatgc

SEQ ID NO: 17945 - DNA, 20 bp, Artificial Sequence
  chemically synthesized
gtgtgtaatgctcaaatgct

SEQ ID NO: 17946 - DNA, 20 bp, Artificial Sequence
  chemically synthesized
tgtgtaatgctcaaatgctg

SEQ ID NO: 17947 - DNA, 20 bp, Artificial Sequence
  chemically synthesized
atgctcaaatgctggggtca

SEQ ID NO: 17948 - DNA, 20 bp, Artificial Sequence
  chemically synthesized
cctatgatgaccccccccca

SEQ ID NO: 17949 - DNA, 20 bp, Artificial Sequence
  chemically synthesized
ccccaaccaatccccccgcc

SEQ ID NO: 17950 - DNA, 20 bp, Artificial Sequence
  chemically synthesized
cccaaccaatccccccgccc

SEQ ID NO: 17951 - DNA, 20 bp, Artificial Sequence
  chemically synthesized
ccgcccaggttatgcctcct

SEQ ID NO: 17952 - DNA, 20 bp, Artificial Sequence
  chemically synthesized
cgcccaggttatgcctcctc

SEQ ID NO: 17953 - DNA, 20 bp, Artificial Sequence
  chemically synthesized
ggttatgcctcctcaggctt

SEQ ID NO: 17954 - DNA, 20 bp, Artificial Sequence
  chemically synthesized
ggtgccctgtctttaccctc

SEQ ID NO: 17955 - DNA, 20 bp, Artificial Sequence
  chemically synthesized
accctccggctccccacacc

SEQ ID NO: 17956 - DNA, 20 bp, Artificial Sequence
  chemically synthesized
ccctccggctccccacaccc

SEQ ID NO: 17957 - DNA, 20 bp, Artificial Sequence
  chemically synthesized
gctccccacacccaggctgc

SEQ ID NO: 17958 - DNA, 20 bp, Artificial Sequence
  chemically synthesized
ctcctgatgcccctctccca

SEQ ID NO: 17959 - DNA, 20 bp, Artificial Sequence
  chemically synthesized
tcctgatgcccctctcccac

SEQ ID NO: 17960 - DNA, 20 bp, Artificial Sequence
  chemically synthesized
cctgatgcccctctcccaca

SEQ ID NO: 17961 - DNA, 20 bp, Artificial Sequence
  chemically synthesized
ccacagggccacctcctgcc

SEQ ID NO: 17962 - DNA, 20 bp, Artificial Sequence
  chemically synthesized
gccacctcctgcccagcccc

SEQ ID NO: 17963 - DNA, 20 bp, Artificial Sequence
  chemically synthesized
ctcctgcccagcccctggca

SEQ ID NO: 17964 - DNA, 20 bp, Artificial Sequence
  chemically synthesized
ggcacagcgtctctgctcca

SEQ ID NO: 17965 - DNA, 20 bp, Artificial Sequence
  chemically synthesized
ctctgctccatggtctgctt

SEQ ID NO: 17966 - DNA, 20 bp, Artificial Sequence
  chemically synthesized
tgcttcagtctgcttgccct

SEQ ID NO: 17967 - DNA, 20 bp, Artificial Sequence
  chemically synthesized
gagcttcaacatcctgctgc

SEQ ID NO: 17968 - DNA, 20 bp, Artificial Sequence
  chemically synthesized
cttcaacatcctgctgctgg

SEQ ID NO: 17969 - DNA, 20 bp, Artificial Sequence
  chemically synthesized
ctggtggtcatctgtgtgac

SEQ ID NO: 17970 - DNA, 20 bp, Artificial Sequence
  chemically synthesized
tggtggtcatctgtgtgact

SEQ ID NO: 17971 - DNA, 20 bp, Artificial Sequence
  chemically synthesized
atctgtgtgactgggtccca

SEQ ID NO: 17972 - DNA, 20 bp, Artificial Sequence
  chemically synthesized
gtgtgactgggtcccaaagt

SEQ ID NO: 17973 - DNA, 20 bp, Artificial Sequence
  chemically synthesized
tgtgactgggtcccaaagtg

SEQ ID NO: 17974 - DNA, 20 bp, Artificial Sequence
  chemically synthesized
gtgactgggtcccaaagtga

SEQ ID NO: 17975 - DNA, 20 bp, Artificial Sequence
  chemically synthesized
gggtcccaaagtgagggtca

SEQ ID NO: 17976 - DNA, 20 bp, Artificial Sequence
  chemically synthesized
ggtcccaaagtgagggtcac

SEQ ID NO: 17977 - DNA, 20 bp, Artificial Sequence
  chemically synthesized
gtcccaaagtgagggtcacg

SEQ ID NO: 17978 - DNA, 20 bp, Artificial Sequence
  chemically synthesized
tcccaaagtgagggtcacgg

SEQ ID NO: 17979 - DNA, 20 bp, Artificial Sequence
  chemically synthesized
aaagtgagggtcacgggggc

SEQ ID NO: 17980 - DNA, 20 bp, Artificial Sequence
  chemically synthesized
gtgagggtcacgggggccag

SEQ ID NO: 17981 - DNA, 20 bp, Artificial Sequence
  chemically synthesized
tgagggtcacgggggccagc

SEQ ID NO: 17982 - DNA, 20 bp, Artificial Sequence
  chemically synthesized
gagggtcacgggggccagca

SEQ ID NO: 17983 - DNA, 20 bp, Artificial Sequence
  chemically synthesized
gtcacgggggccagcaggga

SEQ ID NO: 17984 - DNA, 20 bp, Artificial Sequence
  chemically synthesized
tcacgggggccagcagggat

SEQ ID NO: 17985 - DNA, 20 bp, Artificial Sequence
  chemically synthesized
gggggccagcagggatgggc

SEQ ID NO: 17986 - DNA, 20 bp, Artificial Sequence
  chemically synthesized
ggggccagcagggatgggca

SEQ ID NO: 17987 - DNA, 20 bp, Artificial Sequence
  chemically synthesized
gggccagcagggatgggcaa

SEQ ID NO: 17988 - DNA, 20 bp, Artificial Sequence
  chemically synthesized
ggccagcagggatgggcaag

SEQ ID NO: 17989 - DNA, 20 bp, Artificial Sequence
  chemically synthesized
cagcagggatgggcaagggg

SEQ ID NO: 17990 - DNA, 20 bp, Artificial Sequence
  chemically synthesized
agcagggatgggcaaggggt

SEQ ID NO: 17991 - DNA, 20 bp, Artificial Sequence
  chemically synthesized
gcagggatgggcaaggggta

SEQ ID NO: 17992 - DNA, 20 bp, Artificial Sequence
  chemically synthesized
ggatgggcaaggggtaggga

SEQ ID NO: 17993 - DNA, 20 bp, Artificial Sequence
  chemically synthesized
atgggcaaggggtagggaaa

SEQ ID NO: 17994 - DNA, 20 bp, Artificial Sequence
  chemically synthesized
aaggggtagggaaagagaca

SEQ ID NO: 17995 - DNA, 20 bp, Artificial Sequence
  chemically synthesized
aggggtagggaaagagacat

SEQ ID NO: 17996 - DNA, 20 bp, Artificial Sequence
  chemically synthesized
ggtagggaaagagacatggg

SEQ ID NO: 17997 - DNA, 20 bp, Artificial Sequence
  chemically synthesized
agggaaagagacatgggcag

SEQ ID NO: 17998 - DNA, 20 bp, Artificial Sequence
  chemically synthesized
acacagatgaccaccagcag

SEQ ID NO: 17999 - DNA, 20 bp, Artificial Sequence
  chemically synthesized
gggcatcaggagccggcagc

SEQ ID NO: 18000 - DNA, 20 bp, Artificial Sequence
  chemically synthesized
agcctgggtgtggggagccg

SEQ ID NO: 18001 - DNA, 20 bp, Artificial Sequence
  chemically synthesized
aggaggcataacctgggcgg

SEQ ID NO: 18002 - DNA, 20 bp, Artificial Sequence
  chemically synthesized
gattggttggggccatgggg

SEQ ID NO: 18003 - DNA, 20 bp, Artificial Sequence
  chemically synthesized
acacacccatgcacacgact

SEQ ID NO: 18004 - DNA, 20 bp, Artificial Sequence
  chemically synthesized
acatcagctgtgtgcaaagc

SEQ ID NO: 18005 - DNA, 20 bp, Artificial Sequence
  chemically synthesized
taggcacacatcctgagaag

SEQ ID NO: 18006 - DNA, 20 bp, Artificial Sequence
  chemically synthesized
catcctgagaagggggatct

SEQ ID NO: 18007 - DNA, 20 bp, Artificial Sequence
  chemically synthesized
ttccattgagatccttaaat

SEQ ID NO: 18008 - DNA, 20 bp, Artificial Sequence
  chemically synthesized
gggaggctcagtcaggggcc

SEQ ID NO: 18009 - DNA, 20 bp, Artificial Sequence
  chemically synthesized
ggtcacttcctgccactgtc

SEQ ID NO: 18010 - DNA, 20 bp, Artificial Sequence
  chemically synthesized
accaagctggccctccatgg

SEQ ID NO: 18011 - DNA, 20 bp, Artificial Sequence
  chemically synthesized
tcttcagcaccctccactca

SEQ ID NO: 18012 - DNA, 20 bp, Artificial Sequence
  chemically synthesized
cgacttatcaactcccaatg

SEQ ID NO: 18013 - DNA, 20 bp, Artificial Sequence
  chemically synthesized
ccctgaaaccagactgccca

SEQ ID NO: 18014 - DNA, 20 bp, Artificial Sequence
  chemically synthesized
tcacagtcgtagctacccga

SEQ ID NO: 18015 - DNA, 20 bp, Artificial Sequence
  chemically synthesized
tagctacccgattggattgc

SEQ ID NO: 18016 - DNA, 20 bp, Artificial Sequence
  chemically synthesized
tggattgctcggataattag

SEQ ID NO: 18017 - DNA, 20 bp, Artificial Sequence
  chemically synthesized
aaaagtttgaacataaaaga

SEQ ID NO: 18018 - DNA, 20 bp, Artificial Sequence
  chemically synthesized
cagggtctgcccaagatggg

SEQ ID NO: 18019 - DNA, 20 bp, Artificial Sequence
  chemically synthesized
actctggacatcaggcaagg

SEQ ID NO: 18020 - DNA, 20 bp, Artificial Sequence
  chemically synthesized
aggaggagtaaagatccctg

SEQ ID NO: 18021 - DNA, 20 bp, Artificial Sequence
  chemically synthesized
accccagcttactgtttgga

SEQ ID NO: 18022 - DNA, 20 bp, Artificial Sequence
  chemically synthesized
cacgttgaggagatggagct

SEQ ID NO: 18023 - DNA, 20 bp, Artificial Sequence
  chemically synthesized
ccgaggagaccaaaacaatt

SEQ ID NO: 18024 - DNA, 20 bp, Artificial Sequence
  chemically synthesized
caaagctcaagaacatttag

SEQ ID NO: 18025 - DNA, 20 bp, Artificial Sequence
  chemically synthesized
aaaagagatccagaactgac

SEQ ID NO: 18026 - DNA, 20 bp, Artificial Sequence
  chemically synthesized
tccagaactgacacggatgc

SEQ ID NO: 18027 - DNA, 20 bp, Artificial Sequence
  chemically synthesized
ggatgctagaattagcaggc

SEQ ID NO: 18028 - DNA, 20 bp, Artificial Sequence
  chemically synthesized
attatgttcaaaaaattaag

SEQ ID NO: 18029 - DNA, 20 bp, Artificial Sequence
  chemically synthesized
aaaaattaagtagaattgtg

SEQ ID NO: 18030 - DNA, 20 bp, Artificial Sequence
  chemically synthesized
tagaattgtggaggatattt

SEQ ID NO: 18031 - DNA, 20 bp, Artificial Sequence
  chemically synthesized
caggcgccgtggctcacgcc

SEQ ID NO: 18032 - DNA, 20 bp, Artificial Sequence
  chemically synthesized
tactcgggaggctgaggcag

SEQ ID NO: 18033 - DNA, 20 bp, Artificial Sequence
  chemically synthesized
gaaagaaaagaaaaaacaca

SEQ ID NO: 18034 - DNA, 20 bp, Artificial Sequence
  chemically synthesized
aaaatttagggccaggcact

SEQ ID NO: 18035 - DNA, 20 bp, Artificial Sequence
  chemically synthesized
ctttgggaggtcgacacggg

SEQ ID NO: 18036 - DNA, 20 bp, Artificial Sequence
  chemically synthesized
tacctgggaggctgaagtgg

SEQ ID NO: 18037 - DNA, 20 bp, Artificial Sequence
  chemically synthesized
cccaggaggtggaggccaca

SEQ ID NO: 18038 - DNA, 20 bp, Artificial Sequence
  chemically synthesized
ctgcattccagcctgggcaa

SEQ ID NO: 18039 - DNA, 20 bp, Artificial Sequence
  chemically synthesized
aatgaaacactgggagaaaa

SEQ ID NO: 18040 - DNA, 20 bp, Artificial Sequence
  chemically synthesized
aaagaattaaaaaatggaaa

SEQ ID NO: 18041 - DNA, 20 bp, Artificial Sequence
  chemically synthesized
aattaaaaaatggaaagaga

SEQ ID NO: 18042 - DNA, 20 bp, Artificial Sequence
  chemically synthesized
tgaaatctttaaaagaaaaa

SEQ ID NO: 18043 - DNA, 20 bp, Artificial Sequence
  chemically synthesized
agcagcatcccgtattctct

SEQ ID NO: 18044 - DNA, 20 bp, Artificial Sequence
  chemically synthesized
ctctgagtgttcactatgta

SEQ ID NO: 18045 - DNA, 20 bp, Artificial Sequence
  chemically synthesized
accgggtgccgtgtgggcac

SEQ ID NO: 18046 - DNA, 20 bp, Artificial Sequence
  chemically synthesized
tgggcactggagttgcagag

SEQ ID NO: 18047 - DNA, 20 bp, Artificial Sequence
  chemically synthesized
aggagatgctactggtgttc

SEQ ID NO: 18048 - DNA, 20 bp, Artificial Sequence
  chemically synthesized
tccctcggttggccagcctc

SEQ ID NO: 18049 - DNA, 20 bp, Artificial Sequence
  chemically synthesized
gttggccagcctcaggaatg

SEQ ID NO: 18050 - DNA, 20 bp, Artificial Sequence
  chemically synthesized
tacttgggaggctgaggtgg

SEQ ID NO: 18051 - DNA, 20 bp, Artificial Sequence
  chemically synthesized
tgggaggatggcttgagccc

SEQ ID NO: 18052 - DNA, 20 bp, Artificial Sequence
  chemically synthesized
tcagtcaagatttattacag

SEQ ID NO: 18053 - DNA, 20 bp, Artificial Sequence
  chemically synthesized
tattacagaaggatccaggg

SEQ ID NO: 18054 - DNA, 20 bp, Artificial Sequence
  chemically synthesized
tcttgggagatgagaggagc

SEQ ID NO: 18055 - DNA, 20 bp, Artificial Sequence
  chemically synthesized
tgagaggagcagggatcttc

SEQ ID NO: 18056 - DNA, 20 bp, Artificial Sequence
  chemically synthesized
cattcactcacacacacaca

SEQ ID NO: 18057 - DNA, 20 bp, Artificial Sequence
  chemically synthesized
acacacacacagagtcccag

SEQ ID NO: 18058 - DNA, 20 bp, Artificial Sequence
  chemically synthesized
catacgaggcacatgtgttc

SEQ ID NO: 18059 - DNA, 20 bp, Artificial Sequence
  chemically synthesized
cctctggcacatgcctttcc

SEQ ID NO: 18060 - DNA, 20 bp, Artificial Sequence
  chemically synthesized
acatgcctttcctggggtcc

SEQ ID NO: 18061 - DNA, 20 bp, Artificial Sequence
  chemically synthesized
ggtgaggtgagggaacaagc

SEQ ID NO: 18062 - DNA, 20 bp, Artificial Sequence
  chemically synthesized
ccctcctcagtccctgttca

SEQ ID NO: 18063 - DNA, 20 bp, Artificial Sequence
  chemically synthesized
cctcagtccctgttcacaga

SEQ ID NO: 18064 - DNA, 20 bp, Artificial Sequence
  chemically synthesized
tgcacacttgcctttcaaaa

SEQ ID NO: 18065 - DNA, 20 bp, Artificial Sequence
  chemically synthesized
caaaaatggatttcctctcc

SEQ ID NO: 18066 - DNA, 20 bp, Artificial Sequence
  chemically synthesized
cctctcctgggattcagcct

SEQ ID NO: 18067 - DNA, 20 bp, Artificial Sequence
  chemically synthesized
tggcccctcaccttgatgga

SEQ ID NO: 18068 - DNA, 20 bp, Artificial Sequence
  chemically synthesized
ttttcctccgagctcagctg

SEQ ID NO: 18069 - DNA, 20 bp, Artificial Sequence
  chemically synthesized
attcacgtggaggttgatgg

SEQ ID NO: 18070 - DNA, 20 bp, Artificial Sequence
  chemically synthesized
gttgatggtgggatggaacg

SEQ ID NO: 18071 - DNA, 20 bp, Artificial Sequence
  chemically synthesized
gggatggaacgcagggtcgg

SEQ ID NO: 18072 - DNA, 20 bp, Artificial Sequence
  chemically synthesized
aacgcagggtcggaggggtt

SEQ ID NO: 18073 - DNA, 20 bp, Artificial Sequence
  chemically synthesized
gaggggttcggggtggtggc

SEQ ID NO: 18074 - DNA, 20 bp, Artificial Sequence
  chemically synthesized
gttcggggtggtggcctggg

SEQ ID NO: 18075 - DNA, 20 bp, Artificial Sequence
  chemically synthesized
atcccaccatcaacctccac

SEQ ID NO: 18076 - DNA, 20 bp, Artificial Sequence
  chemically synthesized
aggggccaggcactcgcagg

SEQ ID NO: 18077 - DNA, 20 bp, Artificial Sequence
  chemically synthesized
tgtgcacgtatgtgcatatg

SEQ ID NO: 18078 - DNA, 20 bp, Artificial Sequence
  chemically synthesized
ctgggactctgtgtgtgtgt

SEQ ID NO: 18079 - DNA, 20 bp, Artificial Sequence
  chemically synthesized
gactctgtgtgtgtgtgtga

SEQ ID NO: 18080 - DNA, 20 bp, Artificial Sequence
  chemically synthesized
tgtgtatgtcgtgtatgtga

SEQ ID NO: 18081 - DNA, 20 bp, Artificial Sequence
  chemically synthesized
tgagagggtatgttgtgtgt

SEQ ID NO: 18082 - DNA, 20 bp, Artificial Sequence
  chemically synthesized
gtgttgtgtgtgtatgttgt

SEQ ID NO: 18083 - DNA, 20 bp, Artificial Sequence
  chemically synthesized
atgttgtgtgtatcttgtgt

SEQ ID NO: 18084 - DNA, 20 bp, Artificial Sequence
  chemically synthesized
tgtgcatgtgtgtatgttgt

SEQ ID NO: 18085 - DNA, 20 bp, Artificial Sequence
  chemically synthesized
tgcgagtgtatgttgtgtat

SEQ ID NO: 18086 - DNA, 20 bp, Artificial Sequence
  chemically synthesized
tgtgtgtatgtatgttgtgt

SEQ ID NO: 18087 - DNA, 20 bp, Artificial Sequence
  chemically synthesized
gtgttgtgtgtgtgtattgt

SEQ ID NO: 18088 - DNA, 20 bp, Artificial Sequence
  chemically synthesized
tatgtatgtttgtgtgttgt

SEQ ID NO: 18089 - DNA, 20 bp, Artificial Sequence
  chemically synthesized
tgtgcgtgtgtgtatgttgt

SEQ ID NO: 18090 - DNA, 20 bp, Artificial Sequence
  chemically synthesized
gtgtgttgtgtgtgtatgtt

SEQ ID NO: 18091 - DNA, 20 bp, Artificial Sequence
  chemically synthesized
gtgttatgtatgttgtgtgt

SEQ ID NO: 18092 - DNA, 20 bp, Artificial Sequence
  chemically synthesized
tgtgtgtgtgagtgtgttgc

SEQ ID NO: 18093 - DNA, 20 bp, Artificial Sequence
  chemically synthesized
tgtgtgtgtgtgtgtagagg

SEQ ID NO: 18094 - DNA, 20 bp, Artificial Sequence
  chemically synthesized
tgtgtgtgtgtagaggtggg

SEQ ID NO: 18095 - DNA, 20 bp, Artificial Sequence
  chemically synthesized
tgtgtagaggtggggtgagt

SEQ ID NO: 18096 - DNA, 20 bp, Artificial Sequence
  chemically synthesized
tagaggtggggtgagttggg

SEQ ID NO: 18097 - DNA, 20 bp, Artificial Sequence
  chemically synthesized
tcatctcccaagacccttcc

SEQ ID NO: 18098 - DNA, 20 bp, Artificial Sequence
  chemically synthesized
gacattttttttttagagac

SEQ ID NO: 18099 - DNA, 20 bp, Artificial Sequence
  chemically synthesized
tagagacaggagtgtagtgg

SEQ ID NO: 18100 - DNA, 20 bp, Artificial Sequence
  chemically synthesized
aaaaaaattttttagagaaa

SEQ ID NO: 18101 - DNA, 20 bp, Artificial Sequence
  chemically synthesized
taggcagaagggcaagagcc

SEQ ID NO: 18102 - DNA, 20 bp, Artificial Sequence
  chemically synthesized
agggcaagagccaggaatgg

SEQ ID NO: 18103 - DNA, 20 bp, Artificial Sequence
  chemically synthesized
aatggaggagtgtcaggtgt

SEQ ID NO: 18104 - DNA, 20 bp, Artificial Sequence
  chemically synthesized
tgtgggtgctggtggtggag

SEQ ID NO: 18105 - DNA, 20 bp, Artificial Sequence
  chemically synthesized
aggggcttggagcttaggaa

SEQ ID NO: 18106 - DNA, 20 bp, Artificial Sequence
  chemically synthesized
aggggattggttagctgggc

SEQ ID NO: 18107 - DNA, 20 bp, Artificial Sequence
  chemically synthesized
agggcagggcaggggacagg

SEQ ID NO: 18108 - DNA, 20 bp, Artificial Sequence
  chemically synthesized
gtacatagtgaacactcaga

SEQ ID NO: 18109 - DNA, 20 bp, Artificial Sequence
  chemically synthesized
gtgaacactcagagagaata

SEQ ID NO: 18110 - DNA, 20 bp, Artificial Sequence
  chemically synthesized
agagagaatacgggatgctg

SEQ ID NO: 18111 - DNA, 20 bp, Artificial Sequence
  chemically synthesized
gggatgctgctgaatcttct

SEQ ID NO: 18112 - DNA, 20 bp, Artificial Sequence
  chemically synthesized
gctgaatcttctgagggtga

SEQ ID NO: 18113 - DNA, 20 bp, Artificial Sequence
  chemically synthesized
cttctgagggtgacagaatt

SEQ ID NO: 18114 - DNA, 20 bp, Artificial Sequence
  chemically synthesized
caggaggcttggagagaggc

SEQ ID NO: 18115 - DNA, 20 bp, Artificial Sequence
  chemically synthesized
aggatttctgaaattaatgg

SEQ ID NO: 18116 - DNA, 20 bp, Artificial Sequence
  chemically synthesized
taatgggagagtgagctcac

SEQ ID NO: 18117 - DNA, 20 bp, Artificial Sequence
  chemically synthesized
accagtgagggaccgtctga

SEQ ID NO: 18118 - DNA, 20 bp, Artificial Sequence
  chemically synthesized
ccgcatttccctccagcagc

SEQ ID NO: 18119 - DNA, 20 bp, Artificial Sequence
  chemically synthesized
atttcaattatgcatgtatt

SEQ ID NO: 18120 - DNA, 20 bp, Artificial Sequence
  chemically synthesized
tctcccagtgtttcatttta

SEQ ID NO: 18121 - DNA, 20 bp, Artificial Sequence
  chemically synthesized
tctcactctgttgcccaggc

SEQ ID NO: 18122 - DNA, 20 bp, Artificial Sequence
  chemically synthesized
gagacggttttgccatgtag

SEQ ID NO: 18123 - DNA, 20 bp, Artificial Sequence
  chemically synthesized
gtgtcgacctcccaaagtgc

SEQ ID NO: 18124 - DNA, 20 bp, Artificial Sequence
  chemically synthesized
cttttttttttttttggagg

SEQ ID NO: 18125 - DNA, 20 bp, Artificial Sequence
  chemically synthesized
tctcgctctgttgcccaggc

SEQ ID NO: 18126 - DNA, 20 bp, Artificial Sequence
  chemically synthesized
ctcactgcaagctctgcctc

SEQ ID NO: 18127 - DNA, 20 bp, Artificial Sequence
  chemically synthesized
cattctcctgcctcagcctc

SEQ ID NO: 18128 - DNA, 20 bp, Artificial Sequence
  chemically synthesized
ttttgtatttttagtagaga

SEQ ID NO: 18129 - DNA, 20 bp, Artificial Sequence
  chemically synthesized
tggggtttcaccatgttagc

SEQ ID NO: 18130 - DNA, 20 bp, Artificial Sequence
  chemically synthesized
gccttggcctcccacagtgc

SEQ ID NO: 18131 - DNA, 20 bp, Artificial Sequence
  chemically synthesized
acttaattttttgaacataa

SEQ ID NO: 18132 - DNA, 20 bp, Artificial Sequence
  chemically synthesized
ttctagcatccgtgtcagtt

SEQ ID NO: 18133 - DNA, 20 bp, Artificial Sequence
  chemically synthesized
acattgtcaatttcaccttg

SEQ ID NO: 18134 - DNA, 20 bp, Artificial Sequence
  chemically synthesized
caatttcaccttgttgggtg

SEQ ID NO: 18135 - DNA, 20 bp, Artificial Sequence
  chemically synthesized
aatgttcttgagctttgctc

SEQ ID NO: 18136 - DNA, 20 bp, Artificial Sequence
  chemically synthesized
cgggatgcagttaagcaact

SEQ ID NO: 18137 - DNA, 20 bp, Artificial Sequence
  chemically synthesized
agctccatctcctcaacgtg

SEQ ID NO: 18138 - DNA, 20 bp, Artificial Sequence
  chemically synthesized
actctctccaaacagtaagc

SEQ ID NO: 18139 - DNA, 20 bp, Artificial Sequence
  chemically synthesized
acagtaagctggggtgatcg

SEQ ID NO: 18140 - DNA, 20 bp, Artificial Sequence
  chemically synthesized
ttgtttgcttcttatccctc

SEQ ID NO: 18141 - DNA, 20 bp, Artificial Sequence
  chemically synthesized
actcctccttgcctgatgtc

SEQ ID NO: 18142 - DNA, 20 bp, Artificial Sequence
  chemically synthesized
taattatccgagcaatccaa

SEQ ID NO: 18143 - DNA, 20 bp, Artificial Sequence
  chemically synthesized
aaaatggaagcatggagaaa

SEQ ID NO: 18144 - DNA, 20 bp, Artificial Sequence
  chemically synthesized
ccctgtgggcagtctggttt

SEQ ID NO: 18145 - DNA, 20 bp, Artificial Sequence
  chemically synthesized
gtgggcagtctggtttcagg

SEQ ID NO: 18146 - DNA, 20 bp, Artificial Sequence
  chemically synthesized
tgctgggctgacccagcatt

SEQ ID NO: 18147 - DNA, 20 bp, Artificial Sequence
  chemically synthesized
gggaagcaggacaggaccct

SEQ ID NO: 18148 - DNA, 20 bp, Artificial Sequence
  chemically synthesized
aggacaggaccctctgagtg

SEQ ID NO: 18149 - DNA, 20 bp, Artificial Sequence
  chemically synthesized
accgtggtcatggagcgctt

SEQ ID NO: 18150 - DNA, 20 bp, Artificial Sequence
  chemically synthesized
tggagcgcttctggatggag

SEQ ID NO: 18151 - DNA, 20 bp, Artificial Sequence
  chemically synthesized
aatgcaaaggccttggagga

SEQ ID NO: 18152 - DNA, 20 bp, Artificial Sequence
  chemically synthesized
ggggtgggggcagtgagagg

SEQ ID NO: 18153 - DNA, 20 bp, Artificial Sequence
  chemically synthesized
ggtggggctgtgctcagagc

SEQ ID NO: 18154 - DNA, 20 bp, Artificial Sequence
  chemically synthesized
tggaggtgtcagaggcctcc

SEQ ID NO: 18155 - DNA, 20 bp, Artificial Sequence
  chemically synthesized
agaggcctccctgggtcaaa

SEQ ID NO: 18156 - DNA, 20 bp, Artificial Sequence
  chemically synthesized
tccctgggtcaaatggggtc

SEQ ID NO: 18157 - DNA, 20 bp, Artificial Sequence
  chemically synthesized
tcactggtgtgaaaaagatg

SEQ ID NO: 18158 - DNA, 20 bp, Artificial Sequence
  chemically synthesized
ggcccctgactgagcctccc

SEQ ID NO: 18159 - DNA, 20 bp, Artificial Sequence
  chemically synthesized
ctccccaggatgtggtcctg

SEQ ID NO: 18160 - DNA, 20 bp, Artificial Sequence
  chemically synthesized
gatgtggtcctgctgggtcg

SEQ ID NO: 18161 - DNA, 20 bp, Artificial Sequence
  chemically synthesized
ctgctgggtcggggggtgat

SEQ ID NO: 18162 - DNA, 20 bp, Artificial Sequence
  chemically synthesized
tgagaagacaaggaagtcca

SEQ ID NO: 18163 - DNA, 20 bp, Artificial Sequence
  chemically synthesized
gacaaggaagtccacagagt

SEQ ID NO: 18164 - DNA, 20 bp, Artificial Sequence
  chemically synthesized
agaaggtgttctgtttgcag

SEQ ID NO: 18165 - DNA, 20 bp, Artificial Sequence
  chemically synthesized
ctgggacaactggagctgct

SEQ ID NO: 18166 - DNA, 20 bp, Artificial Sequence
  chemically synthesized
agctctgtgtgcaggaagac

SEQ ID NO: 18167 - DNA, 20 bp, Artificial Sequence
  chemically synthesized
gtgcaggaagacgtgggtgt

SEQ ID NO: 18168 - DNA, 20 bp, Artificial Sequence
  chemically synthesized
gggtgtgtgagtgtacgtgt

SEQ ID NO: 18169 - DNA, 20 bp, Artificial Sequence
  chemically synthesized
tcaggtgtgtgtgtgtggga

SEQ ID NO: 18170 - DNA, 20 bp, Artificial Sequence
  chemically synthesized
gtgtgtgtgtgggagggagt

SEQ ID NO: 18171 - DNA, 20 bp, Artificial Sequence
  chemically synthesized
tagcatgcatatgcacatgt

SEQ ID NO: 18172 - DNA, 20 bp, Artificial Sequence
  chemically synthesized
atgcatatgcacatgtgaga

SEQ ID NO: 18173 - DNA, 20 bp, Artificial Sequence
  chemically synthesized
gggtacagcagagcgtggtc

SEQ ID NO: 18174 - DNA, 20 bp, Artificial Sequence
  chemically synthesized
gtgtgtgcaaatgtgtgttt

SEQ ID NO: 18175 - DNA, 20 bp, Artificial Sequence
  chemically synthesized
ttgagtgaagtgagcaatgt

SEQ ID NO: 18176 - DNA, 20 bp, Artificial Sequence
  chemically synthesized
agtgagcaatgtgtgagtgt

SEQ ID NO: 18177 - DNA, 20 bp, Artificial Sequence
  chemically synthesized
gtgtgagtgtgtgagtgtgt

SEQ ID NO: 18178 - DNA, 20 bp, Artificial Sequence
  chemically synthesized
gtgtgagtttgtgagggcat

SEQ ID NO: 18179 - DNA, 20 bp, Artificial Sequence
  chemically synthesized
aatgtgtgtgtcagtgctgt

SEQ ID NO: 18180 - DNA, 20 bp, Artificial Sequence
  chemically synthesized
tcagtgctgtcagggtgcag

SEQ ID NO: 18181 - DNA, 20 bp, Artificial Sequence
  chemically synthesized
ggaggaggccttgcgtggtg

SEQ ID NO: 18182 - DNA, 20 bp, Artificial Sequence
  chemically synthesized
aggacaacaggtgggacctg

SEQ ID NO: 18183 - DNA, 20 bp, Artificial Sequence
  chemically synthesized
gacctggagggttgtgcttg

SEQ ID NO: 18184 - DNA, 20 bp, Artificial Sequence
  chemically synthesized
gcttggagagtgggctatgg

SEQ ID NO: 18185 - DNA, 20 bp, Artificial Sequence
  chemically synthesized
tggtggaatgacccagattt

SEQ ID NO: 18186 - DNA, 20 bp, Artificial Sequence
  chemically synthesized
cccagatttaaggatctcaa

SEQ ID NO: 18187 - DNA, 20 bp, Artificial Sequence
  chemically synthesized
aggggagggactgttccagt

SEQ ID NO: 18188 - DNA, 20 bp, Artificial Sequence
  chemically synthesized
agaacacagggcccagcttc

SEQ ID NO: 18189 - DNA, 20 bp, Artificial Sequence
  chemically synthesized
ctggaggcctctgccactgg

SEQ ID NO: 18190 - DNA, 20 bp, Artificial Sequence
  chemically synthesized
cattcacagatcccccttct

SEQ ID NO: 18191 - DNA, 20 bp, Artificial Sequence
  chemically synthesized
ggatgtgtgcctaggcaggg

SEQ ID NO: 18192 - DNA, 20 bp, Artificial Sequence
  chemically synthesized
gtctcccagtcccccagctc

SEQ ID NO: 18193 - DNA, 20 bp, Artificial Sequence
  chemically synthesized
gggctttgcacacagctgat

SEQ ID NO: 18194 - DNA, 20 bp, Artificial Sequence
  chemically synthesized
acacagctgatgtgaatatc

SEQ ID NO: 18195 - DNA, 20 bp, Artificial Sequence
  chemically synthesized
gaatatcctgagtcgtgtgc

SEQ ID NO: 18196 - DNA, 20 bp, Artificial Sequence
  chemically synthesized
gtatatttatacatggtaat

SEQ ID NO: 18197 - DNA, 20 bp, Artificial Sequence
  chemically synthesized
ttatacatggtaatatgggt

SEQ ID NO: 18198 - DNA, 20 bp, Artificial Sequence
  chemically synthesized
taatatgggtgcgagtgtgt

SEQ ID NO: 18199 - DNA, 20 bp, Artificial Sequence
  chemically synthesized
tgtgtgtaatgctcaaatgc

SEQ ID NO: 18200 - DNA, 20 bp, Artificial Sequence
  chemically synthesized
gctggtggtcatctgtgtga

SEQ ID NO: 18201 - DNA, 20 bp, Artificial Sequence
  chemically synthesized
gtgtgactgggtcccaaagt

SEQ ID NO: 18202 - DNA, 20 bp, Artificial Sequence
  chemically synthesized
tgagggtcacgggggccagc

SEQ ID NO: 18203 - DNA, 20 bp, Artificial Sequence
  chemically synthesized
ggggccagcagggatgggca

SEQ ID NO: 18204 - DNA, 20 bp, Artificial Sequence
  chemically synthesized
cgccctttgccctcgcttcc

SEQ ID NO: 18205 - DNA, 20 bp, Artificial Sequence
  chemically synthesized
ggggaggctcagtcaggggc

SEQ ID NO: 18206 - DNA, 20 bp, Artificial Sequence
  chemically synthesized
tgggaagagttcttctctcc

SEQ ID NO: 18207 - DNA, 20 bp, Artificial Sequence
  chemically synthesized
atccagaactgacacggatg

SEQ ID NO: 18208 - DNA, 20 bp, Artificial Sequence
  chemically synthesized
cattatgttcaaaaaattaa

SEQ ID NO: 18209 - DNA, 20 bp, Artificial Sequence
  chemically synthesized
ctactcgggaggctgaggca

SEQ ID NO: 18210 - DNA, 20 bp, Artificial Sequence
  chemically synthesized
tccgcctccaaaaaaaaaaa

SEQ ID NO: 18211 - DNA, 20 bp, Artificial Sequence
  chemically synthesized
ctccaaaaaaaaaaaaaaga

SEQ ID NO: 18212 - DNA, 20 bp, Artificial Sequence
  chemically synthesized
aaaaaaaaaaaaaagaaaag

SEQ ID NO: 18213 - DNA, 20 bp, Artificial Sequence
  chemically synthesized
aaaaaaaaagaaaagaaaga

SEQ ID NO: 18214 - DNA, 20 bp, Artificial Sequence
  chemically synthesized
tggatggaaataatggaaga

SEQ ID NO: 18215 - DNA, 20 bp, Artificial Sequence
  chemically synthesized
aatggaagatgagaaatgcg

SEQ ID NO: 18216 - DNA, 20 bp, Artificial Sequence
  chemically synthesized
ctctataaaatgaaacactg

SEQ ID NO: 18217 - DNA, 20 bp, Artificial Sequence
  chemically synthesized
aaatgaaacactgggagaaa

SEQ ID NO: 18218 - DNA, 20 bp, Artificial Sequence
  chemically synthesized
aaaagaattaaaaaatggaa

SEQ ID NO: 18219 - DNA, 20 bp, Artificial Sequence
  chemically synthesized
atgcataattgaaatcttta

SEQ ID NO: 18220 - DNA, 20 bp, Artificial Sequence
  chemically synthesized
tttaaaagaaaaagggggta

SEQ ID NO: 18221 - DNA, 20 bp, Artificial Sequence
  chemically synthesized
agctcactctcccattaatt

SEQ ID NO: 18222 - DNA, 20 bp, Artificial Sequence
  chemically synthesized
gacagagggggagcaaagcc

SEQ ID NO: 18223 - DNA, 20 bp, Artificial Sequence
  chemically synthesized
caaattaaaaaaaatttttt

SEQ ID NO: 18224 - DNA, 20 bp, Artificial Sequence
  chemically synthesized
ggtacatagtgaacactcag

SEQ ID NO: 18225 - DNA, 20 bp, Artificial Sequence
  chemically synthesized
tgctgaatcttctgagggtg

SEQ ID NO: 18226 - DNA, 20 bp, Artificial Sequence
  chemically synthesized
tgtgatctccattttacaca

SEQ ID NO: 18227 - DNA, 20 bp, Artificial Sequence
  chemically synthesized
acacgagaaaatggaagcat

SEQ ID NO: 18228 - DNA, 20 bp, Artificial Sequence
  chemically synthesized
acacattgctcacttcactc

SEQ ID NO: 18229 - DNA, 20 bp, Artificial Sequence
  chemically synthesized
cttctctccccagaaacaat

SEQ ID NO: 18230 - DNA, 20 bp, Artificial Sequence
  chemically synthesized
tccccagaaacaatcaaaac

SEQ ID NO: 18231 - DNA, 20 bp, Artificial Sequence
  chemically synthesized
agctgagagtccgaggagac

SEQ ID NO: 18232 - DNA, 20 bp, Artificial Sequence
  chemically synthesized
caaggcatgcaatgaaacgg

SEQ ID NO: 18233 - DNA, 20 bp, Artificial Sequence
  chemically synthesized
gaattagcaggcaaggatgg

SEQ ID NO: 18234 - DNA, 20 bp, Artificial Sequence
  chemically synthesized
ccaggtgaacttctagagat

SEQ ID NO: 18235 - DNA, 20 bp, Artificial Sequence
  chemically synthesized
aactacaatgtctgaaatga

SEQ ID NO: 18236 - DNA, 20 bp, Artificial Sequence
  chemically synthesized
aaaagaaaagaaagaaaaga

SEQ ID NO: 18237 - DNA, 20 bp, Artificial Sequence
  chemically synthesized
gactagtctgggcagcatgg

SEQ ID NO: 18238 - DNA, 20 bp, Artificial Sequence
  chemically synthesized
ggcaaaacccctctacatgg

SEQ ID NO: 18239 - DNA, 20 bp, Artificial Sequence
  chemically synthesized
tgccactggctggatgggag

SEQ ID NO: 18240 - DNA, 20 bp, Artificial Sequence
  chemically synthesized
gaggaggcataacctgggcg

SEQ ID NO: 18241 - DNA, 20 bp, Artificial Sequence
  chemically synthesized
ggccatgggggggggtcatc

SEQ ID NO: 18242 - DNA, 20 bp, Artificial Sequence
  chemically synthesized
cctgagaagggggatctgtg

SEQ ID NO: 18243 - DNA, 20 bp, Artificial Sequence
  chemically synthesized
tcttctaaggctcctgtccc

SEQ ID NO: 18244 - DNA, 20 bp, Artificial Sequence
  chemically synthesized
tcctccccagcgccctttgc

SEQ ID NO: 18245 - DNA, 20 bp, Artificial Sequence
  chemically synthesized
cctccactcagagggtcctg

SEQ ID NO: 18246 - DNA, 20 bp, Artificial Sequence
  chemically synthesized
tgcaccagcattcaatttct

SEQ ID NO: 18247 - DNA, 20 bp, Artificial Sequence
  chemically synthesized
tggagatcacagtcgtagct

SEQ ID NO: 18248 - DNA, 20 bp, Artificial Sequence
  chemically synthesized
atcacagtcgtagctacccg

SEQ ID NO: 18249 - DNA, 20 bp, Artificial Sequence
  chemically synthesized
tagatgagttaaaatatgta

SEQ ID NO: 18250 - DNA, 20 bp, Artificial Sequence
  chemically synthesized
atgtaatgtgcttcttaggc

SEQ ID NO: 18251 - DNA, 20 bp, Artificial Sequence
  chemically synthesized
aacagacaactatagaacat

SEQ ID NO: 18252 - DNA, 20 bp, Artificial Sequence
  chemically synthesized
aacaggaaccctccgatcac

SEQ ID NO: 18253 - DNA, 20 bp, Artificial Sequence
  chemically synthesized
accctccgatcaccccagct

SEQ ID NO: 18254 - DNA, 20 bp, Artificial Sequence
  chemically synthesized
aaacgatcaaactgactcta

SEQ ID NO: 18255 - DNA, 20 bp, Artificial Sequence
  chemically synthesized
gacaatgtctggcagccaat

SEQ ID NO: 18256 - DNA, 20 bp, Artificial Sequence
  chemically synthesized
aatggcatgaacccgggagg

SEQ ID NO: 18257 - DNA, 20 bp, Artificial Sequence
  chemically synthesized
ctctaaattctgtcaccctc

SEQ ID NO: 18258 - DNA, 20 bp, Artificial Sequence
  chemically synthesized
ttgggaggctgaggtgggag

SEQ ID NO: 18259 - DNA, 20 bp, Artificial Sequence
  chemically synthesized
aagatacttaggtccttcag

SEQ ID NO: 18260 - DNA, 20 bp, Artificial Sequence
  chemically synthesized
ctgcacacttgcctttcaaa

SEQ ID NO: 18261 - DNA, 20 bp, Artificial Sequence
  chemically synthesized
tcaaaaatggatttcctctc

SEQ ID NO: 18262 - DNA, 20 bp, Artificial Sequence
  chemically synthesized
ggctggggctggggcagagg

SEQ ID NO: 18263 - DNA, 20 bp, Artificial Sequence
  chemically synthesized
ccatttttgaaaggcaagtg

SEQ ID NO: 18264 - DNA, 20 bp, Artificial Sequence
  chemically synthesized
aaaggcaagtgtgcagtttc

SEQ ID NO: 18265 - DNA, 20 bp, Artificial Sequence
  chemically synthesized
tgctccccctctgtctcagc

SEQ ID NO: 18266 - DNA, 20 bp, Artificial Sequence
  chemically synthesized
gactgaggagggcccgacac

SEQ ID NO: 18267 - DNA, 20 bp, Artificial Sequence
  chemically synthesized
acgtatgtgcatatgaggaa

SEQ ID NO: 18268 - DNA, 20 bp, Artificial Sequence
  chemically synthesized
tgtgtattgtgtgagtgtat

SEQ ID NO: 18269 - DNA, 20 bp, Artificial Sequence
  chemically synthesized
gtgtgtgtgttagtgtgtgt

SEQ ID NO: 18270 - DNA, 20 bp, Artificial Sequence
  chemically synthesized
atgttgcccaggctggtggg

SEQ ID NO: 18271 - DNA, 20 bp, Artificial Sequence
  chemically synthesized
tccatggaggcaggaggagc

SEQ ID NO: 18272 - DNA, 20 bp, Artificial Sequence
  chemically synthesized
aggcaggaggagcaggggct

SEQ ID NO: 18273 - DNA, 20 bp, Artificial Sequence
  chemically synthesized
caggggcttggagcttagga

SEQ ID NO: 18274 - DNA, 20 bp, Artificial Sequence
  chemically synthesized
cttctgagggtgacagaatt

SEQ ID NO: 18275 - DNA, 20 bp, Artificial Sequence
  chemically synthesized
cagaatttagagtttgagca

SEQ ID NO: 18276 - DNA, 20 bp, Artificial Sequence
  chemically synthesized
gcaggaggcttggagagagg

SEQ ID NO: 18277 - DNA, 20 bp, Artificial Sequence
  chemically synthesized
catcttccacttgtctcagc

SEQ ID NO: 18278 - DNA, 20 bp, Artificial Sequence
  chemically synthesized
ctgctaccccctttttcttt

SEQ ID NO: 18279 - DNA, 20 bp, Artificial Sequence
  chemically synthesized
tttttaattcttttttctcc

SEQ ID NO: 18280 - DNA, 20 bp, Artificial Sequence
  chemically synthesized
cccctcccctcctttccttc

SEQ ID NO: 18281 - DNA, 20 bp, Artificial Sequence
  chemically synthesized
tgttgcccaggctggaatgc

SEQ ID NO: 18282 - DNA, 20 bp, Artificial Sequence
  chemically synthesized
taaaaatttttttttgtaga

SEQ ID NO: 18283 - DNA, 20 bp, Artificial Sequence
  chemically synthesized
gagacggttttgccatgtag

SEQ ID NO: 18284 - DNA, 20 bp, Artificial Sequence
  chemically synthesized
agtcttgagctcctgggctc

SEQ ID NO: 18285 - DNA, 20 bp, Artificial Sequence
  chemically synthesized
cgtgtcgacctcccaaagtg

SEQ ID NO: 18286 - DNA, 20 bp, Artificial Sequence
  chemically synthesized
tcttccattatttccatcca

SEQ ID NO: 18287 - DNA, 20 bp, Artificial Sequence
  chemically synthesized
ttttgtatttttagtagaga

SEQ ID NO: 18288 - DNA, 20 bp, Artificial Sequence
  chemically synthesized
cgccttggcctcccacagtg

SEQ ID NO: 18289 - DNA, 20 bp, Artificial Sequence
  chemically synthesized
tgagccacggcgcctggcca

SEQ ID NO: 18290 - DNA, 20 bp, Artificial Sequence
  chemically synthesized
tgttttttcatttcagacat

SEQ ID NO: 18291 - DNA, 20 bp, Artificial Sequence
  chemically synthesized
taatgggatatggctataat

SEQ ID NO: 18292 - DNA, 20 bp, Artificial Sequence
  chemically synthesized
atgaacctcctcgttatgca

SEQ ID NO: 18293 - DNA, 20 bp, Artificial Sequence
  chemically synthesized
cctcgttatgcattgtgttt

SEQ ID NO: 18294 - DNA, 20 bp, Artificial Sequence
  chemically synthesized
ttcattgcatgccttgtaat

SEQ ID NO: 18295 - DNA, 20 bp, Artificial Sequence
  chemically synthesized
ttgtattcctctaaatgttc

SEQ ID NO: 18296 - DNA, 20 bp, Artificial Sequence
  chemically synthesized
atgcagttaagcaacttaga

SEQ ID NO: 18297 - DNA, 20 bp, Artificial Sequence
  chemically synthesized
aagcaacttagagtcagttt

SEQ ID NO: 18298 - DNA, 20 bp, Artificial Sequence
  chemically synthesized
gtttgatcgtttgaactctt

SEQ ID NO: 18299 - DNA, 20 bp, Artificial Sequence
  chemically synthesized
tggggtgatcggagggttcc

SEQ ID NO: 18300 - DNA, 20 bp, Artificial Sequence
  chemically synthesized
gtgatcggagggttcctgtt

SEQ ID NO: 18301 - DNA, 20 bp, Artificial Sequence
  chemically synthesized
agctgccatgttctatagtt

SEQ ID NO: 18302 - DNA, 20 bp, Artificial Sequence
  chemically synthesized
catgttctatagttgtctgt

SEQ ID NO: 18303 - DNA, 20 bp, Artificial Sequence
  chemically synthesized
tctatagttgtctgtttttg

SEQ ID NO: 18304 - DNA, 20 bp, Artificial Sequence
  chemically synthesized
tagttgtctgtttttgtttt

SEQ ID NO: 18305 - DNA, 20 bp, Artificial Sequence
  chemically synthesized
ctgggctaccctgtgggcag

SEQ ID NO: 18306 - DNA, 20 bp, Artificial Sequence
  chemically synthesized
cagggactcagccatggagg

SEQ ID NO: 18307 - DNA, 20 bp, Artificial Sequence
  chemically synthesized
tggggaacaccgtggtcatg

SEQ ID NO: 18308 - DNA, 20 bp, Artificial Sequence
  chemically synthesized
ggcaggaagtgacctgggga

SEQ ID NO: 18309 - DNA, 20 bp, Artificial Sequence
  chemically synthesized
ggtccaaggcctagaaggtg

SEQ ID NO: 18310 - DNA, 20 bp, Artificial Sequence
  chemically synthesized
ggtcatgagtgtgtgcaaat

SEQ ID NO: 18311 - DNA, 20 bp, Artificial Sequence
  chemically synthesized
gtgtgagtgtgtgagtgtgt

SEQ ID NO: 18312 - DNA, 20 bp, Artificial Sequence
  chemically synthesized
ggagcaaatttagtgtggaa

SEQ ID NO: 18313 - DNA, 20 bp, Artificial Sequence
  chemically synthesized
aacaggtgggacctggaggg

SEQ ID NO: 18314 - DNA, 20 bp, Artificial Sequence
  chemically synthesized
agtgggctatggtggaatga

SEQ ID NO: 18315 - DNA, 20 bp, Artificial Sequence
  chemically synthesized
caggggagggactgttccag

SEQ ID NO: 18316 - DNA, 20 bp, Artificial Sequence
  chemically synthesized
attttaggaagaacacaggg

SEQ ID NO: 18317 - DNA, 20 bp, Artificial Sequence
  chemically synthesized
cagtcccccagctccaggat

SEQ ID NO: 18318 - DNA, 20 bp, Artificial Sequence
  chemically synthesized
gtgtgcatgggtgtgtgtgc

SEQ ID NO: 18319 - DNA, 20 bp, Artificial Sequence
  chemically synthesized
cccgcccaggttatgcctcc

SEQ ID NO: 18320 - DNA, 20 bp, Artificial Sequence
  chemically synthesized
cacagcgtctctgctccatg

SEQ ID NO: 18321 - DNA, 20 bp, Artificial Sequence
  chemically synthesized
ctgctccatggtctgcttca

SEQ ID NO: 18322 - DNA, 20 bp, Artificial Sequence
  chemically synthesized
tctgcttcagtctgcttgcc

SEQ ID NO: 18323 - DNA, 22 bp, Artificial Sequence
  chemically synthesized
cccatgtctctttccctacccc

SEQ ID NO: 18324 - DNA, 22 bp, Artificial Sequence
  chemically synthesized
tttccctaccccttgcccatcc

SEQ ID NO: 18325 - DNA, 22 bp, Artificial Sequence
  chemically synthesized
tccctaccccttgcccatccct

SEQ ID NO: 18326 - DNA, 22 bp, Artificial Sequence
  chemically synthesized
ccctaccccttgcccatccctg

SEQ ID NO: 18327 - DNA, 22 bp, Artificial Sequence
  chemically synthesized
cctaccccttgcccatccctgc

SEQ ID NO: 18328 - DNA, 22 bp, Artificial Sequence
  chemically synthesized
ccccttgcccatccctgctggc

SEQ ID NO: 18329 - DNA, 22 bp, Artificial Sequence
  chemically synthesized
gcccatccctgctggcccccgt

SEQ ID NO: 18330 - DNA, 22 bp, Artificial Sequence
  chemically synthesized
cccatccctgctggcccccgtg

SEQ ID NO: 18331 - DNA, 22 bp, Artificial Sequence
  chemically synthesized
ctggcccccgtgaccctcactt

SEQ ID NO: 18332 - DNA, 22 bp, Artificial Sequence
  chemically synthesized
gcccccgtgaccctcactttgg

SEQ ID NO: 18333 - DNA, 22 bp, Artificial Sequence
  chemically synthesized
actttgggacccagtcacacag

SEQ ID NO: 18334 - DNA, 22 bp, Artificial Sequence
  chemically synthesized
tgggacccagtcacacagatga

SEQ ID NO: 18335 - DNA, 22 bp, Artificial Sequence
  chemically synthesized
gggacccagtcacacagatgac

SEQ ID NO: 18336 - DNA, 22 bp, Artificial Sequence
  chemically synthesized
ggacccagtcacacagatgacc

SEQ ID NO: 18337 - DNA, 22 bp, Artificial Sequence
  chemically synthesized
aagctcagggcaagcagactga

SEQ ID NO: 18338 - DNA, 22 bp, Artificial Sequence
  chemically synthesized
agggcaagcagactgaagcaga

SEQ ID NO: 18339 - DNA, 22 bp, Artificial Sequence
  chemically synthesized
aagcagaccatggagcagagac

SEQ ID NO: 18340 - DNA, 22 bp, Artificial Sequence
  chemically synthesized
tgccaggggctgggcaggaggt

SEQ ID NO: 18341 - DNA, 22 bp, Artificial Sequence
  chemically synthesized
ggcaggaggtggccctgtggga

SEQ ID NO: 18342 - DNA, 22 bp, Artificial Sequence
  chemically synthesized
tgggagaggggcatcaggagcc

SEQ ID NO: 18343 - DNA, 22 bp, Artificial Sequence
  chemically synthesized
ggtgtggggagccggagggtaa

SEQ ID NO: 18344 - DNA, 22 bp, Artificial Sequence
  chemically synthesized
aggaggcataacctgggcgggg

SEQ ID NO: 18345 - DNA, 22 bp, Artificial Sequence
  chemically synthesized
ggcggggggattggttggggcc

SEQ ID NO: 18346 - DNA, 22 bp, Artificial Sequence
  chemically synthesized
gttggggccatgggggggggtc

SEQ ID NO: 18347 - DNA, 22 bp, Artificial Sequence
  chemically synthesized
gggccatgggggggggtcatca

SEQ ID NO: 18348 - DNA, 22 bp, Artificial Sequence
  chemically synthesized
tgaccccagcatttgagcatta

SEQ ID NO: 18349 - DNA, 22 bp, Artificial Sequence
  chemically synthesized
gaccccagcatttgagcattac

SEQ ID NO: 18350 - DNA, 22 bp, Artificial Sequence
  chemically synthesized
accccagcatttgagcattaca

SEQ ID NO: 18351 - DNA, 22 bp, Artificial Sequence
  chemically synthesized
gagcattacacacacactctta

SEQ ID NO: 18352 - DNA, 22 bp, Artificial Sequence
  chemically synthesized
agcattacacacacactcttac

SEQ ID NO: 18353 - DNA, 22 bp, Artificial Sequence
  chemically synthesized
cacacacactcttacacactcg

SEQ ID NO: 18354 - DNA, 22 bp, Artificial Sequence
  chemically synthesized
ttacacactcgcacccatatta

SEQ ID NO: 18355 - DNA, 22 bp, Artificial Sequence
  chemically synthesized
acacactcgcacccatattacc

SEQ ID NO: 18356 - DNA, 22 bp, Artificial Sequence
  chemically synthesized
cacactcgcacccatattacca

SEQ ID NO: 18357 - DNA, 22 bp, Artificial Sequence
  chemically synthesized
gcacccatattaccatgtataa

SEQ ID NO: 18358 - DNA, 22 bp, Artificial Sequence
  chemically synthesized
ccatgtataaatatacacacgc

SEQ ID NO: 18359 - DNA, 22 bp, Artificial Sequence
  chemically synthesized
atctggtgcacacacacccatg

SEQ ID NO: 18360 - DNA, 22 bp, Artificial Sequence
  chemically synthesized
gtgcacacacacccatgcacac

SEQ ID NO: 18361 - DNA, 22 bp, Artificial Sequence
  chemically synthesized
aggatattcacatcagctgtgt

SEQ ID NO: 18362 - DNA, 22 bp, Artificial Sequence
  chemically synthesized
acatcagctgtgtgcaaagccc

SEQ ID NO: 18363 - DNA, 22 bp, Artificial Sequence
  chemically synthesized
tgtgcaaagcccggatcctgga

SEQ ID NO: 18364 - DNA, 22 bp, Artificial Sequence
  chemically synthesized
gagctgggggactgggagacgc

SEQ ID NO: 18365 - DNA, 22 bp, Artificial Sequence
  chemically synthesized
ggggactgggagacgcacaggg

SEQ ID NO: 18366 - DNA, 22 bp, Artificial Sequence
  chemically synthesized
ggagacgcacagggggcggggg

SEQ ID NO: 18367 - DNA, 22 bp, Artificial Sequence
  chemically synthesized
cctaggcacacatcctgagaag

SEQ ID NO: 18368 - DNA, 22 bp, Artificial Sequence
  chemically synthesized
ggcacacatcctgagaaggggg

SEQ ID NO: 18369 - DNA, 22 bp, Artificial Sequence
  chemically synthesized
agaagggggatctgtgaatggt

SEQ ID NO: 18370 - DNA, 22 bp, Artificial Sequence
  chemically synthesized
tgaatggttttcctcccatcca

SEQ ID NO: 18371 - DNA, 22 bp, Artificial Sequence
  chemically synthesized
tcctcccatccagccagtggca

SEQ ID NO: 18372 - DNA, 22 bp, Artificial Sequence
  chemically synthesized
cctcccatccagccagtggcag

SEQ ID NO: 18373 - DNA, 22 bp, Artificial Sequence
  chemically synthesized
ctcccatccagccagtggcaga

SEQ ID NO: 18374 - DNA, 22 bp, Artificial Sequence
  chemically synthesized
ccatccagccagtggcagaggc

SEQ ID NO: 18375 - DNA, 22 bp, Artificial Sequence
  chemically synthesized
cagatcacctcgggccttagtc

SEQ ID NO: 18376 - DNA, 22 bp, Artificial Sequence
  chemically synthesized
gggccttagtctcagctcttct

SEQ ID NO: 18377 - DNA, 22 bp, Artificial Sequence
  chemically synthesized
agtctcagctcttctaaggctc

SEQ ID NO: 18378 - DNA, 22 bp, Artificial Sequence
  chemically synthesized
gtctcagctcttctaaggctcc

SEQ ID NO: 18379 - DNA, 22 bp, Artificial Sequence
  chemically synthesized
agctcttctaaggctcctgtcc

SEQ ID NO: 18380 - DNA, 22 bp, Artificial Sequence
  chemically synthesized
ttctaaggctcctgtcccctca

SEQ ID NO: 18381 - DNA, 22 bp, Artificial Sequence
  chemically synthesized
ctaaggctcctgtcccctcaga

SEQ ID NO: 18382 - DNA, 22 bp, Artificial Sequence
  chemically synthesized
taaggctcctgtcccctcagat

SEQ ID NO: 18383 - DNA, 22 bp, Artificial Sequence
  chemically synthesized
aggctcctgtcccctcagattg

SEQ ID NO: 18384 - DNA, 22 bp, Artificial Sequence
  chemically synthesized
ctgtcccctcagattggagact

SEQ ID NO: 18385 - DNA, 22 bp, Artificial Sequence
  chemically synthesized
tcccctcagattggagactcca

SEQ ID NO: 18386 - DNA, 22 bp, Artificial Sequence
  chemically synthesized
agattggagactccagaagctg

SEQ ID NO: 18387 - DNA, 22 bp, Artificial Sequence
  chemically synthesized
gagactccagaagctgggccct

SEQ ID NO: 18388 - DNA, 22 bp, Artificial Sequence
  chemically synthesized
cagaagctgggccctgtgttct

SEQ ID NO: 18389 - DNA, 22 bp, Artificial Sequence
  chemically synthesized
ggccctgtgttcttcctaaaat

SEQ ID NO: 18390 - DNA, 22 bp, Artificial Sequence
  chemically synthesized
tgttcttcctaaaatccatact

SEQ ID NO: 18391 - DNA, 22 bp, Artificial Sequence
  chemically synthesized
ttcctaaaatccatactggaac

SEQ ID NO: 18392 - DNA, 22 bp, Artificial Sequence
  chemically synthesized
cctaaaatccatactggaacag

SEQ ID NO: 18393 - DNA, 22 bp, Artificial Sequence
  chemically synthesized
ctaaaatccatactggaacagt

SEQ ID NO: 18394 - DNA, 22 bp, Artificial Sequence
  chemically synthesized
aaatccatactggaacagtccc

SEQ ID NO: 18395 - DNA, 22 bp, Artificial Sequence
  chemically synthesized
gaacagtccctcccctgccaaa

SEQ ID NO: 18396 - DNA, 22 bp, Artificial Sequence
  chemically synthesized
ccctgccaaaattccattgaga

SEQ ID NO: 18397 - DNA, 22 bp, Artificial Sequence
  chemically synthesized
ccaaaattccattgagatcctt

SEQ ID NO: 18398 - DNA, 22 bp, Artificial Sequence
  chemically synthesized
cattgagatccttaaatctggg

SEQ ID NO: 18399 - DNA, 22 bp, Artificial Sequence
  chemically synthesized
agatccttaaatctgggtcatt

SEQ ID NO: 18400 - DNA, 22 bp, Artificial Sequence
  chemically synthesized
aaatctgggtcattccaccata

SEQ ID NO: 18401 - DNA, 22 bp, Artificial Sequence
  chemically synthesized
aatctgggtcattccaccatag

SEQ ID NO: 18402 - DNA, 22 bp, Artificial Sequence
  chemically synthesized
ggtcattccaccatagcccact

SEQ ID NO: 18403 - DNA, 22 bp, Artificial Sequence
  chemically synthesized
caccatagcccactctccaagc

SEQ ID NO: 18404 - DNA, 22 bp, Artificial Sequence
  chemically synthesized
tccaagcacaaccctccaggtc

SEQ ID NO: 18405 - DNA, 22 bp, Artificial Sequence
  chemically synthesized
caagcacaaccctccaggtccc

SEQ ID NO: 18406 - DNA, 22 bp, Artificial Sequence
  chemically synthesized
caggtcccacctgttgtcctca

SEQ ID NO: 18407 - DNA, 22 bp, Artificial Sequence
  chemically synthesized
ttgtcctcatcccccaccacgc

SEQ ID NO: 18408 - DNA, 22 bp, Artificial Sequence
  chemically synthesized
tcctcatcccccaccacgcaag

SEQ ID NO: 18409 - DNA, 22 bp, Artificial Sequence
  chemically synthesized
atcccccaccacgcaaggcctc

SEQ ID NO: 18410 - DNA, 22 bp, Artificial Sequence
  chemically synthesized
ctccccagcgccctttgccctc

SEQ ID NO: 18411 - DNA, 22 bp, Artificial Sequence
  chemically synthesized
cccagcgccctttgccctcgct

SEQ ID NO: 18412 - DNA, 22 bp, Artificial Sequence
  chemically synthesized
tgccctcgcttccctagaaacc

SEQ ID NO: 18413 - DNA, 22 bp, Artificial Sequence
  chemically synthesized
gccctcgcttccctagaaacct

SEQ ID NO: 18414 - DNA, 22 bp, Artificial Sequence
  chemically synthesized
ccctcgcttccctagaaacctc

SEQ ID NO: 18415 - DNA, 22 bp, Artificial Sequence
  chemically synthesized
gcttccctagaaacctcgttcc

SEQ ID NO: 18416 - DNA, 22 bp, Artificial Sequence
  chemically synthesized
ccctagaaacctcgttccacac

SEQ ID NO: 18417 - DNA, 22 bp, Artificial Sequence
  chemically synthesized
cctagaaacctcgttccacact

SEQ ID NO: 18418 - DNA, 22 bp, Artificial Sequence
  chemically synthesized
gaaacctcgttccacactaaat

SEQ ID NO: 18419 - DNA, 22 bp, Artificial Sequence
  chemically synthesized
gttccacactaaatttgctccc

SEQ ID NO: 18420 - DNA, 22 bp, Artificial Sequence
  chemically synthesized
cacactaaatttgctcccctca

SEQ ID NO: 18421 - DNA, 22 bp, Artificial Sequence
  chemically synthesized
aatttgctcccctcagcccgag

SEQ ID NO: 18422 - DNA, 22 bp, Artificial Sequence
  chemically synthesized
gctcccctcagcccgaggtcat

SEQ ID NO: 18423 - DNA, 22 bp, Artificial Sequence
  chemically synthesized
ctcccctcagcccgaggtcatc

SEQ ID NO: 18424 - DNA, 22 bp, Artificial Sequence
  chemically synthesized
ccctcagcccgaggtcatctca

SEQ ID NO: 18425 - DNA, 22 bp, Artificial Sequence
  chemically synthesized
agcccgaggtcatctcacaggt

SEQ ID NO: 18426 - DNA, 22 bp, Artificial Sequence
  chemically synthesized
acaggtacctctcctgcccctt

SEQ ID NO: 18427 - DNA, 22 bp, Artificial Sequence
  chemically synthesized
tcctgccccttgatccatctgc

SEQ ID NO: 18428 - DNA, 22 bp, Artificial Sequence
  chemically synthesized
ctgccccttgatccatctgcac

SEQ ID NO: 18429 - DNA, 22 bp, Artificial Sequence
  chemically synthesized
ccccttgatccatctgcaccct

SEQ ID NO: 18430 - DNA, 22 bp, Artificial Sequence
  chemically synthesized
gatccatctgcaccctgacagc

SEQ ID NO: 18431 - DNA, 22 bp, Artificial Sequence
  chemically synthesized
atccatctgcaccctgacagca

SEQ ID NO: 18432 - DNA, 22 bp, Artificial Sequence
  chemically synthesized
caccctgacagcactgacacac

SEQ ID NO: 18433 - DNA, 22 bp, Artificial Sequence
  chemically synthesized
acagcactgacacacacattca

SEQ ID NO: 18434 - DNA, 22 bp, Artificial Sequence
  chemically synthesized
acacacacattcacatgccctc

SEQ ID NO: 18435 - DNA, 22 bp, Artificial Sequence
  chemically synthesized
acatgccctcacaaactcacac

SEQ ID NO: 18436 - DNA, 22 bp, Artificial Sequence
  chemically synthesized
acaaactcacacacactcacac

SEQ ID NO: 18437 - DNA, 22 bp, Artificial Sequence
  chemically synthesized
acacacactcacacactcacac

SEQ ID NO: 18438 - DNA, 22 bp, Artificial Sequence
  chemically synthesized
acacactcacacattgctcact

SEQ ID NO: 18439 - DNA, 22 bp, Artificial Sequence
  chemically synthesized
acacattgctcacttcactcaa

SEQ ID NO: 18440 - DNA, 22 bp, Artificial Sequence
  chemically synthesized
ctcacttcactcaaaaacacac

SEQ ID NO: 18441 - DNA, 22 bp, Artificial Sequence
  chemically synthesized
acttcactcaaaaacacacatt

SEQ ID NO: 18442 - DNA, 22 bp, Artificial Sequence
  chemically synthesized
cactcaaaaacacacatttgca

SEQ ID NO: 18443 - DNA, 22 bp, Artificial Sequence
  chemically synthesized
actcaaaaacacacatttgcac

SEQ ID NO: 18444 - DNA, 22 bp, Artificial Sequence
  chemically synthesized
aaaaacacacatttgcacacac

SEQ ID NO: 18445 - DNA, 22 bp, Artificial Sequence
  chemically synthesized
gcacacactcatgaccacgctc

SEQ ID NO: 18446 - DNA, 22 bp, Artificial Sequence
  chemically synthesized
cacacactcatgaccacgctct

SEQ ID NO: 18447 - DNA, 22 bp, Artificial Sequence
  chemically synthesized
atgaccacgctctgctgtaccc

SEQ ID NO: 18448 - DNA, 22 bp, Artificial Sequence
  chemically synthesized
tgctgtacccactctcacatgt

SEQ ID NO: 18449 - DNA, 22 bp, Artificial Sequence
  chemically synthesized
ctgtacccactctcacatgtgc

SEQ ID NO: 18450 - DNA, 22 bp, Artificial Sequence
  chemically synthesized
tacccactctcacatgtgcata

SEQ ID NO: 18451 - DNA, 22 bp, Artificial Sequence
  chemically synthesized
tcacatgtgcatatgcatgcta

SEQ ID NO: 18452 - DNA, 22 bp, Artificial Sequence
  chemically synthesized
acatgtgcatatgcatgctaat

SEQ ID NO: 18453 - DNA, 22 bp, Artificial Sequence
  chemically synthesized
atgcacacattcatactccctc

SEQ ID NO: 18454 - DNA, 22 bp, Artificial Sequence
  chemically synthesized
atactccctcccacacacacac

SEQ ID NO: 18455 - DNA, 22 bp, Artificial Sequence
  chemically synthesized
cctcccacacacacacacctga

SEQ ID NO: 18456 - DNA, 22 bp, Artificial Sequence
  chemically synthesized
ccacacacacacacctgacaca

SEQ ID NO: 18457 - DNA, 22 bp, Artificial Sequence
  chemically synthesized
acacacccacacacgtacactc

SEQ ID NO: 18458 - DNA, 22 bp, Artificial Sequence
  chemically synthesized
acacacccacgtcttcctgcac

SEQ ID NO: 18459 - DNA, 22 bp, Artificial Sequence
  chemically synthesized
cctgcacacagagctgggctcc

SEQ ID NO: 18460 - DNA, 22 bp, Artificial Sequence
  chemically synthesized
ctgcacacagagctgggctccc

SEQ ID NO: 18461 - DNA, 22 bp, Artificial Sequence
  chemically synthesized
cacacagagctgggctccctct

SEQ ID NO: 18462 - DNA, 22 bp, Artificial Sequence
  chemically synthesized
ggctccctctctgctgcctcca

SEQ ID NO: 18463 - DNA, 22 bp, Artificial Sequence
  chemically synthesized
cctctctgctgcctccagaccc

SEQ ID NO: 18464 - DNA, 22 bp, Artificial Sequence
  chemically synthesized
tctgctgcctccagacccagag

SEQ ID NO: 18465 - DNA, 22 bp, Artificial Sequence
  chemically synthesized
tgctgcctccagacccagagca

SEQ ID NO: 18466 - DNA, 22 bp, Artificial Sequence
  chemically synthesized
ctgcctccagacccagagcagc

SEQ ID NO: 18467 - DNA, 22 bp, Artificial Sequence
  chemically synthesized
cctccagacccagagcagctcc

SEQ ID NO: 18468 - DNA, 22 bp, Artificial Sequence
  chemically synthesized
cagacccagagcagctccagtt

SEQ ID NO: 18469 - DNA, 22 bp, Artificial Sequence
  chemically synthesized
cagttgtcccagccctgagctc

SEQ ID NO: 18470 - DNA, 22 bp, Artificial Sequence
  chemically synthesized
tcccagccctgagctcctctct

SEQ ID NO: 18471 - DNA, 22 bp, Artificial Sequence
  chemically synthesized
agctcctctctttgcagcatcc

SEQ ID NO: 18472 - DNA, 22 bp, Artificial Sequence
  chemically synthesized
ctctctttgcagcatccacctg

SEQ ID NO: 18473 - DNA, 22 bp, Artificial Sequence
  chemically synthesized
tctttgcagcatccacctgcaa

SEQ ID NO: 18474 - DNA, 22 bp, Artificial Sequence
  chemically synthesized
tttgcagcatccacctgcaaac

SEQ ID NO: 18475 - DNA, 22 bp, Artificial Sequence
  chemically synthesized
tgcagcatccacctgcaaacag

SEQ ID NO: 18476 - DNA, 22 bp, Artificial Sequence
  chemically synthesized
gcagcatccacctgcaaacaga

SEQ ID NO: 18477 - DNA, 22 bp, Artificial Sequence
  chemically synthesized
cagcatccacctgcaaacagaa

SEQ ID NO: 18478 - DNA, 22 bp, Artificial Sequence
  chemically synthesized
caaacagaacaccttctaggcc

SEQ ID NO: 18479 - DNA, 22 bp, Artificial Sequence
  chemically synthesized
ctaggccttggaccctgactct

SEQ ID NO: 18480 - DNA, 22 bp, Artificial Sequence
  chemically synthesized
taggccttggaccctgactctg

SEQ ID NO: 18481 - DNA, 22 bp, Artificial Sequence
  chemically synthesized
ggccttggaccctgactctgtg

SEQ ID NO: 18482 - DNA, 22 bp, Artificial Sequence
  chemically synthesized
ggaccctgactctgtggacttc

SEQ ID NO: 18483 - DNA, 22 bp, Artificial Sequence
  chemically synthesized
gaccctgactctgtggacttcc

SEQ ID NO: 18484 - DNA, 22 bp, Artificial Sequence
  chemically synthesized
actctgtggacttccttgtctt

SEQ ID NO: 18485 - DNA, 22 bp, Artificial Sequence
  chemically synthesized
tgtggacttccttgtcttctca

SEQ ID NO: 18486 - DNA, 22 bp, Artificial Sequence
  chemically synthesized
tggacttccttgtcttctcatt

SEQ ID NO: 18487 - DNA, 22 bp, Artificial Sequence
  chemically synthesized
ccttgtcttctcattcctatca

SEQ ID NO: 18488 - DNA, 22 bp, Artificial Sequence
  chemically synthesized
cttgtcttctcattcctatcac

SEQ ID NO: 18489 - DNA, 22 bp, Artificial Sequence
  chemically synthesized
gtcttctcattcctatcacccc

SEQ ID NO: 18490 - DNA, 22 bp, Artificial Sequence
  chemically synthesized
tcttctcattcctatcaccccc

SEQ ID NO: 18491 - DNA, 22 bp, Artificial Sequence
  chemically synthesized
ctcattcctatcaccccccgac

SEQ ID NO: 18492 - DNA, 22 bp, Artificial Sequence
  chemically synthesized
tcattcctatcaccccccgacc

SEQ ID NO: 18493 - DNA, 22 bp, Artificial Sequence
  chemically synthesized
attcctatcaccccccgaccca

SEQ ID NO: 18494 - DNA, 22 bp, Artificial Sequence
  chemically synthesized
ctatcaccccccgacccagcag

SEQ ID NO: 18495 - DNA, 22 bp, Artificial Sequence
  chemically synthesized
tcaccccccgacccagcaggac

SEQ ID NO: 18496 - DNA, 22 bp, Artificial Sequence
  chemically synthesized
gggaggctcagtcaggggccca

SEQ ID NO: 18497 - DNA, 22 bp, Artificial Sequence
  chemically synthesized
agtcaggggcccagaatcttcc

SEQ ID NO: 18498 - DNA, 22 bp, Artificial Sequence
  chemically synthesized
cctccccaggtcacttcctgcc

SEQ ID NO: 18499 - DNA, 22 bp, Artificial Sequence
  chemically synthesized
ctccccaggtcacttcctgcca

SEQ ID NO: 18500 - DNA, 22 bp, Artificial Sequence
  chemically synthesized
cccaggtcacttcctgccactg

SEQ ID NO: 18501 - DNA, 22 bp, Artificial Sequence
  chemically synthesized
cctgccactgtcctgagtcaga

SEQ ID NO: 18502 - DNA, 22 bp, Artificial Sequence
  chemically synthesized
ctgccactgtcctgagtcagac

SEQ ID NO: 18503 - DNA, 22 bp, Artificial Sequence
  chemically synthesized
ccactgtcctgagtcagacact

SEQ ID NO: 18504 - DNA, 22 bp, Artificial Sequence
  chemically synthesized
tcctgagtcagacactgcccct

SEQ ID NO: 18505 - DNA, 22 bp, Artificial Sequence
  chemically synthesized
agtcagacactgcccctgtaag

SEQ ID NO: 18506 - DNA, 22 bp, Artificial Sequence
  chemically synthesized
cccctgtaagtgactgtccata

SEQ ID NO: 18507 - DNA, 22 bp, Artificial Sequence
  chemically synthesized
taagtgactgtccataactctt

SEQ ID NO: 18508 - DNA, 22 bp, Artificial Sequence
  chemically synthesized
tccataactcttcatctttttc

SEQ ID NO: 18509 - DNA, 22 bp, Artificial Sequence
  chemically synthesized
ttcatctttttcacaccagtga

SEQ ID NO: 18510 - DNA, 22 bp, Artificial Sequence
  chemically synthesized
catctttttcacaccagtgact

SEQ ID NO: 18511 - DNA, 22 bp, Artificial Sequence
  chemically synthesized
atctttttcacaccagtgactt

SEQ ID NO: 18512 - DNA, 22 bp, Artificial Sequence
  chemically synthesized
tttcacaccagtgacttccacc

SEQ ID NO: 18513 - DNA, 22 bp, Artificial Sequence
  chemically synthesized
ttcacaccagtgacttccacct

SEQ ID NO: 18514 - DNA, 22 bp, Artificial Sequence
  chemically synthesized
tcacaccagtgacttccacctt

SEQ ID NO: 18515 - DNA, 22 bp, Artificial Sequence
  chemically synthesized
cacaccagtgacttccaccttc

SEQ ID NO: 18516 - DNA, 22 bp, Artificial Sequence
  chemically synthesized
acaccagtgacttccaccttcc

SEQ ID NO: 18517 - DNA, 22 bp, Artificial Sequence
  chemically synthesized
ccaccttccccactgcagccac

SEQ ID NO: 18518 - DNA, 22 bp, Artificial Sequence
  chemically synthesized
caccttccccactgcagccaca

SEQ ID NO: 18519 - DNA, 22 bp, Artificial Sequence
  chemically synthesized
ccccactgcagccacactcagg

SEQ ID NO: 18520 - DNA, 22 bp, Artificial Sequence
  chemically synthesized
cccactgcagccacactcagga

SEQ ID NO: 18521 - DNA, 22 bp, Artificial Sequence
  chemically synthesized
cagccacactcaggaccccatt

SEQ ID NO: 18522 - DNA, 22 bp, Artificial Sequence
  chemically synthesized
aggaccccatttgacccaggga

SEQ ID NO: 18523 - DNA, 22 bp, Artificial Sequence
  chemically synthesized
gacccagggaggcctctgacac

SEQ ID NO: 18524 - DNA, 22 bp, Artificial Sequence
  chemically synthesized
acccagggaggcctctgacacc

SEQ ID NO: 18525 - DNA, 22 bp, Artificial Sequence
  chemically synthesized
tgacacctccactgcccactcc

SEQ ID NO: 18526 - DNA, 22 bp, Artificial Sequence
  chemically synthesized
acacctccactgcccactcccg

SEQ ID NO: 18527 - DNA, 22 bp, Artificial Sequence
  chemically synthesized
cactgcccactcccgctctgag

SEQ ID NO: 18528 - DNA, 22 bp, Artificial Sequence
  chemically synthesized
cccactcccgctctgagcacag

SEQ ID NO: 18529 - DNA, 22 bp, Artificial Sequence
  chemically synthesized
ccgctctgagcacagccccacc

SEQ ID NO: 18530 - DNA, 22 bp, Artificial Sequence
  chemically synthesized
tgagcacagccccaccctccct

SEQ ID NO: 18531 - DNA, 22 bp, Artificial Sequence
  chemically synthesized
agcacagccccaccctccctct

SEQ ID NO: 18532 - DNA, 22 bp, Artificial Sequence
  chemically synthesized
cctctcactgcccccacccctt

SEQ ID NO: 18533 - DNA, 22 bp, Artificial Sequence
  chemically synthesized
tcactgcccccaccccttcctc

SEQ ID NO: 18534 - DNA, 22 bp, Artificial Sequence
  chemically synthesized
actgcccccaccccttcctcca

SEQ ID NO: 18535 - DNA, 22 bp, Artificial Sequence
  chemically synthesized
cccccaccccttcctccaaggc

SEQ ID NO: 18536 - DNA, 22 bp, Artificial Sequence
  chemically synthesized
cctccaaggcctttgcattcct

SEQ ID NO: 18537 - DNA, 22 bp, Artificial Sequence
  chemically synthesized
ctccaaggcctttgcattcctc

SEQ ID NO: 18538 - DNA, 22 bp, Artificial Sequence
  chemically synthesized
caaggcctttgcattcctctcc

SEQ ID NO: 18539 - DNA, 22 bp, Artificial Sequence
  chemically synthesized
tgcattcctctccatccagaag

SEQ ID NO: 18540 - DNA, 22 bp, Artificial Sequence
  chemically synthesized
gcattcctctccatccagaagc

SEQ ID NO: 18541 - DNA, 22 bp, Artificial Sequence
  chemically synthesized
cattcctctccatccagaagcg

SEQ ID NO: 18542 - DNA, 22 bp, Artificial Sequence
  chemically synthesized
ctctccatccagaagcgctcca

SEQ ID NO: 18543 - DNA, 22 bp, Artificial Sequence
  chemically synthesized
tccatccagaagcgctccatga

SEQ ID NO: 18544 - DNA, 22 bp, Artificial Sequence
  chemically synthesized
catccagaagcgctccatgacc

SEQ ID NO: 18545 - DNA, 22 bp, Artificial Sequence
  chemically synthesized
catgaccacggtgttccccacc

SEQ ID NO: 18546 - DNA, 22 bp, Artificial Sequence
  chemically synthesized
cccaccaagctggccctccatg

SEQ ID NO: 18547 - DNA, 22 bp, Artificial Sequence
  chemically synthesized
gccctccatggctgagtccctg

SEQ ID NO: 18548 - DNA, 22 bp, Artificial Sequence
  chemically synthesized
catggctgagtccctgactgct

SEQ ID NO: 18549 - DNA, 22 bp, Artificial Sequence
  chemically synthesized
agtccctgactgctgtcttcag

SEQ ID NO: 18550 - DNA, 22 bp, Artificial Sequence
  chemically synthesized
actgctgtcttcagcaccctcc

SEQ ID NO: 18551 - DNA, 22 bp, Artificial Sequence
  chemically synthesized
ctgtcttcagcaccctccactc

SEQ ID NO: 18552 - DNA, 22 bp, Artificial Sequence
  chemically synthesized
tcttcagcaccctccactcaga

SEQ ID NO: 18553 - DNA, 22 bp, Artificial Sequence
  chemically synthesized
cagcaccctccactcagagggt

SEQ ID NO: 18554 - DNA, 22 bp, Artificial Sequence
  chemically synthesized
agcaccctccactcagagggtc

SEQ ID NO: 18555 - DNA, 22 bp, Artificial Sequence
  chemically synthesized
cactcagagggtcctgtcctgc

SEQ ID NO: 18556 - DNA, 22 bp, Artificial Sequence
  chemically synthesized
agagggtcctgtcctgcttccc

SEQ ID NO: 18557 - DNA, 22 bp, Artificial Sequence
  chemically synthesized
tcctgcttcccagtccgactta

SEQ ID NO: 18558 - DNA, 22 bp, Artificial Sequence
  chemically synthesized
cttcccagtccgacttatcaac

SEQ ID NO: 18559 - DNA, 22 bp, Artificial Sequence
  chemically synthesized
cccagtccgacttatcaactcc

SEQ ID NO: 18560 - DNA, 22 bp, Artificial Sequence
  chemically synthesized
ccagtccgacttatcaactccc

SEQ ID NO: 18561 - DNA, 22 bp, Artificial Sequence
  chemically synthesized
atcaactcccaatgctgggtca

SEQ ID NO: 18562 - DNA, 22 bp, Artificial Sequence
  chemically synthesized
tcaactcccaatgctgggtcag

SEQ ID NO: 18563 - DNA, 22 bp, Artificial Sequence
  chemically synthesized
ccaatgctgggtcagcccagca

SEQ ID NO: 18564 - DNA, 22 bp, Artificial Sequence
  chemically synthesized
ggtcagcccagcaacgtgtctg

SEQ ID NO: 18565 - DNA, 22 bp, Artificial Sequence
  chemically synthesized
tatatccaccctgaaaccagac

SEQ ID NO: 18566 - DNA, 22 bp, Artificial Sequence
  chemically synthesized
aaaccagactgcccacagggta

SEQ ID NO: 18567 - DNA, 22 bp, Artificial Sequence
  chemically synthesized
cccacagggtagcccagctgtg

SEQ ID NO: 18568 - DNA, 22 bp, Artificial Sequence
  chemically synthesized
tgcctccaggtagctctgagat

SEQ ID NO: 18569 - DNA, 22 bp, Artificial Sequence
  chemically synthesized
caggtagctctgagatcatgca

SEQ ID NO: 18570 - DNA, 22 bp, Artificial Sequence
  chemically synthesized
tgagatcatgcaccagcattca

SEQ ID NO: 18571 - DNA, 22 bp, Artificial Sequence
  chemically synthesized
agatcatgcaccagcattcaat

SEQ ID NO: 18572 - DNA, 22 bp, Artificial Sequence
  chemically synthesized
aatttctccatgcttccatttt

SEQ ID NO: 18573 - DNA, 22 bp, Artificial Sequence
  chemically synthesized
ctccatgcttccattttctcgt

SEQ ID NO: 18574 - DNA, 22 bp, Artificial Sequence
  chemically synthesized
tccatgcttccattttctcgtg

SEQ ID NO: 18575 - DNA, 22 bp, Artificial Sequence
  chemically synthesized
catgcttccattttctcgtgtg

SEQ ID NO: 18576 - DNA, 22 bp, Artificial Sequence
  chemically synthesized
ccattttctcgtgtgtaaaatg

SEQ ID NO: 18577 - DNA, 22 bp, Artificial Sequence
  chemically synthesized
cattttctcgtgtgtaaaatgg

SEQ ID NO: 18578 - DNA, 22 bp, Artificial Sequence
  chemically synthesized
tctcgtgtgtaaaatggagatc

SEQ ID NO: 18579 - DNA, 22 bp, Artificial Sequence
  chemically synthesized
ctcgtgtgtaaaatggagatca

SEQ ID NO: 18580 - DNA, 22 bp, Artificial Sequence
  chemically synthesized
tcgtgtgtaaaatggagatcac

SEQ ID NO: 18581 - DNA, 22 bp, Artificial Sequence
  chemically synthesized
gtgtgtaaaatggagatcacag

SEQ ID NO: 18582 - DNA, 22 bp, Artificial Sequence
  chemically synthesized
cccgattggattgctcggataa

SEQ ID NO: 18583 - DNA, 22 bp, Artificial Sequence
  chemically synthesized
gattgctcggataattagatga

SEQ ID NO: 18584 - DNA, 22 bp, Artificial Sequence
  chemically synthesized
ctcggataattagatgagttaa

SEQ ID NO: 18585 - DNA, 22 bp, Artificial Sequence
  chemically synthesized
ggataattagatgagttaaaat

SEQ ID NO: 18586 - DNA, 22 bp, Artificial Sequence
  chemically synthesized
gatgagttaaaatatgtaatgt

SEQ ID NO: 18587 - DNA, 22 bp, Artificial Sequence
  chemically synthesized
aaatatgtaatgtgcttcttag

SEQ ID NO: 18588 - DNA, 22 bp, Artificial Sequence
  chemically synthesized
cttaggcaaaagtttgaacata

SEQ ID NO: 18589 - DNA, 22 bp, Artificial Sequence
  chemically synthesized
ttaggcaaaagtttgaacataa

SEQ ID NO: 18590 - DNA, 22 bp, Artificial Sequence
  chemically synthesized
aggcaaaagtttgaacataaaa

SEQ ID NO: 18591 - DNA, 22 bp, Artificial Sequence
  chemically synthesized
ggcaaaagtttgaacataaaag

SEQ ID NO: 18592 - DNA, 22 bp, Artificial Sequence
  chemically synthesized
gaacataaaagacagggtctgc

SEQ ID NO: 18593 - DNA, 22 bp, Artificial Sequence
  chemically synthesized
aacataaaagacagggtctgcc

SEQ ID NO: 18594 - DNA, 22 bp, Artificial Sequence
  chemically synthesized
cccaagatgggaagagttcttc

SEQ ID NO: 18595 - DNA, 22 bp, Artificial Sequence
  chemically synthesized
ttctctccccagaaacaatcaa

SEQ ID NO: 18596 - DNA, 22 bp, Artificial Sequence
  chemically synthesized
ctctccccagaaacaatcaaaa

SEQ ID NO: 18597 - DNA, 22 bp, Artificial Sequence
  chemically synthesized
tctccccagaaacaatcaaaac

SEQ ID NO: 18598 - DNA, 22 bp, Artificial Sequence
  chemically synthesized
tccccagaaacaatcaaaacaa

SEQ ID NO: 18599 - DNA, 22 bp, Artificial Sequence
  chemically synthesized
cccagaaacaatcaaaacaaaa

SEQ ID NO: 18600 - DNA, 22 bp, Artificial Sequence
  chemically synthesized
tagaacatggcagctttcaaga

SEQ ID NO: 18601 - DNA, 22 bp, Artificial Sequence
  chemically synthesized
tcaagactctggacatcaggca

SEQ ID NO: 18602 - DNA, 22 bp, Artificial Sequence
  chemically synthesized
caagactctggacatcaggcaa

SEQ ID NO: 18603 - DNA, 22 bp, Artificial Sequence
  chemically synthesized
aagactctggacatcaggcaag

SEQ ID NO: 18604 - DNA, 22 bp, Artificial Sequence
  chemically synthesized
tggacatcaggcaaggaggagt

SEQ ID NO: 18605 - DNA, 22 bp, Artificial Sequence
  chemically synthesized
gacatcaggcaaggaggagtaa

SEQ ID NO: 18606 - DNA, 22 bp, Artificial Sequence
  chemically synthesized
agggataagaagcaaacaacag

SEQ ID NO: 18607 - DNA, 22 bp, Artificial Sequence
  chemically synthesized
cgatcaccccagcttactgttt

SEQ ID NO: 18608 - DNA, 22 bp, Artificial Sequence
  chemically synthesized
actgtttggagagagtctgcag

SEQ ID NO: 18609 - DNA, 22 bp, Artificial Sequence
  chemically synthesized
ctgtttggagagagtctgcagg

SEQ ID NO: 18610 - DNA, 22 bp, Artificial Sequence
  chemically synthesized
tttggagagagtctgcaggtta

SEQ ID NO: 18611 - DNA, 22 bp, Artificial Sequence
  chemically synthesized
ggagagagtctgcaggttacag

SEQ ID NO: 18612 - DNA, 22 bp, Artificial Sequence
  chemically synthesized
gagagagtctgcaggttacagg

SEQ ID NO: 18613 - DNA, 22 bp, Artificial Sequence
  chemically synthesized
caggttacaggccaggaaaggg

SEQ ID NO: 18614 - DNA, 22 bp, Artificial Sequence
  chemically synthesized
caggccaggaaagggaagtcca

SEQ ID NO: 18615 - DNA, 22 bp, Artificial Sequence
  chemically synthesized
cccacgttgaggagatggagct

SEQ ID NO: 18616 - DNA, 22 bp, Artificial Sequence
  chemically synthesized
aggagatggagctgagagtccg

SEQ ID NO: 18617 - DNA, 22 bp, Artificial Sequence
  chemically synthesized
agagtccgaggagaccaaaaca

SEQ ID NO: 18618 - DNA, 22 bp, Artificial Sequence
  chemically synthesized
agagttcaaacgatcaaactga

SEQ ID NO: 18619 - DNA, 22 bp, Artificial Sequence
  chemically synthesized
aaacgatcaaactgactctaag

SEQ ID NO: 18620 - DNA, 22 bp, Artificial Sequence
  chemically synthesized
actctaagttgcttaactgcat

SEQ ID NO: 18621 - DNA, 22 bp, Artificial Sequence
  chemically synthesized
taagttgcttaactgcatcccg

SEQ ID NO: 18622 - DNA, 22 bp, Artificial Sequence
  chemically synthesized
agttgcttaactgcatcccgga

SEQ ID NO: 18623 - DNA, 22 bp, Artificial Sequence
  chemically synthesized
cttaactgcatcccggagcaaa

SEQ ID NO: 18624 - DNA, 22 bp, Artificial Sequence
  chemically synthesized
aactgcatcccggagcaaagct

SEQ ID NO: 18625 - DNA, 22 bp, Artificial Sequence
  chemically synthesized
actgcatcccggagcaaagctc

SEQ ID NO: 18626 - DNA, 22 bp, Artificial Sequence
  chemically synthesized
catcccggagcaaagctcaaga

SEQ ID NO: 18627 - DNA, 22 bp, Artificial Sequence
  chemically synthesized
aagaacatttagaggaatacaa

SEQ ID NO: 18628 - DNA, 22 bp, Artificial Sequence
  chemically synthesized
agaggaatacaaaaatatccag

SEQ ID NO: 18629 - DNA, 22 bp, Artificial Sequence
  chemically synthesized
gaggaatacaaaaatatccagc

SEQ ID NO: 18630 - DNA, 22 bp, Artificial Sequence
  chemically synthesized
acaatgtctggcagccaatcaa

SEQ ID NO: 18631 - DNA, 22 bp, Artificial Sequence
  chemically synthesized
gcagccaatcaaagattacaag

SEQ ID NO: 18632 - DNA, 22 bp, Artificial Sequence
  chemically synthesized
caaggcatgcaatgaaacggga

SEQ ID NO: 18633 - DNA, 22 bp, Artificial Sequence
  chemically synthesized
ataaatatcaaaagagatccag

SEQ ID NO: 18634 - DNA, 22 bp, Artificial Sequence
  chemically synthesized
acacggatgctagaattagcag

SEQ ID NO: 18635 - DNA, 22 bp, Artificial Sequence
  chemically synthesized
gaattagcaggcaaggatggta

SEQ ID NO: 18636 - DNA, 22 bp, Artificial Sequence
  chemically synthesized
gcaggcaaggatggtaaaacag

SEQ ID NO: 18637 - DNA, 22 bp, Artificial Sequence
  chemically synthesized
tagccatatcccattatgttca

SEQ ID NO: 18638 - DNA, 22 bp, Artificial Sequence
  chemically synthesized
tgttcaaaaaattaagtagaat

SEQ ID NO: 18639 - DNA, 22 bp, Artificial Sequence
  chemically synthesized
aaaaaattaagtagaattgtgg

SEQ ID NO: 18640 - DNA, 22 bp, Artificial Sequence
  chemically synthesized
agtagaattgtggaggatattt

SEQ ID NO: 18641 - DNA, 22 bp, Artificial Sequence
  chemically synthesized
tggaggatatttaagagtcccc

SEQ ID NO: 18642 - DNA, 22 bp, Artificial Sequence
  chemically synthesized
aagagtccccaggtgaacttct

SEQ ID NO: 18643 - DNA, 22 bp, Artificial Sequence
  chemically synthesized
agagtccccaggtgaacttcta

SEQ ID NO: 18644 - DNA, 22 bp, Artificial Sequence
  chemically synthesized
ctagagataaaaactacaatgt

SEQ ID NO: 18645 - DNA, 22 bp, Artificial Sequence
  chemically synthesized
tagagataaaaactacaatgtc

SEQ ID NO: 18646 - DNA, 22 bp, Artificial Sequence
  chemically synthesized
gagataaaaactacaatgtctg

SEQ ID NO: 18647 - DNA, 22 bp, Artificial Sequence
  chemically synthesized
caatgtctgaaatgaaaaaaca

SEQ ID NO: 18648 - DNA, 22 bp, Artificial Sequence
  chemically synthesized
aaatgaaaaaacacactggcca

SEQ ID NO: 18649 - DNA, 22 bp, Artificial Sequence
  chemically synthesized
gccaggcgccgtggctcacgcc

SEQ ID NO: 18650 - DNA, 22 bp, Artificial Sequence
  chemically synthesized
acgcctggaatcccagcactgt

SEQ ID NO: 18651 - DNA, 22 bp, Artificial Sequence
  chemically synthesized
gaatcccagcactgtgggaggc

SEQ ID NO: 18652 - DNA, 22 bp, Artificial Sequence
  chemically synthesized
tgggaggccaaggcgggcagat

SEQ ID NO: 18653 - DNA, 22 bp, Artificial Sequence
  chemically synthesized
gctaacatggtgaaaccccatc

SEQ ID NO: 18654 - DNA, 22 bp, Artificial Sequence
  chemically synthesized
acatggtgaaaccccatctcta

SEQ ID NO: 18655 - DNA, 22 bp, Artificial Sequence
  chemically synthesized
tactaaaaatacaaaaaattag

SEQ ID NO: 18656 - DNA, 22 bp, Artificial Sequence
  chemically synthesized
ctaaaaatacaaaaaattagcc

SEQ ID NO: 18657 - DNA, 22 bp, Artificial Sequence
  chemically synthesized
aaaatacaaaaaattagccaga

SEQ ID NO: 18658 - DNA, 22 bp, Artificial Sequence
  chemically synthesized
gccagacgtggtggcaggcgcc

SEQ ID NO: 18659 - DNA, 22 bp, Artificial Sequence
  chemically synthesized
tagtcccagctactcgggaggc

SEQ ID NO: 18660 - DNA, 22 bp, Artificial Sequence
  chemically synthesized
ctcgggaggctgaggcaggaga

SEQ ID NO: 18661 - DNA, 22 bp, Artificial Sequence
  chemically synthesized
gggaggctgaggcaggagaatg

SEQ ID NO: 18662 - DNA, 22 bp, Artificial Sequence
  chemically synthesized
aggcaggagaatggcatgaacc

SEQ ID NO: 18663 - DNA, 22 bp, Artificial Sequence
  chemically synthesized
gcagtgagccaagatcgcgcca

SEQ ID NO: 18664 - DNA, 22 bp, Artificial Sequence
  chemically synthesized
cagtgagccaagatcgcgccac

SEQ ID NO: 18665 - DNA, 22 bp, Artificial Sequence
  chemically synthesized
cactccggcctgggcaacagag

SEQ ID NO: 18666 - DNA, 22 bp, Artificial Sequence
  chemically synthesized
cggcctgggcaacagagcgaga

SEQ ID NO: 18667 - DNA, 22 bp, Artificial Sequence
  chemically synthesized
ggcaacagagcgagactccgcc

SEQ ID NO: 18668 - DNA, 22 bp, Artificial Sequence
  chemically synthesized
cgcctccaaaaaaaaaaaaaag

SEQ ID NO: 18669 - DNA, 22 bp, Artificial Sequence
  chemically synthesized
caaaaaaaaaaaaaagaaaaga

SEQ ID NO: 18670 - DNA, 22 bp, Artificial Sequence
  chemically synthesized
gatggaaataatggaagatgag

SEQ ID NO: 18671 - DNA, 22 bp, Artificial Sequence
  chemically synthesized
agggccaggcactgtggatcac

SEQ ID NO: 18672 - DNA, 22 bp, Artificial Sequence
  chemically synthesized
gggccaggcactgtggatcaca

SEQ ID NO: 18673 - DNA, 22 bp, Artificial Sequence
  chemically synthesized
tggatcacatctgtaatcccag

SEQ ID NO: 18674 - DNA, 22 bp, Artificial Sequence
  chemically synthesized
taatcccagcactttgggaggt

SEQ ID NO: 18675 - DNA, 22 bp, Artificial Sequence
  chemically synthesized
tgggaggtcgacacggggggaa

SEQ ID NO: 18676 - DNA, 22 bp, Artificial Sequence
  chemically synthesized
gggaggtcgacacggggggaat

SEQ ID NO: 18677 - DNA, 22 bp, Artificial Sequence
  chemically synthesized
ggaggtcgacacggggggaatc

SEQ ID NO: 18678 - DNA, 22 bp, Artificial Sequence
  chemically synthesized
gagcccaggagctcaagactag

SEQ ID NO: 18679 - DNA, 22 bp, Artificial Sequence
  chemically synthesized
agcccaggagctcaagactagt

SEQ ID NO: 18680 - DNA, 22 bp, Artificial Sequence
  chemically synthesized
aagactagtctgggcagcatgg

SEQ ID NO: 18681 - DNA, 22 bp, Artificial Sequence
  chemically synthesized
gtctgggcagcatggcaaaacc

SEQ ID NO: 18682 - DNA, 22 bp, Artificial Sequence
  chemically synthesized
ggcagcatggcaaaacccctct

SEQ ID NO: 18683 - DNA, 22 bp, Artificial Sequence
  chemically synthesized
tacatggcaaaaccgtctctac

SEQ ID NO: 18684 - DNA, 22 bp, Artificial Sequence
  chemically synthesized
catggcaaaaccgtctctacaa

SEQ ID NO: 18685 - DNA, 22 bp, Artificial Sequence
  chemically synthesized
tacaaaaaaaaatttttaatta

SEQ ID NO: 18686 - DNA, 22 bp, Artificial Sequence
  chemically synthesized
caaaaaaaaatttttaattagc

SEQ ID NO: 18687 - DNA, 22 bp, Artificial Sequence
  chemically synthesized
ttaattagccaggtgtggtgcc

SEQ ID NO: 18688 - DNA, 22 bp, Artificial Sequence
  chemically synthesized
taattagccaggtgtggtgcca

SEQ ID NO: 18689 - DNA, 22 bp, Artificial Sequence
  chemically synthesized
aattagccaggtgtggtgccac

SEQ ID NO: 18690 - DNA, 22 bp, Artificial Sequence
  chemically synthesized
attagccaggtgtggtgccaca

SEQ ID NO: 18691 - DNA, 22 bp, Artificial Sequence
  chemically synthesized
gccaggtgtggtgccacatgcc

SEQ ID NO: 18692 - DNA, 22 bp, Artificial Sequence
  chemically synthesized
tagtcccagctacctgggaggc

SEQ ID NO: 18693 - DNA, 22 bp, Artificial Sequence
  chemically synthesized
cctgggaggctgaagtggaagg

SEQ ID NO: 18694 - DNA, 22 bp, Artificial Sequence
  chemically synthesized
ggaggctgaagtggaaggatcg

SEQ ID NO: 18695 - DNA, 22 bp, Artificial Sequence
  chemically synthesized
aagtggaaggatcgcctgagcc

SEQ ID NO: 18696 - DNA, 22 bp, Artificial Sequence
  chemically synthesized
agcccaggaggtggaggccaca

SEQ ID NO: 18697 - DNA, 22 bp, Artificial Sequence
  chemically synthesized
tgacaagctactgcattccagc

SEQ ID NO: 18698 - DNA, 22 bp, Artificial Sequence
  chemically synthesized
ctgcattccagcctgggcaaca

SEQ ID NO: 18699 - DNA, 22 bp, Artificial Sequence
  chemically synthesized
cattccagcctgggcaacagag

SEQ ID NO: 18700 - DNA, 22 bp, Artificial Sequence
  chemically synthesized
cagcctgggcaacagagtgaga

SEQ ID NO: 18701 - DNA, 22 bp, Artificial Sequence
  chemically synthesized
ggcaacagagtgagatgagaga

SEQ ID NO: 18702 - DNA, 22 bp, Artificial Sequence
  chemically synthesized
tagttaacttaatgaacagcaa

SEQ ID NO: 18703 - DNA, 22 bp, Artificial Sequence
  chemically synthesized
agttaacttaatgaacagcaat

SEQ ID NO: 18704 - DNA, 22 bp, Artificial Sequence
  chemically synthesized
gttaacttaatgaacagcaata

SEQ ID NO: 18705 - DNA, 22 bp, Artificial Sequence
  chemically synthesized
acttaatgaacagcaataactc

SEQ ID NO: 18706 - DNA, 22 bp, Artificial Sequence
  chemically synthesized
aatgaacagcaataactctata

SEQ ID NO: 18707 - DNA, 22 bp, Artificial Sequence
  chemically synthesized
atgaacagcaataactctataa

SEQ ID NO: 18708 - DNA, 22 bp, Artificial Sequence
  chemically synthesized
tataaaatgaaacactgggaga

SEQ ID NO: 18709 - DNA, 22 bp, Artificial Sequence
  chemically synthesized
taaaatgaaacactgggagaaa

SEQ ID NO: 18710 - DNA, 22 bp, Artificial Sequence
  chemically synthesized
ggagaaaaaagaattaaaaaat

SEQ ID NO: 18711 - DNA, 22 bp, Artificial Sequence
  chemically synthesized
aaaaatggaaagagaatgagtg

SEQ ID NO: 18712 - DNA, 22 bp, Artificial Sequence
  chemically synthesized
tgggacccttaatacatgcata

SEQ ID NO: 18713 - DNA, 22 bp, Artificial Sequence
  chemically synthesized
aatacatgcataattgaaatct

SEQ ID NO: 18714 - DNA, 22 bp, Artificial Sequence
  chemically synthesized
atacatgcataattgaaatctt

SEQ ID NO: 18715 - DNA, 22 bp, Artificial Sequence
  chemically synthesized
aaatctttaaaagaaaaagggg

SEQ ID NO: 18716 - DNA, 22 bp, Artificial Sequence
  chemically synthesized
taaaagaaaaagggggtagcag

SEQ ID NO: 18717 - DNA, 22 bp, Artificial Sequence
  chemically synthesized
aaaagaaaaagggggtagcaga

SEQ ID NO: 18718 - DNA, 22 bp, Artificial Sequence
  chemically synthesized
aaagaaaaagggggtagcagaa

SEQ ID NO: 18719 - DNA, 22 bp, Artificial Sequence
  chemically synthesized
agacaagtggaagatgggcccc

SEQ ID NO: 18720 - DNA, 22 bp, Artificial Sequence
  chemically synthesized
atcagtgtcagctcccatgatg

SEQ ID NO: 18721 - DNA, 22 bp, Artificial Sequence
  chemically synthesized
ccatgatgacgttcccccagcc

SEQ ID NO: 18722 - DNA, 22 bp, Artificial Sequence
  chemically synthesized
ccccagcccccaccacccgggc

SEQ ID NO: 18723 - DNA, 22 bp, Artificial Sequence
  chemically synthesized
ctggagggaaatgcggtgactt

SEQ ID NO: 18724 - DNA, 22 bp, Artificial Sequence
  chemically synthesized
gagggaaatgcggtgactttgc

SEQ ID NO: 18725 - DNA, 22 bp, Artificial Sequence
  chemically synthesized
tgctacatcccttcagacggtc

SEQ ID NO: 18726 - DNA, 22 bp, Artificial Sequence
  chemically synthesized
gctacatcccttcagacggtcc

SEQ ID NO: 18727 - DNA, 22 bp, Artificial Sequence
  chemically synthesized
ctacatcccttcagacggtccc

SEQ ID NO: 18728 - DNA, 22 bp, Artificial Sequence
  chemically synthesized
catcccttcagacggtccctca

SEQ ID NO: 18729 - DNA, 22 bp, Artificial Sequence
  chemically synthesized
cagacggtccctcactggtgtc

SEQ ID NO: 18730 - DNA, 22 bp, Artificial Sequence
  chemically synthesized
agacggtccctcactggtgtcc

SEQ ID NO: 18731 - DNA, 22 bp, Artificial Sequence
  chemically synthesized
actggtgtccctcagcccattc

SEQ ID NO: 18732 - DNA, 22 bp, Artificial Sequence
  chemically synthesized
gtgtccctcagcccattcgcgt

SEQ ID NO: 18733 - DNA, 22 bp, Artificial Sequence
  chemically synthesized
agcccattcgcgtgagctcact

SEQ ID NO: 18734 - DNA, 22 bp, Artificial Sequence
  chemically synthesized
gcgtgagctcactctcccatta

SEQ ID NO: 18735 - DNA, 22 bp, Artificial Sequence
  chemically synthesized
actctcccattaatttcagaaa

SEQ ID NO: 18736 - DNA, 22 bp, Artificial Sequence
  chemically synthesized
tcccattaatttcagaaatcct

SEQ ID NO: 18737 - DNA, 22 bp, Artificial Sequence
  chemically synthesized
ccattaatttcagaaatcctgg

SEQ ID NO: 18738 - DNA, 22 bp, Artificial Sequence
  chemically synthesized
atttcagaaatcctggcctctc

SEQ ID NO: 18739 - DNA, 22 bp, Artificial Sequence
  chemically synthesized
cagaaatcctggcctctctcca

SEQ ID NO: 18740 - DNA, 22 bp, Artificial Sequence
  chemically synthesized
agaaatcctggcctctctccaa

SEQ ID NO: 18741 - DNA, 22 bp, Artificial Sequence
  chemically synthesized
gcctctctccaagcctcctgct

SEQ ID NO: 18742 - DNA, 22 bp, Artificial Sequence
  chemically synthesized
tctccaagcctcctgctcaaac

SEQ ID NO: 18743 - DNA, 22 bp, Artificial Sequence
  chemically synthesized
tccaagcctcctgctcaaactc

SEQ ID NO: 18744 - DNA, 22 bp, Artificial Sequence
  chemically synthesized
caagcctcctgctcaaactcta

SEQ ID NO: 18745 - DNA, 22 bp, Artificial Sequence
  chemically synthesized
ctgctcaaactctaaattctgt

SEQ ID NO: 18746 - DNA, 22 bp, Artificial Sequence
  chemically synthesized
ctcaaactctaaattctgtcac

SEQ ID NO: 18747 - DNA, 22 bp, Artificial Sequence
  chemically synthesized
aaactctaaattctgtcaccct

SEQ ID NO: 18748 - DNA, 22 bp, Artificial Sequence
  chemically synthesized
taaattctgtcaccctcagaag

SEQ ID NO: 18749 - DNA, 22 bp, Artificial Sequence
  chemically synthesized
aattctgtcaccctcagaagat

SEQ ID NO: 18750 - DNA, 22 bp, Artificial Sequence
  chemically synthesized
tgtcaccctcagaagattcagc

SEQ ID NO: 18751 - DNA, 22 bp, Artificial Sequence
  chemically synthesized
tcaccctcagaagattcagcag

SEQ ID NO: 18752 - DNA, 22 bp, Artificial Sequence
  chemically synthesized
agaagattcagcagcatcccgt

SEQ ID NO: 18753 - DNA, 22 bp, Artificial Sequence
  chemically synthesized
agcagcatcccgtattctctct

SEQ ID NO: 18754 - DNA, 22 bp, Artificial Sequence
  chemically synthesized
tctctgagtgttcactatgtac

SEQ ID NO: 18755 - DNA, 22 bp, Artificial Sequence
  chemically synthesized
tctgagtgttcactatgtaccg

SEQ ID NO: 18756 - DNA, 22 bp, Artificial Sequence
  chemically synthesized
tgagtgttcactatgtaccggg

SEQ ID NO: 18757 - DNA, 22 bp, Artificial Sequence
  chemically synthesized
agtgttcactatgtaccgggtg

SEQ ID NO: 18758 - DNA, 22 bp, Artificial Sequence
  chemically synthesized
actatgtaccgggtgccgtgtg

SEQ ID NO: 18759 - DNA, 22 bp, Artificial Sequence
  chemically synthesized
tgtaccgggtgccgtgtgggca

SEQ ID NO: 18760 - DNA, 22 bp, Artificial Sequence
  chemically synthesized
gagttgcagaggagagtgaggc

SEQ ID NO: 18761 - DNA, 22 bp, Artificial Sequence
  chemically synthesized
cagaggagagtgaggcggacag

SEQ ID NO: 18762 - DNA, 22 bp, Artificial Sequence
  chemically synthesized
tgcctgtggggacaccgcctgg

SEQ ID NO: 18763 - DNA, 22 bp, Artificial Sequence
  chemically synthesized
cctgtggggacaccgcctggtg

SEQ ID NO: 18764 - DNA, 22 bp, Artificial Sequence
  chemically synthesized
tggggacaccgcctggtgggaa

SEQ ID NO: 18765 - DNA, 22 bp, Artificial Sequence
  chemically synthesized
gtgggaagtccagccagccccc

SEQ ID NO: 18766 - DNA, 22 bp, Artificial Sequence
  chemically synthesized
cagagagaggagatgctactgg

SEQ ID NO: 18767 - DNA, 22 bp, Artificial Sequence
  chemically synthesized
ctggtgttcctgagtggtcctc

SEQ ID NO: 18768 - DNA, 22 bp, Artificial Sequence
  chemically synthesized
gtgttcctgagtggtcctcggg

SEQ ID NO: 18769 - DNA, 22 bp, Artificial Sequence
  chemically synthesized
ctgagtggtcctcgggagggac

SEQ ID NO: 18770 - DNA, 22 bp, Artificial Sequence
  chemically synthesized
agtggtcctcgggagggacctc

SEQ ID NO: 18771 - DNA, 22 bp, Artificial Sequence
  chemically synthesized
gggagggacctcctatccctcc

SEQ ID NO: 18772 - DNA, 22 bp, Artificial Sequence
  chemically synthesized
ctatccctcctgtcccctgccc

SEQ ID NO: 18773 - DNA, 22 bp, Artificial Sequence
  chemically synthesized
tccctcctgtcccctgccctgc

SEQ ID NO: 18774 - DNA, 22 bp, Artificial Sequence
  chemically synthesized
ctgtcccctgccctgccctgcc

SEQ ID NO: 18775 - DNA, 22 bp, Artificial Sequence
  chemically synthesized
tcccctgccctgccctgcccag

SEQ ID NO: 18776 - DNA, 22 bp, Artificial Sequence
  chemically synthesized
ccctgccctgcccagcaccggc

SEQ ID NO: 18777 - DNA, 22 bp, Artificial Sequence
  chemically synthesized
ccctgcccagcaccggccctcc

SEQ ID NO: 18778 - DNA, 22 bp, Artificial Sequence
  chemically synthesized
cccagcaccggccctccctcgg

SEQ ID NO: 18779 - DNA, 22 bp, Artificial Sequence
  chemically synthesized
cctcggttggccagcctcagga

SEQ ID NO: 18780 - DNA, 22 bp, Artificial Sequence
  chemically synthesized
ggttggccagcctcaggaatga

SEQ ID NO: 18781 - DNA, 22 bp, Artificial Sequence
  chemically synthesized
gccagcctcaggaatgaggagt

SEQ ID NO: 18782 - DNA, 22 bp, Artificial Sequence
  chemically synthesized
aggaatgaggagtccctcattc

SEQ ID NO: 18783 - DNA, 22 bp, Artificial Sequence
  chemically synthesized
attccagcccagctaaccaatc

SEQ ID NO: 18784 - DNA, 22 bp, Artificial Sequence
  chemically synthesized
cagcccagctaaccaatcccct

SEQ ID NO: 18785 - DNA, 22 bp, Artificial Sequence
  chemically synthesized
accaatccccttcctaagctcc

SEQ ID NO: 18786 - DNA, 22 bp, Artificial Sequence
  chemically synthesized
cctaagctccaagcccctgctc

SEQ ID NO: 18787 - DNA, 22 bp, Artificial Sequence
  chemically synthesized
ctaagctccaagcccctgctcc

SEQ ID NO: 18788 - DNA, 22 bp, Artificial Sequence
  chemically synthesized
agctccaagcccctgctcctcc

SEQ ID NO: 18789 - DNA, 22 bp, Artificial Sequence
  chemically synthesized
caagcccctgctcctcctgcct

SEQ ID NO: 18790 - DNA, 22 bp, Artificial Sequence
  chemically synthesized
ctcctcctgcctccatggaacc

SEQ ID NO: 18791 - DNA, 22 bp, Artificial Sequence
  chemically synthesized
ctcctgcctccatggaacccgg

SEQ ID NO: 18792 - DNA, 22 bp, Artificial Sequence
  chemically synthesized
ctgcctccatggaacccggctc

SEQ ID NO: 18793 - DNA, 22 bp, Artificial Sequence
  chemically synthesized
cctccatggaacccggctccac

SEQ ID NO: 18794 - DNA, 22 bp, Artificial Sequence
  chemically synthesized
catggaacccggctccaccacc

SEQ ID NO: 18795 - DNA, 22 bp, Artificial Sequence
  chemically synthesized
caccaccagcacccacacacct

SEQ ID NO: 18796 - DNA, 22 bp, Artificial Sequence
  chemically synthesized
acactcctccattcctggctct

SEQ ID NO: 18797 - DNA, 22 bp, Artificial Sequence
  chemically synthesized
ctccattcctggctcttgccct

SEQ ID NO: 18798 - DNA, 22 bp, Artificial Sequence
  chemically synthesized
cattcctggctcttgcccttct

SEQ ID NO: 18799 - DNA, 22 bp, Artificial Sequence
  chemically synthesized
ctggctcttgcccttctgccta

SEQ ID NO: 18800 - DNA, 22 bp, Artificial Sequence
  chemically synthesized
gctcttgcccttctgcctagca

SEQ ID NO: 18801 - DNA, 22 bp, Artificial Sequence
  chemically synthesized
ttgcccttctgcctagcactgc

SEQ ID NO: 18802 - DNA, 22 bp, Artificial Sequence
  chemically synthesized
gcccttctgcctagcactgctc

SEQ ID NO: 18803 - DNA, 22 bp, Artificial Sequence
  chemically synthesized
cccttctgcctagcactgctca

SEQ ID NO: 18804 - DNA, 22 bp, Artificial Sequence
  chemically synthesized
ctgcctagcactgctcagatct

SEQ ID NO: 18805 - DNA, 22 bp, Artificial Sequence
  chemically synthesized
tgcctagcactgctcagatctc

SEQ ID NO: 18806 - DNA, 22 bp, Artificial Sequence
  chemically synthesized
cctagcactgctcagatctctc

SEQ ID NO: 18807 - DNA, 22 bp, Artificial Sequence
  chemically synthesized
gcactgctcagatctctctcac

SEQ ID NO: 18808 - DNA, 22 bp, Artificial Sequence
  chemically synthesized
ctcagatctctctcaccttaaa

SEQ ID NO: 18809 - DNA, 22 bp, Artificial Sequence
  chemically synthesized
agatctctctcaccttaaaatc

SEQ ID NO: 18810 - DNA, 22 bp, Artificial Sequence
  chemically synthesized
tctcaccttaaaatcttttccc

SEQ ID NO: 18811 - DNA, 22 bp, Artificial Sequence
  chemically synthesized
tcaccttaaaatcttttcccac

SEQ ID NO: 18812 - DNA, 22 bp, Artificial Sequence
  chemically synthesized
accttaaaatcttttcccacca

SEQ ID NO: 18813 - DNA, 22 bp, Artificial Sequence
  chemically synthesized
aaaatcttttcccaccagcctg

SEQ ID NO: 18814 - DNA, 22 bp, Artificial Sequence
  chemically synthesized
aaatcttttcccaccagcctgg

SEQ ID NO: 18815 - DNA, 22 bp, Artificial Sequence
  chemically synthesized
ttcccaccagcctgggcaacat

SEQ ID NO: 18816 - DNA, 22 bp, Artificial Sequence
  chemically synthesized
tcccaccagcctgggcaacata

SEQ ID NO: 18817 - DNA, 22 bp, Artificial Sequence
  chemically synthesized
cccaccagcctgggcaacatag

SEQ ID NO: 18818 - DNA, 22 bp, Artificial Sequence
  chemically synthesized
ccaccagcctgggcaacatagc

SEQ ID NO: 18819 - DNA, 22 bp, Artificial Sequence
  chemically synthesized
ggcaacatagcaagaccccatt

SEQ ID NO: 18820 - DNA, 22 bp, Artificial Sequence
  chemically synthesized
ctctaaaaaattttttttaatt

SEQ ID NO: 18821 - DNA, 22 bp, Artificial Sequence
  chemically synthesized
tctaaaaaattttttttaattt

SEQ ID NO: 18822 - DNA, 22 bp, Artificial Sequence
  chemically synthesized
taaaaaattttttttaatttgc

SEQ ID NO: 18823 - DNA, 22 bp, Artificial Sequence
  chemically synthesized
aaaaattttttttaatttgcca

SEQ ID NO: 18824 - DNA, 22 bp, Artificial Sequence
  chemically synthesized
tttttaatttgccaggcacagt

SEQ ID NO: 18825 - DNA, 22 bp, Artificial Sequence
  chemically synthesized
ttttaatttgccaggcacagtg

SEQ ID NO: 18826 - DNA, 22 bp, Artificial Sequence
  chemically synthesized
tttaatttgccaggcacagtgg

SEQ ID NO: 18827 - DNA, 22 bp, Artificial Sequence
  chemically synthesized
ttaatttgccaggcacagtggt

SEQ ID NO: 18828 - DNA, 22 bp, Artificial Sequence
  chemically synthesized
taatttgccaggcacagtggtg

SEQ ID NO: 18829 - DNA, 22 bp, Artificial Sequence
  chemically synthesized
aatttgccaggcacagtggtgc

SEQ ID NO: 18830 - DNA, 22 bp, Artificial Sequence
  chemically synthesized
atttgccaggcacagtggtgca

SEQ ID NO: 18831 - DNA, 22 bp, Artificial Sequence
  chemically synthesized
gccaggcacagtggtgcacacc

SEQ ID NO: 18832 - DNA, 22 bp, Artificial Sequence
  chemically synthesized
ccaggcacagtggtgcacacct

SEQ ID NO: 18833 - DNA, 22 bp, Artificial Sequence
  chemically synthesized
taagtcctaactacttgggagg

SEQ ID NO: 18834 - DNA, 22 bp, Artificial Sequence
  chemically synthesized
actacttgggaggctgaggtgg

SEQ ID NO: 18835 - DNA, 22 bp, Artificial Sequence
  chemically synthesized
cttgggaggctgaggtgggagg

SEQ ID NO: 18836 - DNA, 22 bp, Artificial Sequence
  chemically synthesized
gggaggctgaggtgggaggatg

SEQ ID NO: 18837 - DNA, 22 bp, Artificial Sequence
  chemically synthesized
ggaggctgaggtgggaggatgg

SEQ ID NO: 18838 - DNA, 22 bp, Artificial Sequence
  chemically synthesized
aggtgggaggatggcttgagcc

SEQ ID NO: 18839 - DNA, 22 bp, Artificial Sequence
  chemically synthesized
gagcccaggagttcgaggttgc

SEQ ID NO: 18840 - DNA, 22 bp, Artificial Sequence
  chemically synthesized
agcccaggagttcgaggttgca

SEQ ID NO: 18841 - DNA, 22 bp, Artificial Sequence
  chemically synthesized
gaggttgcagtgagctatgatc

SEQ ID NO: 18842 - DNA, 22 bp, Artificial Sequence
  chemically synthesized
cagtgagctatgatcctgccac

SEQ ID NO: 18843 - DNA, 22 bp, Artificial Sequence
  chemically synthesized
tgatcctgccactacactcctg

SEQ ID NO: 18844 - DNA, 22 bp, Artificial Sequence
  chemically synthesized
ccactacactcctgtctctaaa

SEQ ID NO: 18845 - DNA, 22 bp, Artificial Sequence
  chemically synthesized
cactcctgtctctaaaaaaaaa

SEQ ID NO: 18846 - DNA, 22 bp, Artificial Sequence
  chemically synthesized
ctgtctctaaaaaaaaaatgtc

SEQ ID NO: 18847 - DNA, 22 bp, Artificial Sequence
  chemically synthesized
tctctaaaaaaaaaatgtccaa

SEQ ID NO: 18848 - DNA, 22 bp, Artificial Sequence
  chemically synthesized
taaaaaaaaaatgtccaagata

SEQ ID NO: 18849 - DNA, 22 bp, Artificial Sequence
  chemically synthesized
aaaaaaaaatgtccaagatact

SEQ ID NO: 18850 - DNA, 22 bp, Artificial Sequence
  chemically synthesized
aggtccttcagtcaagatttat

SEQ ID NO: 18851 - DNA, 22 bp, Artificial Sequence
  chemically synthesized
ggtccttcagtcaagatttatt

SEQ ID NO: 18852 - DNA, 22 bp, Artificial Sequence
  chemically synthesized
cagtcaagatttattacagaag

SEQ ID NO: 18853 - DNA, 22 bp, Artificial Sequence
  chemically synthesized
agtcaagatttattacagaagg

SEQ ID NO: 18854 - DNA, 22 bp, Artificial Sequence
  chemically synthesized
attacagaaggatccagggaag

SEQ ID NO: 18855 - DNA, 22 bp, Artificial Sequence
  chemically synthesized
ttacagaaggatccagggaagg

SEQ ID NO: 18856 - DNA, 22 bp, Artificial Sequence
  chemically synthesized
cagaaggatccagggaagggtc

SEQ ID NO: 18857 - DNA, 22 bp, Artificial Sequence
  chemically synthesized
gggagatgagaggagcagggat

SEQ ID NO: 18858 - DNA, 22 bp, Artificial Sequence
  chemically synthesized
ggagatgagaggagcagggatc

SEQ ID NO: 18859 - DNA, 22 bp, Artificial Sequence
  chemically synthesized
ccaggatctctctgtgctcacg

SEQ ID NO: 18860 - DNA, 22 bp, Artificial Sequence
  chemically synthesized
caggatctctctgtgctcacgt

SEQ ID NO: 18861 - DNA, 22 bp, Artificial Sequence
  chemically synthesized
tctgtgctcacgtcccccaccc

SEQ ID NO: 18862 - DNA, 22 bp, Artificial Sequence
  chemically synthesized
tgtgctcacgtcccccacccat

SEQ ID NO: 18863 - DNA, 22 bp, Artificial Sequence
  chemically synthesized
tgctcacgtcccccacccatcc

SEQ ID NO: 18864 - DNA, 22 bp, Artificial Sequence
  chemically synthesized
acgtcccccacccatcccaact

SEQ ID NO: 18865 - DNA, 22 bp, Artificial Sequence
  chemically synthesized
accccacctctacacacacaca

SEQ ID NO: 18866 - DNA, 22 bp, Artificial Sequence
  chemically synthesized
tacacacacacacacacacaca

SEQ ID NO: 18867 - DNA, 22 bp, Artificial Sequence
  chemically synthesized
cacacacacacacacacacata

SEQ ID NO: 18868 - DNA, 22 bp, Artificial Sequence
  chemically synthesized
acacacacactcacgcaacaca

SEQ ID NO: 18869 - DNA, 22 bp, Artificial Sequence
  chemically synthesized
acgcaacacactcacacacaca

SEQ ID NO: 18870 - DNA, 22 bp, Artificial Sequence
  chemically synthesized
acacacacaacatacataacac

SEQ ID NO: 18871 - DNA, 22 bp, Artificial Sequence
  chemically synthesized
acaacatacacacacaacacac

SEQ ID NO: 18872 - DNA, 22 bp, Artificial Sequence
  chemically synthesized
gcacaacatacacacacgcaca

SEQ ID NO: 18873 - DNA, 22 bp, Artificial Sequence
  chemically synthesized
acacaacacacaaacatacata

SEQ ID NO: 18874 - DNA, 22 bp, Artificial Sequence
  chemically synthesized
acacaatacacacacacaacac

SEQ ID NO: 18875 - DNA, 22 bp, Artificial Sequence
  chemically synthesized
atacacaacatacatacacaca

SEQ ID NO: 18876 - DNA, 22 bp, Artificial Sequence
  chemically synthesized
acatacacaacatacactcgca

SEQ ID NO: 18877 - DNA, 22 bp, Artificial Sequence
  chemically synthesized
gcacaacatacacacatgcaca

SEQ ID NO: 18878 - DNA, 22 bp, Artificial Sequence
  chemically synthesized
acacacaagatacacacaacat

SEQ ID NO: 18879 - DNA, 22 bp, Artificial Sequence
  chemically synthesized
acacaacatacacacacaacac

SEQ ID NO: 18880 - DNA, 22 bp, Artificial Sequence
  chemically synthesized
tcacacacaacataccctctca

SEQ ID NO: 18881 - DNA, 22 bp, Artificial Sequence
  chemically synthesized
acacacaacataccctctcaca

SEQ ID NO: 18882 - DNA, 22 bp, Artificial Sequence
  chemically synthesized
tcacatacacgacatacacaca

SEQ ID NO: 18883 - DNA, 22 bp, Artificial Sequence
  chemically synthesized
acatacacgacatacacacaca

SEQ ID NO: 18884 - DNA, 22 bp, Artificial Sequence
  chemically synthesized
tcgcgcacatatacacacacac

SEQ ID NO: 18885 - DNA, 22 bp, Artificial Sequence
  chemically synthesized
gcgcacatatacacacacacaa

SEQ ID NO: 18886 - DNA, 22 bp, Artificial Sequence
  chemically synthesized
actcacacacacacacagagtc

SEQ ID NO: 18887 - DNA, 22 bp, Artificial Sequence
  chemically synthesized
acacacacacacagagtcccag

SEQ ID NO: 18888 - DNA, 22 bp, Artificial Sequence
  chemically synthesized
aatctgcattcctcatatgcac

SEQ ID NO: 18889 - DNA, 22 bp, Artificial Sequence
  chemically synthesized
cattcctcatatgcacatacgt

SEQ ID NO: 18890 - DNA, 22 bp, Artificial Sequence
  chemically synthesized
ctcatatgcacatacgtgcaca

SEQ ID NO: 18891 - DNA, 22 bp, Artificial Sequence
  chemically synthesized
atatgcacatacgtgcacacgc

SEQ ID NO: 18892 - DNA, 22 bp, Artificial Sequence
  chemically synthesized
ttgggttgggaggagaagggca

SEQ ID NO: 18893 - DNA, 22 bp, Artificial Sequence
  chemically synthesized
gggttgggaggagaagggcagg

SEQ ID NO: 18894 - DNA, 22 bp, Artificial Sequence
  chemically synthesized
ggttgggaggagaagggcaggc

SEQ ID NO: 18895 - DNA, 22 bp, Artificial Sequence
  chemically synthesized
ggaggagaagggcaggcagtta

SEQ ID NO: 18896 - DNA, 22 bp, Artificial Sequence
  chemically synthesized
tcttccagatctccccacacct

SEQ ID NO: 18897 - DNA, 22 bp, Artificial Sequence
  chemically synthesized
ccagatctccccacacctctgg

SEQ ID NO: 18898 - DNA, 22 bp, Artificial Sequence
  chemically synthesized
cagatctccccacacctctggc

SEQ ID NO: 18899 - DNA, 22 bp, Artificial Sequence
  chemically synthesized
cccacacctctggcacatgcct

SEQ ID NO: 18900 - DNA, 22 bp, Artificial Sequence
  chemically synthesized
tggcacatgcctttcctggggt

SEQ ID NO: 18901 - DNA, 22 bp, Artificial Sequence
  chemically synthesized
gcacatgcctttcctggggtcc

SEQ ID NO: 18902 - DNA, 22 bp, Artificial Sequence
  chemically synthesized
tcctggggtcctggggtagaca

SEQ ID NO: 18903 - DNA, 22 bp, Artificial Sequence
  chemically synthesized
cctggggtcctggggtagacag

SEQ ID NO: 18904 - DNA, 22 bp, Artificial Sequence
  chemically synthesized
ctggggtcctggggtagacagg

SEQ ID NO: 18905 - DNA, 22 bp, Artificial Sequence
  chemically synthesized
gggtcctggggtagacaggaag

SEQ ID NO: 18906 - DNA, 22 bp, Artificial Sequence
  chemically synthesized
gggtagacaggaaggtgaggtg

SEQ ID NO: 18907 - DNA, 22 bp, Artificial Sequence
  chemically synthesized
ctcagtccctgttcacagagtg

SEQ ID NO: 18908 - DNA, 22 bp, Artificial Sequence
  chemically synthesized
agtccctgttcacagagtgggt

SEQ ID NO: 18909 - DNA, 22 bp, Artificial Sequence
  chemically synthesized
ttcacagagtgggtgcggcaga

SEQ ID NO: 18910 - DNA, 22 bp, Artificial Sequence
  chemically synthesized
acagagtgggtgcggcagagac

SEQ ID NO: 18911 - DNA, 22 bp, Artificial Sequence
  chemically synthesized
aaagggacagagcaatcatgag

SEQ ID NO: 18912 - DNA, 22 bp, Artificial Sequence
  chemically synthesized
agacagagggggagcaaagccg

SEQ ID NO: 18913 - DNA, 22 bp, Artificial Sequence
  chemically synthesized
cacacttgcctttcaaaaatgg

SEQ ID NO: 18914 - DNA, 22 bp, Artificial Sequence
  chemically synthesized
gcctttcaaaaatggatttcct

SEQ ID NO: 18915 - DNA, 22 bp, Artificial Sequence
  chemically synthesized
cctttcaaaaatggatttcctc

SEQ ID NO: 18916 - DNA, 22 bp, Artificial Sequence
  chemically synthesized
tcaaaaatggatttcctctcct

SEQ ID NO: 18917 - DNA, 22 bp, Artificial Sequence
  chemically synthesized
caaaaatggatttcctctcctg

SEQ ID NO: 18918 - DNA, 22 bp, Artificial Sequence
  chemically synthesized
aaaaatggatttcctctcctgg

SEQ ID NO: 18919 - DNA, 22 bp, Artificial Sequence
  chemically synthesized
cctctcctgggattcagcctgc

SEQ ID NO: 18920 - DNA, 22 bp, Artificial Sequence
  chemically synthesized
ctctcctgggattcagcctgcg

SEQ ID NO: 18921 - DNA, 22 bp, Artificial Sequence
  chemically synthesized
tcctgggattcagcctgcgagt

SEQ ID NO: 18922 - DNA, 22 bp, Artificial Sequence
  chemically synthesized
ctgggattcagcctgcgagtgc

SEQ ID NO: 18923 - DNA, 22 bp, Artificial Sequence
  chemically synthesized
ggattcagcctgcgagtgcctg

SEQ ID NO: 18924 - DNA, 22 bp, Artificial Sequence
  chemically synthesized
agcctgcgagtgcctggcccct

SEQ ID NO: 18925 - DNA, 22 bp, Artificial Sequence
  chemically synthesized
cgagtgcctggcccctcacctt

SEQ ID NO: 18926 - DNA, 22 bp, Artificial Sequence
  chemically synthesized
gcccctcaccttgatggaaagg

SEQ ID NO: 18927 - DNA, 22 bp, Artificial Sequence
  chemically synthesized
accttgatggaaaggatggtca

SEQ ID NO: 18928 - DNA, 22 bp, Artificial Sequence
  chemically synthesized
gatggaaaggatggtcattttc

SEQ ID NO: 18929 - DNA, 22 bp, Artificial Sequence
  chemically synthesized
atggaaaggatggtcattttcc

SEQ ID NO: 18930 - DNA, 22 bp, Artificial Sequence
  chemically synthesized
tcctccgagctcagctgctgga

SEQ ID NO: 18931 - DNA, 22 bp, Artificial Sequence
  chemically synthesized
cctccgagctcagctgctggat

SEQ ID NO: 18932 - DNA, 22 bp, Artificial Sequence
  chemically synthesized
ctccgagctcagctgctggata

SEQ ID NO: 18933 - DNA, 22 bp, Artificial Sequence
  chemically synthesized
cgagctcagctgctggatatct

SEQ ID NO: 18934 - DNA, 22 bp, Artificial Sequence
  chemically synthesized
agctgctggatatcttgaaagt

SEQ ID NO: 18935 - DNA, 22 bp, Artificial Sequence
  chemically synthesized
ctggatatcttgaaagtccttg

SEQ ID NO: 18936 - DNA, 22 bp, Artificial Sequence
  chemically synthesized
gatatcttgaaagtccttggcc

SEQ ID NO: 18937 - DNA, 22 bp, Artificial Sequence
  chemically synthesized
gaaagtccttggccatgatggg

SEQ ID NO: 18938 - DNA, 22 bp, Artificial Sequence
  chemically synthesized
aaagtccttggccatgatgggg

SEQ ID NO: 18939 - DNA, 22 bp, Artificial Sequence
  chemically synthesized
ggccatgatggggcccgggctg

SEQ ID NO: 18940 - DNA, 22 bp, Artificial Sequence
  chemically synthesized
gccatgatggggcccgggctgg

SEQ ID NO: 18941 - DNA, 22 bp, Artificial Sequence
  chemically synthesized
gagctggagctggagctgggct

SEQ ID NO: 18942 - DNA, 22 bp, Artificial Sequence
  chemically synthesized
gagctggagctgggctgggctg

SEQ ID NO: 18943 - DNA, 22 bp, Artificial Sequence
  chemically synthesized
gagctgggctgggctgggctga

SEQ ID NO: 18944 - DNA, 22 bp, Artificial Sequence
  chemically synthesized
ggctgggctgggctgaggttgc

SEQ ID NO: 18945 - DNA, 22 bp, Artificial Sequence
  chemically synthesized
ggctgggctgaggttgctctga

SEQ ID NO: 18946 - DNA, 22 bp, Artificial Sequence
  chemically synthesized
ggctgaggttgctctgagggct

SEQ ID NO: 18947 - DNA, 22 bp, Artificial Sequence
  chemically synthesized
aggttgctctgagggctggggc

SEQ ID NO: 18948 - DNA, 22 bp, Artificial Sequence
  chemically synthesized
ctctgagggctggggctggggc

SEQ ID NO: 18949 - DNA, 22 bp, Artificial Sequence
  chemically synthesized
tgagggctggggctggggcaga

SEQ ID NO: 18950 - DNA, 22 bp, Artificial Sequence
  chemically synthesized
agggctggggctggggcagagg

SEQ ID NO: 18951 - DNA, 22 bp, Artificial Sequence
  chemically synthesized
gggctggggcagaggtgcagat

SEQ ID NO: 18952 - DNA, 22 bp, Artificial Sequence
  chemically synthesized
gggcagaggtgcagattcacgt

SEQ ID NO: 18953 - DNA, 22 bp, Artificial Sequence
  chemically synthesized
acgtggaggttgatggtgggat

SEQ ID NO: 18954 - DNA, 22 bp, Artificial Sequence
  chemically synthesized
atggtgggatggaacgcagggt

SEQ ID NO: 18955 - DNA, 22 bp, Artificial Sequence
  chemically synthesized
ggggtggtggcctgggtaggat

SEQ ID NO: 18956 - DNA, 22 bp, Artificial Sequence
  chemically synthesized
agatcctacccaggccaccacc

SEQ ID NO: 18957 - DNA, 22 bp, Artificial Sequence
  chemically synthesized
cccaggccaccaccccgaaccc

SEQ ID NO: 18958 - DNA, 22 bp, Artificial Sequence
  chemically synthesized
cgaccctgcgttccatcccacc

SEQ ID NO: 18959 - DNA, 22 bp, Artificial Sequence
  chemically synthesized
cgttccatcccaccatcaacct

SEQ ID NO: 18960 - DNA, 22 bp, Artificial Sequence
  chemically synthesized
catcccaccatcaacctccacg

SEQ ID NO: 18961 - DNA, 22 bp, Artificial Sequence
  chemically synthesized
cacgtgaatctgcacctctgcc

SEQ ID NO: 18962 - DNA, 22 bp, Artificial Sequence
  chemically synthesized
cacctctgccccagccccagcc

SEQ ID NO: 18963 - DNA, 22 bp, Artificial Sequence
  chemically synthesized
tgccccagccccagccctcaga

SEQ ID NO: 18964 - DNA, 22 bp, Artificial Sequence
  chemically synthesized
ccccagccccagccctcagagc

SEQ ID NO: 18965 - DNA, 22 bp, Artificial Sequence
  chemically synthesized
agagcaacctcagcccagccca

SEQ ID NO: 18966 - DNA, 22 bp, Artificial Sequence
  chemically synthesized
agcccagcccagcccagctcca

SEQ ID NO: 18967 - DNA, 22 bp, Artificial Sequence
  chemically synthesized
cagctccagctccagcccgggc

SEQ ID NO: 18968 - DNA, 22 bp, Artificial Sequence
  chemically synthesized
cagctccagcccgggccccatc

SEQ ID NO: 18969 - DNA, 22 bp, Artificial Sequence
  chemically synthesized
cagcccgggccccatcatggcc

SEQ ID NO: 18970 - DNA, 22 bp, Artificial Sequence
  chemically synthesized
tcaagatatccagcagctgagc

SEQ ID NO: 18971 - DNA, 22 bp, Artificial Sequence
  chemically synthesized
caagatatccagcagctgagct

SEQ ID NO: 18972 - DNA, 22 bp, Artificial Sequence
  chemically synthesized
aagatatccagcagctgagctc

SEQ ID NO: 18973 - DNA, 22 bp, Artificial Sequence
  chemically synthesized
agctcggaggaaaatgaccatc

SEQ ID NO: 18974 - DNA, 22 bp, Artificial Sequence
  chemically synthesized
ggaggaaaatgaccatcctttc

SEQ ID NO: 18975 - DNA, 22 bp, Artificial Sequence
  chemically synthesized
tccatcaaggtgaggggccagg

SEQ ID NO: 18976 - DNA, 22 bp, Artificial Sequence
  chemically synthesized
ccatcaaggtgaggggccaggc

SEQ ID NO: 18977 - DNA, 22 bp, Artificial Sequence
  chemically synthesized
catcaaggtgaggggccaggca

SEQ ID NO: 18978 - DNA, 22 bp, Artificial Sequence
  chemically synthesized
gcaggctgaatcccaggagagg

SEQ ID NO: 18979 - DNA, 22 bp, Artificial Sequence
  chemically synthesized
aatcccaggagaggaaatccat

SEQ ID NO: 18980 - DNA, 22 bp, Artificial Sequence
  chemically synthesized
ttgaaaggcaagtgtgcagttt

SEQ ID NO: 18981 - DNA, 22 bp, Artificial Sequence
  chemically synthesized
tgaaaggcaagtgtgcagtttc

SEQ ID NO: 18982 - DNA, 22 bp, Artificial Sequence
  chemically synthesized
gaaaggcaagtgtgcagtttct

SEQ ID NO: 18983 - DNA, 22 bp, Artificial Sequence
  chemically synthesized
aaaggcaagtgtgcagtttctg

SEQ ID NO: 18984 - DNA, 22 bp, Artificial Sequence
  chemically synthesized
ctgcggctttgctccccctctg

SEQ ID NO: 18985 - DNA, 22 bp, Artificial Sequence
  chemically synthesized
tgcggctttgctccccctctgt

SEQ ID NO: 18986 - DNA, 22 bp, Artificial Sequence
  chemically synthesized
cggctttgctccccctctgtct

SEQ ID NO: 18987 - DNA, 22 bp, Artificial Sequence
  chemically synthesized
tgctccccctctgtctcagctc

SEQ ID NO: 18988 - DNA, 22 bp, Artificial Sequence
  chemically synthesized
gctccccctctgtctcagctca

SEQ ID NO: 18989 - DNA, 22 bp, Artificial Sequence
  chemically synthesized
ctccccctctgtctcagctcat

SEQ ID NO: 18990 - DNA, 22 bp, Artificial Sequence
  chemically synthesized
cccctctgtctcagctcatgat

SEQ ID NO: 18991 - DNA, 22 bp, Artificial Sequence
  chemically synthesized
tgtctcagctcatgattgctct

SEQ ID NO: 18992 - DNA, 22 bp, Artificial Sequence
  chemically synthesized
tctcagctcatgattgctctgt

SEQ ID NO: 18993 - DNA, 22 bp, Artificial Sequence
  chemically synthesized
agctcatgattgctctgtccct

SEQ ID NO: 18994 - DNA, 22 bp, Artificial Sequence
  chemically synthesized
atgattgctctgtccctttgag

SEQ ID NO: 18995 - DNA, 22 bp, Artificial Sequence
  chemically synthesized
ctctgtccctttgaggtctctg

SEQ ID NO: 18996 - DNA, 22 bp, Artificial Sequence
  chemically synthesized
tgtccctttgaggtctctgccg

SEQ ID NO: 18997 - DNA, 22 bp, Artificial Sequence
  chemically synthesized
tccctttgaggtctctgccgca

SEQ ID NO: 18998 - DNA, 22 bp, Artificial Sequence
  chemically synthesized
tgaggtctctgccgcacccact

SEQ ID NO: 18999 - DNA, 22 bp, Artificial Sequence
  chemically synthesized
gaggtctctgccgcacccactc

SEQ ID NO: 19000 - DNA, 22 bp, Artificial Sequence
  chemically synthesized
aggtctctgccgcacccactct

SEQ ID NO: 19001 - DNA, 22 bp, Artificial Sequence
  chemically synthesized
tgccgcacccactctgtgaaca

SEQ ID NO: 19002 - DNA, 22 bp, Artificial Sequence
  chemically synthesized
ccgcacccactctgtgaacagg

SEQ ID NO: 19003 - DNA, 22 bp, Artificial Sequence
  chemically synthesized
tgtgaacagggactgaggaggg

SEQ ID NO: 19004 - DNA, 22 bp, Artificial Sequence
  chemically synthesized
tgaacagggactgaggagggcc

SEQ ID NO: 19005 - DNA, 22 bp, Artificial Sequence
  chemically synthesized
aggagggcccgacacccccgct

SEQ ID NO: 19006 - DNA, 22 bp, Artificial Sequence
  chemically synthesized
gttccctcacctcaccttcctg

SEQ ID NO: 19007 - DNA, 22 bp, Artificial Sequence
  chemically synthesized
ttccctcacctcaccttcctgt

SEQ ID NO: 19008 - DNA, 22 bp, Artificial Sequence
  chemically synthesized
cctcacctcaccttcctgtcta

SEQ ID NO: 19009 - DNA, 22 bp, Artificial Sequence
  chemically synthesized
acctcaccttcctgtctacccc

SEQ ID NO: 19010 - DNA, 22 bp, Artificial Sequence
  chemically synthesized
accttcctgtctaccccaggac

SEQ ID NO: 19011 - DNA, 22 bp, Artificial Sequence
  chemically synthesized
cctgtctaccccaggaccccag

SEQ ID NO: 19012 - DNA, 22 bp, Artificial Sequence
  chemically synthesized
ctgtctaccccaggaccccagg

SEQ ID NO: 19013 - DNA, 22 bp, Artificial Sequence
  chemically synthesized
tctaccccaggaccccaggaaa

SEQ ID NO: 19014 - DNA, 22 bp, Artificial Sequence
  chemically synthesized
ccccaggaccccaggaaaggca

SEQ ID NO: 19015 - DNA, 22 bp, Artificial Sequence
  chemically synthesized
gaagataactgcctgcccttct

SEQ ID NO: 19016 - DNA, 22 bp, Artificial Sequence
  chemically synthesized
cctgcccttctcctcccaaccc

SEQ ID NO: 19017 - DNA, 22 bp, Artificial Sequence
  chemically synthesized
cccttctcctcccaacccaaga

SEQ ID NO: 19018 - DNA, 22 bp, Artificial Sequence
  chemically synthesized
ctcctcccaacccaagaacaca

SEQ ID NO: 19019 - DNA, 22 bp, Artificial Sequence
  chemically synthesized
tcctcccaacccaagaacacat

SEQ ID NO: 19020 - DNA, 22 bp, Artificial Sequence
  chemically synthesized
ctcccaacccaagaacacatgt

SEQ ID NO: 19021 - DNA, 22 bp, Artificial Sequence
  chemically synthesized
ccaacccaagaacacatgtgcc

SEQ ID NO: 19022 - DNA, 22 bp, Artificial Sequence
  chemically synthesized
gtatgtgcgtgtgcacgtatgt

SEQ ID NO: 19023 - DNA, 22 bp, Artificial Sequence
  chemically synthesized
agctgggactctgtgtgtgtgt

SEQ ID NO: 19024 - DNA, 22 bp, Artificial Sequence
  chemically synthesized
ggactctgtgtgtgtgtgtgag

SEQ ID NO: 19025 - DNA, 22 bp, Artificial Sequence
  chemically synthesized
tgtgtgtgtgtgtgagtgaatg

SEQ ID NO: 19026 - DNA, 22 bp, Artificial Sequence
  chemically synthesized
tgtgtgtgtgtgagtgaatgtt

SEQ ID NO: 19027 - DNA, 22 bp, Artificial Sequence
  chemically synthesized
tgtgtgtgtatatgtgcgcgag

SEQ ID NO: 19028 - DNA, 22 bp, Artificial Sequence
  chemically synthesized
tgtgtgtgtatgtcgtgtatgt

SEQ ID NO: 19029 - DNA, 22 bp, Artificial Sequence
  chemically synthesized
tgtgtgagagtgtgttgtgtgt

SEQ ID NO: 19030 - DNA, 22 bp, Artificial Sequence
  chemically synthesized
tgtgtgtatgttgtgtgagtat

SEQ ID NO: 19031 - DNA, 22 bp, Artificial Sequence
  chemically synthesized
tgtgagtatatgttgtgtgtat

SEQ ID NO: 19032 - DNA, 22 bp, Artificial Sequence
  chemically synthesized
tgtgtatcttgtgtgtgagtgt

SEQ ID NO: 19033 - DNA, 22 bp, Artificial Sequence
  chemically synthesized
gtgtgtgagtgtatgttgtgtg

SEQ ID NO: 19034 - DNA, 22 bp, Artificial Sequence
  chemically synthesized
tgtgtgagtgtatgttgtgtgt

SEQ ID NO: 19035 - DNA, 22 bp, Artificial Sequence
  chemically synthesized
tgtgttgtgtgtgtatcttgtg

SEQ ID NO: 19036 - DNA, 22 bp, Artificial Sequence
  chemically synthesized
tgtgtgtatcttgtgcatgtgt

SEQ ID NO: 19037 - DNA, 22 bp, Artificial Sequence
  chemically synthesized
gtgcatgtgtgtatgttgtgcg

SEQ ID NO: 19038 - DNA, 22 bp, Artificial Sequence
  chemically synthesized
tgcatgtgtgtatgttgtgcga

SEQ ID NO: 19039 - DNA, 22 bp, Artificial Sequence
  chemically synthesized
tgcgagtgtatgttgtgtatgt

SEQ ID NO: 19040 - DNA, 22 bp, Artificial Sequence
  chemically synthesized
tgtatgtgagtgtgtgtatgtt

SEQ ID NO: 19041 - DNA, 22 bp, Artificial Sequence
  chemically synthesized
tgtgtatgttgtgtgtatgtat

SEQ ID NO: 19042 - DNA, 22 bp, Artificial Sequence
  chemically synthesized
tgtgtatgtatgttgtgtatga

SEQ ID NO: 19043 - DNA, 22 bp, Artificial Sequence
  chemically synthesized
tgtatgagtgtgtgtatgttgt

SEQ ID NO: 19044 - DNA, 22 bp, Artificial Sequence
  chemically synthesized
tgtgtgtgtacgttgtgtatgt

SEQ ID NO: 19045 - DNA, 22 bp, Artificial Sequence
  chemically synthesized
tgtatgttgtgtgtgtgttgtg

SEQ ID NO: 19046 - DNA, 22 bp, Artificial Sequence
  chemically synthesized
tgtgtgtgttgtgtgtgtgtat

SEQ ID NO: 19047 - DNA, 22 bp, Artificial Sequence
  chemically synthesized
tgtgtgtgtattgtgtgagtgt

SEQ ID NO: 19048 - DNA, 22 bp, Artificial Sequence
  chemically synthesized
tgtgagtgtatgtatgtttgtg

SEQ ID NO: 19049 - DNA, 22 bp, Artificial Sequence
  chemically synthesized
gtgtgttgtgtgagtgttgtgt

SEQ ID NO: 19050 - DNA, 22 bp, Artificial Sequence
  chemically synthesized
tgtgttgtgtgagtgttgtgta

SEQ ID NO: 19051 - DNA, 22 bp, Artificial Sequence
  chemically synthesized
tgtgagtgttgtgtatgttgtg

SEQ ID NO: 19052 - DNA, 22 bp, Artificial Sequence
  chemically synthesized
tgtatgttgtgcgtgtgtgtat

SEQ ID NO: 19053 - DNA, 22 bp, Artificial Sequence
  chemically synthesized
tgcgtgtgtgtatgttgtgcga

SEQ ID NO: 19054 - DNA, 22 bp, Artificial Sequence
  chemically synthesized
tgcgagtgtgtgtgttgtgtgt

SEQ ID NO: 19055 - DNA, 22 bp, Artificial Sequence
  chemically synthesized
tgtgtgtatgttgtgagtgtgt

SEQ ID NO: 19056 - DNA, 22 bp, Artificial Sequence
  chemically synthesized
tgagtgtgttatgtatgttgtg

SEQ ID NO: 19057 - DNA, 22 bp, Artificial Sequence
  chemically synthesized
tgtatgttgtgtgtgtgagtgt

SEQ ID NO: 19058 - DNA, 22 bp, Artificial Sequence
  chemically synthesized
tgtgtgtgagtgtgttgcgtga

SEQ ID NO: 19059 - DNA, 22 bp, Artificial Sequence
  chemically synthesized
cgtgagtgtgtgtgttagtgtg

SEQ ID NO: 19060 - DNA, 22 bp, Artificial Sequence
  chemically synthesized
gtgtgtgtatgtgattgtatgt

SEQ ID NO: 19061 - DNA, 22 bp, Artificial Sequence
  chemically synthesized
tatgtgtgtgtgtgtgtgtgtg

SEQ ID NO: 19062 - DNA, 22 bp, Artificial Sequence
  chemically synthesized
ggatgggtgggggacgtgagca

SEQ ID NO: 19063 - DNA, 22 bp, Artificial Sequence
  chemically synthesized
gaagatccctgctcctctcatc

SEQ ID NO: 19064 - DNA, 22 bp, Artificial Sequence
  chemically synthesized
ctcctctcatctcccaagaccc

SEQ ID NO: 19065 - DNA, 22 bp, Artificial Sequence
  chemically synthesized
ctctcatctcccaagacccttc

SEQ ID NO: 19066 - DNA, 22 bp, Artificial Sequence
  chemically synthesized
tcatctcccaagacccttccct

SEQ ID NO: 19067 - DNA, 22 bp, Artificial Sequence
  chemically synthesized
atctcccaagacccttccctgg

SEQ ID NO: 19068 - DNA, 22 bp, Artificial Sequence
  chemically synthesized
ccaagacccttccctggatcct

SEQ ID NO: 19069 - DNA, 22 bp, Artificial Sequence
  chemically synthesized
ccctggatccttctgtaataaa

SEQ ID NO: 19070 - DNA, 22 bp, Artificial Sequence
  chemically synthesized
cctggatccttctgtaataaat

SEQ ID NO: 19071 - DNA, 22 bp, Artificial Sequence
  chemically synthesized
gatccttctgtaataaatcttg

SEQ ID NO: 19072 - DNA, 22 bp, Artificial Sequence
  chemically synthesized
ctgtaataaatcttgactgaag

SEQ ID NO: 19073 - DNA, 22 bp, Artificial Sequence
  chemically synthesized
tgtaataaatcttgactgaagg

SEQ ID NO: 19074 - DNA, 22 bp, Artificial Sequence
  chemically synthesized
taataaatcttgactgaaggac

SEQ ID NO: 19075 - DNA, 22 bp, Artificial Sequence
  chemically synthesized
gactgaaggacctaagtatctt

SEQ ID NO: 19076 - DNA, 22 bp, Artificial Sequence
  chemically synthesized
actgaaggacctaagtatcttg

SEQ ID NO: 19077 - DNA, 22 bp, Artificial Sequence
  chemically synthesized
aaggacctaagtatcttggaca

SEQ ID NO: 19078 - DNA, 22 bp, Artificial Sequence
  chemically synthesized
agtatcttggacattttttttt

SEQ ID NO: 19079 - DNA, 22 bp, Artificial Sequence
  chemically synthesized
ggacattttttttttagagaca

SEQ ID NO: 19080 - DNA, 22 bp, Artificial Sequence
  chemically synthesized
gacattttttttttagagacag

SEQ ID NO: 19081 - DNA, 22 bp, Artificial Sequence
  chemically synthesized
tttttttagagacaggagtgta

SEQ ID NO: 19082 - DNA, 22 bp, Artificial Sequence
  chemically synthesized
ttttttagagacaggagtgtag

SEQ ID NO: 19083 - DNA, 22 bp, Artificial Sequence
  chemically synthesized
tttttagagacaggagtgtagt

SEQ ID NO: 19084 - DNA, 22 bp, Artificial Sequence
  chemically synthesized
ttttagagacaggagtgtagtg

SEQ ID NO: 19085 - DNA, 22 bp, Artificial Sequence
  chemically synthesized
tttagagacaggagtgtagtgg

SEQ ID NO: 19086 - DNA, 22 bp, Artificial Sequence
  chemically synthesized
ttagagacaggagtgtagtggc

SEQ ID NO: 19087 - DNA, 22 bp, Artificial Sequence
  chemically synthesized
tagagacaggagtgtagtggca

SEQ ID NO: 19088 - DNA, 22 bp, Artificial Sequence
  chemically synthesized
agagacaggagtgtagtggcag

SEQ ID NO: 19089 - DNA, 22 bp, Artificial Sequence
  chemically synthesized
gagacaggagtgtagtggcagg

SEQ ID NO: 19090 - DNA, 22 bp, Artificial Sequence
  chemically synthesized
actgcaacctcgaactcctggg

SEQ ID NO: 19091 - DNA, 22 bp, Artificial Sequence
  chemically synthesized
caacctcgaactcctgggctca

SEQ ID NO: 19092 - DNA, 22 bp, Artificial Sequence
  chemically synthesized
gaactcctgggctcaagccatc

SEQ ID NO: 19093 - DNA, 22 bp, Artificial Sequence
  chemically synthesized
ctgggctcaagccatcctccca

SEQ ID NO: 19094 - DNA, 22 bp, Artificial Sequence
  chemically synthesized
ggctcaagccatcctcccacct

SEQ ID NO: 19095 - DNA, 22 bp, Artificial Sequence
  chemically synthesized
aagccatcctcccacctcagcc

SEQ ID NO: 19096 - DNA, 22 bp, Artificial Sequence
  chemically synthesized
ccacctcagcctcccaagtagt

SEQ ID NO: 19097 - DNA, 22 bp, Artificial Sequence
  chemically synthesized
agcctcccaagtagttaggact

SEQ ID NO: 19098 - DNA, 22 bp, Artificial Sequence
  chemically synthesized
ccaagtagttaggacttacagg

SEQ ID NO: 19099 - DNA, 22 bp, Artificial Sequence
  chemically synthesized
ggacttacaggtgtgcaccact

SEQ ID NO: 19100 - DNA, 22 bp, Artificial Sequence
  chemically synthesized
acaggtgtgcaccactgtgcct

SEQ ID NO: 19101 - DNA, 22 bp, Artificial Sequence
  chemically synthesized
caggtgtgcaccactgtgcctg

SEQ ID NO: 19102 - DNA, 22 bp, Artificial Sequence
  chemically synthesized
tgcctggcaaattaaaaaaaat

SEQ ID NO: 19103 - DNA, 22 bp, Artificial Sequence
  chemically synthesized
gcaaattaaaaaaaatttttta

SEQ ID NO: 19104 - DNA, 22 bp, Artificial Sequence
  chemically synthesized
aaaaaaattttttagagaaatg

SEQ ID NO: 19105 - DNA, 22 bp, Artificial Sequence
  chemically synthesized
tttagagaaatggggtcttgct

SEQ ID NO: 19106 - DNA, 22 bp, Artificial Sequence
  chemically synthesized
ttagagaaatggggtcttgcta

SEQ ID NO: 19107 - DNA, 22 bp, Artificial Sequence
  chemically synthesized
tagagaaatggggtcttgctat

SEQ ID NO: 19108 - DNA, 22 bp, Artificial Sequence
  chemically synthesized
agagaaatggggtcttgctatg

SEQ ID NO: 19109 - DNA, 22 bp, Artificial Sequence
  chemically synthesized
gagaaatggggtcttgctatgt

SEQ ID NO: 19110 - DNA, 22 bp, Artificial Sequence
  chemically synthesized
gctatgttgcccaggctggtgg

SEQ ID NO: 19111 - DNA, 22 bp, Artificial Sequence
  chemically synthesized
ctatgttgcccaggctggtggg

SEQ ID NO: 19112 - DNA, 22 bp, Artificial Sequence
  chemically synthesized
tgttgcccaggctggtgggaaa

SEQ ID NO: 19113 - DNA, 22 bp, Artificial Sequence
  chemically synthesized
cccaggctggtgggaaaagatt

SEQ ID NO: 19114 - DNA, 22 bp, Artificial Sequence
  chemically synthesized
gtgggaaaagattttaaggtga

SEQ ID NO: 19115 - DNA, 22 bp, Artificial Sequence
  chemically synthesized
taaggtgagagagatctgagca

SEQ ID NO: 19116 - DNA, 22 bp, Artificial Sequence
  chemically synthesized
aaggtgagagagatctgagcag

SEQ ID NO: 19117 - DNA, 22 bp, Artificial Sequence
  chemically synthesized
aggtgagagagatctgagcagt

SEQ ID NO: 19118 - DNA, 22 bp, Artificial Sequence
  chemically synthesized
agcagtgctaggcagaagggca

SEQ ID NO: 19119 - DNA, 22 bp, Artificial Sequence
  chemically synthesized
ggcagaagggcaagagccagga

SEQ ID NO: 19120 - DNA, 22 bp, Artificial Sequence
  chemically synthesized
gtggtggagccgggttccatgg

SEQ ID NO: 19121 - DNA, 22 bp, Artificial Sequence
  chemically synthesized
catggaggcaggaggagcaggg

SEQ ID NO: 19122 - DNA, 22 bp, Artificial Sequence
  chemically synthesized
ggagcttaggaaggggattggt

SEQ ID NO: 19123 - DNA, 22 bp, Artificial Sequence
  chemically synthesized
gagcttaggaaggggattggtt

SEQ ID NO: 19124 - DNA, 22 bp, Artificial Sequence
  chemically synthesized
aggaaggggattggttagctgg

SEQ ID NO: 19125 - DNA, 22 bp, Artificial Sequence
  chemically synthesized
ggaaggggattggttagctggg

SEQ ID NO: 19126 - DNA, 22 bp, Artificial Sequence
  chemically synthesized
gttagctgggctggaatgaggg

SEQ ID NO: 19127 - DNA, 22 bp, Artificial Sequence
  chemically synthesized
gctgggctggaatgagggactc

SEQ ID NO: 19128 - DNA, 22 bp, Artificial Sequence
  chemically synthesized
ggctggaatgagggactcctca

SEQ ID NO: 19129 - DNA, 22 bp, Artificial Sequence
  chemically synthesized
gaatgagggactcctcattcct

SEQ ID NO: 19130 - DNA, 22 bp, Artificial Sequence
  chemically synthesized
ctcattcctgaggctggccaac

SEQ ID NO: 19131 - DNA, 22 bp, Artificial Sequence
  chemically synthesized
attcctgaggctggccaaccga

SEQ ID NO: 19132 - DNA, 22 bp, Artificial Sequence
  chemically synthesized
ctgaggctggccaaccgaggga

SEQ ID NO: 19133 - DNA, 22 bp, Artificial Sequence
  chemically synthesized
aggctggccaaccgagggaggg

SEQ ID NO: 19134 - DNA, 22 bp, Artificial Sequence
  chemically synthesized
gccaaccgagggagggccggtg

SEQ ID NO: 19135 - DNA, 22 bp, Artificial Sequence
  chemically synthesized
ggcagggcagggcaggggacag

SEQ ID NO: 19136 - DNA, 22 bp, Artificial Sequence
  chemically synthesized
ccgaggaccactcaggaacacc

SEQ ID NO: 19137 - DNA, 22 bp, Artificial Sequence
  chemically synthesized
aggaacaccagtagcatctcct

SEQ ID NO: 19138 - DNA, 22 bp, Artificial Sequence
  chemically synthesized
ctctctctgtagggggctggct

SEQ ID NO: 19139 - DNA, 22 bp, Artificial Sequence
  chemically synthesized
tctctgtagggggctggctgga

SEQ ID NO: 19140 - DNA, 22 bp, Artificial Sequence
  chemically synthesized
tctgtagggggctggctggact

SEQ ID NO: 19141 - DNA, 22 bp, Artificial Sequence
  chemically synthesized
tgtagggggctggctggacttc

SEQ ID NO: 19142 - DNA, 22 bp, Artificial Sequence
  chemically synthesized
tagggggctggctggacttccc

SEQ ID NO: 19143 - DNA, 22 bp, Artificial Sequence
  chemically synthesized
gctggacttcccaccaggcggt

SEQ ID NO: 19144 - DNA, 22 bp, Artificial Sequence
  chemically synthesized
gacttcccaccaggcggtgtcc

SEQ ID NO: 19145 - DNA, 22 bp, Artificial Sequence
  chemically synthesized
cccaccaggcggtgtccccaca

SEQ ID NO: 19146 - DNA, 22 bp, Artificial Sequence
  chemically synthesized
ccaccaggcggtgtccccacag

SEQ ID NO: 19147 - DNA, 22 bp, Artificial Sequence
  chemically synthesized
tccgcctcactctcctctgcaa

SEQ ID NO: 19148 - DNA, 22 bp, Artificial Sequence
  chemically synthesized
actctcctctgcaactccagtg

SEQ ID NO: 19149 - DNA, 22 bp, Artificial Sequence
  chemically synthesized
tcctctgcaactccagtgccca

SEQ ID NO: 19150 - DNA, 22 bp, Artificial Sequence
  chemically synthesized
ctctgcaactccagtgcccaca

SEQ ID NO: 19151 - DNA, 22 bp, Artificial Sequence
  chemically synthesized
tgcaactccagtgcccacacgg

SEQ ID NO: 19152 - DNA, 22 bp, Artificial Sequence
  chemically synthesized
caactccagtgcccacacggca

SEQ ID NO: 19153 - DNA, 22 bp, Artificial Sequence
  chemically synthesized
cagtgcccacacggcacccggt

SEQ ID NO: 19154 - DNA, 22 bp, Artificial Sequence
  chemically synthesized
agagagaatacgggatgctgct

SEQ ID NO: 19155 - DNA, 22 bp, Artificial Sequence
  chemically synthesized
ctgaatcttctgagggtgacag

SEQ ID NO: 19156 - DNA, 22 bp, Artificial Sequence
  chemically synthesized
aatcttctgagggtgacagaat

SEQ ID NO: 19157 - DNA, 22 bp, Artificial Sequence
  chemically synthesized
ctgagggtgacagaatttagag

SEQ ID NO: 19158 - DNA, 22 bp, Artificial Sequence
  chemically synthesized
tgagggtgacagaatttagagt

SEQ ID NO: 19159 - DNA, 22 bp, Artificial Sequence
  chemically synthesized
agggtgacagaatttagagttt

SEQ ID NO: 19160 - DNA, 22 bp, Artificial Sequence
  chemically synthesized
agagtttgagcaggaggcttgg

SEQ ID NO: 19161 - DNA, 22 bp, Artificial Sequence
  chemically synthesized
gagtttgagcaggaggcttgga

SEQ ID NO: 19162 - DNA, 22 bp, Artificial Sequence
  chemically synthesized
gagcaggaggcttggagagagg

SEQ ID NO: 19163 - DNA, 22 bp, Artificial Sequence
  chemically synthesized
agcaggaggcttggagagaggc

SEQ ID NO: 19164 - DNA, 22 bp, Artificial Sequence
  chemically synthesized
ggagagaggccaggatttctga

SEQ ID NO: 19165 - DNA, 22 bp, Artificial Sequence
  chemically synthesized
gagagaggccaggatttctgaa

SEQ ID NO: 19166 - DNA, 22 bp, Artificial Sequence
  chemically synthesized
ctgaaattaatgggagagtgag

SEQ ID NO: 19167 - DNA, 22 bp, Artificial Sequence
  chemically synthesized
tgaaattaatgggagagtgagc

SEQ ID NO: 19168 - DNA, 22 bp, Artificial Sequence
  chemically synthesized
aaattaatgggagagtgagctc

SEQ ID NO: 19169 - DNA, 22 bp, Artificial Sequence
  chemically synthesized
atgggagagtgagctcacgcga

SEQ ID NO: 19170 - DNA, 22 bp, Artificial Sequence
  chemically synthesized
acgcgaatgggctgagggacac

SEQ ID NO: 19171 - DNA, 22 bp, Artificial Sequence
  chemically synthesized
agggacaccagtgagggaccgt

SEQ ID NO: 19172 - DNA, 22 bp, Artificial Sequence
  chemically synthesized
aagggatgtagcaaagtcaccg

SEQ ID NO: 19173 - DNA, 22 bp, Artificial Sequence
  chemically synthesized
ccctccagcagcccgggtggtg

SEQ ID NO: 19174 - DNA, 22 bp, Artificial Sequence
  chemically synthesized
cctccagcagcccgggtggtgg

SEQ ID NO: 19175 - DNA, 22 bp, Artificial Sequence
  chemically synthesized
cagcagcccgggtggtgggggc

SEQ ID NO: 19176 - DNA, 22 bp, Artificial Sequence
  chemically synthesized
ggggaacgtcatcatgggagct

SEQ ID NO: 19177 - DNA, 22 bp, Artificial Sequence
  chemically synthesized
acactgatcagctgctcaccgg

SEQ ID NO: 19178 - DNA, 22 bp, Artificial Sequence
  chemically synthesized
atcagctgctcaccggggccca

SEQ ID NO: 19179 - DNA, 22 bp, Artificial Sequence
  chemically synthesized
ctcaccggggcccatcttccac

SEQ ID NO: 19180 - DNA, 22 bp, Artificial Sequence
  chemically synthesized
accggggcccatcttccacttg

SEQ ID NO: 19181 - DNA, 22 bp, Artificial Sequence
  chemically synthesized
ccacttgtctcagcacttgatt

SEQ ID NO: 19182 - DNA, 22 bp, Artificial Sequence
  chemically synthesized
cacttgtctcagcacttgattt

SEQ ID NO: 19183 - DNA, 22 bp, Artificial Sequence
  chemically synthesized
gtctcagcacttgatttttttc

SEQ ID NO: 19184 - DNA, 22 bp, Artificial Sequence
  chemically synthesized
tctcagcacttgatttttttct

SEQ ID NO: 19185 - DNA, 22 bp, Artificial Sequence
  chemically synthesized
agcacttgatttttttctgcta

SEQ ID NO: 19186 - DNA, 22 bp, Artificial Sequence
  chemically synthesized
gatttttttctgctaccccctt

SEQ ID NO: 19187 - DNA, 22 bp, Artificial Sequence
  chemically synthesized
atttttttctgctacccccttt

SEQ ID NO: 19188 - DNA, 22 bp, Artificial Sequence
  chemically synthesized
ttttctgctaccccctttttct

SEQ ID NO: 19189 - DNA, 22 bp, Artificial Sequence
  chemically synthesized
tttctgctaccccctttttctt

SEQ ID NO: 19190 - DNA, 22 bp, Artificial Sequence
  chemically synthesized
ttctgctaccccctttttcttt

SEQ ID NO: 19191 - DNA, 22 bp, Artificial Sequence
  chemically synthesized
tctgctaccccctttttctttt

SEQ ID NO: 19192 - DNA, 22 bp, Artificial Sequence
  chemically synthesized
ctgctaccccctttttctttta

SEQ ID NO: 19193 - DNA, 22 bp, Artificial Sequence
  chemically synthesized
tgctaccccctttttcttttaa

SEQ ID NO: 19194 - DNA, 22 bp, Artificial Sequence
  chemically synthesized
ctaccccctttttcttttaaag

SEQ ID NO: 19195 - DNA, 22 bp, Artificial Sequence
  chemically synthesized
ccccctttttcttttaaagatt

SEQ ID NO: 19196 - DNA, 22 bp, Artificial Sequence
  chemically synthesized
tttcttttaaagatttcaatta

SEQ ID NO: 19197 - DNA, 22 bp, Artificial Sequence
  chemically synthesized
ttcttttaaagatttcaattat

SEQ ID NO: 19198 - DNA, 22 bp, Artificial Sequence
  chemically synthesized
tcttttaaagatttcaattatg

SEQ ID NO: 19199 - DNA, 22 bp, Artificial Sequence
  chemically synthesized
cttttaaagatttcaattatgc

SEQ ID NO: 19200 - DNA, 22 bp, Artificial Sequence
  chemically synthesized
ttttaaagatttcaattatgca

SEQ ID NO: 19201 - DNA, 22 bp, Artificial Sequence
  chemically synthesized
ttaaagatttcaattatgcatg

SEQ ID NO: 19202 - DNA, 22 bp, Artificial Sequence
  chemically synthesized
taaagatttcaattatgcatgt

SEQ ID NO: 19203 - DNA, 22 bp, Artificial Sequence
  chemically synthesized
aaagatttcaattatgcatgta

SEQ ID NO: 19204 - DNA, 22 bp, Artificial Sequence
  chemically synthesized
aagatttcaattatgcatgtat

SEQ ID NO: 19205 - DNA, 22 bp, Artificial Sequence
  chemically synthesized
caattatgcatgtattaagggt

SEQ ID NO: 19206 - DNA, 22 bp, Artificial Sequence
  chemically synthesized
aattatgcatgtattaagggtc

SEQ ID NO: 19207 - DNA, 22 bp, Artificial Sequence
  chemically synthesized
tgcatgtattaagggtcccaca

SEQ ID NO: 19208 - DNA, 22 bp, Artificial Sequence
  chemically synthesized
agggtcccacagctcactcatt

SEQ ID NO: 19209 - DNA, 22 bp, Artificial Sequence
  chemically synthesized
actcattctctttccatttttt

SEQ ID NO: 19210 - DNA, 22 bp, Artificial Sequence
  chemically synthesized
attctctttccattttttaatt

SEQ ID NO: 19211 - DNA, 22 bp, Artificial Sequence
  chemically synthesized
tctttccattttttaattcttt

SEQ ID NO: 19212 - DNA, 22 bp, Artificial Sequence
  chemically synthesized
tttccattttttaattcttttt

SEQ ID NO: 19213 - DNA, 22 bp, Artificial Sequence
  chemically synthesized
tccattttttaattcttttttc

SEQ ID NO: 19214 - DNA, 22 bp, Artificial Sequence
  chemically synthesized
ccattttttaattcttttttct

SEQ ID NO: 19215 - DNA, 22 bp, Artificial Sequence
  chemically synthesized
cattttttaattcttttttctc

SEQ ID NO: 19216 - DNA, 22 bp, Artificial Sequence
  chemically synthesized
tttaattcttttttctcccagt

SEQ ID NO: 19217 - DNA, 22 bp, Artificial Sequence
  chemically synthesized
ttaattcttttttctcccagtg

SEQ ID NO: 19218 - DNA, 22 bp, Artificial Sequence
  chemically synthesized
taattcttttttctcccagtgt

SEQ ID NO: 19219 - DNA, 22 bp, Artificial Sequence
  chemically synthesized
aattcttttttctcccagtgtt

SEQ ID NO: 19220 - DNA, 22 bp, Artificial Sequence
  chemically synthesized
attcttttttctcccagtgttt

SEQ ID NO: 19221 - DNA, 22 bp, Artificial Sequence
  chemically synthesized
ttttttctcccagtgtttcatt

SEQ ID NO: 19222 - DNA, 22 bp, Artificial Sequence
  chemically synthesized
ttttctcccagtgtttcatttt

SEQ ID NO: 19223 - DNA, 22 bp, Artificial Sequence
  chemically synthesized
tttctcccagtgtttcatttta

SEQ ID NO: 19224 - DNA, 22 bp, Artificial Sequence
  chemically synthesized
ttctcccagtgtttcattttat

SEQ ID NO: 19225 - DNA, 22 bp, Artificial Sequence
  chemically synthesized
tctcccagtgtttcattttata

SEQ ID NO: 19226 - DNA, 22 bp, Artificial Sequence
  chemically synthesized
ctcccagtgtttcattttatag

SEQ ID NO: 19227 - DNA, 22 bp, Artificial Sequence
  chemically synthesized
tcccagtgtttcattttataga

SEQ ID NO: 19228 - DNA, 22 bp, Artificial Sequence
  chemically synthesized
ccagtgtttcattttatagagt

SEQ ID NO: 19229 - DNA, 22 bp, Artificial Sequence
  chemically synthesized
cattttatagagttattgctgt

SEQ ID NO: 19230 - DNA, 22 bp, Artificial Sequence
  chemically synthesized
attttatagagttattgctgtt

SEQ ID NO: 19231 - DNA, 22 bp, Artificial Sequence
  chemically synthesized
tatagagttattgctgttcatt

SEQ ID NO: 19232 - DNA, 22 bp, Artificial Sequence
  chemically synthesized
atagagttattgctgttcatta

SEQ ID NO: 19233 - DNA, 22 bp, Artificial Sequence
  chemically synthesized
tagagttattgctgttcattaa

SEQ ID NO: 19234 - DNA, 22 bp, Artificial Sequence
  chemically synthesized
ttgctgttcattaagttaacta

SEQ ID NO: 19235 - DNA, 22 bp, Artificial Sequence
  chemically synthesized
ctgttcattaagttaactaaaa

SEQ ID NO: 19236 - DNA, 22 bp, Artificial Sequence
  chemically synthesized
ttcattaagttaactaaaattt

SEQ ID NO: 19237 - DNA, 22 bp, Artificial Sequence
  chemically synthesized
attaagttaactaaaattttcc

SEQ ID NO: 19238 - DNA, 22 bp, Artificial Sequence
  chemically synthesized
agttaactaaaattttcccctt

SEQ ID NO: 19239 - DNA, 22 bp, Artificial Sequence
  chemically synthesized
actaaaattttccccttcccct

SEQ ID NO: 19240 - DNA, 22 bp, Artificial Sequence
  chemically synthesized
aaattttccccttcccctcccc

SEQ ID NO: 19241 - DNA, 22 bp, Artificial Sequence
  chemically synthesized
tccccttcccctccccctcccc

SEQ ID NO: 19242 - DNA, 22 bp, Artificial Sequence
  chemically synthesized
ccccttcccctccccctcccct

SEQ ID NO: 19243 - DNA, 22 bp, Artificial Sequence
  chemically synthesized
cccttcccctccccctcccctc

SEQ ID NO: 19244 - DNA, 22 bp, Artificial Sequence
  chemically synthesized
cccctccccctcccctcccctc

SEQ ID NO: 19245 - DNA, 22 bp, Artificial Sequence
  chemically synthesized
ccctccccctcccctcccctcc

SEQ ID NO: 19246 - DNA, 22 bp, Artificial Sequence
  chemically synthesized
cccctcccctcccctcctttcc

SEQ ID NO: 19247 - DNA, 22 bp, Artificial Sequence
  chemically synthesized
ccctcccctcctttccttccct

SEQ ID NO: 19248 - DNA, 22 bp, Artificial Sequence
  chemically synthesized
ccctcctttccttccctcgctt

SEQ ID NO: 19249 - DNA, 22 bp, Artificial Sequence
  chemically synthesized
ctttccttccctcgcttcccct

SEQ ID NO: 19250 - DNA, 22 bp, Artificial Sequence
  chemically synthesized
tccttccctcgcttcccctccc

SEQ ID NO: 19251 - DNA, 22 bp, Artificial Sequence
  chemically synthesized
ccttccctcgcttcccctcccc

SEQ ID NO: 19252 - DNA, 22 bp, Artificial Sequence
  chemically synthesized
cttccctcgcttcccctcccct

SEQ ID NO: 19253 - DNA, 22 bp, Artificial Sequence
  chemically synthesized
ccctcgcttcccctcccctctc

SEQ ID NO: 19254 - DNA, 22 bp, Artificial Sequence
  chemically synthesized
cctcgcttcccctcccctctct

SEQ ID NO: 19255 - DNA, 22 bp, Artificial Sequence
  chemically synthesized
gcttcccctcccctctctctct

SEQ ID NO: 19256 - DNA, 22 bp, Artificial Sequence
  chemically synthesized
cccctcccctctctctctctca

SEQ ID NO: 19257 - DNA, 22 bp, Artificial Sequence
  chemically synthesized
ccctcccctctctctctctcat

SEQ ID NO: 19258 - DNA, 22 bp, Artificial Sequence
  chemically synthesized
ccctctctctctctcatctcac

SEQ ID NO: 19259 - DNA, 22 bp, Artificial Sequence
  chemically synthesized
tctctctctcatctcactctgt

SEQ ID NO: 19260 - DNA, 22 bp, Artificial Sequence
  chemically synthesized
tctctctcatctcactctgttg

SEQ ID NO: 19261 - DNA, 22 bp, Artificial Sequence
  chemically synthesized
tctctcatctcactctgttgcc

SEQ ID NO: 19262 - DNA, 22 bp, Artificial Sequence
  chemically synthesized
tctcatctcactctgttgccca

SEQ ID NO: 19263 - DNA, 22 bp, Artificial Sequence
  chemically synthesized
tcatctcactctgttgcccagg

SEQ ID NO: 19264 - DNA, 22 bp, Artificial Sequence
  chemically synthesized
atctcactctgttgcccaggct

SEQ ID NO: 19265 - DNA, 22 bp, Artificial Sequence
  chemically synthesized
actctgttgcccaggctggaat

SEQ ID NO: 19266 - DNA, 22 bp, Artificial Sequence
  chemically synthesized
tgttgcccaggctggaatgcag

SEQ ID NO: 19267 - DNA, 22 bp, Artificial Sequence
  chemically synthesized
ttgcccaggctggaatgcagta

SEQ ID NO: 19268 - DNA, 22 bp, Artificial Sequence
  chemically synthesized
cccaggctggaatgcagtagct

SEQ ID NO: 19269 - DNA, 22 bp, Artificial Sequence
  chemically synthesized
gaatgcagtagcttgtcacaac

SEQ ID NO: 19270 - DNA, 22 bp, Artificial Sequence
  chemically synthesized
gtcacaactcactgtggcctcc

SEQ ID NO: 19271 - DNA, 22 bp, Artificial Sequence
  chemically synthesized
tcacaactcactgtggcctcca

SEQ ID NO: 19272 - DNA, 22 bp, Artificial Sequence
  chemically synthesized
actgtggcctccacctcctggg

SEQ ID NO: 19273 - DNA, 22 bp, Artificial Sequence
  chemically synthesized
tggcctccacctcctgggctca

SEQ ID NO: 19274 - DNA, 22 bp, Artificial Sequence
  chemically synthesized
cacctcctgggctcaggcgatc

SEQ ID NO: 19275 - DNA, 22 bp, Artificial Sequence
  chemically synthesized
ctgggctcaggcgatccttcca

SEQ ID NO: 19276 - DNA, 22 bp, Artificial Sequence
  chemically synthesized
ggctcaggcgatccttccactt

SEQ ID NO: 19277 - DNA, 22 bp, Artificial Sequence
  chemically synthesized
aggcgatccttccacttcagcc

SEQ ID NO: 19278 - DNA, 22 bp, Artificial Sequence
  chemically synthesized
ccacttcagcctcccaggtagc

SEQ ID NO: 19279 - DNA, 22 bp, Artificial Sequence
  chemically synthesized
cacttcagcctcccaggtagct

SEQ ID NO: 19280 - DNA, 22 bp, Artificial Sequence
  chemically synthesized
cagcctcccaggtagctgggac

SEQ ID NO: 19281 - DNA, 22 bp, Artificial Sequence
  chemically synthesized
agcctcccaggtagctgggact

SEQ ID NO: 19282 - DNA, 22 bp, Artificial Sequence
  chemically synthesized
ccaggtagctgggactataggc

SEQ ID NO: 19283 - DNA, 22 bp, Artificial Sequence
  chemically synthesized
ggactataggcatgtggcacca

SEQ ID NO: 19284 - DNA, 22 bp, Artificial Sequence
  chemically synthesized
taggcatgtggcaccacacctg

SEQ ID NO: 19285 - DNA, 22 bp, Artificial Sequence
  chemically synthesized
gctaattaaaaatttttttttg

SEQ ID NO: 19286 - DNA, 22 bp, Artificial Sequence
  chemically synthesized
attaaaaatttttttttgtaga

SEQ ID NO: 19287 - DNA, 22 bp, Artificial Sequence
  chemically synthesized
aaaatttttttttgtagagacg

SEQ ID NO: 19288 - DNA, 22 bp, Artificial Sequence
  chemically synthesized
ttttttgtagagacggttttgc

SEQ ID NO: 19289 - DNA, 22 bp, Artificial Sequence
  chemically synthesized
tttttgtagagacggttttgcc

SEQ ID NO: 19290 - DNA, 22 bp, Artificial Sequence
  chemically synthesized
ttttgtagagacggttttgcca

SEQ ID NO: 19291 - DNA, 22 bp, Artificial Sequence
  chemically synthesized
tttgtagagacggttttgccat

SEQ ID NO: 19292 - DNA, 22 bp, Artificial Sequence
  chemically synthesized
ttgtagagacggttttgccatg

SEQ ID NO: 19293 - DNA, 22 bp, Artificial Sequence
  chemically synthesized
tgtagagacggttttgccatgt

SEQ ID NO: 19294 - DNA, 22 bp, Artificial Sequence
  chemically synthesized
gtagagacggttttgccatgta

SEQ ID NO: 19295 - DNA, 22 bp, Artificial Sequence
  chemically synthesized
tagagacggttttgccatgtag

SEQ ID NO: 19296 - DNA, 22 bp, Artificial Sequence
  chemically synthesized
tgccatgtagaggggttttgcc

SEQ ID NO: 19297 - DNA, 22 bp, Artificial Sequence
  chemically synthesized
gccatgtagaggggttttgcca

SEQ ID NO: 19298 - DNA, 22 bp, Artificial Sequence
  chemically synthesized
ccatgtagaggggttttgccat

SEQ ID NO: 19299 - DNA, 22 bp, Artificial Sequence
  chemically synthesized
tgccatgctgcccagactagtc

SEQ ID NO: 19300 - DNA, 22 bp, Artificial Sequence
  chemically synthesized
gccatgctgcccagactagtct

SEQ ID NO: 19301 - DNA, 22 bp, Artificial Sequence
  chemically synthesized
ccatgctgcccagactagtctt

SEQ ID NO: 19302 - DNA, 22 bp, Artificial Sequence
  chemically synthesized
cccagactagtcttgagctcct

SEQ ID NO: 19303 - DNA, 22 bp, Artificial Sequence
  chemically synthesized
gtcttgagctcctgggctcaag

SEQ ID NO: 19304 - DNA, 22 bp, Artificial Sequence
  chemically synthesized
gagctcctgggctcaagtgatt

SEQ ID NO: 19305 - DNA, 22 bp, Artificial Sequence
  chemically synthesized
agctcctgggctcaagtgattc

SEQ ID NO: 19306 - DNA, 22 bp, Artificial Sequence
  chemically synthesized
ctgggctcaagtgattcccccc

SEQ ID NO: 19307 - DNA, 22 bp, Artificial Sequence
  chemically synthesized
ggctcaagtgattccccccgtg

SEQ ID NO: 19308 - DNA, 22 bp, Artificial Sequence
  chemically synthesized
aagtgattccccccgtgtcgac

SEQ ID NO: 19309 - DNA, 22 bp, Artificial Sequence
  chemically synthesized
cccccgtgtcgacctcccaaag

SEQ ID NO: 19310 - DNA, 22 bp, Artificial Sequence
  chemically synthesized
ccaaagtgctgggattacagat

SEQ ID NO: 19311 - DNA, 22 bp, Artificial Sequence
  chemically synthesized
ggattacagatgtgatccacag

SEQ ID NO: 19312 - DNA, 22 bp, Artificial Sequence
  chemically synthesized
cagatgtgatccacagtgcctg

SEQ ID NO: 19313 - DNA, 22 bp, Artificial Sequence
  chemically synthesized
gccctaaatttttcttacgcat

SEQ ID NO: 19314 - DNA, 22 bp, Artificial Sequence
  chemically synthesized
aatttttcttacgcatttctca

SEQ ID NO: 19315 - DNA, 22 bp, Artificial Sequence
  chemically synthesized
ttcttacgcatttctcatcttc

SEQ ID NO: 19316 - DNA, 22 bp, Artificial Sequence
  chemically synthesized
tcttacgcatttctcatcttcc

SEQ ID NO: 19317 - DNA, 22 bp, Artificial Sequence
  chemically synthesized
cttacgcatttctcatcttcca

SEQ ID NO: 19318 - DNA, 22 bp, Artificial Sequence
  chemically synthesized
ttacgcatttctcatcttccat

SEQ ID NO: 19319 - DNA, 22 bp, Artificial Sequence
  chemically synthesized
acgcatttctcatcttccatta

SEQ ID NO: 19320 - DNA, 22 bp, Artificial Sequence
  chemically synthesized
cgcatttctcatcttccattat

SEQ ID NO: 19321 - DNA, 22 bp, Artificial Sequence
  chemically synthesized
ctcatcttccattatttccatc

SEQ ID NO: 19322 - DNA, 22 bp, Artificial Sequence
  chemically synthesized
tcatcttccattatttccatcc

SEQ ID NO: 19323 - DNA, 22 bp, Artificial Sequence
  chemically synthesized
atcttccattatttccatccag

SEQ ID NO: 19324 - DNA, 22 bp, Artificial Sequence
  chemically synthesized
ccattatttccatccagtgtgt

SEQ ID NO: 19325 - DNA, 22 bp, Artificial Sequence
  chemically synthesized
cattatttccatccagtgtgtt

SEQ ID NO: 19326 - DNA, 22 bp, Artificial Sequence
  chemically synthesized
tttccatccagtgtgttttttc

SEQ ID NO: 19327 - DNA, 22 bp, Artificial Sequence
  chemically synthesized
ccatccagtgtgttttttcttt

SEQ ID NO: 19328 - DNA, 22 bp, Artificial Sequence
  chemically synthesized
catccagtgtgttttttctttt

SEQ ID NO: 19329 - DNA, 22 bp, Artificial Sequence
  chemically synthesized
tttcttttctttcttttctttt

SEQ ID NO: 19330 - DNA, 22 bp, Artificial Sequence
  chemically synthesized
ttcttttctttcttttcttttt

SEQ ID NO: 19331 - DNA, 22 bp, Artificial Sequence
  chemically synthesized
tcttttctttcttttctttttt

SEQ ID NO: 19332 - DNA, 22 bp, Artificial Sequence
  chemically synthesized
cttttctttcttttcttttttt

SEQ ID NO: 19333 - DNA, 22 bp, Artificial Sequence
  chemically synthesized
ttttctttcttttctttttttt

SEQ ID NO: 19334 - DNA, 22 bp, Artificial Sequence
  chemically synthesized
ttctttcttttctttttttttt

SEQ ID NO: 19335 - DNA, 22 bp, Artificial Sequence
  chemically synthesized
tctttcttttcttttttttttt

SEQ ID NO: 19336 - DNA, 22 bp, Artificial Sequence
  chemically synthesized
ctttcttttctttttttttttt

SEQ ID NO: 19337 - DNA, 22 bp, Artificial Sequence
  chemically synthesized
tttcttttcttttttttttttt

SEQ ID NO: 19338 - DNA, 22 bp, Artificial Sequence
  chemically synthesized
tcttttcttttttttttttttg

SEQ ID NO: 19339 - DNA, 22 bp, Artificial Sequence
  chemically synthesized
cttttcttttttttttttttgg

SEQ ID NO: 19340 - DNA, 22 bp, Artificial Sequence
  chemically synthesized
ttttcttttttttttttttgga

SEQ ID NO: 19341 - DNA, 22 bp, Artificial Sequence
  chemically synthesized
ttcttttttttttttttggagg

SEQ ID NO: 19342 - DNA, 22 bp, Artificial Sequence
  chemically synthesized
tcttttttttttttttggaggc

SEQ ID NO: 19343 - DNA, 22 bp, Artificial Sequence
  chemically synthesized
cttttttttttttttggaggcg

SEQ ID NO: 19344 - DNA, 22 bp, Artificial Sequence
  chemically synthesized
ttttttttttttttggaggcgg

SEQ ID NO: 19345 - DNA, 22 bp, Artificial Sequence
  chemically synthesized
ttttttttttttggaggcggag

SEQ ID NO: 19346 - DNA, 22 bp, Artificial Sequence
  chemically synthesized
tttttttttttggaggcggagt

SEQ ID NO: 19347 - DNA, 22 bp, Artificial Sequence
  chemically synthesized
ttttttttttggaggcggagtc

SEQ ID NO: 19348 - DNA, 22 bp, Artificial Sequence
  chemically synthesized
tttttttttggaggcggagtct

SEQ ID NO: 19349 - DNA, 22 bp, Artificial Sequence
  chemically synthesized
ttttttttggaggcggagtctc

SEQ ID NO: 19350 - DNA, 22 bp, Artificial Sequence
  chemically synthesized
tttttttggaggcggagtctcg

SEQ ID NO: 19351 - DNA, 22 bp, Artificial Sequence
  chemically synthesized
ttttttggaggcggagtctcgc

SEQ ID NO: 19352 - DNA, 22 bp, Artificial Sequence
  chemically synthesized
tttttggaggcggagtctcgct

SEQ ID NO: 19353 - DNA, 22 bp, Artificial Sequence
  chemically synthesized
ttttggaggcggagtctcgctc

SEQ ID NO: 19354 - DNA, 22 bp, Artificial Sequence
  chemically synthesized
tttggaggcggagtctcgctct

SEQ ID NO: 19355 - DNA, 22 bp, Artificial Sequence
  chemically synthesized
ttggaggcggagtctcgctctg

SEQ ID NO: 19356 - DNA, 22 bp, Artificial Sequence
  chemically synthesized
tggaggcggagtctcgctctgt

SEQ ID NO: 19357 - DNA, 22 bp, Artificial Sequence
  chemically synthesized
ggaggcggagtctcgctctgtt

SEQ ID NO: 19358 - DNA, 22 bp, Artificial Sequence
  chemically synthesized
gaggcggagtctcgctctgttg

SEQ ID NO: 19359 - DNA, 22 bp, Artificial Sequence
  chemically synthesized
gctctgttgcccaggccggagt

SEQ ID NO: 19360 - DNA, 22 bp, Artificial Sequence
  chemically synthesized
tgttgcccaggccggagtgcag

SEQ ID NO: 19361 - DNA, 22 bp, Artificial Sequence
  chemically synthesized
ttgcccaggccggagtgcagtg

SEQ ID NO: 19362 - DNA, 22 bp, Artificial Sequence
  chemically synthesized
cccaggccggagtgcagtggcg

SEQ ID NO: 19363 - DNA, 22 bp, Artificial Sequence
  chemically synthesized
ggctcactgcaagctctgcctc

SEQ ID NO: 19364 - DNA, 22 bp, Artificial Sequence
  chemically synthesized
gctcactgcaagctctgcctcc

SEQ ID NO: 19365 - DNA, 22 bp, Artificial Sequence
  chemically synthesized
actgcaagctctgcctcccggg

SEQ ID NO: 19366 - DNA, 22 bp, Artificial Sequence
  chemically synthesized
caagctctgcctcccgggttca

SEQ ID NO: 19367 - DNA, 22 bp, Artificial Sequence
  chemically synthesized
tgcctcccgggttcatgccatt

SEQ ID NO: 19368 - DNA, 22 bp, Artificial Sequence
  chemically synthesized
cctcccgggttcatgccattct

SEQ ID NO: 19369 - DNA, 22 bp, Artificial Sequence
  chemically synthesized
ccgggttcatgccattctcctg

SEQ ID NO: 19370 - DNA, 22 bp, Artificial Sequence
  chemically synthesized
atgccattctcctgcctcagcc

SEQ ID NO: 19371 - DNA, 22 bp, Artificial Sequence
  chemically synthesized
tcctgcctcagcctcccgagta

SEQ ID NO: 19372 - DNA, 22 bp, Artificial Sequence
  chemically synthesized
ctgcctcagcctcccgagtagc

SEQ ID NO: 19373 - DNA, 22 bp, Artificial Sequence
  chemically synthesized
cctcagcctcccgagtagctgg

SEQ ID NO: 19374 - DNA, 22 bp, Artificial Sequence
  chemically synthesized
agcctcccgagtagctgggact

SEQ ID NO: 19375 - DNA, 22 bp, Artificial Sequence
  chemically synthesized
ccgagtagctgggactacaggc

SEQ ID NO: 19376 - DNA, 22 bp, Artificial Sequence
  chemically synthesized
ggactacaggcgcctgccacca

SEQ ID NO: 19377 - DNA, 22 bp, Artificial Sequence
  chemically synthesized
caggcgcctgccaccacgtctg

SEQ ID NO: 19378 - DNA, 22 bp, Artificial Sequence
  chemically synthesized
ccaccacgtctggctaattttt

SEQ ID NO: 19379 - DNA, 22 bp, Artificial Sequence
  chemically synthesized
gctaattttttgtatttttagt

SEQ ID NO: 19380 - DNA, 22 bp, Artificial Sequence
  chemically synthesized
attttttgtatttttagtagag

SEQ ID NO: 19381 - DNA, 22 bp, Artificial Sequence
  chemically synthesized
tttgtatttttagtagagatgg

SEQ ID NO: 19382 - DNA, 22 bp, Artificial Sequence
  chemically synthesized
ttgtatttttagtagagatggg

SEQ ID NO: 19383 - DNA, 22 bp, Artificial Sequence
  chemically synthesized
tgtatttttagtagagatgggg

SEQ ID NO: 19384 - DNA, 22 bp, Artificial Sequence
  chemically synthesized
gtatttttagtagagatggggt

SEQ ID NO: 19385 - DNA, 22 bp, Artificial Sequence
  chemically synthesized
tatttttagtagagatggggtt

SEQ ID NO: 19386 - DNA, 22 bp, Artificial Sequence
  chemically synthesized
ttagtagagatggggtttcacc

SEQ ID NO: 19387 - DNA, 22 bp, Artificial Sequence
  chemically synthesized
tagtagagatggggtttcacca

SEQ ID NO: 19388 - DNA, 22 bp, Artificial Sequence
  chemically synthesized
agtagagatggggtttcaccat

SEQ ID NO: 19389 - DNA, 22 bp, Artificial Sequence
  chemically synthesized
gtagagatggggtttcaccatg

SEQ ID NO: 19390 - DNA, 22 bp, Artificial Sequence
  chemically synthesized
caccatgttagccaggatggtg

SEQ ID NO: 19391 - DNA, 22 bp, Artificial Sequence
  chemically synthesized
accatgttagccaggatggtgt

SEQ ID NO: 19392 - DNA, 22 bp, Artificial Sequence
  chemically synthesized
gccaggatggtgtcgatctcct

SEQ ID NO: 19393 - DNA, 22 bp, Artificial Sequence
  chemically synthesized
ctgacctcatgatctgcccgcc

SEQ ID NO: 19394 - DNA, 22 bp, Artificial Sequence
  chemically synthesized
acctcatgatctgcccgccttg

SEQ ID NO: 19395 - DNA, 22 bp, Artificial Sequence
  chemically synthesized
atgatctgcccgccttggcctc

SEQ ID NO: 19396 - DNA, 22 bp, Artificial Sequence
  chemically synthesized
cccgccttggcctcccacagtg

SEQ ID NO: 19397 - DNA, 22 bp, Artificial Sequence
  chemically synthesized
ggcctcccacagtgctgggatt

SEQ ID NO: 19398 - DNA, 22 bp, Artificial Sequence
  chemically synthesized
gcctcccacagtgctgggattc

SEQ ID NO: 19399 - DNA, 22 bp, Artificial Sequence
  chemically synthesized
ccacagtgctgggattccaggc

SEQ ID NO: 19400 - DNA, 22 bp, Artificial Sequence
  chemically synthesized
ggattccaggcgtgagccacgg

SEQ ID NO: 19401 - DNA, 22 bp, Artificial Sequence
  chemically synthesized
caggcgtgagccacggcgcctg

SEQ ID NO: 19402 - DNA, 22 bp, Artificial Sequence
  chemically synthesized
gccagtgtgttttttcatttca

SEQ ID NO: 19403 - DNA, 22 bp, Artificial Sequence
  chemically synthesized
tttcatttcagacattgtagtt

SEQ ID NO: 19404 - DNA, 22 bp, Artificial Sequence
  chemically synthesized
ttcatttcagacattgtagttt

SEQ ID NO: 19405 - DNA, 22 bp, Artificial Sequence
  chemically synthesized
tcatttcagacattgtagtttt

SEQ ID NO: 19406 - DNA, 22 bp, Artificial Sequence
  chemically synthesized
catttcagacattgtagttttt

SEQ ID NO: 19407 - DNA, 22 bp, Artificial Sequence
  chemically synthesized
atttcagacattgtagttttta

SEQ ID NO: 19408 - DNA, 22 bp, Artificial Sequence
  chemically synthesized
cagacattgtagtttttatctc

SEQ ID NO: 19409 - DNA, 22 bp, Artificial Sequence
  chemically synthesized
agacattgtagtttttatctct

SEQ ID NO: 19410 - DNA, 22 bp, Artificial Sequence
  chemically synthesized
tagtttttatctctagaagttc

SEQ ID NO: 19411 - DNA, 22 bp, Artificial Sequence
  chemically synthesized
ttatctctagaagttcacctgg

SEQ ID NO: 19412 - DNA, 22 bp, Artificial Sequence
  chemically synthesized
tatctctagaagttcacctggg

SEQ ID NO: 19413 - DNA, 22 bp, Artificial Sequence
  chemically synthesized
atctctagaagttcacctgggg

SEQ ID NO: 19414 - DNA, 22 bp, Artificial Sequence
  chemically synthesized
tctctagaagttcacctgggga

SEQ ID NO: 19415 - DNA, 22 bp, Artificial Sequence
  chemically synthesized
tagaagttcacctggggactct

SEQ ID NO: 19416 - DNA, 22 bp, Artificial Sequence
  chemically synthesized
gaagttcacctggggactctta

SEQ ID NO: 19417 - DNA, 22 bp, Artificial Sequence
  chemically synthesized
acctggggactcttaaatatcc

SEQ ID NO: 19418 - DNA, 22 bp, Artificial Sequence
  chemically synthesized
gggactcttaaatatcctccac

SEQ ID NO: 19419 - DNA, 22 bp, Artificial Sequence
  chemically synthesized
ttaaatatcctccacaattcta

SEQ ID NO: 19420 - DNA, 22 bp, Artificial Sequence
  chemically synthesized
aaatatcctccacaattctact

SEQ ID NO: 19421 - DNA, 22 bp, Artificial Sequence
  chemically synthesized
aatatcctccacaattctactt

SEQ ID NO: 19422 - DNA, 22 bp, Artificial Sequence
  chemically synthesized
cacaattctacttaattttttg

SEQ ID NO: 19423 - DNA, 22 bp, Artificial Sequence
  chemically synthesized
tacttaattttttgaacataat

SEQ ID NO: 19424 - DNA, 22 bp, Artificial Sequence
  chemically synthesized
cttaattttttgaacataatgg

SEQ ID NO: 19425 - DNA, 22 bp, Artificial Sequence
  chemically synthesized
aattttttgaacataatgggat

SEQ ID NO: 19426 - DNA, 22 bp, Artificial Sequence
  chemically synthesized
attttttgaacataatgggata

SEQ ID NO: 19427 - DNA, 22 bp, Artificial Sequence
  chemically synthesized
tttgaacataatgggatatggc

SEQ ID NO: 19428 - DNA, 22 bp, Artificial Sequence
  chemically synthesized
ttgaacataatgggatatggct

SEQ ID NO: 19429 - DNA, 22 bp, Artificial Sequence
  chemically synthesized
tgaacataatgggatatggcta

SEQ ID NO: 19430 - DNA, 22 bp, Artificial Sequence
  chemically synthesized
gaacataatgggatatggctat

SEQ ID NO: 19431 - DNA, 22 bp, Artificial Sequence
  chemically synthesized
aacataatgggatatggctata

SEQ ID NO: 19432 - DNA, 22 bp, Artificial Sequence
  chemically synthesized
taatatctgttttaccatcctt

SEQ ID NO: 19433 - DNA, 22 bp, Artificial Sequence
  chemically synthesized
ttttaccatccttgcctgctaa

SEQ ID NO: 19434 - DNA, 22 bp, Artificial Sequence
  chemically synthesized
taccatccttgcctgctaattc

SEQ ID NO: 19435 - DNA, 22 bp, Artificial Sequence
  chemically synthesized
accatccttgcctgctaattct

SEQ ID NO: 19436 - DNA, 22 bp, Artificial Sequence
  chemically synthesized
ccatccttgcctgctaattcta

SEQ ID NO: 19437 - DNA, 22 bp, Artificial Sequence
  chemically synthesized
gcctgctaattctagcatccgt

SEQ ID NO: 19438 - DNA, 22 bp, Artificial Sequence
  chemically synthesized
cctgctaattctagcatccgtg

SEQ ID NO: 19439 - DNA, 22 bp, Artificial Sequence
  chemically synthesized
ctaattctagcatccgtgtcag

SEQ ID NO: 19440 - DNA, 22 bp, Artificial Sequence
  chemically synthesized
attctagcatccgtgtcagttc

SEQ ID NO: 19441 - DNA, 22 bp, Artificial Sequence
  chemically synthesized
tagcatccgtgtcagttctgga

SEQ ID NO: 19442 - DNA, 22 bp, Artificial Sequence
  chemically synthesized
gcatccgtgtcagttctggatc

SEQ ID NO: 19443 - DNA, 22 bp, Artificial Sequence
  chemically synthesized
tggatctcttttgatatttatg

SEQ ID NO: 19444 - DNA, 22 bp, Artificial Sequence
  chemically synthesized
gatctcttttgatatttatgaa

SEQ ID NO: 19445 - DNA, 22 bp, Artificial Sequence
  chemically synthesized
ttttgatatttatgaacctcct

SEQ ID NO: 19446 - DNA, 22 bp, Artificial Sequence
  chemically synthesized
ttgatatttatgaacctcctcg

SEQ ID NO: 19447 - DNA, 22 bp, Artificial Sequence
  chemically synthesized
tgatatttatgaacctcctcgt

SEQ ID NO: 19448 - DNA, 22 bp, Artificial Sequence
  chemically synthesized
gatatttatgaacctcctcgtt

SEQ ID NO: 19449 - DNA, 22 bp, Artificial Sequence
  chemically synthesized
atatttatgaacctcctcgtta

SEQ ID NO: 19450 - DNA, 22 bp, Artificial Sequence
  chemically synthesized
atgaacctcctcgttatgcatt

SEQ ID NO: 19451 - DNA, 22 bp, Artificial Sequence
  chemically synthesized
tgaacctcctcgttatgcattg

SEQ ID NO: 19452 - DNA, 22 bp, Artificial Sequence
  chemically synthesized
ctcgttatgcattgtgttttcc

SEQ ID NO: 19453 - DNA, 22 bp, Artificial Sequence
  chemically synthesized
gttatgcattgtgttttcccgt

SEQ ID NO: 19454 - DNA, 22 bp, Artificial Sequence
  chemically synthesized
tgcattgtgttttcccgtttca

SEQ ID NO: 19455 - DNA, 22 bp, Artificial Sequence
  chemically synthesized
tgttttcccgtttcattgcatg

SEQ ID NO: 19456 - DNA, 22 bp, Artificial Sequence
  chemically synthesized
tcccgtttcattgcatgccttg

SEQ ID NO: 19457 - DNA, 22 bp, Artificial Sequence
  chemically synthesized
cccgtttcattgcatgccttgt

SEQ ID NO: 19458 - DNA, 22 bp, Artificial Sequence
  chemically synthesized
ccgtttcattgcatgccttgta

SEQ ID NO: 19459 - DNA, 22 bp, Artificial Sequence
  chemically synthesized
cattgcatgccttgtaatcttt

SEQ ID NO: 19460 - DNA, 22 bp, Artificial Sequence
  chemically synthesized
attgcatgccttgtaatctttg

SEQ ID NO: 19461 - DNA, 22 bp, Artificial Sequence
  chemically synthesized
catgccttgtaatctttgattg

SEQ ID NO: 19462 - DNA, 22 bp, Artificial Sequence
  chemically synthesized
gtaatctttgattggctgccag

SEQ ID NO: 19463 - DNA, 22 bp, Artificial Sequence
  chemically synthesized
taatctttgattggctgccaga

SEQ ID NO: 19464 - DNA, 22 bp, Artificial Sequence
  chemically synthesized
tgattggctgccagacattgtc

SEQ ID NO: 19465 - DNA, 22 bp, Artificial Sequence
  chemically synthesized
gattggctgccagacattgtca

SEQ ID NO: 19466 - DNA, 22 bp, Artificial Sequence
  chemically synthesized
attggctgccagacattgtcaa

SEQ ID NO: 19467 - DNA, 22 bp, Artificial Sequence
  chemically synthesized
gctgccagacattgtcaatttc

SEQ ID NO: 19468 - DNA, 22 bp, Artificial Sequence
  chemically synthesized
ccagacattgtcaatttcacct

SEQ ID NO: 19469 - DNA, 22 bp, Artificial Sequence
  chemically synthesized
tcaatttcaccttgttgggtgc

SEQ ID NO: 19470 - DNA, 22 bp, Artificial Sequence
  chemically synthesized
caccttgttgggtgctggatat

SEQ ID NO: 19471 - DNA, 22 bp, Artificial Sequence
  chemically synthesized
accttgttgggtgctggatatt

SEQ ID NO: 19472 - DNA, 22 bp, Artificial Sequence
  chemically synthesized
gttgggtgctggatatttttgt

SEQ ID NO: 19473 - DNA, 22 bp, Artificial Sequence
  chemically synthesized
ttgggtgctggatatttttgta

SEQ ID NO: 19474 - DNA, 22 bp, Artificial Sequence
  chemically synthesized
ggtgctggatatttttgtattc

SEQ ID NO: 19475 - DNA, 22 bp, Artificial Sequence
  chemically synthesized
gatatttttgtattcctctaaa

SEQ ID NO: 19476 - DNA, 22 bp, Artificial Sequence
  chemically synthesized
ttgtattcctctaaatgttctt

SEQ ID NO: 19477 - DNA, 22 bp, Artificial Sequence
  chemically synthesized
tgtattcctctaaatgttcttg

SEQ ID NO: 19478 - DNA, 22 bp, Artificial Sequence
  chemically synthesized
gtattcctctaaatgttcttga

SEQ ID NO: 19479 - DNA, 22 bp, Artificial Sequence
  chemically synthesized
tattcctctaaatgttcttgag

SEQ ID NO: 19480 - DNA, 22 bp, Artificial Sequence
  chemically synthesized
ctctaaatgttcttgagctttg

SEQ ID NO: 19481 - DNA, 22 bp, Artificial Sequence
  chemically synthesized
taaatgttcttgagctttgctc

SEQ ID NO: 19482 - DNA, 22 bp, Artificial Sequence
  chemically synthesized
aatgttcttgagctttgctccg

SEQ ID NO: 19483 - DNA, 22 bp, Artificial Sequence
  chemically synthesized
ttgagctttgctccgggatgca

SEQ ID NO: 19484 - DNA, 22 bp, Artificial Sequence
  chemically synthesized
gagctttgctccgggatgcagt

SEQ ID NO: 19485 - DNA, 22 bp, Artificial Sequence
  chemically synthesized
agctttgctccgggatgcagtt

SEQ ID NO: 19486 - DNA, 22 bp, Artificial Sequence
  chemically synthesized
tgctccgggatgcagttaagca

SEQ ID NO: 19487 - DNA, 22 bp, Artificial Sequence
  chemically synthesized
gctccgggatgcagttaagcaa

SEQ ID NO: 19488 - DNA, 22 bp, Artificial Sequence
  chemically synthesized
ctccgggatgcagttaagcaac

SEQ ID NO: 19489 - DNA, 22 bp, Artificial Sequence
  chemically synthesized
cgggatgcagttaagcaactta

SEQ ID NO: 19490 - DNA, 22 bp, Artificial Sequence
  chemically synthesized
agcaacttagagtcagtttgat

SEQ ID NO: 19491 - DNA, 22 bp, Artificial Sequence
  chemically synthesized
agagtcagtttgatcgtttgaa

SEQ ID NO: 19492 - DNA, 22 bp, Artificial Sequence
  chemically synthesized
gagtcagtttgatcgtttgaac

SEQ ID NO: 19493 - DNA, 22 bp, Artificial Sequence
  chemically synthesized
gatcgtttgaactcttaattgt

SEQ ID NO: 19494 - DNA, 22 bp, Artificial Sequence
  chemically synthesized
atcgtttgaactcttaattgtt

SEQ ID NO: 19495 - DNA, 22 bp, Artificial Sequence
  chemically synthesized
gaactcttaattgttttggtct

SEQ ID NO: 19496 - DNA, 22 bp, Artificial Sequence
  chemically synthesized
aactcttaattgttttggtctc

SEQ ID NO: 19497 - DNA, 22 bp, Artificial Sequence
  chemically synthesized
ttaattgttttggtctcctcgg

SEQ ID NO: 19498 - DNA, 22 bp, Artificial Sequence
  chemically synthesized
aattgttttggtctcctcggac

SEQ ID NO: 19499 - DNA, 22 bp, Artificial Sequence
  chemically synthesized
attgttttggtctcctcggact

SEQ ID NO: 19500 - DNA, 22 bp, Artificial Sequence
  chemically synthesized
ttttggtctcctcggactctca

SEQ ID NO: 19501 - DNA, 22 bp, Artificial Sequence
  chemically synthesized
tggtctcctcggactctcagct

SEQ ID NO: 19502 - DNA, 22 bp, Artificial Sequence
  chemically synthesized
ggtctcctcggactctcagctc

SEQ ID NO: 19503 - DNA, 22 bp, Artificial Sequence
  chemically synthesized
gtctcctcggactctcagctcc

SEQ ID NO: 19504 - DNA, 22 bp, Artificial Sequence
  chemically synthesized
ctcggactctcagctccatctc

SEQ ID NO: 19505 - DNA, 22 bp, Artificial Sequence
  chemically synthesized
ggactctcagctccatctcctc

SEQ ID NO: 19506 - DNA, 22 bp, Artificial Sequence
  chemically synthesized
tcagctccatctcctcaacgtg

SEQ ID NO: 19507 - DNA, 22 bp, Artificial Sequence
  chemically synthesized
agctccatctcctcaacgtggg

SEQ ID NO: 19508 - DNA, 22 bp, Artificial Sequence
  chemically synthesized
catctcctcaacgtggggagtc

SEQ ID NO: 19509 - DNA, 22 bp, Artificial Sequence
  chemically synthesized
ctcaacgtggggagtctcttgg

SEQ ID NO: 19510 - DNA, 22 bp, Artificial Sequence
  chemically synthesized
aacgtggggagtctcttgggct

SEQ ID NO: 19511 - DNA, 22 bp, Artificial Sequence
  chemically synthesized
ttgggctctgcctggacttccc

SEQ ID NO: 19512 - DNA, 22 bp, Artificial Sequence
  chemically synthesized
gggctctgcctggacttccctt

SEQ ID NO: 19513 - DNA, 22 bp, Artificial Sequence
  chemically synthesized
ggctctgcctggacttcccttt

SEQ ID NO: 19514 - DNA, 22 bp, Artificial Sequence
  chemically synthesized
tgcctggacttccctttcctgg

SEQ ID NO: 19515 - DNA, 22 bp, Artificial Sequence
  chemically synthesized
cctggacttccctttcctggcc

SEQ ID NO: 19516 - DNA, 22 bp, Artificial Sequence
  chemically synthesized
gacttccctttcctggcctgta

SEQ ID NO: 19517 - DNA, 22 bp, Artificial Sequence
  chemically synthesized
ccctttcctggcctgtaacctg

SEQ ID NO: 19518 - DNA, 22 bp, Artificial Sequence
  chemically synthesized
cctttcctggcctgtaacctgc

SEQ ID NO: 19519 - DNA, 22 bp, Artificial Sequence
  chemically synthesized
tcctggcctgtaacctgcagac

SEQ ID NO: 19520 - DNA, 22 bp, Artificial Sequence
  chemically synthesized
cctggcctgtaacctgcagact

SEQ ID NO: 19521 - DNA, 22 bp, Artificial Sequence
  chemically synthesized
ctggcctgtaacctgcagactc

SEQ ID NO: 19522 - DNA, 22 bp, Artificial Sequence
  chemically synthesized
gcctgtaacctgcagactctct

SEQ ID NO: 19523 - DNA, 22 bp, Artificial Sequence
  chemically synthesized
taacctgcagactctctccaaa

SEQ ID NO: 19524 - DNA, 22 bp, Artificial Sequence
  chemically synthesized
cagactctctccaaacagtaag

SEQ ID NO: 19525 - DNA, 22 bp, Artificial Sequence
  chemically synthesized
tctccaaacagtaagctggggt

SEQ ID NO: 19526 - DNA, 22 bp, Artificial Sequence
  chemically synthesized
tccaaacagtaagctggggtga

SEQ ID NO: 19527 - DNA, 22 bp, Artificial Sequence
  chemically synthesized
caaacagtaagctggggtgatc

SEQ ID NO: 19528 - DNA, 22 bp, Artificial Sequence
  chemically synthesized
gggtgatcggagggttcctgtt

SEQ ID NO: 19529 - DNA, 22 bp, Artificial Sequence
  chemically synthesized
ctgttgtttgcttcttatccct

SEQ ID NO: 19530 - DNA, 22 bp, Artificial Sequence
  chemically synthesized
ttgtttgcttcttatccctcag

SEQ ID NO: 19531 - DNA, 22 bp, Artificial Sequence
  chemically synthesized
tttgcttcttatccctcaggga

SEQ ID NO: 19532 - DNA, 22 bp, Artificial Sequence
  chemically synthesized
gcttcttatccctcagggatct

SEQ ID NO: 19533 - DNA, 22 bp, Artificial Sequence
  chemically synthesized
cttcttatccctcagggatctt

SEQ ID NO: 19534 - DNA, 22 bp, Artificial Sequence
  chemically synthesized
cttatccctcagggatctttac

SEQ ID NO: 19535 - DNA, 22 bp, Artificial Sequence
  chemically synthesized
ttatccctcagggatctttact

SEQ ID NO: 19536 - DNA, 22 bp, Artificial Sequence
  chemically synthesized
atccctcagggatctttactcc

SEQ ID NO: 19537 - DNA, 22 bp, Artificial Sequence
  chemically synthesized
tccctcagggatctttactcct

SEQ ID NO: 19538 - DNA, 22 bp, Artificial Sequence
  chemically synthesized
agggatctttactcctccttgc

SEQ ID NO: 19539 - DNA, 22 bp, Artificial Sequence
  chemically synthesized
tactcctccttgcctgatgtcc

SEQ ID NO: 19540 - DNA, 22 bp, Artificial Sequence
  chemically synthesized
actcctccttgcctgatgtcca

SEQ ID NO: 19541 - DNA, 22 bp, Artificial Sequence
  chemically synthesized
ctcctccttgcctgatgtccag

SEQ ID NO: 19542 - DNA, 22 bp, Artificial Sequence
  chemically synthesized
ctccttgcctgatgtccagagt

SEQ ID NO: 19543 - DNA, 22 bp, Artificial Sequence
  chemically synthesized
cttgcctgatgtccagagtctt

SEQ ID NO: 19544 - DNA, 22 bp, Artificial Sequence
  chemically synthesized
gcctgatgtccagagtcttgaa

SEQ ID NO: 19545 - DNA, 22 bp, Artificial Sequence
  chemically synthesized
cctgatgtccagagtcttgaaa

SEQ ID NO: 19546 - DNA, 22 bp, Artificial Sequence
  chemically synthesized
atgtccagagtcttgaaagctg

SEQ ID NO: 19547 - DNA, 22 bp, Artificial Sequence
  chemically synthesized
gaaagctgccatgttctatagt

SEQ ID NO: 19548 - DNA, 22 bp, Artificial Sequence
  chemically synthesized
aaagctgccatgttctatagtt

SEQ ID NO: 19549 - DNA, 22 bp, Artificial Sequence
  chemically synthesized
ccatgttctatagttgtctgtt

SEQ ID NO: 19550 - DNA, 22 bp, Artificial Sequence
  chemically synthesized
tatagttgtctgtttttgtttt

SEQ ID NO: 19551 - DNA, 22 bp, Artificial Sequence
  chemically synthesized
tagttgtctgtttttgttttga

SEQ ID NO: 19552 - DNA, 22 bp, Artificial Sequence
  chemically synthesized
tctgtttttgttttgattgttt

SEQ ID NO: 19553 - DNA, 22 bp, Artificial Sequence
  chemically synthesized
tttttgttttgattgtttctgg

SEQ ID NO: 19554 - DNA, 22 bp, Artificial Sequence
  chemically synthesized
ttgttttgattgtttctgggga

SEQ ID NO: 19555 - DNA, 22 bp, Artificial Sequence
  chemically synthesized
tgttttgattgtttctggggag

SEQ ID NO: 19556 - DNA, 22 bp, Artificial Sequence
  chemically synthesized
gttttgattgtttctggggaga

SEQ ID NO: 19557 - DNA, 22 bp, Artificial Sequence
  chemically synthesized
ttttgattgtttctggggagag

SEQ ID NO: 19558 - DNA, 22 bp, Artificial Sequence
  chemically synthesized
tgattgtttctggggagagaag

SEQ ID NO: 19559 - DNA, 22 bp, Artificial Sequence
  chemically synthesized
gattgtttctggggagagaaga

SEQ ID NO: 19560 - DNA, 22 bp, Artificial Sequence
  chemically synthesized
attgtttctggggagagaagaa

SEQ ID NO: 19561 - DNA, 22 bp, Artificial Sequence
  chemically synthesized
tttctggggagagaagaactct

SEQ ID NO: 19562 - DNA, 22 bp, Artificial Sequence
  chemically synthesized
ctggggagagaagaactcttcc

SEQ ID NO: 19563 - DNA, 22 bp, Artificial Sequence
  chemically synthesized
tggggagagaagaactcttccc

SEQ ID NO: 19564 - DNA, 22 bp, Artificial Sequence
  chemically synthesized
gggagagaagaactcttcccat

SEQ ID NO: 19565 - DNA, 22 bp, Artificial Sequence
  chemically synthesized
ttcccatcttgggcagaccctg

SEQ ID NO: 19566 - DNA, 22 bp, Artificial Sequence
  chemically synthesized
cccatcttgggcagaccctgtc

SEQ ID NO: 19567 - DNA, 22 bp, Artificial Sequence
  chemically synthesized
ccatcttgggcagaccctgtct

SEQ ID NO: 19568 - DNA, 22 bp, Artificial Sequence
  chemically synthesized
gggcagaccctgtcttttatgt

SEQ ID NO: 19569 - DNA, 22 bp, Artificial Sequence
  chemically synthesized
ggcagaccctgtcttttatgtt

SEQ ID NO: 19570 - DNA, 22 bp, Artificial Sequence
  chemically synthesized
tcttttatgttcaaacttttgc

SEQ ID NO: 19571 - DNA, 22 bp, Artificial Sequence
  chemically synthesized
ttatgttcaaacttttgcctaa

SEQ ID NO: 19572 - DNA, 22 bp, Artificial Sequence
  chemically synthesized
tatgttcaaacttttgcctaag

SEQ ID NO: 19573 - DNA, 22 bp, Artificial Sequence
  chemically synthesized
atgttcaaacttttgcctaaga

SEQ ID NO: 19574 - DNA, 22 bp, Artificial Sequence
  chemically synthesized
tgttcaaacttttgcctaagaa

SEQ ID NO: 19575 - DNA, 22 bp, Artificial Sequence
  chemically synthesized
aaacttttgcctaagaagcaca

SEQ ID NO: 19576 - DNA, 22 bp, Artificial Sequence
  chemically synthesized
ttgcctaagaagcacattacat

SEQ ID NO: 19577 - DNA, 22 bp, Artificial Sequence
  chemically synthesized
tgcctaagaagcacattacata

SEQ ID NO: 19578 - DNA, 22 bp, Artificial Sequence
  chemically synthesized
gcctaagaagcacattacatat

SEQ ID NO: 19579 - DNA, 22 bp, Artificial Sequence
  chemically synthesized
cctaagaagcacattacatatt

SEQ ID NO: 19580 - DNA, 22 bp, Artificial Sequence
  chemically synthesized
agaagcacattacatattttaa

SEQ ID NO: 19581 - DNA, 22 bp, Artificial Sequence
  chemically synthesized
catattttaactcatctaatta

SEQ ID NO: 19582 - DNA, 22 bp, Artificial Sequence
  chemically synthesized
taactcatctaattatccgagc

SEQ ID NO: 19583 - DNA, 22 bp, Artificial Sequence
  chemically synthesized
aactcatctaattatccgagca

SEQ ID NO: 19584 - DNA, 22 bp, Artificial Sequence
  chemically synthesized
actcatctaattatccgagcaa

SEQ ID NO: 19585 - DNA, 22 bp, Artificial Sequence
  chemically synthesized
atctaattatccgagcaatcca

SEQ ID NO: 19586 - DNA, 22 bp, Artificial Sequence
  chemically synthesized
attatccgagcaatccaatcgg

SEQ ID NO: 19587 - DNA, 22 bp, Artificial Sequence
  chemically synthesized
tccgagcaatccaatcgggtag

SEQ ID NO: 19588 - DNA, 22 bp, Artificial Sequence
  chemically synthesized
cgactgtgatctccattttaca

SEQ ID NO: 19589 - DNA, 22 bp, Artificial Sequence
  chemically synthesized
tgatctccattttacacacgag

SEQ ID NO: 19590 - DNA, 22 bp, Artificial Sequence
  chemically synthesized
cattttacacacgagaaaatgg

SEQ ID NO: 19591 - DNA, 22 bp, Artificial Sequence
  chemically synthesized
tacacacgagaaaatggaagca

SEQ ID NO: 19592 - DNA, 22 bp, Artificial Sequence
  chemically synthesized
acacacgagaaaatggaagcat

SEQ ID NO: 19593 - DNA, 22 bp, Artificial Sequence
  chemically synthesized
cacacgagaaaatggaagcatg

SEQ ID NO: 19594 - DNA, 22 bp, Artificial Sequence
  chemically synthesized
aatgctggtgcatgatctcaga

SEQ ID NO: 19595 - DNA, 22 bp, Artificial Sequence
  chemically synthesized
gtgcatgatctcagagctacct

SEQ ID NO: 19596 - DNA, 22 bp, Artificial Sequence
  chemically synthesized
agagctacctggaggcacagct

SEQ ID NO: 19597 - DNA, 22 bp, Artificial Sequence
  chemically synthesized
cctggaggcacagctgggctac

SEQ ID NO: 19598 - DNA, 22 bp, Artificial Sequence
  chemically synthesized
gaggcacagctgggctaccctg

SEQ ID NO: 19599 - DNA, 22 bp, Artificial Sequence
  chemically synthesized
ggctaccctgtgggcagtctgg

SEQ ID NO: 19600 - DNA, 22 bp, Artificial Sequence
  chemically synthesized
ccctgtgggcagtctggtttca

SEQ ID NO: 19601 - DNA, 22 bp, Artificial Sequence
  chemically synthesized
tgggcagtctggtttcagggtg

SEQ ID NO: 19602 - DNA, 22 bp, Artificial Sequence
  chemically synthesized
gtttcagggtggatatacagac

SEQ ID NO: 19603 - DNA, 22 bp, Artificial Sequence
  chemically synthesized
cagggtggatatacagacacgt

SEQ ID NO: 19604 - DNA, 22 bp, Artificial Sequence
  chemically synthesized
agggtggatatacagacacgtt

SEQ ID NO: 19605 - DNA, 22 bp, Artificial Sequence
  chemically synthesized
ctgggctgacccagcattggga

SEQ ID NO: 19606 - DNA, 22 bp, Artificial Sequence
  chemically synthesized
ggctgacccagcattgggagtt

SEQ ID NO: 19607 - DNA, 22 bp, Artificial Sequence
  chemically synthesized
acccagcattgggagttgataa

SEQ ID NO: 19608 - DNA, 22 bp, Artificial Sequence
  chemically synthesized
ggagttgataagtcggactggg

SEQ ID NO: 19609 - DNA, 22 bp, Artificial Sequence
  chemically synthesized
ataagtcggactgggaagcagg

SEQ ID NO: 19610 - DNA, 22 bp, Artificial Sequence
  chemically synthesized
ggaagcaggacaggaccctctg

SEQ ID NO: 19611 - DNA, 22 bp, Artificial Sequence
  chemically synthesized
tgagtggagggtgctgaagaca

SEQ ID NO: 19612 - DNA, 22 bp, Artificial Sequence
  chemically synthesized
agtggagggtgctgaagacagc

SEQ ID NO: 19613 - DNA, 22 bp, Artificial Sequence
  chemically synthesized
aagacagcagtcagggactcag

SEQ ID NO: 19614 - DNA, 22 bp, Artificial Sequence
  chemically synthesized
agccatggagggccagcttggt

SEQ ID NO: 19615 - DNA, 22 bp, Artificial Sequence
  chemically synthesized
ggtggggaacaccgtggtcatg

SEQ ID NO: 19616 - DNA, 22 bp, Artificial Sequence
  chemically synthesized
gtggggaacaccgtggtcatgg

SEQ ID NO: 19617 - DNA, 22 bp, Artificial Sequence
  chemically synthesized
ctggatggagaggaatgcaaag

SEQ ID NO: 19618 - DNA, 22 bp, Artificial Sequence
  chemically synthesized
tggatggagaggaatgcaaagg

SEQ ID NO: 19619 - DNA, 22 bp, Artificial Sequence
  chemically synthesized
gatggagaggaatgcaaaggcc

SEQ ID NO: 19620 - DNA, 22 bp, Artificial Sequence
  chemically synthesized
ggaggaaggggtgggggcagtg

SEQ ID NO: 19621 - DNA, 22 bp, Artificial Sequence
  chemically synthesized
gaggaaggggtgggggcagtga

SEQ ID NO: 19622 - DNA, 22 bp, Artificial Sequence
  chemically synthesized
tgctcagagcgggagtgggcag

SEQ ID NO: 19623 - DNA, 22 bp, Artificial Sequence
  chemically synthesized
agagcgggagtgggcagtggag

SEQ ID NO: 19624 - DNA, 22 bp, Artificial Sequence
  chemically synthesized
cctgggtcaaatggggtcctga

SEQ ID NO: 19625 - DNA, 22 bp, Artificial Sequence
  chemically synthesized
ggtcaaatggggtcctgagtgt

SEQ ID NO: 19626 - DNA, 22 bp, Artificial Sequence
  chemically synthesized
agtgtggctgcagtggggaagg

SEQ ID NO: 19627 - DNA, 22 bp, Artificial Sequence
  chemically synthesized
cagtggggaaggtggaagtcac

SEQ ID NO: 19628 - DNA, 22 bp, Artificial Sequence
  chemically synthesized
gtgtgaaaaagatgaagagtta

SEQ ID NO: 19629 - DNA, 22 bp, Artificial Sequence
  chemically synthesized
tggacagtcacttacaggggca

SEQ ID NO: 19630 - DNA, 22 bp, Artificial Sequence
  chemically synthesized
acaggggcagtgtctgactcag

SEQ ID NO: 19631 - DNA, 22 bp, Artificial Sequence
  chemically synthesized
caggggcagtgtctgactcagg

SEQ ID NO: 19632 - DNA, 22 bp, Artificial Sequence
  chemically synthesized
actcaggacagtggcaggaagt

SEQ ID NO: 19633 - DNA, 22 bp, Artificial Sequence
  chemically synthesized
aggacagtggcaggaagtgacc

SEQ ID NO: 19634 - DNA, 22 bp, Artificial Sequence
  chemically synthesized
gggaggaagattctgggcccct

SEQ ID NO: 19635 - DNA, 22 bp, Artificial Sequence
  chemically synthesized
tgggcccctgactgagcctccc

SEQ ID NO: 19636 - DNA, 22 bp, Artificial Sequence
  chemically synthesized
ggcccctgactgagcctcccca

SEQ ID NO: 19637 - DNA, 22 bp, Artificial Sequence
  chemically synthesized
actgagcctccccaggatgtgg

SEQ ID NO: 19638 - DNA, 22 bp, Artificial Sequence
  chemically synthesized
agcctccccaggatgtggtcct

SEQ ID NO: 19639 - DNA, 22 bp, Artificial Sequence
  chemically synthesized
cccaggatgtggtcctgctggg

SEQ ID NO: 19640 - DNA, 22 bp, Artificial Sequence
  chemically synthesized
ctgggtcggggggtgataggaa

SEQ ID NO: 19641 - DNA, 22 bp, Artificial Sequence
  chemically synthesized
ggtcggggggtgataggaatga

SEQ ID NO: 19642 - DNA, 22 bp, Artificial Sequence
  chemically synthesized
gaaggtgttctgtttgcaggtg

SEQ ID NO: 19643 - DNA, 22 bp, Artificial Sequence
  chemically synthesized
tgtttgcaggtggatgctgcaa

SEQ ID NO: 19644 - DNA, 22 bp, Artificial Sequence
  chemically synthesized
tttgcaggtggatgctgcaaag

SEQ ID NO: 19645 - DNA, 22 bp, Artificial Sequence
  chemically synthesized
gcaggtggatgctgcaaagaga

SEQ ID NO: 19646 - DNA, 22 bp, Artificial Sequence
  chemically synthesized
caggtggatgctgcaaagagag

SEQ ID NO: 19647 - DNA, 22 bp, Artificial Sequence
  chemically synthesized
caaagagaggagctcagggctg

SEQ ID NO: 19648 - DNA, 22 bp, Artificial Sequence
  chemically synthesized
agggctgggacaactggagctg

SEQ ID NO: 19649 - DNA, 22 bp, Artificial Sequence
  chemically synthesized
ggacaactggagctgctctggg

SEQ ID NO: 19650 - DNA, 22 bp, Artificial Sequence
  chemically synthesized
gagctgctctgggtctggaggc

SEQ ID NO: 19651 - DNA, 22 bp, Artificial Sequence
  chemically synthesized
ctctgggtctggaggcagcaga

SEQ ID NO: 19652 - DNA, 22 bp, Artificial Sequence
  chemically synthesized
tgggtctggaggcagcagagag

SEQ ID NO: 19653 - DNA, 22 bp, Artificial Sequence
  chemically synthesized
ggtctggaggcagcagagaggg

SEQ ID NO: 19654 - DNA, 22 bp, Artificial Sequence
  chemically synthesized
gaggcagcagagagggagccca

SEQ ID NO: 19655 - DNA, 22 bp, Artificial Sequence
  chemically synthesized
tgtgtgcaggaagacgtgggtg

SEQ ID NO: 19656 - DNA, 22 bp, Artificial Sequence
  chemically synthesized
tgtgcaggaagacgtgggtgtg

SEQ ID NO: 19657 - DNA, 22 bp, Artificial Sequence
  chemically synthesized
gcatgcatatgcacatgtgaga

SEQ ID NO: 19658 - DNA, 22 bp, Artificial Sequence
  chemically synthesized
ttgagtgaagtgagcaatgtgt

SEQ ID NO: 19659 - DNA, 22 bp, Artificial Sequence
  chemically synthesized
tgagtgaagtgagcaatgtgtg

SEQ ID NO: 19660 - DNA, 22 bp, Artificial Sequence
  chemically synthesized
gagtgaagtgagcaatgtgtga

SEQ ID NO: 19661 - DNA, 22 bp, Artificial Sequence
  chemically synthesized
agtgaagtgagcaatgtgtgag

SEQ ID NO: 19662 - DNA, 22 bp, Artificial Sequence
  chemically synthesized
gtgagggcatgtgaatgtgtgt

SEQ ID NO: 19663 - DNA, 22 bp, Artificial Sequence
  chemically synthesized
tgagggcatgtgaatgtgtgtg

SEQ ID NO: 19664 - DNA, 22 bp, Artificial Sequence
  chemically synthesized
tcagggtgcagatggatcaagg

SEQ ID NO: 19665 - DNA, 22 bp, Artificial Sequence
  chemically synthesized
tgagatgacctcgggctgaggg

SEQ ID NO: 19666 - DNA, 22 bp, Artificial Sequence
  chemically synthesized
gggctgaggggagcaaatttag

SEQ ID NO: 19667 - DNA, 22 bp, Artificial Sequence
  chemically synthesized
aggggagcaaatttagtgtgga

SEQ ID NO: 19668 - DNA, 22 bp, Artificial Sequence
  chemically synthesized
agtgtggaacgaggtttctagg

SEQ ID NO: 19669 - DNA, 22 bp, Artificial Sequence
  chemically synthesized
gtgtggaacgaggtttctaggg

SEQ ID NO: 19670 - DNA, 22 bp, Artificial Sequence
  chemically synthesized
ctagggaagcgagggcaaaggg

SEQ ID NO: 19671 - DNA, 22 bp, Artificial Sequence
  chemically synthesized
tagggaagcgagggcaaagggc

SEQ ID NO: 19672 - DNA, 22 bp, Artificial Sequence
  chemically synthesized
gggaagcgagggcaaagggcgc

SEQ ID NO: 19673 - DNA, 22 bp, Artificial Sequence
  chemically synthesized
gggaggaggccttgcgtggtgg

SEQ ID NO: 19674 - DNA, 22 bp, Artificial Sequence
  chemically synthesized
gcgtggtgggggatgaggacaa

SEQ ID NO: 19675 - DNA, 22 bp, Artificial Sequence
  chemically synthesized
cgtggtgggggatgaggacaac

SEQ ID NO: 19676 - DNA, 22 bp, Artificial Sequence
  chemically synthesized
gagggttgtgcttggagagtgg

SEQ ID NO: 19677 - DNA, 22 bp, Artificial Sequence
  chemically synthesized
tgcttggagagtgggctatggt

SEQ ID NO: 19678 - DNA, 22 bp, Artificial Sequence
  chemically synthesized
ggagagtgggctatggtggaat

SEQ ID NO: 19679 - DNA, 22 bp, Artificial Sequence
  chemically synthesized
gagagtgggctatggtggaatg

SEQ ID NO: 19680 - DNA, 22 bp, Artificial Sequence
  chemically synthesized
tggtggaatgacccagatttaa

SEQ ID NO: 19681 - DNA, 22 bp, Artificial Sequence
  chemically synthesized
aaggatctcaatggaattttgg

SEQ ID NO: 19682 - DNA, 22 bp, Artificial Sequence
  chemically synthesized
aggatctcaatggaattttggc

SEQ ID NO: 19683 - DNA, 22 bp, Artificial Sequence
  chemically synthesized
aatggaattttggcaggggagg

SEQ ID NO: 19684 - DNA, 22 bp, Artificial Sequence
  chemically synthesized
tggcaggggagggactgttcca

SEQ ID NO: 19685 - DNA, 22 bp, Artificial Sequence
  chemically synthesized
ggcaggggagggactgttccag

SEQ ID NO: 19686 - DNA, 22 bp, Artificial Sequence
  chemically synthesized
gcaggggagggactgttccagt

SEQ ID NO: 19687 - DNA, 22 bp, Artificial Sequence
  chemically synthesized
ttccagtatggattttaggaag

SEQ ID NO: 19688 - DNA, 22 bp, Artificial Sequence
  chemically synthesized
cagtatggattttaggaagaac

SEQ ID NO: 19689 - DNA, 22 bp, Artificial Sequence
  chemically synthesized
taggaagaacacagggcccagc

SEQ ID NO: 19690 - DNA, 22 bp, Artificial Sequence
  chemically synthesized
aggaagaacacagggcccagct

SEQ ID NO: 19691 - DNA, 22 bp, Artificial Sequence
  chemically synthesized
ggaagaacacagggcccagctt

SEQ ID NO: 19692 - DNA, 22 bp, Artificial Sequence
  chemically synthesized
ctggagtctccaatctgagggg

SEQ ID NO: 19693 - DNA, 22 bp, Artificial Sequence
  chemically synthesized
tggagtctccaatctgagggga

SEQ ID NO: 19694 - DNA, 22 bp, Artificial Sequence
  chemically synthesized
gagtctccaatctgaggggaca

SEQ ID NO: 19695 - DNA, 22 bp, Artificial Sequence
  chemically synthesized
caatctgaggggacaggagcct

SEQ ID NO: 19696 - DNA, 22 bp, Artificial Sequence
  chemically synthesized
aggggacaggagccttagaaga

SEQ ID NO: 19697 - DNA, 22 bp, Artificial Sequence
  chemically synthesized
agaagagctgagactaaggccc

SEQ ID NO: 19698 - DNA, 22 bp, Artificial Sequence
  chemically synthesized
gaagagctgagactaaggcccg

SEQ ID NO: 19699 - DNA, 22 bp, Artificial Sequence
  chemically synthesized
agactaaggcccgaggtgatct

SEQ ID NO: 19700 - DNA, 22 bp, Artificial Sequence
  chemically synthesized
aggcccgaggtgatctggaggc

SEQ ID NO: 19701 - DNA, 22 bp, Artificial Sequence
  chemically synthesized
gaggcctctgccactggctgga

SEQ ID NO: 19702 - DNA, 22 bp, Artificial Sequence
  chemically synthesized
tgccactggctggatgggagga

SEQ ID NO: 19703 - DNA, 22 bp, Artificial Sequence
  chemically synthesized
ccactggctggatgggaggaaa

SEQ ID NO: 19704 - DNA, 22 bp, Artificial Sequence
  chemically synthesized
gctggatgggaggaaaaccatt

SEQ ID NO: 19705 - DNA, 22 bp, Artificial Sequence
  chemically synthesized
gatgggaggaaaaccattcaca

SEQ ID NO: 19706 - DNA, 22 bp, Artificial Sequence
  chemically synthesized
acagatcccccttctcaggatg

SEQ ID NO: 19707 - DNA, 22 bp, Artificial Sequence
  chemically synthesized
ctcaggatgtgtgcctaggcag

SEQ ID NO: 19708 - DNA, 22 bp, Artificial Sequence
  chemically synthesized
tcaggatgtgtgcctaggcagg

SEQ ID NO: 19709 - DNA, 22 bp, Artificial Sequence
  chemically synthesized
aggatgtgtgcctaggcagggc

SEQ ID NO: 19710 - DNA, 22 bp, Artificial Sequence
  chemically synthesized
ggcagggccgggtctgcccccc

SEQ ID NO: 19711 - DNA, 22 bp, Artificial Sequence
  chemically synthesized
cccccccgccccctgtgcgtct

SEQ ID NO: 19712 - DNA, 22 bp, Artificial Sequence
  chemically synthesized
tgcgtctcccagtcccccagct

SEQ ID NO: 19713 - DNA, 22 bp, Artificial Sequence
  chemically synthesized
ccagtcccccagctccaggatc

SEQ ID NO: 19714 - DNA, 22 bp, Artificial Sequence
  chemically synthesized
caggatccgggctttgcacaca

SEQ ID NO: 19715 - DNA, 22 bp, Artificial Sequence
  chemically synthesized
tgcacacagctgatgtgaatat

SEQ ID NO: 19716 - DNA, 22 bp, Artificial Sequence
  chemically synthesized
gcacacagctgatgtgaatatc

SEQ ID NO: 19717 - DNA, 22 bp, Artificial Sequence
  chemically synthesized
cacacagctgatgtgaatatcc

SEQ ID NO: 19718 - DNA, 22 bp, Artificial Sequence
  chemically synthesized
atgtgaatatcctgagtcgtgt

SEQ ID NO: 19719 - DNA, 22 bp, Artificial Sequence
  chemically synthesized
agtcgtgtgcatgggtgtgtgt

SEQ ID NO: 19720 - DNA, 22 bp, Artificial Sequence
  chemically synthesized
gctgcgtgtgtatatttataca

SEQ ID NO: 19721 - DNA, 22 bp, Artificial Sequence
  chemically synthesized
cgtgtgtatatttatacatggt

SEQ ID NO: 19722 - DNA, 22 bp, Artificial Sequence
  chemically synthesized
atacatggtaatatgggtgcga

SEQ ID NO: 19723 - DNA, 22 bp, Artificial Sequence
  chemically synthesized
tacatggtaatatgggtgcgag

SEQ ID NO: 19724 - DNA, 22 bp, Artificial Sequence
  chemically synthesized
aaatgctggggtcaaagcctat

SEQ ID NO: 19725 - DNA, 22 bp, Artificial Sequence
  chemically synthesized
gggtcaaagcctatgatgaccc

SEQ ID NO: 19726 - DNA, 22 bp, Artificial Sequence
  chemically synthesized
tgatgacccccccccatggccc

SEQ ID NO: 19727 - DNA, 22 bp, Artificial Sequence
  chemically synthesized
tgcctcctcaggcttcggtgcc

SEQ ID NO: 19728 - DNA, 22 bp, Artificial Sequence
  chemically synthesized
ctcaggcttcggtgccctgtct

SEQ ID NO: 19729 - DNA, 22 bp, Artificial Sequence
  chemically synthesized
aggcttcggtgccctgtcttta

SEQ ID NO: 19730 - DNA, 22 bp, Artificial Sequence
  chemically synthesized
cggtgccctgtctttaccctcc

SEQ ID NO: 19731 - DNA, 22 bp, Artificial Sequence
  chemically synthesized
ggtgccctgtctttaccctccg

SEQ ID NO: 19732 - DNA, 22 bp, Artificial Sequence
  chemically synthesized
tctttaccctccggctccccac

SEQ ID NO: 19733 - DNA, 22 bp, Artificial Sequence
  chemically synthesized
taccctccggctccccacaccc

SEQ ID NO: 19734 - DNA, 22 bp, Artificial Sequence
  chemically synthesized
accctccggctccccacaccca

SEQ ID NO: 19735 - DNA, 22 bp, Artificial Sequence
  chemically synthesized
ccctccggctccccacacccag

SEQ ID NO: 19736 - DNA, 22 bp, Artificial Sequence
  chemically synthesized
cggctccccacacccaggctgc

SEQ ID NO: 19737 - DNA, 22 bp, Artificial Sequence
  chemically synthesized
cccacacccaggctgccggctc

SEQ ID NO: 19738 - DNA, 22 bp, Artificial Sequence
  chemically synthesized
ccggctcctgatgcccctctcc

SEQ ID NO: 19739 - DNA, 22 bp, Artificial Sequence
  chemically synthesized
ctgatgcccctctcccacaggg

SEQ ID NO: 19740 - DNA, 22 bp, Artificial Sequence
  chemically synthesized
atgcccctctcccacagggcca

SEQ ID NO: 19741 - DNA, 22 bp, Artificial Sequence
  chemically synthesized
tcccacagggccacctcctgcc

SEQ ID NO: 19742 - DNA, 22 bp, Artificial Sequence
  chemically synthesized
ccacagggccacctcctgccca

SEQ ID NO: 19743 - DNA, 22 bp, Artificial Sequence
  chemically synthesized
ctgcccagcccctggcacagcg

SEQ ID NO: 19744 - DNA, 22 bp, Artificial Sequence
  chemically synthesized
cccagcccctggcacagcgtct

SEQ ID NO: 19745 - DNA, 22 bp, Artificial Sequence
  chemically synthesized
gcacagcgtctctgctccatgg

SEQ ID NO: 19746 - DNA, 22 bp, Artificial Sequence
  chemically synthesized
tgctccatggtctgcttcagtc

SEQ ID NO: 19747 - DNA, 22 bp, Artificial Sequence
  chemically synthesized
ctccatggtctgcttcagtctg

SEQ ID NO: 19748 - DNA, 22 bp, Artificial Sequence
  chemically synthesized
catggtctgcttcagtctgctt

SEQ ID NO: 19749 - DNA, 22 bp, Artificial Sequence
  chemically synthesized
cttcagtctgcttgccctgagc

SEQ ID NO: 19750 - DNA, 22 bp, Artificial Sequence
  chemically synthesized
cagtctgcttgccctgagcttc

SEQ ID NO: 19751 - DNA, 22 bp, Artificial Sequence
  chemically synthesized
agtctgcttgccctgagcttca

SEQ ID NO: 19752 - DNA, 22 bp, Artificial Sequence
  chemically synthesized
cttgccctgagcttcaacatcc

SEQ ID NO: 19753 - DNA, 22 bp, Artificial Sequence
  chemically synthesized
gccctgagcttcaacatcctgc

SEQ ID NO: 19754 - DNA, 22 bp, Artificial Sequence
  chemically synthesized
ccctgagcttcaacatcctgct

SEQ ID NO: 19755 - DNA, 22 bp, Artificial Sequence
  chemically synthesized
agcttcaacatcctgctgctgg

SEQ ID NO: 19756 - DNA, 22 bp, Artificial Sequence
  chemically synthesized
caacatcctgctgctggtggtc

SEQ ID NO: 19757 - DNA, 22 bp, Artificial Sequence
  chemically synthesized
aacatcctgctgctggtggtca

SEQ ID NO: 19758 - DNA, 22 bp, Artificial Sequence
  chemically synthesized
ctgctggtggtcatctgtgtga

SEQ ID NO: 19759 - DNA, 22 bp, Artificial Sequence
  chemically synthesized
ctggtggtcatctgtgtgactg

SEQ ID NO: 19760 - DNA, 22 bp, Artificial Sequence
  chemically synthesized
gtggtcatctgtgtgactgggt

SEQ ID NO: 19761 - DNA, 22 bp, Artificial Sequence
  chemically synthesized
tgtgactgggtcccaaagtgag

SEQ ID NO: 19762 - DNA, 22 bp, Artificial Sequence
  chemically synthesized
ggtcccaaagtgagggtcacgg

SEQ ID NO: 19763 - DNA, 20 bp, Artificial Sequence
  chemically synthesized
cttcagatagattatatctg

SEQ ID NO: 19764 - DNA, 20 bp, Artificial Sequence
  chemically synthesized
gatagattatatctggagtg

SEQ ID NO: 19765 - DNA, 20 bp, Artificial Sequence
  chemically synthesized
aatcctgccacctatgtatc

SEQ ID NO: 19766 - DNA, 20 bp, Artificial Sequence
  chemically synthesized
tgccacctatgtatctggca

SEQ ID NO: 19767 - DNA, 20 bp, Artificial Sequence
  chemically synthesized
ctatgtatctggcatagtgt

SEQ ID NO: 19768 - DNA, 20 bp, Artificial Sequence
  chemically synthesized
gagtcctcataaatgcttac

SEQ ID NO: 19769 - DNA, 20 bp, Artificial Sequence
  chemically synthesized
cataaatgcttactggtttg

SEQ ID NO: 19770 - DNA, 20 bp, Artificial Sequence
  chemically synthesized
ataaatgcttactggtttga

SEQ ID NO: 19771 - DNA, 20 bp, Artificial Sequence
  chemically synthesized
taaatgcttactggtttgaa

SEQ ID NO: 19772 - DNA, 20 bp, Artificial Sequence
  chemically synthesized
tggtttgaagggcaacaaaa

SEQ ID NO: 19773 - DNA, 20 bp, Artificial Sequence
  chemically synthesized
aagggcaacaaaatagtgaa

SEQ ID NO: 19774 - DNA, 20 bp, Artificial Sequence
  chemically synthesized
gggcaacaaaatagtgaaca

SEQ ID NO: 19775 - DNA, 20 bp, Artificial Sequence
  chemically synthesized
acagagtgaaaatccccact

SEQ ID NO: 19776 - DNA, 20 bp, Artificial Sequence
  chemically synthesized
gaaaatccccactaagatcc

SEQ ID NO: 19777 - DNA, 20 bp, Artificial Sequence
  chemically synthesized
aaaatccccactaagatcct

SEQ ID NO: 19778 - DNA, 20 bp, Artificial Sequence
  chemically synthesized
ccccactaagatcctgggtc

SEQ ID NO: 19779 - DNA, 20 bp, Artificial Sequence
  chemically synthesized
taagatcctgggtccagaaa

SEQ ID NO: 19780 - DNA, 20 bp, Artificial Sequence
  chemically synthesized
atcctgggtccagaaaaaga

SEQ ID NO: 19781 - DNA, 20 bp, Artificial Sequence
  chemically synthesized
tcctgggtccagaaaaagat

SEQ ID NO: 19782 - DNA, 20 bp, Artificial Sequence
  chemically synthesized
aaaaagatgggaaacctgtt

SEQ ID NO: 19783 - DNA, 20 bp, Artificial Sequence
  chemically synthesized
aacctgtttagctcacccgt

SEQ ID NO: 19784 - DNA, 20 bp, Artificial Sequence
  chemically synthesized
ttagctcacccgtgagccca

SEQ ID NO: 19785 - DNA, 20 bp, Artificial Sequence
  chemically synthesized
agcccatagttaaaactctt

SEQ ID NO: 19786 - DNA, 20 bp, Artificial Sequence
  chemically synthesized
agttaaaactctttagacaa

SEQ ID NO: 19787 - DNA, 20 bp, Artificial Sequence
  chemically synthesized
gttaaaactctttagacaac

SEQ ID NO: 19788 - DNA, 20 bp, Artificial Sequence
  chemically synthesized
caacaggttgtttccgttta

SEQ ID NO: 19789 - DNA, 20 bp, Artificial Sequence
  chemically synthesized
acaggttgtttccgtttaca

SEQ ID NO: 19790 - DNA, 20 bp, Artificial Sequence
  chemically synthesized
tttacagagaacaataatat

SEQ ID NO: 19791 - DNA, 20 bp, Artificial Sequence
  chemically synthesized
ttacagagaacaataatatt

SEQ ID NO: 19792 - DNA, 20 bp, Artificial Sequence
  chemically synthesized
cagagaacaataatattggg

SEQ ID NO: 19793 - DNA, 20 bp, Artificial Sequence
  chemically synthesized
gaacaataatattgggtggt

SEQ ID NO: 19794 - DNA, 20 bp, Artificial Sequence
  chemically synthesized
ttgggtggtgagcatctgtg

SEQ ID NO: 19795 - DNA, 20 bp, Artificial Sequence
  chemically synthesized
tgggtggtgagcatctgtgt

SEQ ID NO: 19796 - DNA, 20 bp, Artificial Sequence
  chemically synthesized
gggtggtgagcatctgtgtg

SEQ ID NO: 19797 - DNA, 20 bp, Artificial Sequence
  chemically synthesized
ggtggtgagcatctgtgtgg

SEQ ID NO: 19798 - DNA, 20 bp, Artificial Sequence
  chemically synthesized
gtgagcatctgtgtgggggt

SEQ ID NO: 19799 - DNA, 20 bp, Artificial Sequence
  chemically synthesized
tgagcatctgtgtgggggtt

SEQ ID NO: 19800 - DNA, 20 bp, Artificial Sequence
  chemically synthesized
gagcatctgtgtgggggttg

SEQ ID NO: 19801 - DNA, 20 bp, Artificial Sequence
  chemically synthesized
catctgtgtgggggttgggg

SEQ ID NO: 19802 - DNA, 20 bp, Artificial Sequence
  chemically synthesized
atctgtgtgggggttggggt

SEQ ID NO: 19803 - DNA, 20 bp, Artificial Sequence
  chemically synthesized
gtgtgggggttggggtggga

SEQ ID NO: 19804 - DNA, 20 bp, Artificial Sequence
  chemically synthesized
tgtgggggttggggtgggat

SEQ ID NO: 19805 - DNA, 20 bp, Artificial Sequence
  chemically synthesized
gtgggggttggggtgggata

SEQ ID NO: 19806 - DNA, 20 bp, Artificial Sequence
  chemically synthesized
tgggggttggggtgggatag

SEQ ID NO: 19807 - DNA, 20 bp, Artificial Sequence
  chemically synthesized
ttggggtgggataggggata

SEQ ID NO: 19808 - DNA, 20 bp, Artificial Sequence
  chemically synthesized
tggggtgggataggggatac

SEQ ID NO: 19809 - DNA, 20 bp, Artificial Sequence
  chemically synthesized
ggggtgggataggggatacg

SEQ ID NO: 19810 - DNA, 20 bp, Artificial Sequence
  chemically synthesized
ggtgggataggggatacggg

SEQ ID NO: 19811 - DNA, 20 bp, Artificial Sequence
  chemically synthesized
tgggataggggatacgggga

SEQ ID NO: 19812 - DNA, 20 bp, Artificial Sequence
  chemically synthesized
gataggggatacggggagag

SEQ ID NO: 19813 - DNA, 20 bp, Artificial Sequence
  chemically synthesized
taggggatacggggagagtg

SEQ ID NO: 19814 - DNA, 20 bp, Artificial Sequence
  chemically synthesized
atacggggagagtggagaaa

SEQ ID NO: 19815 - DNA, 20 bp, Artificial Sequence
  chemically synthesized
tacggggagagtggagaaaa

SEQ ID NO: 19816 - DNA, 20 bp, Artificial Sequence
  chemically synthesized
acggggagagtggagaaaaa

SEQ ID NO: 19817 - DNA, 20 bp, Artificial Sequence
  chemically synthesized
cggggagagtggagaaaaag

SEQ ID NO: 19818 - DNA, 20 bp, Artificial Sequence
  chemically synthesized
gagtggagaaaaaggggaca

SEQ ID NO: 19819 - DNA, 20 bp, Artificial Sequence
  chemically synthesized
agtggagaaaaaggggacac

SEQ ID NO: 19820 - DNA, 20 bp, Artificial Sequence
  chemically synthesized
gtggagaaaaaggggacaca

SEQ ID NO: 19821 - DNA, 20 bp, Artificial Sequence
  chemically synthesized
ggggacacagggttaatgtg

SEQ ID NO: 19822 - DNA, 20 bp, Artificial Sequence
  chemically synthesized
cacagggttaatgtgaagtc

SEQ ID NO: 19823 - DNA, 20 bp, Artificial Sequence
  chemically synthesized
acagggttaatgtgaagtcc

SEQ ID NO: 19824 - DNA, 20 bp, Artificial Sequence
  chemically synthesized
aggatccccctctacattta

SEQ ID NO: 19825 - DNA, 20 bp, Artificial Sequence
  chemically synthesized
tccccctctacatttaaagt

SEQ ID NO: 19826 - DNA, 20 bp, Artificial Sequence
  chemically synthesized
tctacatttaaagttggttt

SEQ ID NO: 19827 - DNA, 20 bp, Artificial Sequence
  chemically synthesized
catttaaagttggtttaagt

SEQ ID NO: 19828 - DNA, 20 bp, Artificial Sequence
  chemically synthesized
tttaagttggctttaattaa

SEQ ID NO: 19829 - DNA, 20 bp, Artificial Sequence
  chemically synthesized
tttaattaatagcaactctt

SEQ ID NO: 19830 - DNA, 20 bp, Artificial Sequence
  chemically synthesized
atagcaactcttaagataat

SEQ ID NO: 19831 - DNA, 20 bp, Artificial Sequence
  chemically synthesized
tcagaattttcttaaccttt

SEQ ID NO: 19832 - DNA, 20 bp, Artificial Sequence
  chemically synthesized
cttttagccttactgttgaa

SEQ ID NO: 19833 - DNA, 20 bp, Artificial Sequence
  chemically synthesized
tgtacaaatcatttgcttct

SEQ ID NO: 19834 - DNA, 20 bp, Artificial Sequence
  chemically synthesized
caaatcatttgcttcttgga

SEQ ID NO: 19835 - DNA, 20 bp, Artificial Sequence
  chemically synthesized
taatttcttttactaaaatg

SEQ ID NO: 19836 - DNA, 20 bp, Artificial Sequence
  chemically synthesized
aatttcttttactaaaatgt

SEQ ID NO: 19837 - DNA, 20 bp, Artificial Sequence
  chemically synthesized
ctaaaatgtgggcttttgac

SEQ ID NO: 19838 - DNA, 20 bp, Artificial Sequence
  chemically synthesized
gatgaatgtaaatgttcttc

SEQ ID NO: 19839 - DNA, 20 bp, Artificial Sequence
  chemically synthesized
ttattctttatattttctaa

SEQ ID NO: 19840 - DNA, 20 bp, Artificial Sequence
  chemically synthesized
attttctaacagattctgtg

SEQ ID NO: 19841 - DNA, 20 bp, Artificial Sequence
  chemically synthesized
ttctaacagattctgtgtag

SEQ ID NO: 19842 - DNA, 20 bp, Artificial Sequence
  chemically synthesized
tctaacagattctgtgtagt

SEQ ID NO: 19843 - DNA, 20 bp, Artificial Sequence
  chemically synthesized
cagattctgtgtagtgggat

SEQ ID NO: 19844 - DNA, 20 bp, Artificial Sequence
  chemically synthesized
attctgtgtagtgggatgag

SEQ ID NO: 19845 - DNA, 20 bp, Artificial Sequence
  chemically synthesized
tctgtgtagtgggatgagca

SEQ ID NO: 19846 - DNA, 20 bp, Artificial Sequence
  chemically synthesized
agaacaaaaacaaaataatc

SEQ ID NO: 19847 - DNA, 20 bp, Artificial Sequence
  chemically synthesized
caaaaacaaaataatccagt

SEQ ID NO: 19848 - DNA, 20 bp, Artificial Sequence
  chemically synthesized
acaaaataatccagtgagaa

SEQ ID NO: 19849 - DNA, 20 bp, Artificial Sequence
  chemically synthesized
aaagcccgtaaataaacctt

SEQ ID NO: 19850 - DNA, 20 bp, Artificial Sequence
  chemically synthesized
ccgtaaataaaccttcagac

SEQ ID NO: 19851 - DNA, 20 bp, Artificial Sequence
  chemically synthesized
gtaaataaaccttcagacca

SEQ ID NO: 19852 - DNA, 20 bp, Artificial Sequence
  chemically synthesized
cagaccagagatctattctc

SEQ ID NO: 19853 - DNA, 20 bp, Artificial Sequence
  chemically synthesized
tctattctctagcttatttt

SEQ ID NO: 19854 - DNA, 20 bp, Artificial Sequence
  chemically synthesized
tattttaagctcaacttaaa

SEQ ID NO: 19855 - DNA, 20 bp, Artificial Sequence
  chemically synthesized
tttaagctcaacttaaaaag

SEQ ID NO: 19856 - DNA, 20 bp, Artificial Sequence
  chemically synthesized
ttaactccaccctccttcaa

SEQ ID NO: 19857 - DNA, 20 bp, Artificial Sequence
  chemically synthesized
ccaccctccttcaaaagaaa

SEQ ID NO: 19858 - DNA, 20 bp, Artificial Sequence
  chemically synthesized
gtctatatgattgatttgca

SEQ ID NO: 19859 - DNA, 20 bp, Artificial Sequence
  chemically synthesized
attgatttgcacagctcatc

SEQ ID NO: 19860 - DNA, 20 bp, Artificial Sequence
  chemically synthesized
atttgcacagctcatctggc

SEQ ID NO: 19861 - DNA, 20 bp, Artificial Sequence
  chemically synthesized
tgcacagctcatctggccag

SEQ ID NO: 19862 - DNA, 20 bp, Artificial Sequence
  chemically synthesized
cacagctcatctggccagaa

SEQ ID NO: 19863 - DNA, 20 bp, Artificial Sequence
  chemically synthesized
ctcatctggccagaagagct

SEQ ID NO: 19864 - DNA, 20 bp, Artificial Sequence
  chemically synthesized
tgagacatccgttcccctac

SEQ ID NO: 19865 - DNA, 20 bp, Artificial Sequence
  chemically synthesized
gagagtttcttgtaggggaa

SEQ ID NO: 19866 - DNA, 20 bp, Artificial Sequence
  chemically synthesized
ttgtaggggaacggatgtct

SEQ ID NO: 19867 - DNA, 20 bp, Artificial Sequence
  chemically synthesized
aacggatgtctcagctcttc

SEQ ID NO: 19868 - DNA, 20 bp, Artificial Sequence
  chemically synthesized
gatgtctcagctcttctggc

SEQ ID NO: 19869 - DNA, 20 bp, Artificial Sequence
  chemically synthesized
ctcagctcttctggccagat

SEQ ID NO: 19870 - DNA, 20 bp, Artificial Sequence
  chemically synthesized
agctgtgcaaatcaatcata

SEQ ID NO: 19871 - DNA, 20 bp, Artificial Sequence
  chemically synthesized
gtgcaaatcaatcatataga

SEQ ID NO: 19872 - DNA, 20 bp, Artificial Sequence
  chemically synthesized
caatcatatagacagtataa

SEQ ID NO: 19873 - DNA, 20 bp, Artificial Sequence
  chemically synthesized
tcatatagacagtataaaag

SEQ ID NO: 19874 - DNA, 20 bp, Artificial Sequence
  chemically synthesized
catatagacagtataaaagt

SEQ ID NO: 19875 - DNA, 20 bp, Artificial Sequence
  chemically synthesized
aggaaatgctgtttcttttg

SEQ ID NO: 19876 - DNA, 20 bp, Artificial Sequence
  chemically synthesized
ggaaatgctgtttcttttga

SEQ ID NO: 19877 - DNA, 20 bp, Artificial Sequence
  chemically synthesized
aaatgctgtttcttttgaag

SEQ ID NO: 19878 - DNA, 20 bp, Artificial Sequence
  chemically synthesized
aatgctgtttcttttgaagg

SEQ ID NO: 19879 - DNA, 20 bp, Artificial Sequence
  chemically synthesized
atgctgtttcttttgaagga

SEQ ID NO: 19880 - DNA, 20 bp, Artificial Sequence
  chemically synthesized
ctgtttcttttgaaggaggg

SEQ ID NO: 19881 - DNA, 20 bp, Artificial Sequence
  chemically synthesized
gtttcttttgaaggagggtg

SEQ ID NO: 19882 - DNA, 20 bp, Artificial Sequence
  chemically synthesized
gagggtggagttaaatcatt

SEQ ID NO: 19883 - DNA, 20 bp, Artificial Sequence
  chemically synthesized
ttaaatcattaagtgtattg

SEQ ID NO: 19884 - DNA, 20 bp, Artificial Sequence
  chemically synthesized
taaatcattaagtgtattga

SEQ ID NO: 19885 - DNA, 20 bp, Artificial Sequence
  chemically synthesized
ttaagtgtattgaaggcgaa

SEQ ID NO: 19886 - DNA, 20 bp, Artificial Sequence
  chemically synthesized
gtattgaaggcgaaaagaat

SEQ ID NO: 19887 - DNA, 20 bp, Artificial Sequence
  chemically synthesized
attgaaggcgaaaagaatca

SEQ ID NO: 19888 - DNA, 20 bp, Artificial Sequence
  chemically synthesized
aggcgaaaagaatcagagaa

SEQ ID NO: 19889 - DNA, 20 bp, Artificial Sequence
  chemically synthesized
agagaacagttcttcttttt

SEQ ID NO: 19890 - DNA, 20 bp, Artificial Sequence
  chemically synthesized
acagttcttctttttaagtt

SEQ ID NO: 19891 - DNA, 20 bp, Artificial Sequence
  chemically synthesized
ttttaagttgagcttaaaat

SEQ ID NO: 19892 - DNA, 20 bp, Artificial Sequence
  chemically synthesized
aagttgagcttaaaataagc

SEQ ID NO: 19893 - DNA, 20 bp, Artificial Sequence
  chemically synthesized
gttgagcttaaaataagcta

SEQ ID NO: 19894 - DNA, 20 bp, Artificial Sequence
  chemically synthesized
gcttaaaataagctagagaa

SEQ ID NO: 19895 - DNA, 20 bp, Artificial Sequence
  chemically synthesized
taagctagagaatagatctc

SEQ ID NO: 19896 - DNA, 20 bp, Artificial Sequence
  chemically synthesized
gagaatagatctctggtctg

SEQ ID NO: 19897 - DNA, 20 bp, Artificial Sequence
  chemically synthesized
agaatagatctctggtctga

SEQ ID NO: 19898 - DNA, 20 bp, Artificial Sequence
  chemically synthesized
ctggtctgaaggtttattta

SEQ ID NO: 19899 - DNA, 20 bp, Artificial Sequence
  chemically synthesized
tggtctgaaggtttatttac

SEQ ID NO: 19900 - DNA, 20 bp, Artificial Sequence
  chemically synthesized
tatttacgggcttttctcac

SEQ ID NO: 19901 - DNA, 20 bp, Artificial Sequence
  chemically synthesized
tctctgctcatcccactaca

SEQ ID NO: 19902 - DNA, 20 bp, Artificial Sequence
  chemically synthesized
tcccactacacagaatctgt

SEQ ID NO: 19903 - DNA, 20 bp, Artificial Sequence
  chemically synthesized
agaatctgttagaaaatata

SEQ ID NO: 19904 - DNA, 20 bp, Artificial Sequence
  chemically synthesized
gttagaaaatataaagaata

SEQ ID NO: 19905 - DNA, 20 bp, Artificial Sequence
  chemically synthesized
ttagaaaatataaagaataa

SEQ ID NO: 19906 - DNA, 20 bp, Artificial Sequence
  chemically synthesized
atataaagaataaaggatat

SEQ ID NO: 19907 - DNA, 20 bp, Artificial Sequence
  chemically synthesized
ataaagaataaaggatatca

SEQ ID NO: 19908 - DNA, 20 bp, Artificial Sequence
  chemically synthesized
agaataaaggatatcagagc

SEQ ID NO: 19909 - DNA, 20 bp, Artificial Sequence
  chemically synthesized
ataaaggatatcagagctag

SEQ ID NO: 19910 - DNA, 20 bp, Artificial Sequence
  chemically synthesized
gaagaacatttacattcatc

SEQ ID NO: 19911 - DNA, 20 bp, Artificial Sequence
  chemically synthesized
atttacattcatctagtcaa

SEQ ID NO: 19912 - DNA, 20 bp, Artificial Sequence
  chemically synthesized
ctagtcaaaagcccacattt

SEQ ID NO: 19913 - DNA, 20 bp, Artificial Sequence
  chemically synthesized
aaaagcccacattttagtaa

SEQ ID NO: 19914 - DNA, 20 bp, Artificial Sequence
  chemically synthesized
agtaaaagaaattactatcc

SEQ ID NO: 19915 - DNA, 20 bp, Artificial Sequence
  chemically synthesized
aaaagaaattactatccaag

SEQ ID NO: 19916 - DNA, 20 bp, Artificial Sequence
  chemically synthesized
aagaagcaaatgatttgtac

SEQ ID NO: 19917 - DNA, 20 bp, Artificial Sequence
  chemically synthesized
aaatgatttgtacaagatca

SEQ ID NO: 19918 - DNA, 20 bp, Artificial Sequence
  chemically synthesized
aatgatttgtacaagatcac

SEQ ID NO: 19919 - DNA, 20 bp, Artificial Sequence
  chemically synthesized
atgatttgtacaagatcaca

SEQ ID NO: 19920 - DNA, 20 bp, Artificial Sequence
  chemically synthesized
aagatcacagggcttttcaa

SEQ ID NO: 19921 - DNA, 20 bp, Artificial Sequence
  chemically synthesized
tcacagggcttttcaacagt

SEQ ID NO: 19922 - DNA, 20 bp, Artificial Sequence
  chemically synthesized
cacagggcttttcaacagta

SEQ ID NO: 19923 - DNA, 20 bp, Artificial Sequence
  chemically synthesized
cttttcaacagtaaggctaa

SEQ ID NO: 19924 - DNA, 20 bp, Artificial Sequence
  chemically synthesized
ttttcaacagtaaggctaaa

SEQ ID NO: 19925 - DNA, 20 bp, Artificial Sequence
  chemically synthesized
aacagtaaggctaaaaggtt

SEQ ID NO: 19926 - DNA, 20 bp, Artificial Sequence
  chemically synthesized
aagaaaattctgattatctt

SEQ ID NO: 19927 - DNA, 20 bp, Artificial Sequence
  chemically synthesized
gaaaattctgattatcttaa

SEQ ID NO: 19928 - DNA, 20 bp, Artificial Sequence
  chemically synthesized
ttaagagttgctattaatta

SEQ ID NO: 19929 - DNA, 20 bp, Artificial Sequence
  chemically synthesized
acttaaaccaactttaaatg

SEQ ID NO: 19930 - DNA, 20 bp, Artificial Sequence
  chemically synthesized
ttaaaccaactttaaatgta

SEQ ID NO: 19931 - DNA, 20 bp, Artificial Sequence
  chemically synthesized
taaaccaactttaaatgtag

SEQ ID NO: 19932 - DNA, 20 bp, Artificial Sequence
  chemically synthesized
aaaccaactttaaatgtaga

SEQ ID NO: 19933 - DNA, 20 bp, Artificial Sequence
  chemically synthesized
aaccaactttaaatgtagag

SEQ ID NO: 19934 - DNA, 20 bp, Artificial Sequence
  chemically synthesized
accaactttaaatgtagagg

SEQ ID NO: 19935 - DNA, 20 bp, Artificial Sequence
  chemically synthesized
ttaaatgtagagggggatcc

SEQ ID NO: 19936 - DNA, 20 bp, Artificial Sequence
  chemically synthesized
atcccaccccaacccccaca

SEQ ID NO: 19937 - DNA, 20 bp, Artificial Sequence
  chemically synthesized
atattattgttctctgtaaa

SEQ ID NO: 19938 - DNA, 20 bp, Artificial Sequence
  chemically synthesized
cggaaacaacctgttgtcta

SEQ ID NO: 19939 - DNA, 20 bp, Artificial Sequence
  chemically synthesized
gaaacaacctgttgtctaaa

SEQ ID NO: 19940 - DNA, 20 bp, Artificial Sequence
  chemically synthesized
tgtctaaagagttttaacta

SEQ ID NO: 19941 - DNA, 20 bp, Artificial Sequence
  chemically synthesized
gtctaaagagttttaactat

SEQ ID NO: 19942 - DNA, 20 bp, Artificial Sequence
  chemically synthesized
gagttttaactatgggctca

SEQ ID NO: 19943 - DNA, 20 bp, Artificial Sequence
  chemically synthesized
agttttaactatgggctcac

SEQ ID NO: 19944 - DNA, 20 bp, Artificial Sequence
  chemically synthesized
ttaactatgggctcacgggt

SEQ ID NO: 19945 - DNA, 20 bp, Artificial Sequence
  chemically synthesized
gggctcacgggtgagctaaa

SEQ ID NO: 19946 - DNA, 20 bp, Artificial Sequence
  chemically synthesized
ggctcacgggtgagctaaac

SEQ ID NO: 19947 - DNA, 20 bp, Artificial Sequence
  chemically synthesized
acaggtttcccatctttttc

SEQ ID NO: 19948 - DNA, 20 bp, Artificial Sequence
  chemically synthesized
ttcccatctttttctggacc

SEQ ID NO: 19949 - DNA, 20 bp, Artificial Sequence
  chemically synthesized
tcccatctttttctggaccc

SEQ ID NO: 19950 - DNA, 20 bp, Artificial Sequence
  chemically synthesized
tttttctggacccaggatct

SEQ ID NO: 19951 - DNA, 20 bp, Artificial Sequence
  chemically synthesized
ttctggacccaggatcttag

SEQ ID NO: 19952 - DNA, 20 bp, Artificial Sequence
  chemically synthesized
tctggacccaggatcttagt

SEQ ID NO: 19953 - DNA, 20 bp, Artificial Sequence
  chemically synthesized
ctggacccaggatcttagtg

SEQ ID NO: 19954 - DNA, 20 bp, Artificial Sequence
  chemically synthesized
tattttgttgcccttcaaac

SEQ ID NO: 19955 - DNA, 20 bp, Artificial Sequence
  chemically synthesized
ttgttgcccttcaaaccagt

SEQ ID NO: 19956 - DNA, 20 bp, Artificial Sequence
  chemically synthesized
tcaaaccagtaagcatttat

SEQ ID NO: 19957 - DNA, 20 bp, Artificial Sequence
  chemically synthesized
caaaccagtaagcatttatg

SEQ ID NO: 19958 - DNA, 20 bp, Artificial Sequence
  chemically synthesized
tatgaggactcacactatgc

SEQ ID NO: 19959 - DNA, 20 bp, Artificial Sequence
  chemically synthesized
ctcacactatgccagataca

SEQ ID NO: 19960 - DNA, 20 bp, Artificial Sequence
  chemically synthesized
tcacactatgccagatacat

SEQ ID NO: 19961 - DNA, 20 bp, Artificial Sequence
  chemically synthesized
cactatgccagatacatagg

SEQ ID NO: 19962 - DNA, 20 bp, Artificial Sequence
  chemically synthesized
tatgccagatacataggtgg

SEQ ID NO: 19963 - DNA, 20 bp, Artificial Sequence
  chemically synthesized
atgccagatacataggtggc

SEQ ID NO: 19964 - DNA, 20 bp, Artificial Sequence
  chemically synthesized
ggtggcaggattcttcactc

SEQ ID NO: 19965 - DNA, 20 bp, Artificial Sequence
  chemically synthesized
ctccagatataatctatctg

SEQ ID NO: 19966 - DNA, 20 bp, Artificial Sequence
  chemically synthesized
gatagattatatctggagtg

SEQ ID NO: 19967 - DNA, 20 bp, Artificial Sequence
  chemically synthesized
acctatgtatctggcatagt

SEQ ID NO: 19968 - DNA, 20 bp, Artificial Sequence
  chemically synthesized
aagggcaacaaaatagtgaa

SEQ ID NO: 19969 - DNA, 20 bp, Artificial Sequence
  chemically synthesized
tgaaaatccccactaagatc

SEQ ID NO: 19970 - DNA, 20 bp, Artificial Sequence
  chemically synthesized
gtttacagagaacaataata

SEQ ID NO: 19971 - DNA, 20 bp, Artificial Sequence
  chemically synthesized
tgggtggtgagcatctgtgt

SEQ ID NO: 19972 - DNA, 20 bp, Artificial Sequence
  chemically synthesized
gtgagcatctgtgtgggggt

SEQ ID NO: 19973 - DNA, 20 bp, Artificial Sequence
  chemically synthesized
catctgtgtgggggttgggg

SEQ ID NO: 19974 - DNA, 20 bp, Artificial Sequence
  chemically synthesized
gtgggggttggggtgggata

SEQ ID NO: 19975 - DNA, 20 bp, Artificial Sequence
  chemically synthesized
ggtgggataggggatacggg

SEQ ID NO: 19976 - DNA, 20 bp, Artificial Sequence
  chemically synthesized
gagtggagaaaaaggggaca

SEQ ID NO: 19977 - DNA, 20 bp, Artificial Sequence
  chemically synthesized
cacagggttaatgtgaagtc

SEQ ID NO: 19978 - DNA, 20 bp, Artificial Sequence
  chemically synthesized
atagcaactcttaagataat

SEQ ID NO: 19979 - DNA, 20 bp, Artificial Sequence
  chemically synthesized
ttgtacaaatcatttgcttc

SEQ ID NO: 19980 - DNA, 20 bp, Artificial Sequence
  chemically synthesized
aaatgtgggcttttgactag

SEQ ID NO: 19981 - DNA, 20 bp, Artificial Sequence
  chemically synthesized
ttctaacagattctgtgtag

SEQ ID NO: 19982 - DNA, 20 bp, Artificial Sequence
  chemically synthesized
ggagagtttcttgtagggga

SEQ ID NO: 19983 - DNA, 20 bp, Artificial Sequence
  chemically synthesized
aaatgctgtttcttttgaag

SEQ ID NO: 19984 - DNA, 20 bp, Artificial Sequence
  chemically synthesized
ctgtttcttttgaaggaggg

SEQ ID NO: 19985 - DNA, 20 bp, Artificial Sequence
  chemically synthesized
ttaagtgtattgaaggcgaa

SEQ ID NO: 19986 - DNA, 20 bp, Artificial Sequence
  chemically synthesized
gttgagcttaaaataagcta

SEQ ID NO: 19987 - DNA, 20 bp, Artificial Sequence
  chemically synthesized
ttatttacgggcttttctca

SEQ ID NO: 19988 - DNA, 20 bp, Artificial Sequence
  chemically synthesized
tctctgctcatcccactaca

SEQ ID NO: 19989 - DNA, 20 bp, Artificial Sequence
  chemically synthesized
agaatctgttagaaaatata

SEQ ID NO: 19990 - DNA, 20 bp, Artificial Sequence
  chemically synthesized
gttagaaaatataaagaata

SEQ ID NO: 19991 - DNA, 20 bp, Artificial Sequence
  chemically synthesized
aagaaaattctgattatctt

SEQ ID NO: 19992 - DNA, 20 bp, Artificial Sequence
  chemically synthesized
aaccaactttaaatgtagag

SEQ ID NO: 19993 - DNA, 20 bp, Artificial Sequence
  chemically synthesized
cggaaacaacctgttgtcta

SEQ ID NO: 19994 - DNA, 20 bp, Artificial Sequence
  chemically synthesized
agagttttaactatgggctc

SEQ ID NO: 19995 - DNA, 20 bp, Artificial Sequence
  chemically synthesized
ttcccatctttttctggacc

SEQ ID NO: 19996 - DNA, 20 bp, Artificial Sequence
  chemically synthesized
tctggacccaggatcttagt

SEQ ID NO: 19997 - DNA, 20 bp, Artificial Sequence
  chemically synthesized
tatgccagatacataggtgg

SEQ ID NO: 19998 - DNA, 20 bp, Artificial Sequence
  chemically synthesized
agatagattatatctggagt

SEQ ID NO: 19999 - DNA, 20 bp, Artificial Sequence
  chemically synthesized
tccccactaagatcctgggt

SEQ ID NO: 20000 - DNA, 20 bp, Artificial Sequence
  chemically synthesized
ataggggatacggggagagt

SEQ ID NO: 20001 - DNA, 20 bp, Artificial Sequence
  chemically synthesized
aatagcaactcttaagataa

SEQ ID NO: 20002 - DNA, 20 bp, Artificial Sequence
  chemically synthesized
acaaaaacaaaataatccag

SEQ ID NO: 20003 - DNA, 20 bp, Artificial Sequence
  chemically synthesized
tttaactccaccctccttca

SEQ ID NO: 20004 - DNA, 20 bp, Artificial Sequence
  chemically synthesized
ctgagacatccgttccccta

SEQ ID NO: 20005 - DNA, 20 bp, Artificial Sequence
  chemically synthesized
attaagtgtattgaaggcga

SEQ ID NO: 20006 - DNA, 20 bp, Artificial Sequence
  chemically synthesized
agttgagcttaaaataagct

SEQ ID NO: 20007 - DNA, 20 bp, Artificial Sequence
  chemically synthesized
ttctctgctcatcccactac

SEQ ID NO: 20008 - DNA, 20 bp, Artificial Sequence
  chemically synthesized
atcccactacacagaatctg

SEQ ID NO: 20009 - DNA, 20 bp, Artificial Sequence
  chemically synthesized
cagaatctgttagaaaatat

SEQ ID NO: 20010 - DNA, 20 bp, Artificial Sequence
  chemically synthesized
caaaagcccacattttagta

SEQ ID NO: 20011 - DNA, 20 bp, Artificial Sequence
  chemically synthesized
caacagtaaggctaaaaggt

SEQ ID NO: 20012 - DNA, 20 bp, Artificial Sequence
  chemically synthesized
ctcacccgtgagcccatagt

SEQ ID NO: 20013 - DNA, 20 bp, Artificial Sequence
  chemically synthesized
tagtgggatgagcagagaac

SEQ ID NO: 20014 - DNA, 20 bp, Artificial Sequence
  chemically synthesized
ggcatagtgtgagtcctcat

SEQ ID NO: 20015 - DNA, 20 bp, Artificial Sequence
  chemically synthesized
gtgagtcctcataaatgctt

SEQ ID NO: 20016 - DNA, 20 bp, Artificial Sequence
  chemically synthesized
ggtccagaaaaagatgggaa

SEQ ID NO: 20017 - DNA, 20 bp, Artificial Sequence
  chemically synthesized
ttaaaactctttagacaaca

SEQ ID NO: 20018 - DNA, 20 bp, Artificial Sequence
  chemically synthesized
ctctttagacaacaggttgt

SEQ ID NO: 20019 - DNA, 20 bp, Artificial Sequence
  chemically synthesized
gatccccctctacatttaaa

SEQ ID NO: 20020 - DNA, 20 bp, Artificial Sequence
  chemically synthesized
tacatttaaagttggtttaa

SEQ ID NO: 20021 - DNA, 20 bp, Artificial Sequence
  chemically synthesized
cctgtgatcttgtacaaatc

SEQ ID NO: 20022 - DNA, 20 bp, Artificial Sequence
  chemically synthesized
gtaatttcttttactaaaat

SEQ ID NO: 20023 - DNA, 20 bp, Artificial Sequence
  chemically synthesized
ctttattctttatattttct

SEQ ID NO: 20024 - DNA, 20 bp, Artificial Sequence
  chemically synthesized
ttcagaccagagatctattc

SEQ ID NO: 20025 - DNA, 20 bp, Artificial Sequence
  chemically synthesized
acttaaaaagaagaactgtt

SEQ ID NO: 20026 - DNA, 20 bp, Artificial Sequence
  chemically synthesized
cttttcgccttcaatacact

SEQ ID NO: 20027 - DNA, 20 bp, Artificial Sequence
  chemically synthesized
ttcctacttttatactgtct

SEQ ID NO: 20028 - DNA, 20 bp, Artificial Sequence
  chemically synthesized
tacttttatactgtctatat

SEQ ID NO: 20029 - DNA, 20 bp, Artificial Sequence
  chemically synthesized
gacagtataaaagtaggaaa

SEQ ID NO: 20030 - DNA, 20 bp, Artificial Sequence
  chemically synthesized
gaacagttcttctttttaag

SEQ ID NO: 20031 - DNA, 20 bp, Artificial Sequence
  chemically synthesized
agagaatagatctctggtct

SEQ ID NO: 20032 - DNA, 20 bp, Artificial Sequence
  chemically synthesized
tctggtctgaaggtttattt

SEQ ID NO: 20033 - DNA, 20 bp, Artificial Sequence
  chemically synthesized
tttatttacgggcttttctc

SEQ ID NO: 20034 - DNA, 20 bp, Artificial Sequence
  chemically synthesized
gggcttttctcactggatta

SEQ ID NO: 20035 - DNA, 20 bp, Artificial Sequence
  chemically synthesized
gaaattactatccaagaagc

SEQ ID NO: 20036 - DNA, 20 bp, Artificial Sequence
  chemically synthesized
aaatgatttgtacaagatca

SEQ ID NO: 20037 - DNA, 20 bp, Artificial Sequence
  chemically synthesized
aggctaaaaggttaagaaaa

SEQ ID NO: 20038 - DNA, 20 bp, Artificial Sequence
  chemically synthesized
cggaaacaacctgttgtcta

SEQ ID NO: 20039 - DNA, 20 bp, Artificial Sequence
  chemically synthesized
tgggctcacgggtgagctaa

SEQ ID NO: 20040 - DNA, 20 bp, Artificial Sequence
  chemically synthesized
ttctggacccaggatcttag

SEQ ID NO: 20041 - DNA, 20 bp, Artificial Sequence
  chemically synthesized
ctatgccagatacataggtg

SEQ ID NO: 20042 - DNA, 22 bp, Artificial Sequence
  chemically synthesized
cagatagattatatctggagtg

SEQ ID NO: 20043 - DNA, 22 bp, Artificial Sequence
  chemically synthesized
agatagattatatctggagtga

SEQ ID NO: 20044 - DNA, 22 bp, Artificial Sequence
  chemically synthesized
tatctggagtgaagaatcctgc

SEQ ID NO: 20045 - DNA, 22 bp, Artificial Sequence
  chemically synthesized
gagtgaagaatcctgccaccta

SEQ ID NO: 20046 - DNA, 22 bp, Artificial Sequence
  chemically synthesized
ccacctatgtatctggcatagt

SEQ ID NO: 20047 - DNA, 22 bp, Artificial Sequence
  chemically synthesized
tgtatctggcatagtgtgagtc

SEQ ID NO: 20048 - DNA, 22 bp, Artificial Sequence
  chemically synthesized
gcatagtgtgagtcctcataaa

SEQ ID NO: 20049 - DNA, 22 bp, Artificial Sequence
  chemically synthesized
ataaatgcttactggtttgaag

SEQ ID NO: 20050 - DNA, 22 bp, Artificial Sequence
  chemically synthesized
actggtttgaagggcaacaaaa

SEQ ID NO: 20051 - DNA, 22 bp, Artificial Sequence
  chemically synthesized
ctggtttgaagggcaacaaaat

SEQ ID NO: 20052 - DNA, 22 bp, Artificial Sequence
  chemically synthesized
gtttgaagggcaacaaaatagt

SEQ ID NO: 20053 - DNA, 22 bp, Artificial Sequence
  chemically synthesized
gaagggcaacaaaatagtgaac

SEQ ID NO: 20054 - DNA, 22 bp, Artificial Sequence
  chemically synthesized
aagggcaacaaaatagtgaaca

SEQ ID NO: 20055 - DNA, 22 bp, Artificial Sequence
  chemically synthesized
agatcctgggtccagaaaaaga

SEQ ID NO: 20056 - DNA, 22 bp, Artificial Sequence
  chemically synthesized
ggtccagaaaaagatgggaaac

SEQ ID NO: 20057 - DNA, 22 bp, Artificial Sequence
  chemically synthesized
tttagctcacccgtgagcccat

SEQ ID NO: 20058 - DNA, 22 bp, Artificial Sequence
  chemically synthesized
agctcacccgtgagcccatagt

SEQ ID NO: 20059 - DNA, 22 bp, Artificial Sequence
  chemically synthesized
gctcacccgtgagcccatagtt

SEQ ID NO: 20060 - DNA, 22 bp, Artificial Sequence
  chemically synthesized
acccgtgagcccatagttaaaa

SEQ ID NO: 20061 - DNA, 22 bp, Artificial Sequence
  chemically synthesized
aaactctttagacaacaggttg

SEQ ID NO: 20062 - DNA, 22 bp, Artificial Sequence
  chemically synthesized
tttagacaacaggttgtttccg

SEQ ID NO: 20063 - DNA, 22 bp, Artificial Sequence
  chemically synthesized
tagacaacaggttgtttccgtt

SEQ ID NO: 20064 - DNA, 22 bp, Artificial Sequence
  chemically synthesized
agacaacaggttgtttccgttt

SEQ ID NO: 20065 - DNA, 22 bp, Artificial Sequence
  chemically synthesized
gacaacaggttgtttccgttta

SEQ ID NO: 20066 - DNA, 22 bp, Artificial Sequence
  chemically synthesized
tttccgtttacagagaacaata

SEQ ID NO: 20067 - DNA, 22 bp, Artificial Sequence
  chemically synthesized
ccgtttacagagaacaataata

SEQ ID NO: 20068 - DNA, 22 bp, Artificial Sequence
  chemically synthesized
cgtttacagagaacaataatat

SEQ ID NO: 20069 - DNA, 22 bp, Artificial Sequence
  chemically synthesized
acagagaacaataatattgggt

SEQ ID NO: 20070 - DNA, 22 bp, Artificial Sequence
  chemically synthesized
cagagaacaataatattgggtg

SEQ ID NO: 20071 - DNA, 22 bp, Artificial Sequence
  chemically synthesized
ggtggtgagcatctgtgtgggg

SEQ ID NO: 20072 - DNA, 22 bp, Artificial Sequence
  chemically synthesized
tgtgggggttggggtgggatag

SEQ ID NO: 20073 - DNA, 22 bp, Artificial Sequence
  chemically synthesized
gggtgggataggggatacgggg

SEQ ID NO: 20074 - DNA, 22 bp, Artificial Sequence
  chemically synthesized
atgtgaagtccaggatccccct

SEQ ID NO: 20075 - DNA, 22 bp, Artificial Sequence
  chemically synthesized
tacatttaaagttggtttaagt

SEQ ID NO: 20076 - DNA, 22 bp, Artificial Sequence
  chemically synthesized
catttaaagttggtttaagttg

SEQ ID NO: 20077 - DNA, 22 bp, Artificial Sequence
  chemically synthesized
aaagttggtttaagttggcttt

SEQ ID NO: 20078 - DNA, 22 bp, Artificial Sequence
  chemically synthesized
aagttggtttaagttggcttta

SEQ ID NO: 20079 - DNA, 22 bp, Artificial Sequence
  chemically synthesized
gtttaagttggctttaattaat

SEQ ID NO: 20080 - DNA, 22 bp, Artificial Sequence
  chemically synthesized
aagttggctttaattaatagca

SEQ ID NO: 20081 - DNA, 22 bp, Artificial Sequence
  chemically synthesized
agttggctttaattaatagcaa

SEQ ID NO: 20082 - DNA, 22 bp, Artificial Sequence
  chemically synthesized
gctttaattaatagcaactctt

SEQ ID NO: 20083 - DNA, 22 bp, Artificial Sequence
  chemically synthesized
taattaatagcaactcttaaga

SEQ ID NO: 20084 - DNA, 22 bp, Artificial Sequence
  chemically synthesized
aattaatagcaactcttaagat

SEQ ID NO: 20085 - DNA, 22 bp, Artificial Sequence
  chemically synthesized
attaatagcaactcttaagata

SEQ ID NO: 20086 - DNA, 22 bp, Artificial Sequence
  chemically synthesized
atagcaactcttaagataatca

SEQ ID NO: 20087 - DNA, 22 bp, Artificial Sequence
  chemically synthesized
ttaagataatcagaattttctt

SEQ ID NO: 20088 - DNA, 22 bp, Artificial Sequence
  chemically synthesized
aagataatcagaattttcttaa

SEQ ID NO: 20089 - DNA, 22 bp, Artificial Sequence
  chemically synthesized
agataatcagaattttcttaac

SEQ ID NO: 20090 - DNA, 22 bp, Artificial Sequence
  chemically synthesized
tcttaaccttttagccttactg

SEQ ID NO: 20091 - DNA, 22 bp, Artificial Sequence
  chemically synthesized
cttaaccttttagccttactgt

SEQ ID NO: 20092 - DNA, 22 bp, Artificial Sequence
  chemically synthesized
ttaaccttttagccttactgtt

SEQ ID NO: 20093 - DNA, 22 bp, Artificial Sequence
  chemically synthesized
aaccttttagccttactgttga

SEQ ID NO: 20094 - DNA, 22 bp, Artificial Sequence
  chemically synthesized
accttttagccttactgttgaa

SEQ ID NO: 20095 - DNA, 22 bp, Artificial Sequence
  chemically synthesized
ttagccttactgttgaaaagcc

SEQ ID NO: 20096 - DNA, 22 bp, Artificial Sequence
  chemically synthesized
tagccttactgttgaaaagccc

SEQ ID NO: 20097 - DNA, 22 bp, Artificial Sequence
  chemically synthesized
agccttactgttgaaaagccct

SEQ ID NO: 20098 - DNA, 22 bp, Artificial Sequence
  chemically synthesized
gccttactgttgaaaagccctg

SEQ ID NO: 20099 - DNA, 22 bp, Artificial Sequence
  chemically synthesized
actgttgaaaagccctgtgatc

SEQ ID NO: 20100 - DNA, 22 bp, Artificial Sequence
  chemically synthesized
ctgttgaaaagccctgtgatct

SEQ ID NO: 20101 - DNA, 22 bp, Artificial Sequence
  chemically synthesized
ttgaaaagccctgtgatcttgt

SEQ ID NO: 20102 - DNA, 22 bp, Artificial Sequence
  chemically synthesized
aaaagccctgtgatcttgtaca

SEQ ID NO: 20103 - DNA, 22 bp, Artificial Sequence
  chemically synthesized
tgatcttgtacaaatcatttgc

SEQ ID NO: 20104 - DNA, 22 bp, Artificial Sequence
  chemically synthesized
gtacaaatcatttgcttcttgg

SEQ ID NO: 20105 - DNA, 22 bp, Artificial Sequence
  chemically synthesized
tacaaatcatttgcttcttgga

SEQ ID NO: 20106 - DNA, 22 bp, Artificial Sequence
  chemically synthesized
gcttcttggatagtaatttctt

SEQ ID NO: 20107 - DNA, 22 bp, Artificial Sequence
  chemically synthesized
cttcttggatagtaatttcttt

SEQ ID NO: 20108 - DNA, 22 bp, Artificial Sequence
  chemically synthesized
cttggatagtaatttcttttac

SEQ ID NO: 20109 - DNA, 22 bp, Artificial Sequence
  chemically synthesized
ttggatagtaatttcttttact

SEQ ID NO: 20110 - DNA, 22 bp, Artificial Sequence
  chemically synthesized
ggatagtaatttcttttactaa

SEQ ID NO: 20111 - DNA, 22 bp, Artificial Sequence
  chemically synthesized
gatagtaatttcttttactaaa

SEQ ID NO: 20112 - DNA, 22 bp, Artificial Sequence
  chemically synthesized
cttttactaaaatgtgggcttt

SEQ ID NO: 20113 - DNA, 22 bp, Artificial Sequence
  chemically synthesized
ttttactaaaatgtgggctttt

SEQ ID NO: 20114 - DNA, 22 bp, Artificial Sequence
  chemically synthesized
ttactaaaatgtgggcttttga

SEQ ID NO: 20115 - DNA, 22 bp, Artificial Sequence
  chemically synthesized
tactaaaatgtgggcttttgac

SEQ ID NO: 20116 - DNA, 22 bp, Artificial Sequence
  chemically synthesized
actaaaatgtgggcttttgact

SEQ ID NO: 20117 - DNA, 22 bp, Artificial Sequence
  chemically synthesized
ctaaaatgtgggcttttgacta

SEQ ID NO: 20118 - DNA, 22 bp, Artificial Sequence
  chemically synthesized
aaatgtgggcttttgactagat

SEQ ID NO: 20119 - DNA, 22 bp, Artificial Sequence
  chemically synthesized
ttgactagatgaatgtaaatgt

SEQ ID NO: 20120 - DNA, 22 bp, Artificial Sequence
  chemically synthesized
tgactagatgaatgtaaatgtt

SEQ ID NO: 20121 - DNA, 22 bp, Artificial Sequence
  chemically synthesized
gactagatgaatgtaaatgttc

SEQ ID NO: 20122 - DNA, 22 bp, Artificial Sequence
  chemically synthesized
actagatgaatgtaaatgttct

SEQ ID NO: 20123 - DNA, 22 bp, Artificial Sequence
  chemically synthesized
gatgaatgtaaatgttcttcta

SEQ ID NO: 20124 - DNA, 22 bp, Artificial Sequence
  chemically synthesized
ttctagctctgatatcctttat

SEQ ID NO: 20125 - DNA, 22 bp, Artificial Sequence
  chemically synthesized
ctagctctgatatcctttattc

SEQ ID NO: 20126 - DNA, 22 bp, Artificial Sequence
  chemically synthesized
tagctctgatatcctttattct

SEQ ID NO: 20127 - DNA, 22 bp, Artificial Sequence
  chemically synthesized
gctctgatatcctttattcttt

SEQ ID NO: 20128 - DNA, 22 bp, Artificial Sequence
  chemically synthesized
tgatatcctttattctttatat

SEQ ID NO: 20129 - DNA, 22 bp, Artificial Sequence
  chemically synthesized
atatcctttattctttatattt

SEQ ID NO: 20130 - DNA, 22 bp, Artificial Sequence
  chemically synthesized
tattctttatattttctaacag

SEQ ID NO: 20131 - DNA, 22 bp, Artificial Sequence
  chemically synthesized
attctttatattttctaacaga

SEQ ID NO: 20132 - DNA, 22 bp, Artificial Sequence
  chemically synthesized
ttctttatattttctaacagat

SEQ ID NO: 20133 - DNA, 22 bp, Artificial Sequence
  chemically synthesized
tttatattttctaacagattct

SEQ ID NO: 20134 - DNA, 22 bp, Artificial Sequence
  chemically synthesized
tatattttctaacagattctgt

SEQ ID NO: 20135 - DNA, 22 bp, Artificial Sequence
  chemically synthesized
atattttctaacagattctgtg

SEQ ID NO: 20136 - DNA, 22 bp, Artificial Sequence
  chemically synthesized
tattttctaacagattctgtgt

SEQ ID NO: 20137 - DNA, 22 bp, Artificial Sequence
  chemically synthesized
tctaacagattctgtgtagtgg

SEQ ID NO: 20138 - DNA, 22 bp, Artificial Sequence
  chemically synthesized
ctaacagattctgtgtagtggg

SEQ ID NO: 20139 - DNA, 22 bp, Artificial Sequence
  chemically synthesized
taacagattctgtgtagtggga

SEQ ID NO: 20140 - DNA, 22 bp, Artificial Sequence
  chemically synthesized
acagattctgtgtagtgggatg

SEQ ID NO: 20141 - DNA, 22 bp, Artificial Sequence
  chemically synthesized
tgtgtagtgggatgagcagaga

SEQ ID NO: 20142 - DNA, 22 bp, Artificial Sequence
  chemically synthesized
tgtagtgggatgagcagagaac

SEQ ID NO: 20143 - DNA, 22 bp, Artificial Sequence
  chemically synthesized
cagaccagagatctattctcta

SEQ ID NO: 20144 - DNA, 22 bp, Artificial Sequence
  chemically synthesized
agaccagagatctattctctag

SEQ ID NO: 20145 - DNA, 22 bp, Artificial Sequence
  chemically synthesized
ttctctagcttattttaagctc

SEQ ID NO: 20146 - DNA, 22 bp, Artificial Sequence
  chemically synthesized
tctagcttattttaagctcaac

SEQ ID NO: 20147 - DNA, 22 bp, Artificial Sequence
  chemically synthesized
tagcttattttaagctcaactt

SEQ ID NO: 20148 - DNA, 22 bp, Artificial Sequence
  chemically synthesized
gcttattttaagctcaacttaa

SEQ ID NO: 20149 - DNA, 22 bp, Artificial Sequence
  chemically synthesized
attttaagctcaacttaaaaag

SEQ ID NO: 20150 - DNA, 22 bp, Artificial Sequence
  chemically synthesized
ttttaagctcaacttaaaaaga

SEQ ID NO: 20151 - DNA, 22 bp, Artificial Sequence
  chemically synthesized
taagctcaacttaaaaagaaga

SEQ ID NO: 20152 - DNA, 22 bp, Artificial Sequence
  chemically synthesized
aagctcaacttaaaaagaagaa

SEQ ID NO: 20153 - DNA, 22 bp, Artificial Sequence
  chemically synthesized
agctcaacttaaaaagaagaac

SEQ ID NO: 20154 - DNA, 22 bp, Artificial Sequence
  chemically synthesized
aacttaaaaagaagaactgttc

SEQ ID NO: 20155 - DNA, 22 bp, Artificial Sequence
  chemically synthesized
aaaaagaagaactgttctctga

SEQ ID NO: 20156 - DNA, 22 bp, Artificial Sequence
  chemically synthesized
aaaagaagaactgttctctgat

SEQ ID NO: 20157 - DNA, 22 bp, Artificial Sequence
  chemically synthesized
ttctctgattcttttcgccttc

SEQ ID NO: 20158 - DNA, 22 bp, Artificial Sequence
  chemically synthesized
tctgattcttttcgccttcaat

SEQ ID NO: 20159 - DNA, 22 bp, Artificial Sequence
  chemically synthesized
tgattcttttcgccttcaatac

SEQ ID NO: 20160 - DNA, 22 bp, Artificial Sequence
  chemically synthesized
attcttttcgccttcaatacac

SEQ ID NO: 20161 - DNA, 22 bp, Artificial Sequence
  chemically synthesized
ttttcgccttcaatacacttaa

SEQ ID NO: 20162 - DNA, 22 bp, Artificial Sequence
  chemically synthesized
ttcgccttcaatacacttaatg

SEQ ID NO: 20163 - DNA, 22 bp, Artificial Sequence
  chemically synthesized
tcgccttcaatacacttaatga

SEQ ID NO: 20164 - DNA, 22 bp, Artificial Sequence
  chemically synthesized
cgccttcaatacacttaatgat

SEQ ID NO: 20165 - DNA, 22 bp, Artificial Sequence
  chemically synthesized
gccttcaatacacttaatgatt

SEQ ID NO: 20166 - DNA, 22 bp, Artificial Sequence
  chemically synthesized
caatacacttaatgatttaact

SEQ ID NO: 20167 - DNA, 22 bp, Artificial Sequence
  chemically synthesized
aatacacttaatgatttaactc

SEQ ID NO: 20168 - DNA, 22 bp, Artificial Sequence
  chemically synthesized
aatgatttaactccaccctcct

SEQ ID NO: 20169 - DNA, 22 bp, Artificial Sequence
  chemically synthesized
atgatttaactccaccctcctt

SEQ ID NO: 20170 - DNA, 22 bp, Artificial Sequence
  chemically synthesized
aactccaccctccttcaaaaga

SEQ ID NO: 20171 - DNA, 22 bp, Artificial Sequence
  chemically synthesized
actccaccctccttcaaaagaa

SEQ ID NO: 20172 - DNA, 22 bp, Artificial Sequence
  chemically synthesized
caccctccttcaaaagaaacag

SEQ ID NO: 20173 - DNA, 22 bp, Artificial Sequence
  chemically synthesized
cttcaaaagaaacagcatttcc

SEQ ID NO: 20174 - DNA, 22 bp, Artificial Sequence
  chemically synthesized
caaaagaaacagcatttcctac

SEQ ID NO: 20175 - DNA, 22 bp, Artificial Sequence
  chemically synthesized
aaaagaaacagcatttcctact

SEQ ID NO: 20176 - DNA, 22 bp, Artificial Sequence
  chemically synthesized
cctacttttatactgtctatat

SEQ ID NO: 20177 - DNA, 22 bp, Artificial Sequence
  chemically synthesized
ctacttttatactgtctatatg

SEQ ID NO: 20178 - DNA, 22 bp, Artificial Sequence
  chemically synthesized
cttttatactgtctatatgatt

SEQ ID NO: 20179 - DNA, 22 bp, Artificial Sequence
  chemically synthesized
ttatactgtctatatgattgat

SEQ ID NO: 20180 - DNA, 22 bp, Artificial Sequence
  chemically synthesized
tatactgtctatatgattgatt

SEQ ID NO: 20181 - DNA, 22 bp, Artificial Sequence
  chemically synthesized
atactgtctatatgattgattt

SEQ ID NO: 20182 - DNA, 22 bp, Artificial Sequence
  chemically synthesized
tactgtctatatgattgatttg

SEQ ID NO: 20183 - DNA, 22 bp, Artificial Sequence
  chemically synthesized
tctatatgattgatttgcacag

SEQ ID NO: 20184 - DNA, 22 bp, Artificial Sequence
  chemically synthesized
tatgattgatttgcacagctca

SEQ ID NO: 20185 - DNA, 22 bp, Artificial Sequence
  chemically synthesized
atttgcacagctcatctggcca

SEQ ID NO: 20186 - DNA, 22 bp, Artificial Sequence
  chemically synthesized
gcacagctcatctggccagaag

SEQ ID NO: 20187 - DNA, 22 bp, Artificial Sequence
  chemically synthesized
cacagctcatctggccagaaga

SEQ ID NO: 20188 - DNA, 22 bp, Artificial Sequence
  chemically synthesized
atctggccagaagagctgagac

SEQ ID NO: 20189 - DNA, 22 bp, Artificial Sequence
  chemically synthesized
gccagaagagctgagacatccg

SEQ ID NO: 20190 - DNA, 22 bp, Artificial Sequence
  chemically synthesized
agacatccgttcccctacaaga

SEQ ID NO: 20191 - DNA, 22 bp, Artificial Sequence
  chemically synthesized
cttgtaggggaacggatgtctc

SEQ ID NO: 20192 - DNA, 22 bp, Artificial Sequence
  chemically synthesized
ttgtaggggaacggatgtctca

SEQ ID NO: 20193 - DNA, 22 bp, Artificial Sequence
  chemically synthesized
gtaggggaacggatgtctcagc

SEQ ID NO: 20194 - DNA, 22 bp, Artificial Sequence
  chemically synthesized
taggggaacggatgtctcagct

SEQ ID NO: 20195 - DNA, 22 bp, Artificial Sequence
  chemically synthesized
agctcttctggccagatgagct

SEQ ID NO: 20196 - DNA, 22 bp, Artificial Sequence
  chemically synthesized
ttctggccagatgagctgtgca

SEQ ID NO: 20197 - DNA, 22 bp, Artificial Sequence
  chemically synthesized
ctggccagatgagctgtgcaaa

SEQ ID NO: 20198 - DNA, 22 bp, Artificial Sequence
  chemically synthesized
tggccagatgagctgtgcaaat

SEQ ID NO: 20199 - DNA, 22 bp, Artificial Sequence
  chemically synthesized
gccagatgagctgtgcaaatca

SEQ ID NO: 20200 - DNA, 22 bp, Artificial Sequence
  chemically synthesized
tgcaaatcaatcatatagacag

SEQ ID NO: 20201 - DNA, 22 bp, Artificial Sequence
  chemically synthesized
tttcttttgaaggagggtggag

SEQ ID NO: 20202 - DNA, 22 bp, Artificial Sequence
  chemically synthesized
cttttgaaggagggtggagtta

SEQ ID NO: 20203 - DNA, 22 bp, Artificial Sequence
  chemically synthesized
ttttgaaggagggtggagttaa

SEQ ID NO: 20204 - DNA, 22 bp, Artificial Sequence
  chemically synthesized
ttgaaggagggtggagttaaat

SEQ ID NO: 20205 - DNA, 22 bp, Artificial Sequence
  chemically synthesized
tgaaggagggtggagttaaatc

SEQ ID NO: 20206 - DNA, 22 bp, Artificial Sequence
  chemically synthesized
gaaggagggtggagttaaatca

SEQ ID NO: 20207 - DNA, 22 bp, Artificial Sequence
  chemically synthesized
aaggagggtggagttaaatcat

SEQ ID NO: 20208 - DNA, 22 bp, Artificial Sequence
  chemically synthesized
aatcattaagtgtattgaaggc

SEQ ID NO: 20209 - DNA, 22 bp, Artificial Sequence
  chemically synthesized
agtgtattgaaggcgaaaagaa

SEQ ID NO: 20210 - DNA, 22 bp, Artificial Sequence
  chemically synthesized
aaggcgaaaagaatcagagaac

SEQ ID NO: 20211 - DNA, 22 bp, Artificial Sequence
  chemically synthesized
ttctttttaagttgagcttaaa

SEQ ID NO: 20212 - DNA, 22 bp, Artificial Sequence
  chemically synthesized
ctttttaagttgagcttaaaat

SEQ ID NO: 20213 - DNA, 22 bp, Artificial Sequence
  chemically synthesized
tttttaagttgagcttaaaata

SEQ ID NO: 20214 - DNA, 22 bp, Artificial Sequence
  chemically synthesized
tttaagttgagcttaaaataag

SEQ ID NO: 20215 - DNA, 22 bp, Artificial Sequence
  chemically synthesized
ttaagttgagcttaaaataagc

SEQ ID NO: 20216 - DNA, 22 bp, Artificial Sequence
  chemically synthesized
taagttgagcttaaaataagct

SEQ ID NO: 20217 - DNA, 22 bp, Artificial Sequence
  chemically synthesized
aagttgagcttaaaataagcta

SEQ ID NO: 20218 - DNA, 22 bp, Artificial Sequence
  chemically synthesized
agttgagcttaaaataagctag

SEQ ID NO: 20219 - DNA, 22 bp, Artificial Sequence
  chemically synthesized
agcttaaaataagctagagaat

SEQ ID NO: 20220 - DNA, 22 bp, Artificial Sequence
  chemically synthesized
aaaataagctagagaatagatc

SEQ ID NO: 20221 - DNA, 22 bp, Artificial Sequence
  chemically synthesized
aaataagctagagaatagatct

SEQ ID NO: 20222 - DNA, 22 bp, Artificial Sequence
  chemically synthesized
gagaatagatctctggtctgaa

SEQ ID NO: 20223 - DNA, 22 bp, Artificial Sequence
  chemically synthesized
tggtctgaaggtttatttacgg

SEQ ID NO: 20224 - DNA, 22 bp, Artificial Sequence
  chemically synthesized
gtctgaaggtttatttacgggc

SEQ ID NO: 20225 - DNA, 22 bp, Artificial Sequence
  chemically synthesized
aaggtttatttacgggcttttc

SEQ ID NO: 20226 - DNA, 22 bp, Artificial Sequence
  chemically synthesized
atttacgggcttttctcactgg

SEQ ID NO: 20227 - DNA, 22 bp, Artificial Sequence
  chemically synthesized
tttacgggcttttctcactgga

SEQ ID NO: 20228 - DNA, 22 bp, Artificial Sequence
  chemically synthesized
acgggcttttctcactggatta

SEQ ID NO: 20229 - DNA, 22 bp, Artificial Sequence
  chemically synthesized
cgggcttttctcactggattat

SEQ ID NO: 20230 - DNA, 22 bp, Artificial Sequence
  chemically synthesized
ttctcactggattattttgttt

SEQ ID NO: 20231 - DNA, 22 bp, Artificial Sequence
  chemically synthesized
tctcactggattattttgtttt

SEQ ID NO: 20232 - DNA, 22 bp, Artificial Sequence
  chemically synthesized
ctcactggattattttgttttt

SEQ ID NO: 20233 - DNA, 22 bp, Artificial Sequence
  chemically synthesized
tcactggattattttgtttttg

SEQ ID NO: 20234 - DNA, 22 bp, Artificial Sequence
  chemically synthesized
actggattattttgtttttgtt

SEQ ID NO: 20235 - DNA, 22 bp, Artificial Sequence
  chemically synthesized
gattattttgtttttgttctct

SEQ ID NO: 20236 - DNA, 22 bp, Artificial Sequence
  chemically synthesized
ttttgtttttgttctctgctca

SEQ ID NO: 20237 - DNA, 22 bp, Artificial Sequence
  chemically synthesized
tgtttttgttctctgctcatcc

SEQ ID NO: 20238 - DNA, 22 bp, Artificial Sequence
  chemically synthesized
gtttttgttctctgctcatccc

SEQ ID NO: 20239 - DNA, 22 bp, Artificial Sequence
  chemically synthesized
tttttgttctctgctcatccca

SEQ ID NO: 20240 - DNA, 22 bp, Artificial Sequence
  chemically synthesized
ttgttctctgctcatcccacta

SEQ ID NO: 20241 - DNA, 22 bp, Artificial Sequence
  chemically synthesized
tgttctctgctcatcccactac

SEQ ID NO: 20242 - DNA, 22 bp, Artificial Sequence
  chemically synthesized
gttctctgctcatcccactaca

SEQ ID NO: 20243 - DNA, 22 bp, Artificial Sequence
  chemically synthesized
ttctctgctcatcccactacac

SEQ ID NO: 20244 - DNA, 22 bp, Artificial Sequence
  chemically synthesized
tctgctcatcccactacacaga

SEQ ID NO: 20245 - DNA, 22 bp, Artificial Sequence
  chemically synthesized
tgctcatcccactacacagaat

SEQ ID NO: 20246 - DNA, 22 bp, Artificial Sequence
  chemically synthesized
ctcatcccactacacagaatct

SEQ ID NO: 20247 - DNA, 22 bp, Artificial Sequence
  chemically synthesized
atcccactacacagaatctgtt

SEQ ID NO: 20248 - DNA, 22 bp, Artificial Sequence
  chemically synthesized
cacagaatctgttagaaaatat

SEQ ID NO: 20249 - DNA, 22 bp, Artificial Sequence
  chemically synthesized
ttagaaaatataaagaataaag

SEQ ID NO: 20250 - DNA, 22 bp, Artificial Sequence
  chemically synthesized
gaaaatataaagaataaaggat

SEQ ID NO: 20251 - DNA, 22 bp, Artificial Sequence
  chemically synthesized
gaagaacatttacattcatcta

SEQ ID NO: 20252 - DNA, 22 bp, Artificial Sequence
  chemically synthesized
acattcatctagtcaaaagccc

SEQ ID NO: 20253 - DNA, 22 bp, Artificial Sequence
  chemically synthesized
cattcatctagtcaaaagccca

SEQ ID NO: 20254 - DNA, 22 bp, Artificial Sequence
  chemically synthesized
atctagtcaaaagcccacattt

SEQ ID NO: 20255 - DNA, 22 bp, Artificial Sequence
  chemically synthesized
gtcaaaagcccacattttagta

SEQ ID NO: 20256 - DNA, 22 bp, Artificial Sequence
  chemically synthesized
tagtaaaagaaattactatcca

SEQ ID NO: 20257 - DNA, 22 bp, Artificial Sequence
  chemically synthesized
agtaaaagaaattactatccaa

SEQ ID NO: 20258 - DNA, 22 bp, Artificial Sequence
  chemically synthesized
gtaaaagaaattactatccaag

SEQ ID NO: 20259 - DNA, 22 bp, Artificial Sequence
  chemically synthesized
ctatccaagaagcaaatgattt

SEQ ID NO: 20260 - DNA, 22 bp, Artificial Sequence
  chemically synthesized
tccaagaagcaaatgatttgta

SEQ ID NO: 20261 - DNA, 22 bp, Artificial Sequence
  chemically synthesized
gtacaagatcacagggcttttc

SEQ ID NO: 20262 - DNA, 22 bp, Artificial Sequence
  chemically synthesized
tacaagatcacagggcttttca

SEQ ID NO: 20263 - DNA, 22 bp, Artificial Sequence
  chemically synthesized
ttcaacagtaaggctaaaaggt

SEQ ID NO: 20264 - DNA, 22 bp, Artificial Sequence
  chemically synthesized
tcaacagtaaggctaaaaggtt

SEQ ID NO: 20265 - DNA, 22 bp, Artificial Sequence
  chemically synthesized
caacagtaaggctaaaaggtta

SEQ ID NO: 20266 - DNA, 22 bp, Artificial Sequence
  chemically synthesized
aacagtaaggctaaaaggttaa

SEQ ID NO: 20267 - DNA, 22 bp, Artificial Sequence
  chemically synthesized
aaaggttaagaaaattctgatt

SEQ ID NO: 20268 - DNA, 22 bp, Artificial Sequence
  chemically synthesized
agaaaattctgattatcttaag

SEQ ID NO: 20269 - DNA, 22 bp, Artificial Sequence
  chemically synthesized
tgattatcttaagagttgctat

SEQ ID NO: 20270 - DNA, 22 bp, Artificial Sequence
  chemically synthesized
attatcttaagagttgctatta

SEQ ID NO: 20271 - DNA, 22 bp, Artificial Sequence
  chemically synthesized
tcttaagagttgctattaatta

SEQ ID NO: 20272 - DNA, 22 bp, Artificial Sequence
  chemically synthesized
aagagttgctattaattaaagc

SEQ ID NO: 20273 - DNA, 22 bp, Artificial Sequence
  chemically synthesized
agagttgctattaattaaagcc

SEQ ID NO: 20274 - DNA, 22 bp, Artificial Sequence
  chemically synthesized
ctattaattaaagccaacttaa

SEQ ID NO: 20275 - DNA, 22 bp, Artificial Sequence
  chemically synthesized
ttaattaaagccaacttaaacc

SEQ ID NO: 20276 - DNA, 22 bp, Artificial Sequence
  chemically synthesized
attaaagccaacttaaaccaac

SEQ ID NO: 20277 - DNA, 22 bp, Artificial Sequence
  chemically synthesized
aagccaacttaaaccaacttta

SEQ ID NO: 20278 - DNA, 22 bp, Artificial Sequence
  chemically synthesized
aaaccaactttaaatgtagagg

SEQ ID NO: 20279 - DNA, 22 bp, Artificial Sequence
  chemically synthesized
aaccaactttaaatgtagaggg

SEQ ID NO: 20280 - DNA, 22 bp, Artificial Sequence
  chemically synthesized
taaatgtagagggggatcctgg

SEQ ID NO: 20281 - DNA, 22 bp, Artificial Sequence
  chemically synthesized
aaatgtagagggggatcctgga

SEQ ID NO: 20282 - DNA, 22 bp, Artificial Sequence
  chemically synthesized
aatgtagagggggatcctggac

SEQ ID NO: 20283 - DNA, 22 bp, Artificial Sequence
  chemically synthesized
gacttcacattaaccctgtgtc

SEQ ID NO: 20284 - DNA, 22 bp, Artificial Sequence
  chemically synthesized
cacattaaccctgtgtcccctt

SEQ ID NO: 20285 - DNA, 22 bp, Artificial Sequence
  chemically synthesized
acattaaccctgtgtccccttt

SEQ ID NO: 20286 - DNA, 22 bp, Artificial Sequence
  chemically synthesized
accctgtgtcccctttttctcc

SEQ ID NO: 20287 - DNA, 22 bp, Artificial Sequence
  chemically synthesized
tgtcccctttttctccactctc

SEQ ID NO: 20288 - DNA, 22 bp, Artificial Sequence
  chemically synthesized
tttctccactctccccgtatcc

SEQ ID NO: 20289 - DNA, 22 bp, Artificial Sequence
  chemically synthesized
ttctccactctccccgtatccc

SEQ ID NO: 20290 - DNA, 22 bp, Artificial Sequence
  chemically synthesized
tctccactctccccgtatcccc

SEQ ID NO: 20291 - DNA, 22 bp, Artificial Sequence
  chemically synthesized
ctccactctccccgtatcccct

SEQ ID NO: 20292 - DNA, 22 bp, Artificial Sequence
  chemically synthesized
tccactctccccgtatccccta

SEQ ID NO: 20293 - DNA, 22 bp, Artificial Sequence
  chemically synthesized
cactctccccgtatcccctatc

SEQ ID NO: 20294 - DNA, 22 bp, Artificial Sequence
  chemically synthesized
tccccgtatcccctatcccacc

SEQ ID NO: 20295 - DNA, 22 bp, Artificial Sequence
  chemically synthesized
cccgtatcccctatcccacccc

SEQ ID NO: 20296 - DNA, 22 bp, Artificial Sequence
  chemically synthesized
tcccaccccaacccccacacag

SEQ ID NO: 20297 - DNA, 22 bp, Artificial Sequence
  chemically synthesized
accacccaatattattgttctc

SEQ ID NO: 20298 - DNA, 22 bp, Artificial Sequence
  chemically synthesized
ttgttctctgtaaacggaaaca

SEQ ID NO: 20299 - DNA, 22 bp, Artificial Sequence
  chemically synthesized
ttctctgtaaacggaaacaacc

SEQ ID NO: 20300 - DNA, 22 bp, Artificial Sequence
  chemically synthesized
tctgtaaacggaaacaacctgt

SEQ ID NO: 20301 - DNA, 22 bp, Artificial Sequence
  chemically synthesized
tgtaaacggaaacaacctgttg

SEQ ID NO: 20302 - DNA, 22 bp, Artificial Sequence
  chemically synthesized
taaacggaaacaacctgttgtc

SEQ ID NO: 20303 - DNA, 22 bp, Artificial Sequence
  chemically synthesized
ttgtctaaagagttttaactat

SEQ ID NO: 20304 - DNA, 22 bp, Artificial Sequence
  chemically synthesized
tctaaagagttttaactatggg

SEQ ID NO: 20305 - DNA, 22 bp, Artificial Sequence
  chemically synthesized
aagagttttaactatgggctca

SEQ ID NO: 20306 - DNA, 22 bp, Artificial Sequence
  chemically synthesized
taactatgggctcacgggtgag

SEQ ID NO: 20307 - DNA, 22 bp, Artificial Sequence
  chemically synthesized
aactatgggctcacgggtgagc

SEQ ID NO: 20308 - DNA, 22 bp, Artificial Sequence
  chemically synthesized
actatgggctcacgggtgagct

SEQ ID NO: 20309 - DNA, 22 bp, Artificial Sequence
  chemically synthesized
tgggctcacgggtgagctaaac

SEQ ID NO: 20310 - DNA, 22 bp, Artificial Sequence
  chemically synthesized
acgggtgagctaaacaggtttc

SEQ ID NO: 20311 - DNA, 22 bp, Artificial Sequence
  chemically synthesized
aacaggtttcccatctttttct

SEQ ID NO: 20312 - DNA, 22 bp, Artificial Sequence
  chemically synthesized
cccatctttttctggacccagg

SEQ ID NO: 20313 - DNA, 22 bp, Artificial Sequence
  chemically synthesized
ccatctttttctggacccagga

SEQ ID NO: 20314 - DNA, 22 bp, Artificial Sequence
  chemically synthesized
tttctggacccaggatcttagt

SEQ ID NO: 20315 - DNA, 22 bp, Artificial Sequence
  chemically synthesized
ttctggacccaggatcttagtg

SEQ ID NO: 20316 - DNA, 22 bp, Artificial Sequence
  chemically synthesized
tctggacccaggatcttagtgg

SEQ ID NO: 20317 - DNA, 22 bp, Artificial Sequence
  chemically synthesized
ctggacccaggatcttagtggg

SEQ ID NO: 20318 - DNA, 22 bp, Artificial Sequence
  chemically synthesized
tggacccaggatcttagtgggg

SEQ ID NO: 20319 - DNA, 22 bp, Artificial Sequence
  chemically synthesized
gacccaggatcttagtggggat

SEQ ID NO: 20320 - DNA, 22 bp, Artificial Sequence
  chemically synthesized
agtggggattttcactctgttc

SEQ ID NO: 20321 - DNA, 22 bp, Artificial Sequence
  chemically synthesized
gtggggattttcactctgttca

SEQ ID NO: 20322 - DNA, 22 bp, Artificial Sequence
  chemically synthesized
tcactctgttcactattttgtt

SEQ ID NO: 20323 - DNA, 22 bp, Artificial Sequence
  chemically synthesized
cactctgttcactattttgttg

SEQ ID NO: 20324 - DNA, 22 bp, Artificial Sequence
  chemically synthesized
actctgttcactattttgttgc

SEQ ID NO: 20325 - DNA, 22 bp, Artificial Sequence
  chemically synthesized
tgttcactattttgttgccctt

SEQ ID NO: 20326 - DNA, 22 bp, Artificial Sequence
  chemically synthesized
ttcactattttgttgcccttca

SEQ ID NO: 20327 - DNA, 22 bp, Artificial Sequence
  chemically synthesized
actattttgttgcccttcaaac

SEQ ID NO: 20328 - DNA, 22 bp, Artificial Sequence
  chemically synthesized
ttttgttgcccttcaaaccagt

SEQ ID NO: 20329 - DNA, 22 bp, Artificial Sequence
  chemically synthesized
tgttgcccttcaaaccagtaag

SEQ ID NO: 20330 - DNA, 22 bp, Artificial Sequence
  chemically synthesized
gttgcccttcaaaccagtaagc

SEQ ID NO: 20331 - DNA, 22 bp, Artificial Sequence
  chemically synthesized
ttgcccttcaaaccagtaagca

SEQ ID NO: 20332 - DNA, 22 bp, Artificial Sequence
  chemically synthesized
cccttcaaaccagtaagcattt

SEQ ID NO: 20333 - DNA, 22 bp, Artificial Sequence
  chemically synthesized
caaaccagtaagcatttatgag

SEQ ID NO: 20334 - DNA, 22 bp, Artificial Sequence
  chemically synthesized
aaaccagtaagcatttatgagg

SEQ ID NO: 20335 - DNA, 22 bp, Artificial Sequence
  chemically synthesized
atgaggactcacactatgccag

SEQ ID NO: 20336 - DNA, 22 bp, Artificial Sequence
  chemically synthesized
tgaggactcacactatgccaga

SEQ ID NO: 20337 - DNA, 22 bp, Artificial Sequence
  chemically synthesized
acactatgccagatacataggt

SEQ ID NO: 20338 - DNA, 22 bp, Artificial Sequence
  chemically synthesized
tgccagatacataggtggcagg

SEQ ID NO: 20339 - DNA, 22 bp, Artificial Sequence
  chemically synthesized
ttcactccagatataatctatc

SEQ ID NO: 20340 - DNA, 22 bp, Artificial Sequence
  chemically synthesized
cactccagatataatctatctg

SEQ ID NO: 20341 - DNA, 22 bp, Artificial Sequence
  chemically synthesized
actccagatataatctatctga

SEQ ID NO: 20342 - DNA, 20 bp, Artificial Sequence
  chemically synthesized
actttcacaatctgctagca

SEQ ID NO: 20343 - DNA, 20 bp, Artificial Sequence
  chemically synthesized
ctttcacaatctgctagcaa

SEQ ID NO: 20344 - DNA, 20 bp, Artificial Sequence
  chemically synthesized
atctgctagcaaaggttatg

SEQ ID NO: 20345 - DNA, 20 bp, Artificial Sequence
  chemically synthesized
gcagcgcgtgaacatgatca

SEQ ID NO: 20346 - DNA, 20 bp, Artificial Sequence
  chemically synthesized
gcgcgtgaacatgatcatgg

SEQ ID NO: 20347 - DNA, 20 bp, Artificial Sequence
  chemically synthesized
catgatcatggcagaatcac

SEQ ID NO: 20348 - DNA, 20 bp, Artificial Sequence
  chemically synthesized
atgatcatggcagaatcacc

SEQ ID NO: 20349 - DNA, 20 bp, Artificial Sequence
  chemically synthesized
cctcatcaccatctgccttt

SEQ ID NO: 20350 - DNA, 20 bp, Artificial Sequence
  chemically synthesized
ctcatcaccatctgcctttt

SEQ ID NO: 20351 - DNA, 20 bp, Artificial Sequence
  chemically synthesized
tgccttttaggatatctact

SEQ ID NO: 20352 - DNA, 20 bp, Artificial Sequence
  chemically synthesized
tctactcagtgctgaatgta

SEQ ID NO: 20353 - DNA, 20 bp, Artificial Sequence
  chemically synthesized
ctactcagtgctgaatgtac

SEQ ID NO: 20354 - DNA, 20 bp, Artificial Sequence
  chemically synthesized
ttccttttttaaaatacatt

SEQ ID NO: 20355 - DNA, 20 bp, Artificial Sequence
  chemically synthesized
cattgagtatgcttgccttt

SEQ ID NO: 20356 - DNA, 20 bp, Artificial Sequence
  chemically synthesized
gtatgcttgccttttagata

SEQ ID NO: 20357 - DNA, 20 bp, Artificial Sequence
  chemically synthesized
attttgattacatgatttga

SEQ ID NO: 20358 - DNA, 20 bp, Artificial Sequence
  chemically synthesized
atgatttgacagcaatattg

SEQ ID NO: 20359 - DNA, 20 bp, Artificial Sequence
  chemically synthesized
gatttgacagcaatattgaa

SEQ ID NO: 20360 - DNA, 20 bp, Artificial Sequence
  chemically synthesized
agcaatattgaagagtctaa

SEQ ID NO: 20361 - DNA, 20 bp, Artificial Sequence
  chemically synthesized
atattgaagagtctaacagc

SEQ ID NO: 20362 - DNA, 20 bp, Artificial Sequence
  chemically synthesized
agagtctaacagccagcacg

SEQ ID NO: 20363 - DNA, 20 bp, Artificial Sequence
  chemically synthesized
gagtctaacagccagcacgc

SEQ ID NO: 20364 - DNA, 20 bp, Artificial Sequence
  chemically synthesized
ctaacagccagcacgcaggt

SEQ ID NO: 20365 - DNA, 20 bp, Artificial Sequence
  chemically synthesized
cagccagcacgcaggttggt

SEQ ID NO: 20366 - DNA, 20 bp, Artificial Sequence
  chemically synthesized
gcacgcaggttggtaagtac

SEQ ID NO: 20367 - DNA, 20 bp, Artificial Sequence
  chemically synthesized
ggtaagtactggttctttgt

SEQ ID NO: 20368 - DNA, 20 bp, Artificial Sequence
  chemically synthesized
agtactggttctttgttagc

SEQ ID NO: 20369 - DNA, 20 bp, Artificial Sequence
  chemically synthesized
gtactggttctttgttagct

SEQ ID NO: 20370 - DNA, 20 bp, Artificial Sequence
  chemically synthesized
tcttcatttttaaaactaaa

SEQ ID NO: 20371 - DNA, 20 bp, Artificial Sequence
  chemically synthesized
tatgtttaataaacactgtt

SEQ ID NO: 20372 - DNA, 20 bp, Artificial Sequence
  chemically synthesized
acactgttcagttcatgatt

SEQ ID NO: 20373 - DNA, 20 bp, Artificial Sequence
  chemically synthesized
tttggtcatgtaattcctgt

SEQ ID NO: 20374 - DNA, 20 bp, Artificial Sequence
  chemically synthesized
ttagaaaacattcatctcct

SEQ ID NO: 20375 - DNA, 20 bp, Artificial Sequence
  chemically synthesized
ccttggtttaaaaaaattaa

SEQ ID NO: 20376 - DNA, 20 bp, Artificial Sequence
  chemically synthesized
tggtttaaaaaaattaaaag

SEQ ID NO: 20377 - DNA, 20 bp, Artificial Sequence
  chemically synthesized
ggtttaaaaaaattaaaagt

SEQ ID NO: 20378 - DNA, 20 bp, Artificial Sequence
  chemically synthesized
aaattaaaagtgggaaaaca

SEQ ID NO: 20379 - DNA, 20 bp, Artificial Sequence
  chemically synthesized
aaagtgggaaaacaaagaaa

SEQ ID NO: 20380 - DNA, 20 bp, Artificial Sequence
  chemically synthesized
gtgggaaaacaaagaaatag

SEQ ID NO: 20381 - DNA, 20 bp, Artificial Sequence
  chemically synthesized
aacaaagaaatagcagaata

SEQ ID NO: 20382 - DNA, 20 bp, Artificial Sequence
  chemically synthesized
ataaccacattatttttgtt

SEQ ID NO: 20383 - DNA, 20 bp, Artificial Sequence
  chemically synthesized
ttaccactttgaaatcaaaa

SEQ ID NO: 20384 - DNA, 20 bp, Artificial Sequence
  chemically synthesized
taccactttgaaatcaaaat

SEQ ID NO: 20385 - DNA, 20 bp, Artificial Sequence
  chemically synthesized
gaaatcaaaatgggaaacaa

SEQ ID NO: 20386 - DNA, 20 bp, Artificial Sequence
  chemically synthesized
ggaaacaaaagcacaaacaa

SEQ ID NO: 20387 - DNA, 20 bp, Artificial Sequence
  chemically synthesized
aatggccttatttacacaaa

SEQ ID NO: 20388 - DNA, 20 bp, Artificial Sequence
  chemically synthesized
tacacaaaaagtctgatttt

SEQ ID NO: 20389 - DNA, 20 bp, Artificial Sequence
  chemically synthesized
tttaagatatatgacatttc

SEQ ID NO: 20390 - DNA, 20 bp, Artificial Sequence
  chemically synthesized
ttaagatatatgacatttca

SEQ ID NO: 20391 - DNA, 20 bp, Artificial Sequence
  chemically synthesized
tatatgacatttcaaggttt

SEQ ID NO: 20392 - DNA, 20 bp, Artificial Sequence
  chemically synthesized
atgacatttcaaggtttcag

SEQ ID NO: 20393 - DNA, 20 bp, Artificial Sequence
  chemically synthesized
aggtttcagaagtatgtaat

SEQ ID NO: 20394 - DNA, 20 bp, Artificial Sequence
  chemically synthesized
ggtttcagaagtatgtaatg

SEQ ID NO: 20395 - DNA, 20 bp, Artificial Sequence
  chemically synthesized
aattatatatcttcaattta

SEQ ID NO: 20396 - DNA, 20 bp, Artificial Sequence
  chemically synthesized
atatcttcaatttaaagttt

SEQ ID NO: 20397 - DNA, 20 bp, Artificial Sequence
  chemically synthesized
aaagttttagttaaaacata

SEQ ID NO: 20398 - DNA, 20 bp, Artificial Sequence
  chemically synthesized
cataaagattaacctttcat

SEQ ID NO: 20399 - DNA, 20 bp, Artificial Sequence
  chemically synthesized
aagattaacctttcattagc

SEQ ID NO: 20400 - DNA, 20 bp, Artificial Sequence
  chemically synthesized
acctttcattagcaagctgt

SEQ ID NO: 20401 - DNA, 20 bp, Artificial Sequence
  chemically synthesized
caagctgttagttatcacca

SEQ ID NO: 20402 - DNA, 20 bp, Artificial Sequence
  chemically synthesized
gttatcaccaaagcttttca

SEQ ID NO: 20403 - DNA, 20 bp, Artificial Sequence
  chemically synthesized
caccaaagcttttcatggat

SEQ ID NO: 20404 - DNA, 20 bp, Artificial Sequence
  chemically synthesized
accaaagcttttcatggatt

SEQ ID NO: 20405 - DNA, 20 bp, Artificial Sequence
  chemically synthesized
tgtctctatgtcaaacatct

SEQ ID NO: 20406 - DNA, 20 bp, Artificial Sequence
  chemically synthesized
tctctatgtcaaacatcttg

SEQ ID NO: 20407 - DNA, 20 bp, Artificial Sequence
  chemically synthesized
aacatcttggagttgatatt

SEQ ID NO: 20408 - DNA, 20 bp, Artificial Sequence
  chemically synthesized
acatcttggagttgatattt

SEQ ID NO: 20409 - DNA, 20 bp, Artificial Sequence
  chemically synthesized
catcttggagttgatatttg

SEQ ID NO: 20410 - DNA, 20 bp, Artificial Sequence
  chemically synthesized
atttggggaaacacaatact

SEQ ID NO: 20411 - DNA, 20 bp, Artificial Sequence
  chemically synthesized
gggaaacacaatactcagtt

SEQ ID NO: 20412 - DNA, 20 bp, Artificial Sequence
  chemically synthesized
caatactcagttgagttccc

SEQ ID NO: 20413 - DNA, 20 bp, Artificial Sequence
  chemically synthesized
aatactcagttgagttccct

SEQ ID NO: 20414 - DNA, 20 bp, Artificial Sequence
  chemically synthesized
atactcagttgagttcccta

SEQ ID NO: 20415 - DNA, 20 bp, Artificial Sequence
  chemically synthesized
tactcagttgagttccctag

SEQ ID NO: 20416 - DNA, 20 bp, Artificial Sequence
  chemically synthesized
ctcagttgagttccctaggg

SEQ ID NO: 20417 - DNA, 20 bp, Artificial Sequence
  chemically synthesized
ttgagttccctaggggagaa

SEQ ID NO: 20418 - DNA, 20 bp, Artificial Sequence
  chemically synthesized
gttccctaggggagaaaagc

SEQ ID NO: 20419 - DNA, 20 bp, Artificial Sequence
  chemically synthesized
taggggagaaaagcaagctt

SEQ ID NO: 20420 - DNA, 20 bp, Artificial Sequence
  chemically synthesized
caagcttaagaattgacata

SEQ ID NO: 20421 - DNA, 20 bp, Artificial Sequence
  chemically synthesized
agcttaagaattgacataaa

SEQ ID NO: 20422 - DNA, 20 bp, Artificial Sequence
  chemically synthesized
ttaagaattgacataaagag

SEQ ID NO: 20423 - DNA, 20 bp, Artificial Sequence
  chemically synthesized
taagaattgacataaagagt

SEQ ID NO: 20424 - DNA, 20 bp, Artificial Sequence
  chemically synthesized
gaattgacataaagagtagg

SEQ ID NO: 20425 - DNA, 20 bp, Artificial Sequence
  chemically synthesized
tgacataaagagtaggaagt

SEQ ID NO: 20426 - DNA, 20 bp, Artificial Sequence
  chemically synthesized
actttgttttttcacaacta

SEQ ID NO: 20427 - DNA, 20 bp, Artificial Sequence
  chemically synthesized
cagtgactttatgtatttcc

SEQ ID NO: 20428 - DNA, 20 bp, Artificial Sequence
  chemically synthesized
gtgactttatgtatttccca

SEQ ID NO: 20429 - DNA, 20 bp, Artificial Sequence
  chemically synthesized
tgactttatgtatttcccag

SEQ ID NO: 20430 - DNA, 20 bp, Artificial Sequence
  chemically synthesized
ctttatgtatttcccagagg

SEQ ID NO: 20431 - DNA, 20 bp, Artificial Sequence
  chemically synthesized
tttatgtatttcccagagga

SEQ ID NO: 20432 - DNA, 20 bp, Artificial Sequence
  chemically synthesized
atttcccagaggaaggcata

SEQ ID NO: 20433 - DNA, 20 bp, Artificial Sequence
  chemically synthesized
tttcccagaggaaggcatac

SEQ ID NO: 20434 - DNA, 20 bp, Artificial Sequence
  chemically synthesized
ttcccagaggaaggcataca

SEQ ID NO: 20435 - DNA, 20 bp, Artificial Sequence
  chemically synthesized
ccagaggaaggcatacaggg

SEQ ID NO: 20436 - DNA, 20 bp, Artificial Sequence
  chemically synthesized
agggaagaaattatcccatt

SEQ ID NO: 20437 - DNA, 20 bp, Artificial Sequence
  chemically synthesized
aattatcccatttggacaaa

SEQ ID NO: 20438 - DNA, 20 bp, Artificial Sequence
  chemically synthesized
ggacaaacagcatgttctca

SEQ ID NO: 20439 - DNA, 20 bp, Artificial Sequence
  chemically synthesized
gacaaacagcatgttctcac

SEQ ID NO: 20440 - DNA, 20 bp, Artificial Sequence
  chemically synthesized
aaacagcatgttctcacagg

SEQ ID NO: 20441 - DNA, 20 bp, Artificial Sequence
  chemically synthesized
acacttacttgtcaactttc

SEQ ID NO: 20442 - DNA, 20 bp, Artificial Sequence
  chemically synthesized
caactttctagaatcaaatc

SEQ ID NO: 20443 - DNA, 20 bp, Artificial Sequence
  chemically synthesized
ctttctagaatcaaatctag

SEQ ID NO: 20444 - DNA, 20 bp, Artificial Sequence
  chemically synthesized
gaatcaaatctagtagctga

SEQ ID NO: 20445 - DNA, 20 bp, Artificial Sequence
  chemically synthesized
aatctagtagctgacagtac

SEQ ID NO: 20446 - DNA, 20 bp, Artificial Sequence
  chemically synthesized
atctagtagctgacagtacc

SEQ ID NO: 20447 - DNA, 20 bp, Artificial Sequence
  chemically synthesized
gtagctgacagtaccaggat

SEQ ID NO: 20448 - DNA, 20 bp, Artificial Sequence
  chemically synthesized
tagctgacagtaccaggatc

SEQ ID NO: 20449 - DNA, 20 bp, Artificial Sequence
  chemically synthesized
agctgacagtaccaggatca

SEQ ID NO: 20450 - DNA, 20 bp, Artificial Sequence
  chemically synthesized
gctgacagtaccaggatcag

SEQ ID NO: 20451 - DNA, 20 bp, Artificial Sequence
  chemically synthesized
ggatcaggggtgccaaccct

SEQ ID NO: 20452 - DNA, 20 bp, Artificial Sequence
  chemically synthesized
gtgccaaccctaagcacccc

SEQ ID NO: 20453 - DNA, 20 bp, Artificial Sequence
  chemically synthesized
caaccctaagcacccccaga

SEQ ID NO: 20454 - DNA, 20 bp, Artificial Sequence
  chemically synthesized
agcacccccagaaagctgac

SEQ ID NO: 20455 - DNA, 20 bp, Artificial Sequence
  chemically synthesized
cagaaagctgactggccctg

SEQ ID NO: 20456 - DNA, 20 bp, Artificial Sequence
  chemically synthesized
tggccctgtggttcccactc

SEQ ID NO: 20457 - DNA, 20 bp, Artificial Sequence
  chemically synthesized
tcccactccagacatgatgt

SEQ ID NO: 20458 - DNA, 20 bp, Artificial Sequence
  chemically synthesized
catgatgtcagctgtgaaat

SEQ ID NO: 20459 - DNA, 20 bp, Artificial Sequence
  chemically synthesized
aataacgataaaaaaaaata

SEQ ID NO: 20460 - DNA, 20 bp, Artificial Sequence
  chemically synthesized
taacgataaaaaaaaataca

SEQ ID NO: 20461 - DNA, 20 bp, Artificial Sequence
  chemically synthesized
aacgataaaaaaaaatacag

SEQ ID NO: 20462 - DNA, 20 bp, Artificial Sequence
  chemically synthesized
aaaaaatacagaggttaaac

SEQ ID NO: 20463 - DNA, 20 bp, Artificial Sequence
  chemically synthesized
atacagaggttaaactagca

SEQ ID NO: 20464 - DNA, 20 bp, Artificial Sequence
  chemically synthesized
agaggttaaactagcaaagt

SEQ ID NO: 20465 - DNA, 20 bp, Artificial Sequence
  chemically synthesized
ttaaactagcaaagtgagta

SEQ ID NO: 20466 - DNA, 20 bp, Artificial Sequence
  chemically synthesized
ctagcaaagtgagtaaagtc

SEQ ID NO: 20467 - DNA, 20 bp, Artificial Sequence
  chemically synthesized
tagcaaagtgagtaaagtca

SEQ ID NO: 20468 - DNA, 20 bp, Artificial Sequence
  chemically synthesized
agcaaagtgagtaaagtcaa

SEQ ID NO: 20469 - DNA, 20 bp, Artificial Sequence
  chemically synthesized
gtgagtaaagtcaagggata

SEQ ID NO: 20470 - DNA, 20 bp, Artificial Sequence
  chemically synthesized
aagggataaagaaaatttgt

SEQ ID NO: 20471 - DNA, 20 bp, Artificial Sequence
  chemically synthesized
aatttgttggaaaactcaca

SEQ ID NO: 20472 - DNA, 20 bp, Artificial Sequence
  chemically synthesized
ttgttggaaaactcacaaag

SEQ ID NO: 20473 - DNA, 20 bp, Artificial Sequence
  chemically synthesized
tgttggaaaactcacaaagc

SEQ ID NO: 20474 - DNA, 20 bp, Artificial Sequence
  chemically synthesized
aactcacaaagcaggacata

SEQ ID NO: 20475 - DNA, 20 bp, Artificial Sequence
  chemically synthesized
cacaaagcaggacataaagc

SEQ ID NO: 20476 - DNA, 20 bp, Artificial Sequence
  chemically synthesized
acaaagcaggacataaagca

SEQ ID NO: 20477 - DNA, 20 bp, Artificial Sequence
  chemically synthesized
aggacataaagcaaggccat

SEQ ID NO: 20478 - DNA, 20 bp, Artificial Sequence
  chemically synthesized
ggccattagatatatctcat

SEQ ID NO: 20479 - DNA, 20 bp, Artificial Sequence
  chemically synthesized
tatctcattagtgtgacatc

SEQ ID NO: 20480 - DNA, 20 bp, Artificial Sequence
  chemically synthesized
atctcattagtgtgacatct

SEQ ID NO: 20481 - DNA, 20 bp, Artificial Sequence
  chemically synthesized
ctcattagtgtgacatctgg

SEQ ID NO: 20482 - DNA, 20 bp, Artificial Sequence
  chemically synthesized
tcattagtgtgacatctggg

SEQ ID NO: 20483 - DNA, 20 bp, Artificial Sequence
  chemically synthesized
gtgtgacatctgggaggaca

SEQ ID NO: 20484 - DNA, 20 bp, Artificial Sequence
  chemically synthesized
ccaaaccctttcttctatat

SEQ ID NO: 20485 - DNA, 20 bp, Artificial Sequence
  chemically synthesized
aaccctttcttctatataag

SEQ ID NO: 20486 - DNA, 20 bp, Artificial Sequence
  chemically synthesized
ctttcttctatataagtggt

SEQ ID NO: 20487 - DNA, 20 bp, Artificial Sequence
  chemically synthesized
atataagtggtgagatgatg

SEQ ID NO: 20488 - DNA, 20 bp, Artificial Sequence
  chemically synthesized
tataagtggtgagatgatga

SEQ ID NO: 20489 - DNA, 20 bp, Artificial Sequence
  chemically synthesized
ggtgagatgatgaaggttgt

SEQ ID NO: 20490 - DNA, 20 bp, Artificial Sequence
  chemically synthesized
tgagatgatgaaggttgtaa

SEQ ID NO: 20491 - DNA, 20 bp, Artificial Sequence
  chemically synthesized
gagatgatgaaggttgtaag

SEQ ID NO: 20492 - DNA, 20 bp, Artificial Sequence
  chemically synthesized
agatgatgaaggttgtaaga

SEQ ID NO: 20493 - DNA, 20 bp, Artificial Sequence
  chemically synthesized
agagggcttctgcccccttg

SEQ ID NO: 20494 - DNA, 20 bp, Artificial Sequence
  chemically synthesized
ttctgcccccttgaagactt

SEQ ID NO: 20495 - DNA, 20 bp, Artificial Sequence
  chemically synthesized
cccttgaagacttcagatgc

SEQ ID NO: 20496 - DNA, 20 bp, Artificial Sequence
  chemically synthesized
ccttgaagacttcagatgct

SEQ ID NO: 20497 - DNA, 20 bp, Artificial Sequence
  chemically synthesized
cttgaagacttcagatgctg

SEQ ID NO: 20498 - DNA, 20 bp, Artificial Sequence
  chemically synthesized
aagacttcagatgctgggga

SEQ ID NO: 20499 - DNA, 20 bp, Artificial Sequence
  chemically synthesized
agacttcagatgctggggaa

SEQ ID NO: 20500 - DNA, 20 bp, Artificial Sequence
  chemically synthesized
ttcagatgctggggaaagga

SEQ ID NO: 20501 - DNA, 20 bp, Artificial Sequence
  chemically synthesized
atgctggggaaaggatagat

SEQ ID NO: 20502 - DNA, 20 bp, Artificial Sequence
  chemically synthesized
gggaaaggatagataagaat

SEQ ID NO: 20503 - DNA, 20 bp, Artificial Sequence
  chemically synthesized
ggaaaggatagataagaata

SEQ ID NO: 20504 - DNA, 20 bp, Artificial Sequence
  chemically synthesized
agataagaataaggatgaac

SEQ ID NO: 20505 - DNA, 20 bp, Artificial Sequence
  chemically synthesized
gataagaataaggatgaacc

SEQ ID NO: 20506 - DNA, 20 bp, Artificial Sequence
  chemically synthesized
ataaggatgaaccaggcttt

SEQ ID NO: 20507 - DNA, 20 bp, Artificial Sequence
  chemically synthesized
aaggatgaaccaggcttttg

SEQ ID NO: 20508 - DNA, 20 bp, Artificial Sequence
  chemically synthesized
tgaaccaggcttttggagcc

SEQ ID NO: 20509 - DNA, 20 bp, Artificial Sequence
  chemically synthesized
gaaccaggcttttggagcct

SEQ ID NO: 20510 - DNA, 20 bp, Artificial Sequence
  chemically synthesized
ggagcctgggaaataatgac

SEQ ID NO: 20511 - DNA, 20 bp, Artificial Sequence
  chemically synthesized
aatgactagcgataaacctg

SEQ ID NO: 20512 - DNA, 20 bp, Artificial Sequence
  chemically synthesized
atgactagcgataaacctga

SEQ ID NO: 20513 - DNA, 20 bp, Artificial Sequence
  chemically synthesized
tgactagcgataaacctgaa

SEQ ID NO: 20514 - DNA, 20 bp, Artificial Sequence
  chemically synthesized
ctagcgataaacctgaaggg

SEQ ID NO: 20515 - DNA, 20 bp, Artificial Sequence
  chemically synthesized
gataaacctgaagggaagtt

SEQ ID NO: 20516 - DNA, 20 bp, Artificial Sequence
  chemically synthesized
gaagttaagtatacgatccc

SEQ ID NO: 20517 - DNA, 20 bp, Artificial Sequence
  chemically synthesized
tacgatccccagataatact

SEQ ID NO: 20518 - DNA, 20 bp, Artificial Sequence
  chemically synthesized
acgatccccagataatacta

SEQ ID NO: 20519 - DNA, 20 bp, Artificial Sequence
  chemically synthesized
gatccccagataatactaag

SEQ ID NO: 20520 - DNA, 20 bp, Artificial Sequence
  chemically synthesized
cccagataatactaaggaga

SEQ ID NO: 20521 - DNA, 20 bp, Artificial Sequence
  chemically synthesized
ccagataatactaaggagaa

SEQ ID NO: 20522 - DNA, 20 bp, Artificial Sequence
  chemically synthesized
agaaaggcaatgtgattctg

SEQ ID NO: 20523 - DNA, 20 bp, Artificial Sequence
  chemically synthesized
atgtgattctgcagccattg

SEQ ID NO: 20524 - DNA, 20 bp, Artificial Sequence
  chemically synthesized
gattctgcagccattgtagc

SEQ ID NO: 20525 - DNA, 20 bp, Artificial Sequence
  chemically synthesized
ttctgcagccattgtagcca

SEQ ID NO: 20526 - DNA, 20 bp, Artificial Sequence
  chemically synthesized
ccattgtagccagagataat

SEQ ID NO: 20527 - DNA, 20 bp, Artificial Sequence
  chemically synthesized
gccagagataataagccctt

SEQ ID NO: 20528 - DNA, 20 bp, Artificial Sequence
  chemically synthesized
ccagagataataagcccttg

SEQ ID NO: 20529 - DNA, 20 bp, Artificial Sequence
  chemically synthesized
gagataataagcccttgagg

SEQ ID NO: 20530 - DNA, 20 bp, Artificial Sequence
  chemically synthesized
agataataagcccttgagga

SEQ ID NO: 20531 - DNA, 20 bp, Artificial Sequence
  chemically synthesized
gataataagcccttgaggaa

SEQ ID NO: 20532 - DNA, 20 bp, Artificial Sequence
  chemically synthesized
ataataagcccttgaggaag

SEQ ID NO: 20533 - DNA, 20 bp, Artificial Sequence
  chemically synthesized
taagcccttgaggaaggggc

SEQ ID NO: 20534 - DNA, 20 bp, Artificial Sequence
  chemically synthesized
aagcccttgaggaaggggcc

SEQ ID NO: 20535 - DNA, 20 bp, Artificial Sequence
  chemically synthesized
agcccttgaggaaggggcca

SEQ ID NO: 20536 - DNA, 20 bp, Artificial Sequence
  chemically synthesized
gcccttgaggaaggggccag

SEQ ID NO: 20537 - DNA, 20 bp, Artificial Sequence
  chemically synthesized
ggggccaggggaatttttct

SEQ ID NO: 20538 - DNA, 20 bp, Artificial Sequence
  chemically synthesized
gggccaggggaatttttcta

SEQ ID NO: 20539 - DNA, 20 bp, Artificial Sequence
  chemically synthesized
caggggaatttttctaagga

SEQ ID NO: 20540 - DNA, 20 bp, Artificial Sequence
  chemically synthesized
ggaatttttctaaggataga

SEQ ID NO: 20541 - DNA, 20 bp, Artificial Sequence
  chemically synthesized
aaggatagacagtattaatg

SEQ ID NO: 20542 - DNA, 20 bp, Artificial Sequence
  chemically synthesized
ttctgctattaaactctcat

SEQ ID NO: 20543 - DNA, 20 bp, Artificial Sequence
  chemically synthesized
aaactctcattggcttctaa

SEQ ID NO: 20544 - DNA, 20 bp, Artificial Sequence
  chemically synthesized
aactctcattggcttctaaa

SEQ ID NO: 20545 - DNA, 20 bp, Artificial Sequence
  chemically synthesized
ctctcattggcttctaaaag

SEQ ID NO: 20546 - DNA, 20 bp, Artificial Sequence
  chemically synthesized
ttggcttctaaaaggagttt

SEQ ID NO: 20547 - DNA, 20 bp, Artificial Sequence
  chemically synthesized
cttctaaaaggagtttcggt

SEQ ID NO: 20548 - DNA, 20 bp, Artificial Sequence
  chemically synthesized
gtttcggtgagtgatttgct

SEQ ID NO: 20549 - DNA, 20 bp, Artificial Sequence
  chemically synthesized
gctgagatgttgcattttca

SEQ ID NO: 20550 - DNA, 20 bp, Artificial Sequence
  chemically synthesized
attttcatggctgctgcctt

SEQ ID NO: 20551 - DNA, 20 bp, Artificial Sequence
  chemically synthesized
ttttcatggctgctgccttt

SEQ ID NO: 20552 - DNA, 20 bp, Artificial Sequence
  chemically synthesized
gcctttaggtattattgcaa

SEQ ID NO: 20553 - DNA, 20 bp, Artificial Sequence
  chemically synthesized
taggtattattgcaacagtt

SEQ ID NO: 20554 - DNA, 20 bp, Artificial Sequence
  chemically synthesized
ttggaattttgaaattaaaa

SEQ ID NO: 20555 - DNA, 20 bp, Artificial Sequence
  chemically synthesized
ttaaaacagttctgtaaaac

SEQ ID NO: 20556 - DNA, 20 bp, Artificial Sequence
  chemically synthesized
acagttctgtaaaaccagtt

SEQ ID NO: 20557 - DNA, 20 bp, Artificial Sequence
  chemically synthesized
aaaaccagtttagttttgta

SEQ ID NO: 20558 - DNA, 20 bp, Artificial Sequence
  chemically synthesized
tttgtaaagtgtatgcatca

SEQ ID NO: 20559 - DNA, 20 bp, Artificial Sequence
  chemically synthesized
catcaaagatgtccttcatt

SEQ ID NO: 20560 - DNA, 20 bp, Artificial Sequence
  chemically synthesized
tccttcattcagacattact

SEQ ID NO: 20561 - DNA, 20 bp, Artificial Sequence
  chemically synthesized
acattactgagttacaacta

SEQ ID NO: 20562 - DNA, 20 bp, Artificial Sequence
  chemically synthesized
ctgagttacaactatggtgc

SEQ ID NO: 20563 - DNA, 20 bp, Artificial Sequence
  chemically synthesized
tgagttacaactatggtgcc

SEQ ID NO: 20564 - DNA, 20 bp, Artificial Sequence
  chemically synthesized
tatggtgccaggtactgtgt

SEQ ID NO: 20565 - DNA, 20 bp, Artificial Sequence
  chemically synthesized
atggtgccaggtactgtgtc

SEQ ID NO: 20566 - DNA, 20 bp, Artificial Sequence
  chemically synthesized
tggtgccaggtactgtgtca

SEQ ID NO: 20567 - DNA, 20 bp, Artificial Sequence
  chemically synthesized
caggtactgtgtcagggtac

SEQ ID NO: 20568 - DNA, 20 bp, Artificial Sequence
  chemically synthesized
aggtactgtgtcagggtact

SEQ ID NO: 20569 - DNA, 20 bp, Artificial Sequence
  chemically synthesized
ggtactgtgtcagggtacta

SEQ ID NO: 20570 - DNA, 20 bp, Artificial Sequence
  chemically synthesized
gtactgtgtcagggtactag

SEQ ID NO: 20571 - DNA, 20 bp, Artificial Sequence
  chemically synthesized
gtgtcagggtactaggggta

SEQ ID NO: 20572 - DNA, 20 bp, Artificial Sequence
  chemically synthesized
tgtcagggtactaggggtat

SEQ ID NO: 20573 - DNA, 20 bp, Artificial Sequence
  chemically synthesized
gtcagggtactaggggtatg

SEQ ID NO: 20574 - DNA, 20 bp, Artificial Sequence
  chemically synthesized
ctaggggtatggggataaac

SEQ ID NO: 20575 - DNA, 20 bp, Artificial Sequence
  chemically synthesized
cagactccctctttgatcta

SEQ ID NO: 20576 - DNA, 20 bp, Artificial Sequence
  chemically synthesized
actccctctttgatctaaag

SEQ ID NO: 20577 - DNA, 20 bp, Artificial Sequence
  chemically synthesized
tctttgatctaaagcagcat

SEQ ID NO: 20578 - DNA, 20 bp, Artificial Sequence
  chemically synthesized
ctttgatctaaagcagcatg

SEQ ID NO: 20579 - DNA, 20 bp, Artificial Sequence
  chemically synthesized
gatctaaagcagcatgaggc

SEQ ID NO: 20580 - DNA, 20 bp, Artificial Sequence
  chemically synthesized
atctaaagcagcatgaggcc

SEQ ID NO: 20581 - DNA, 20 bp, Artificial Sequence
  chemically synthesized
aaagcagcatgaggccaggt

SEQ ID NO: 20582 - DNA, 20 bp, Artificial Sequence
  chemically synthesized
agcagcatgaggccaggtga

SEQ ID NO: 20583 - DNA, 20 bp, Artificial Sequence
  chemically synthesized
gcagcatgaggccaggtgag

SEQ ID NO: 20584 - DNA, 20 bp, Artificial Sequence
  chemically synthesized
taatgtgataaaatgtgcac

SEQ ID NO: 20585 - DNA, 20 bp, Artificial Sequence
  chemically synthesized
aatgtgataaaatgtgcact

SEQ ID NO: 20586 - DNA, 20 bp, Artificial Sequence
  chemically synthesized
taaaatgtgcactaggtact

SEQ ID NO: 20587 - DNA, 20 bp, Artificial Sequence
  chemically synthesized
aaaatgtgcactaggtacta

SEQ ID NO: 20588 - DNA, 20 bp, Artificial Sequence
  chemically synthesized
aaatgtgcactaggtactaa

SEQ ID NO: 20589 - DNA, 20 bp, Artificial Sequence
  chemically synthesized
cactaggtactaagggatca

SEQ ID NO: 20590 - DNA, 20 bp, Artificial Sequence
  chemically synthesized
ctaggtactaagggatcata

SEQ ID NO: 20591 - DNA, 20 bp, Artificial Sequence
  chemically synthesized
gtactaagggatcatagaga

SEQ ID NO: 20592 - DNA, 20 bp, Artificial Sequence
  chemically synthesized
tactaagggatcatagagaa

SEQ ID NO: 20593 - DNA, 20 bp, Artificial Sequence
  chemically synthesized
agagaaaggaacacattaaa

SEQ ID NO: 20594 - DNA, 20 bp, Artificial Sequence
  chemically synthesized
gagaaaggaacacattaaat

SEQ ID NO: 20595 - DNA, 20 bp, Artificial Sequence
  chemically synthesized
agaaaggaacacattaaatg

SEQ ID NO: 20596 - DNA, 20 bp, Artificial Sequence
  chemically synthesized
ttaaatggggaaacaattga

SEQ ID NO: 20597 - DNA, 20 bp, Artificial Sequence
  chemically synthesized
aaatggggaaacaattgata

SEQ ID NO: 20598 - DNA, 20 bp, Artificial Sequence
  chemically synthesized
atggggaaacaattgataga

SEQ ID NO: 20599 - DNA, 20 bp, Artificial Sequence
  chemically synthesized
ggggaaacaattgatagaga

SEQ ID NO: 20600 - DNA, 20 bp, Artificial Sequence
  chemically synthesized
agagagagaatattttcatc

SEQ ID NO: 20601 - DNA, 20 bp, Artificial Sequence
  chemically synthesized
gagagagaatattttcatct

SEQ ID NO: 20602 - DNA, 20 bp, Artificial Sequence
  chemically synthesized
tattttcatctgggtcttaa

SEQ ID NO: 20603 - DNA, 20 bp, Artificial Sequence
  chemically synthesized
tcatctgggtcttaaaagat

SEQ ID NO: 20604 - DNA, 20 bp, Artificial Sequence
  chemically synthesized
tctgggtcttaaaagatgag

SEQ ID NO: 20605 - DNA, 20 bp, Artificial Sequence
  chemically synthesized
ctgggtcttaaaagatgagt

SEQ ID NO: 20606 - DNA, 20 bp, Artificial Sequence
  chemically synthesized
tctctttaaatgtctgatat

SEQ ID NO: 20607 - DNA, 20 bp, Artificial Sequence
  chemically synthesized
ctctttaaatgtctgatata

SEQ ID NO: 20608 - DNA, 20 bp, Artificial Sequence
  chemically synthesized
tctttaaatgtctgatataa

SEQ ID NO: 20609 - DNA, 20 bp, Artificial Sequence
  chemically synthesized
atataagggcattttatgca

SEQ ID NO: 20610 - DNA, 20 bp, Artificial Sequence
  chemically synthesized
ataagggcattttatgcaaa

SEQ ID NO: 20611 - DNA, 20 bp, Artificial Sequence
  chemically synthesized
taagggcattttatgcaaag

SEQ ID NO: 20612 - DNA, 20 bp, Artificial Sequence
  chemically synthesized
caaagaggatcactcgtgca

SEQ ID NO: 20613 - DNA, 20 bp, Artificial Sequence
  chemically synthesized
ggatcactcgtgcaaagact

SEQ ID NO: 20614 - DNA, 20 bp, Artificial Sequence
  chemically synthesized
gtgcaaagactcagatttgc

SEQ ID NO: 20615 - DNA, 20 bp, Artificial Sequence
  chemically synthesized
actcagatttgcaagaacgt

SEQ ID NO: 20616 - DNA, 20 bp, Artificial Sequence
  chemically synthesized
ctcagatttgcaagaacgtg

SEQ ID NO: 20617 - DNA, 20 bp, Artificial Sequence
  chemically synthesized
tgcaagaacgtgaggtattt

SEQ ID NO: 20618 - DNA, 20 bp, Artificial Sequence
  chemically synthesized
gcaagaacgtgaggtatttc

SEQ ID NO: 20619 - DNA, 20 bp, Artificial Sequence
  chemically synthesized
aagaacgtgaggtatttcag

SEQ ID NO: 20620 - DNA, 20 bp, Artificial Sequence
  chemically synthesized
ggtatttcaggagttttgta

SEQ ID NO: 20621 - DNA, 20 bp, Artificial Sequence
  chemically synthesized
gagttttgtatggttccata

SEQ ID NO: 20622 - DNA, 20 bp, Artificial Sequence
  chemically synthesized
ggttccatatggactatgac

SEQ ID NO: 20623 - DNA, 20 bp, Artificial Sequence
  chemically synthesized
ccatatggactatgacaagt

SEQ ID NO: 20624 - DNA, 20 bp, Artificial Sequence
  chemically synthesized
atggactatgacaagtgaga

SEQ ID NO: 20625 - DNA, 20 bp, Artificial Sequence
  chemically synthesized
tggactatgacaagtgagac

SEQ ID NO: 20626 - DNA, 20 bp, Artificial Sequence
  chemically synthesized
gacaagtgagacaggtaaac

SEQ ID NO: 20627 - DNA, 20 bp, Artificial Sequence
  chemically synthesized
acaagtgagacaggtaaact

SEQ ID NO: 20628 - DNA, 20 bp, Artificial Sequence
  chemically synthesized
agtgagacaggtaaactagg

SEQ ID NO: 20629 - DNA, 20 bp, Artificial Sequence
  chemically synthesized
tgagacaggtaaactaggca

SEQ ID NO: 20630 - DNA, 20 bp, Artificial Sequence
  chemically synthesized
acaggtaaactaggcagagc

SEQ ID NO: 20631 - DNA, 20 bp, Artificial Sequence
  chemically synthesized
aactaggcagagctggtcat

SEQ ID NO: 20632 - DNA, 20 bp, Artificial Sequence
  chemically synthesized
gagctggtcatcagataatg

SEQ ID NO: 20633 - DNA, 20 bp, Artificial Sequence
  chemically synthesized
gataatgaagtcattaacct

SEQ ID NO: 20634 - DNA, 20 bp, Artificial Sequence
  chemically synthesized
ataatgaagtcattaaccta

SEQ ID NO: 20635 - DNA, 20 bp, Artificial Sequence
  chemically synthesized
aatgaagtcattaacctaag

SEQ ID NO: 20636 - DNA, 20 bp, Artificial Sequence
  chemically synthesized
agtcattaacctaaggagat

SEQ ID NO: 20637 - DNA, 20 bp, Artificial Sequence
  chemically synthesized
ttggacaataaaatgcaata

SEQ ID NO: 20638 - DNA, 20 bp, Artificial Sequence
  chemically synthesized
ggacaataaaatgcaatatg

SEQ ID NO: 20639 - DNA, 20 bp, Artificial Sequence
  chemically synthesized
gacaataaaatgcaatatgg

SEQ ID NO: 20640 - DNA, 20 bp, Artificial Sequence
  chemically synthesized
aatgcaatatggaggtatcg

SEQ ID NO: 20641 - DNA, 20 bp, Artificial Sequence
  chemically synthesized
aggtatcgaagtataaacat

SEQ ID NO: 20642 - DNA, 20 bp, Artificial Sequence
  chemically synthesized
ggtatcgaagtataaacata

SEQ ID NO: 20643 - DNA, 20 bp, Artificial Sequence
  chemically synthesized
tatcgaagtataaacataag

SEQ ID NO: 20644 - DNA, 20 bp, Artificial Sequence
  chemically synthesized
aacataaggagtaccactga

SEQ ID NO: 20645 - DNA, 20 bp, Artificial Sequence
  chemically synthesized
agtaccactgatggctgatt

SEQ ID NO: 20646 - DNA, 20 bp, Artificial Sequence
  chemically synthesized
gtaccactgatggctgattt

SEQ ID NO: 20647 - DNA, 20 bp, Artificial Sequence
  chemically synthesized
gatggctgatttaggatgcc

SEQ ID NO: 20648 - DNA, 20 bp, Artificial Sequence
  chemically synthesized
ctgatttaggatgcccagtc

SEQ ID NO: 20649 - DNA, 20 bp, Artificial Sequence
  chemically synthesized
gcaacacgctaatgaaatga

SEQ ID NO: 20650 - DNA, 20 bp, Artificial Sequence
  chemically synthesized
acacgctaatgaaatgatag

SEQ ID NO: 20651 - DNA, 20 bp, Artificial Sequence
  chemically synthesized
cacgctaatgaaatgatagt

SEQ ID NO: 20652 - DNA, 20 bp, Artificial Sequence
  chemically synthesized
acgctaatgaaatgatagtg

SEQ ID NO: 20653 - DNA, 20 bp, Artificial Sequence
  chemically synthesized
cgctaatgaaatgatagtgg

SEQ ID NO: 20654 - DNA, 20 bp, Artificial Sequence
  chemically synthesized
ctaatgaaatgatagtgggg

SEQ ID NO: 20655 - DNA, 20 bp, Artificial Sequence
  chemically synthesized
taatgaaatgatagtggggg

SEQ ID NO: 20656 - DNA, 20 bp, Artificial Sequence
  chemically synthesized
aatgaaatgatagtggggga

SEQ ID NO: 20657 - DNA, 20 bp, Artificial Sequence
  chemically synthesized
atgaaatgatagtgggggag

SEQ ID NO: 20658 - DNA, 20 bp, Artificial Sequence
  chemically synthesized
tgaaatgatagtgggggagg

SEQ ID NO: 20659 - DNA, 20 bp, Artificial Sequence
  chemically synthesized
gtgggggagggggccgtacc

SEQ ID NO: 20660 - DNA, 20 bp, Artificial Sequence
  chemically synthesized
ggagggggccgtaccaagac

SEQ ID NO: 20661 - DNA, 20 bp, Artificial Sequence
  chemically synthesized
gagggggccgtaccaagact

SEQ ID NO: 20662 - DNA, 20 bp, Artificial Sequence
  chemically synthesized
gggggccgtaccaagactag

SEQ ID NO: 20663 - DNA, 20 bp, Artificial Sequence
  chemically synthesized
gggccgtaccaagactagga

SEQ ID NO: 20664 - DNA, 20 bp, Artificial Sequence
  chemically synthesized
gccgtaccaagactaggaga

SEQ ID NO: 20665 - DNA, 20 bp, Artificial Sequence
  chemically synthesized
gtaccaagactaggagagag

SEQ ID NO: 20666 - DNA, 20 bp, Artificial Sequence
  chemically synthesized
gactaggagagagcagtcct

SEQ ID NO: 20667 - DNA, 20 bp, Artificial Sequence
  chemically synthesized
gagactattgcaattatctg

SEQ ID NO: 20668 - DNA, 20 bp, Artificial Sequence
  chemically synthesized
agactattgcaattatctgc

SEQ ID NO: 20669 - DNA, 20 bp, Artificial Sequence
  chemically synthesized
actattgcaattatctgcgg

SEQ ID NO: 20670 - DNA, 20 bp, Artificial Sequence
  chemically synthesized
aattatctgcgggagacata

SEQ ID NO: 20671 - DNA, 20 bp, Artificial Sequence
  chemically synthesized
attatctgcgggagacataa

SEQ ID NO: 20672 - DNA, 20 bp, Artificial Sequence
  chemically synthesized
tctgcgggagacataaaggc

SEQ ID NO: 20673 - DNA, 20 bp, Artificial Sequence
  chemically synthesized
cataaaggctagaacctgaa

SEQ ID NO: 20674 - DNA, 20 bp, Artificial Sequence
  chemically synthesized
aaaggctagaacctgaacag

SEQ ID NO: 20675 - DNA, 20 bp, Artificial Sequence
  chemically synthesized
ggctagaacctgaacagtag

SEQ ID NO: 20676 - DNA, 20 bp, Artificial Sequence
  chemically synthesized
gaacagtagcagtacaaaaa

SEQ ID NO: 20677 - DNA, 20 bp, Artificial Sequence
  chemically synthesized
acagtagcagtacaaaaaaa

SEQ ID NO: 20678 - DNA, 20 bp, Artificial Sequence
  chemically synthesized
cagtagcagtacaaaaaaag

SEQ ID NO: 20679 - DNA, 20 bp, Artificial Sequence
  chemically synthesized
agtagcagtacaaaaaaaga

SEQ ID NO: 20680 - DNA, 20 bp, Artificial Sequence
  chemically synthesized
gtagcagtacaaaaaaagag

SEQ ID NO: 20681 - DNA, 20 bp, Artificial Sequence
  chemically synthesized
agcagtacaaaaaaagaggg

SEQ ID NO: 20682 - DNA, 20 bp, Artificial Sequence
  chemically synthesized
aggggagttcaaatgatatt

SEQ ID NO: 20683 - DNA, 20 bp, Artificial Sequence
  chemically synthesized
ggggagttcaaatgatatta

SEQ ID NO: 20684 - DNA, 20 bp, Artificial Sequence
  chemically synthesized
gagttcaaatgatattaagg

SEQ ID NO: 20685 - DNA, 20 bp, Artificial Sequence
  chemically synthesized
ttcaaatgatattaaggaag

SEQ ID NO: 20686 - DNA, 20 bp, Artificial Sequence
  chemically synthesized
aaatgatattaaggaagtag

SEQ ID NO: 20687 - DNA, 20 bp, Artificial Sequence
  chemically synthesized
tgatattaaggaagtagaag

SEQ ID NO: 20688 - DNA, 20 bp, Artificial Sequence
  chemically synthesized
agtggtatgacttaaccatc

SEQ ID NO: 20689 - DNA, 20 bp, Artificial Sequence
  chemically synthesized
gtggtatgacttaaccatct

SEQ ID NO: 20690 - DNA, 20 bp, Artificial Sequence
  chemically synthesized
atgacttaaccatctgggta

SEQ ID NO: 20691 - DNA, 20 bp, Artificial Sequence
  chemically synthesized
acttaaccatctgggtatgg

SEQ ID NO: 20692 - DNA, 20 bp, Artificial Sequence
  chemically synthesized
cttaaccatctgggtatgga

SEQ ID NO: 20693 - DNA, 20 bp, Artificial Sequence
  chemically synthesized
ttaaccatctgggtatggaa

SEQ ID NO: 20694 - DNA, 20 bp, Artificial Sequence
  chemically synthesized
taaccatctgggtatggaag

SEQ ID NO: 20695 - DNA, 20 bp, Artificial Sequence
  chemically synthesized
tctgggtatggaaggggaaa

SEQ ID NO: 20696 - DNA, 20 bp, Artificial Sequence
  chemically synthesized
ggtatggaaggggaaatggc

SEQ ID NO: 20697 - DNA, 20 bp, Artificial Sequence
  chemically synthesized
tatggaaggggaaatggcta

SEQ ID NO: 20698 - DNA, 20 bp, Artificial Sequence
  chemically synthesized
aggggaaatggctagagtct

SEQ ID NO: 20699 - DNA, 20 bp, Artificial Sequence
  chemically synthesized
ggggaaatggctagagtctt

SEQ ID NO: 20700 - DNA, 20 bp, Artificial Sequence
  chemically synthesized
gggaaatggctagagtcttg

SEQ ID NO: 20701 - DNA, 20 bp, Artificial Sequence
  chemically synthesized
ctttgtgtttgatgtgatta

SEQ ID NO: 20702 - DNA, 20 bp, Artificial Sequence
  chemically synthesized
tttgatgtgattatggacca

SEQ ID NO: 20703 - DNA, 20 bp, Artificial Sequence
  chemically synthesized
tggaccacagaataatgtct

SEQ ID NO: 20704 - DNA, 20 bp, Artificial Sequence
  chemically synthesized
gaccacagaataatgtctaa

SEQ ID NO: 20705 - DNA, 20 bp, Artificial Sequence
  chemically synthesized
agaataatgtctaagagaac

SEQ ID NO: 20706 - DNA, 20 bp, Artificial Sequence
  chemically synthesized
gtctaagagaactggctctt

SEQ ID NO: 20707 - DNA, 20 bp, Artificial Sequence
  chemically synthesized
tggctctttagtctgactgc

SEQ ID NO: 20708 - DNA, 20 bp, Artificial Sequence
  chemically synthesized
gctctttagtctgactgcca

SEQ ID NO: 20709 - DNA, 20 bp, Artificial Sequence
  chemically synthesized
agtctgaatcctgaatgttt

SEQ ID NO: 20710 - DNA, 20 bp, Artificial Sequence
  chemically synthesized
aatgttttagtatgttacct

SEQ ID NO: 20711 - DNA, 20 bp, Artificial Sequence
  chemically synthesized
atgttttagtatgttacctt

SEQ ID NO: 20712 - DNA, 20 bp, Artificial Sequence
  chemically synthesized
ttagtatgttaccttgggca

SEQ ID NO: 20713 - DNA, 20 bp, Artificial Sequence
  chemically synthesized
gttaccttgggcaaagccct

SEQ ID NO: 20714 - DNA, 20 bp, Artificial Sequence
  chemically synthesized
tcttcctcattcataaaaat

SEQ ID NO: 20715 - DNA, 20 bp, Artificial Sequence
  chemically synthesized
cattcataaaaataagatga

SEQ ID NO: 20716 - DNA, 20 bp, Artificial Sequence
  chemically synthesized
agatgacagtgcctatctcg

SEQ ID NO: 20717 - DNA, 20 bp, Artificial Sequence
  chemically synthesized
gatgacagtgcctatctcgt

SEQ ID NO: 20718 - DNA, 20 bp, Artificial Sequence
  chemically synthesized
ctatctcgtgggacttttgt

SEQ ID NO: 20719 - DNA, 20 bp, Artificial Sequence
  chemically synthesized
tatctcgtgggacttttgtg

SEQ ID NO: 20720 - DNA, 20 bp, Artificial Sequence
  chemically synthesized
gtgggacttttgtgaggatg

SEQ ID NO: 20721 - DNA, 20 bp, Artificial Sequence
  chemically synthesized
gacttttgtgaggatgaagt

SEQ ID NO: 20722 - DNA, 20 bp, Artificial Sequence
  chemically synthesized
gtgaggatgaagtgagataa

SEQ ID NO: 20723 - DNA, 20 bp, Artificial Sequence
  chemically synthesized
gaagtgagataatggatgca

SEQ ID NO: 20724 - DNA, 20 bp, Artificial Sequence
  chemically synthesized
ataatggatgcaaagttact

SEQ ID NO: 20725 - DNA, 20 bp, Artificial Sequence
  chemically synthesized
ggatgcaaagttactgagca

SEQ ID NO: 20726 - DNA, 20 bp, Artificial Sequence
  chemically synthesized
actgagcacagtgtccaaca

SEQ ID NO: 20727 - DNA, 20 bp, Artificial Sequence
  chemically synthesized
gagcacagtgtccaacacag

SEQ ID NO: 20728 - DNA, 20 bp, Artificial Sequence
  chemically synthesized
cacagtgtccaacacagcag

SEQ ID NO: 20729 - DNA, 20 bp, Artificial Sequence
  chemically synthesized
cagaagcattacatatacat

SEQ ID NO: 20730 - DNA, 20 bp, Artificial Sequence
  chemically synthesized
acatatacattagctattac

SEQ ID NO: 20731 - DNA, 20 bp, Artificial Sequence
  chemically synthesized
actggctacattatgatata

SEQ ID NO: 20732 - DNA, 20 bp, Artificial Sequence
  chemically synthesized
gctacattatgatatacagt

SEQ ID NO: 20733 - DNA, 20 bp, Artificial Sequence
  chemically synthesized
ctacattatgatatacagtt

SEQ ID NO: 20734 - DNA, 20 bp, Artificial Sequence
  chemically synthesized
tacattatgatatacagtta

SEQ ID NO: 20735 - DNA, 20 bp, Artificial Sequence
  chemically synthesized
cattatgatatacagttagg

SEQ ID NO: 20736 - DNA, 20 bp, Artificial Sequence
  chemically synthesized
atgatatacagttagggagt

SEQ ID NO: 20737 - DNA, 20 bp, Artificial Sequence
  chemically synthesized
tatacagttagggagttgga

SEQ ID NO: 20738 - DNA, 20 bp, Artificial Sequence
  chemically synthesized
tggaaagataatctgaaatt

SEQ ID NO: 20739 - DNA, 20 bp, Artificial Sequence
  chemically synthesized
ggaaagataatctgaaattc

SEQ ID NO: 20740 - DNA, 20 bp, Artificial Sequence
  chemically synthesized
aaagataatctgaaattcag

SEQ ID NO: 20741 - DNA, 20 bp, Artificial Sequence
  chemically synthesized
tcaggagacgtatctgacta

SEQ ID NO: 20742 - DNA, 20 bp, Artificial Sequence
  chemically synthesized
caggagacgtatctgactat

SEQ ID NO: 20743 - DNA, 20 bp, Artificial Sequence
  chemically synthesized
agacgtatctgactataggt

SEQ ID NO: 20744 - DNA, 20 bp, Artificial Sequence
  chemically synthesized
tctgactataggtgagtatt

SEQ ID NO: 20745 - DNA, 20 bp, Artificial Sequence
  chemically synthesized
ggaactcattgttctgtaaa

SEQ ID NO: 20746 - DNA, 20 bp, Artificial Sequence
  chemically synthesized
actcattgttctgtaaacag

SEQ ID NO: 20747 - DNA, 20 bp, Artificial Sequence
  chemically synthesized
tgttctgtaaacagtagtta

SEQ ID NO: 20748 - DNA, 20 bp, Artificial Sequence
  chemically synthesized
agtagttacagccacgtgtg

SEQ ID NO: 20749 - DNA, 20 bp, Artificial Sequence
  chemically synthesized
gtagttacagccacgtgtgt

SEQ ID NO: 20750 - DNA, 20 bp, Artificial Sequence
  chemically synthesized
cagccacgtgtgtgggcatc

SEQ ID NO: 20751 - DNA, 20 bp, Artificial Sequence
  chemically synthesized
gccacgtgtgtgggcatctg

SEQ ID NO: 20752 - DNA, 20 bp, Artificial Sequence
  chemically synthesized
cacgtgtgtgggcatctgga

SEQ ID NO: 20753 - DNA, 20 bp, Artificial Sequence
  chemically synthesized
tgtgtgggcatctggagagt

SEQ ID NO: 20754 - DNA, 20 bp, Artificial Sequence
  chemically synthesized
gggcatctggagagtgagca

SEQ ID NO: 20755 - DNA, 20 bp, Artificial Sequence
  chemically synthesized
agcatggatattgtgatacc

SEQ ID NO: 20756 - DNA, 20 bp, Artificial Sequence
  chemically synthesized
ggatattgtgatacctagta

SEQ ID NO: 20757 - DNA, 20 bp, Artificial Sequence
  chemically synthesized
gtgatacctagtacagtgcc

SEQ ID NO: 20758 - DNA, 20 bp, Artificial Sequence
  chemically synthesized
atacctagtacagtgcctgg

SEQ ID NO: 20759 - DNA, 20 bp, Artificial Sequence
  chemically synthesized
cctagtacagtgcctggcag

SEQ ID NO: 20760 - DNA, 20 bp, Artificial Sequence
  chemically synthesized
agtacagtgcctggcagtag

SEQ ID NO: 20761 - DNA, 20 bp, Artificial Sequence
  chemically synthesized
ggcagtagtggttgtatgct

SEQ ID NO: 20762 - DNA, 20 bp, Artificial Sequence
  chemically synthesized
tgctcagtaaattttgttga

SEQ ID NO: 20763 - DNA, 20 bp, Artificial Sequence
  chemically synthesized
gctcagtaaattttgttgac

SEQ ID NO: 20764 - DNA, 20 bp, Artificial Sequence
  chemically synthesized
ctcagtaaattttgttgaca

SEQ ID NO: 20765 - DNA, 20 bp, Artificial Sequence
  chemically synthesized
gtaaattttgttgacagggt

SEQ ID NO: 20766 - DNA, 20 bp, Artificial Sequence
  chemically synthesized
taaattttgttgacagggtc

SEQ ID NO: 20767 - DNA, 20 bp, Artificial Sequence
  chemically synthesized
aaattttgttgacagggtca

SEQ ID NO: 20768 - DNA, 20 bp, Artificial Sequence
  chemically synthesized
tttgttgacagggtcagggc

SEQ ID NO: 20769 - DNA, 20 bp, Artificial Sequence
  chemically synthesized
tgacagggtcagggccggac

SEQ ID NO: 20770 - DNA, 20 bp, Artificial Sequence
  chemically synthesized
gtcagggccggactagactg

SEQ ID NO: 20771 - DNA, 20 bp, Artificial Sequence
  chemically synthesized
gggccggactagactgtggt

SEQ ID NO: 20772 - DNA, 20 bp, Artificial Sequence
  chemically synthesized
cggactagactgtggtaagc

SEQ ID NO: 20773 - DNA, 20 bp, Artificial Sequence
  chemically synthesized
ggactagactgtggtaagca

SEQ ID NO: 20774 - DNA, 20 bp, Artificial Sequence
  chemically synthesized
actgtggtaagcaaggcctg

SEQ ID NO: 20775 - DNA, 20 bp, Artificial Sequence
  chemically synthesized
ctgtggtaagcaaggcctgt

SEQ ID NO: 20776 - DNA, 20 bp, Artificial Sequence
  chemically synthesized
tgtggtaagcaaggcctgta

SEQ ID NO: 20777 - DNA, 20 bp, Artificial Sequence
  chemically synthesized
taaatatacttgtatgcccc

SEQ ID NO: 20778 - DNA, 20 bp, Artificial Sequence
  chemically synthesized
atatacttgtatgccccgag

SEQ ID NO: 20779 - DNA, 20 bp, Artificial Sequence
  chemically synthesized
acttgtatgccccgagaagt

SEQ ID NO: 20780 - DNA, 20 bp, Artificial Sequence
  chemically synthesized
cttgtatgccccgagaagtg

SEQ ID NO: 20781 - DNA, 20 bp, Artificial Sequence
  chemically synthesized
tgtgccctacatgccttgtt

SEQ ID NO: 20782 - DNA, 20 bp, Artificial Sequence
  chemically synthesized
tgtttggttcactcttgtcc

SEQ ID NO: 20783 - DNA, 20 bp, Artificial Sequence
  chemically synthesized
gttcactcttgtcccagccc

SEQ ID NO: 20784 - DNA, 20 bp, Artificial Sequence
  chemically synthesized
actcttgtcccagccctagc

SEQ ID NO: 20785 - DNA, 20 bp, Artificial Sequence
  chemically synthesized
cagccctagcaagtatatat

SEQ ID NO: 20786 - DNA, 20 bp, Artificial Sequence
  chemically synthesized
agccctagcaagtatatata

SEQ ID NO: 20787 - DNA, 20 bp, Artificial Sequence
  chemically synthesized
caagtatatataaggtgaaa

SEQ ID NO: 20788 - DNA, 20 bp, Artificial Sequence
  chemically synthesized
aagtatatataaggtgaaaa

SEQ ID NO: 20789 - DNA, 20 bp, Artificial Sequence
  chemically synthesized
atataaggtgaaaaaggaaa

SEQ ID NO: 20790 - DNA, 20 bp, Artificial Sequence
  chemically synthesized
aggtgaaaaaggaaaaagct

SEQ ID NO: 20791 - DNA, 20 bp, Artificial Sequence
  chemically synthesized
ggtgaaaaaggaaaaagctg

SEQ ID NO: 20792 - DNA, 20 bp, Artificial Sequence
  chemically synthesized
aaaaaggaaaaagctgaggc

SEQ ID NO: 20793 - DNA, 20 bp, Artificial Sequence
  chemically synthesized
aaaggaaaaagctgaggctg

SEQ ID NO: 20794 - DNA, 20 bp, Artificial Sequence
  chemically synthesized
aaaaagctgaggctggagcc

SEQ ID NO: 20795 - DNA, 20 bp, Artificial Sequence
  chemically synthesized
aaaagctgaggctggagcct

SEQ ID NO: 20796 - DNA, 20 bp, Artificial Sequence
  chemically synthesized
aagctgaggctggagcctgg

SEQ ID NO: 20797 - DNA, 20 bp, Artificial Sequence
  chemically synthesized
gctggagcctgggagaaccc

SEQ ID NO: 20798 - DNA, 20 bp, Artificial Sequence
  chemically synthesized
tgggagaaccctggacattt

SEQ ID NO: 20799 - DNA, 20 bp, Artificial Sequence
  chemically synthesized
gggagaaccctggacattta

SEQ ID NO: 20800 - DNA, 20 bp, Artificial Sequence
  chemically synthesized
ggagaaccctggacatttaa

SEQ ID NO: 20801 - DNA, 20 bp, Artificial Sequence
  chemically synthesized
ccctggacatttaagggcca

SEQ ID NO: 20802 - DNA, 20 bp, Artificial Sequence
  chemically synthesized
ctggacatttaagggccatg

SEQ ID NO: 20803 - DNA, 20 bp, Artificial Sequence
  chemically synthesized
ggacatttaagggccatgga

SEQ ID NO: 20804 - DNA, 20 bp, Artificial Sequence
  chemically synthesized
gacatttaagggccatggag

SEQ ID NO: 20805 - DNA, 20 bp, Artificial Sequence
  chemically synthesized
ttaagggccatggagaggaa

SEQ ID NO: 20806 - DNA, 20 bp, Artificial Sequence
  chemically synthesized
taagggccatggagaggaac

SEQ ID NO: 20807 - DNA, 20 bp, Artificial Sequence
  chemically synthesized
agggccatggagaggaacag

SEQ ID NO: 20808 - DNA, 20 bp, Artificial Sequence
  chemically synthesized
gaacaggagttaatcaattc

SEQ ID NO: 20809 - DNA, 20 bp, Artificial Sequence
  chemically synthesized
gagttaatcaattcaagtgc

SEQ ID NO: 20810 - DNA, 20 bp, Artificial Sequence
  chemically synthesized
taatcaattcaagtgctgga

SEQ ID NO: 20811 - DNA, 20 bp, Artificial Sequence
  chemically synthesized
ttcaagtgctggatggataa

SEQ ID NO: 20812 - DNA, 20 bp, Artificial Sequence
  chemically synthesized
tcaagtgctggatggataac

SEQ ID NO: 20813 - DNA, 20 bp, Artificial Sequence
  chemically synthesized
aagtgctggatggataacag

SEQ ID NO: 20814 - DNA, 20 bp, Artificial Sequence
  chemically synthesized
gctggatggataacaggagt

SEQ ID NO: 20815 - DNA, 20 bp, Artificial Sequence
  chemically synthesized
tggatggataacaggagtta

SEQ ID NO: 20816 - DNA, 20 bp, Artificial Sequence
  chemically synthesized
ggataacaggagttagagca

SEQ ID NO: 20817 - DNA, 20 bp, Artificial Sequence
  chemically synthesized
taacaggagttagagcaaag

SEQ ID NO: 20818 - DNA, 20 bp, Artificial Sequence
  chemically synthesized
aacaggagttagagcaaagc

SEQ ID NO: 20819 - DNA, 20 bp, Artificial Sequence
  chemically synthesized
acaggagttagagcaaagcg

SEQ ID NO: 20820 - DNA, 20 bp, Artificial Sequence
  chemically synthesized
gttagagcaaagcggggaac

SEQ ID NO: 20821 - DNA, 20 bp, Artificial Sequence
  chemically synthesized
agcaaagcggggaaccagaa

SEQ ID NO: 20822 - DNA, 20 bp, Artificial Sequence
  chemically synthesized
caaagcggggaaccagaata

SEQ ID NO: 20823 - DNA, 20 bp, Artificial Sequence
  chemically synthesized
aatagagtgattattataaa

SEQ ID NO: 20824 - DNA, 20 bp, Artificial Sequence
  chemically synthesized
tagagtgattattataaaaa

SEQ ID NO: 20825 - DNA, 20 bp, Artificial Sequence
  chemically synthesized
tataaaaagagtttcctaaa

SEQ ID NO: 20826 - DNA, 20 bp, Artificial Sequence
  chemically synthesized
ataaaaagagtttcctaaaa

SEQ ID NO: 20827 - DNA, 20 bp, Artificial Sequence
  chemically synthesized
taaaaagagtttcctaaaaa

SEQ ID NO: 20828 - DNA, 20 bp, Artificial Sequence
  chemically synthesized
aaaagagtttcctaaaaagg

SEQ ID NO: 20829 - DNA, 20 bp, Artificial Sequence
  chemically synthesized
aagagtttcctaaaaaggga

SEQ ID NO: 20830 - DNA, 20 bp, Artificial Sequence
  chemically synthesized
aaaagggagagatcaacaat

SEQ ID NO: 20831 - DNA, 20 bp, Artificial Sequence
  chemically synthesized
atcaacaattagaaattatt

SEQ ID NO: 20832 - DNA, 20 bp, Artificial Sequence
  chemically synthesized
caacaattagaaattattta

SEQ ID NO: 20833 - DNA, 20 bp, Artificial Sequence
  chemically synthesized
caattagaaattatttagag

SEQ ID NO: 20834 - DNA, 20 bp, Artificial Sequence
  chemically synthesized
tagaaattatttagagcagc

SEQ ID NO: 20835 - DNA, 20 bp, Artificial Sequence
  chemically synthesized
ataaactcaaaattattctt

SEQ ID NO: 20836 - DNA, 20 bp, Artificial Sequence
  chemically synthesized
taaactcaaaattattcttt

SEQ ID NO: 20837 - DNA, 20 bp, Artificial Sequence
  chemically synthesized
gtcattcctgattgtgacaa

SEQ ID NO: 20838 - DNA, 20 bp, Artificial Sequence
  chemically synthesized
ttcattatataaatgtgatt

SEQ ID NO: 20839 - DNA, 20 bp, Artificial Sequence
  chemically synthesized
tcattatataaatgtgatta

SEQ ID NO: 20840 - DNA, 20 bp, Artificial Sequence
  chemically synthesized
ttatataaatgtgattaagg

SEQ ID NO: 20841 - DNA, 20 bp, Artificial Sequence
  chemically synthesized
tatataaatgtgattaagga

SEQ ID NO: 20842 - DNA, 20 bp, Artificial Sequence
  chemically synthesized
aaatgtgattaaggaaggaa

SEQ ID NO: 20843 - DNA, 20 bp, Artificial Sequence
  chemically synthesized
atgtgattaaggaaggaaaa

SEQ ID NO: 20844 - DNA, 20 bp, Artificial Sequence
  chemically synthesized
aaggaaggaaaagagctaca

SEQ ID NO: 20845 - DNA, 20 bp, Artificial Sequence
  chemically synthesized
gaaggaaaagagctacacag

SEQ ID NO: 20846 - DNA, 20 bp, Artificial Sequence
  chemically synthesized
gagctacacagaagttatta

SEQ ID NO: 20847 - DNA, 20 bp, Artificial Sequence
  chemically synthesized
gctacacagaagttattaaa

SEQ ID NO: 20848 - DNA, 20 bp, Artificial Sequence
  chemically synthesized
cagaagttattaaagagcta

SEQ ID NO: 20849 - DNA, 20 bp, Artificial Sequence
  chemically synthesized
gaagttattaaagagctaaa

SEQ ID NO: 20850 - DNA, 20 bp, Artificial Sequence
  chemically synthesized
ttaaagagctaaagagaatt

SEQ ID NO: 20851 - DNA, 20 bp, Artificial Sequence
  chemically synthesized
gagaattgagaaatttaaaa

SEQ ID NO: 20852 - DNA, 20 bp, Artificial Sequence
  chemically synthesized
aattgagaaatttaaaacag

SEQ ID NO: 20853 - DNA, 20 bp, Artificial Sequence
  chemically synthesized
gagaaatttaaaacagaaga

SEQ ID NO: 20854 - DNA, 20 bp, Artificial Sequence
  chemically synthesized
aaatttaaaacagaagaaag

SEQ ID NO: 20855 - DNA, 20 bp, Artificial Sequence
  chemically synthesized
aatttaaaacagaagaaagt

SEQ ID NO: 20856 - DNA, 20 bp, Artificial Sequence
  chemically synthesized
atttaaaacagaagaaagta

SEQ ID NO: 20857 - DNA, 20 bp, Artificial Sequence
  chemically synthesized
agaaagtagggccaacatga

SEQ ID NO: 20858 - DNA, 20 bp, Artificial Sequence
  chemically synthesized
gaaagtagggccaacatgaa

SEQ ID NO: 20859 - DNA, 20 bp, Artificial Sequence
  chemically synthesized
aagtagggccaacatgaaag

SEQ ID NO: 20860 - DNA, 20 bp, Artificial Sequence
  chemically synthesized
tagggccaacatgaaaggag

SEQ ID NO: 20861 - DNA, 20 bp, Artificial Sequence
  chemically synthesized
agggccaacatgaaaggagt

SEQ ID NO: 20862 - DNA, 20 bp, Artificial Sequence
  chemically synthesized
gggccaacatgaaaggagta

SEQ ID NO: 20863 - DNA, 20 bp, Artificial Sequence
  chemically synthesized
gccaacatgaaaggagtagg

SEQ ID NO: 20864 - DNA, 20 bp, Artificial Sequence
  chemically synthesized
atgaaaggagtagggagaaa

SEQ ID NO: 20865 - DNA, 20 bp, Artificial Sequence
  chemically synthesized
gaaaggagtagggagaaaaa

SEQ ID NO: 20866 - DNA, 20 bp, Artificial Sequence
  chemically synthesized
tagggagaaaaagagataac

SEQ ID NO: 20867 - DNA, 20 bp, Artificial Sequence
  chemically synthesized
ctgatcctgccaacacctgt

SEQ ID NO: 20868 - DNA, 20 bp, Artificial Sequence
  chemically synthesized
tcctgccaacacctgtgaga

SEQ ID NO: 20869 - DNA, 20 bp, Artificial Sequence
  chemically synthesized
aacctaatttacatttgaca

SEQ ID NO: 20870 - DNA, 20 bp, Artificial Sequence
  chemically synthesized
aatttacatttgacaaagtt

SEQ ID NO: 20871 - DNA, 20 bp, Artificial Sequence
  chemically synthesized
atttacatttgacaaagtta

SEQ ID NO: 20872 - DNA, 20 bp, Artificial Sequence
  chemically synthesized
catttgacaaagttaaggtt

SEQ ID NO: 20873 - DNA, 20 bp, Artificial Sequence
  chemically synthesized
tttgacaaagttaaggttca

SEQ ID NO: 20874 - DNA, 20 bp, Artificial Sequence
  chemically synthesized
agagcttgtgtgacttgtcc

SEQ ID NO: 20875 - DNA, 20 bp, Artificial Sequence
  chemically synthesized
gagcttgtgtgacttgtcca

SEQ ID NO: 20876 - DNA, 20 bp, Artificial Sequence
  chemically synthesized
gtgtgacttgtccaaggtca

SEQ ID NO: 20877 - DNA, 20 bp, Artificial Sequence
  chemically synthesized
tgtgacttgtccaaggtcac

SEQ ID NO: 20878 - DNA, 20 bp, Artificial Sequence
  chemically synthesized
cttgtccaaggtcacaggtc

SEQ ID NO: 20879 - DNA, 20 bp, Artificial Sequence
  chemically synthesized
tgtccaaggtcacaggtcta

SEQ ID NO: 20880 - DNA, 20 bp, Artificial Sequence
  chemically synthesized
gtccaaggtcacaggtctag

SEQ ID NO: 20881 - DNA, 20 bp, Artificial Sequence
  chemically synthesized
ccaaggtcacaggtctagag

SEQ ID NO: 20882 - DNA, 20 bp, Artificial Sequence
  chemically synthesized
caaggtcacaggtctagagg

SEQ ID NO: 20883 - DNA, 20 bp, Artificial Sequence
  chemically synthesized
ggtcacaggtctagaggagg

SEQ ID NO: 20884 - DNA, 20 bp, Artificial Sequence
  chemically synthesized
ttctgtctgatctgattcta

SEQ ID NO: 20885 - DNA, 20 bp, Artificial Sequence
  chemically synthesized
tttcactcaaccacactgta

SEQ ID NO: 20886 - DNA, 20 bp, Artificial Sequence
  chemically synthesized
actcaaccacactgtacagt

SEQ ID NO: 20887 - DNA, 20 bp, Artificial Sequence
  chemically synthesized
gtacagtcagctctccttgt

SEQ ID NO: 20888 - DNA, 20 bp, Artificial Sequence
  chemically synthesized
agctctccttgtgagttcca

SEQ ID NO: 20889 - DNA, 20 bp, Artificial Sequence
  chemically synthesized
ccttgtgagttccacagcca

SEQ ID NO: 20890 - DNA, 20 bp, Artificial Sequence
  chemically synthesized
gccacagattcaattaactg

SEQ ID NO: 20891 - DNA, 20 bp, Artificial Sequence
  chemically synthesized
actgcagatcaaaaatattc

SEQ ID NO: 20892 - DNA, 20 bp, Artificial Sequence
  chemically synthesized
aaaaatattcaagaaaaaaa

SEQ ID NO: 20893 - DNA, 20 bp, Artificial Sequence
  chemically synthesized
atattcaagaaaaaaatgga

SEQ ID NO: 20894 - DNA, 20 bp, Artificial Sequence
  chemically synthesized
gcatctctactgaacatgta

SEQ ID NO: 20895 - DNA, 20 bp, Artificial Sequence
  chemically synthesized
tcattattccctaaacaata

SEQ ID NO: 20896 - DNA, 20 bp, Artificial Sequence
  chemically synthesized
cagcataacaactatttaca

SEQ ID NO: 20897 - DNA, 20 bp, Artificial Sequence
  chemically synthesized
acatagcatttacattgtat

SEQ ID NO: 20898 - DNA, 20 bp, Artificial Sequence
  chemically synthesized
tttacattgtattagctatt

SEQ ID NO: 20899 - DNA, 20 bp, Artificial Sequence
  chemically synthesized
tacattgtattagctattaa

SEQ ID NO: 20900 - DNA, 20 bp, Artificial Sequence
  chemically synthesized
attagctattaagagaaacc

SEQ ID NO: 20901 - DNA, 20 bp, Artificial Sequence
  chemically synthesized
tagctattaagagaaaccta

SEQ ID NO: 20902 - DNA, 20 bp, Artificial Sequence
  chemically synthesized
agaaacctagagatgattta

SEQ ID NO: 20903 - DNA, 20 bp, Artificial Sequence
  chemically synthesized
tagagatgatttaaagtaca

SEQ ID NO: 20904 - DNA, 20 bp, Artificial Sequence
  chemically synthesized
agagatgatttaaagtacaa

SEQ ID NO: 20905 - DNA, 20 bp, Artificial Sequence
  chemically synthesized
agatgatttaaagtacaaag

SEQ ID NO: 20906 - DNA, 20 bp, Artificial Sequence
  chemically synthesized
gatgatttaaagtacaaagg

SEQ ID NO: 20907 - DNA, 20 bp, Artificial Sequence
  chemically synthesized
agtacaaaggaggatgtgtt

SEQ ID NO: 20908 - DNA, 20 bp, Artificial Sequence
  chemically synthesized
gtacaaaggaggatgtgttt

SEQ ID NO: 20909 - DNA, 20 bp, Artificial Sequence
  chemically synthesized
gtgtttaggttatatgcaaa

SEQ ID NO: 20910 - DNA, 20 bp, Artificial Sequence
  chemically synthesized
ttaggttatatgcaaatagt

SEQ ID NO: 20911 - DNA, 20 bp, Artificial Sequence
  chemically synthesized
atagtaagccatttttatat

SEQ ID NO: 20912 - DNA, 20 bp, Artificial Sequence
  chemically synthesized
agtaagccatttttatatcg

SEQ ID NO: 20913 - DNA, 20 bp, Artificial Sequence
  chemically synthesized
catttttatatcggagactt

SEQ ID NO: 20914 - DNA, 20 bp, Artificial Sequence
  chemically synthesized
atcggagacttgagcatcca

SEQ ID NO: 20915 - DNA, 20 bp, Artificial Sequence
  chemically synthesized
tccacagatcttgatatttg

SEQ ID NO: 20916 - DNA, 20 bp, Artificial Sequence
  chemically synthesized
ccacagatcttgatatttgc

SEQ ID NO: 20917 - DNA, 20 bp, Artificial Sequence
  chemically synthesized
cacagatcttgatatttgca

SEQ ID NO: 20918 - DNA, 20 bp, Artificial Sequence
  chemically synthesized
acagatcttgatatttgcag

SEQ ID NO: 20919 - DNA, 20 bp, Artificial Sequence
  chemically synthesized
cagatcttgatatttgcagg

SEQ ID NO: 20920 - DNA, 20 bp, Artificial Sequence
  chemically synthesized
gtcttgccaccaattttcca

SEQ ID NO: 20921 - DNA, 20 bp, Artificial Sequence
  chemically synthesized
accaattttccatggatact

SEQ ID NO: 20922 - DNA, 20 bp, Artificial Sequence
  chemically synthesized
ccaattttccatggatactg

SEQ ID NO: 20923 - DNA, 20 bp, Artificial Sequence
  chemically synthesized
tactgaggaacgactgtaaa

SEQ ID NO: 20924 - DNA, 20 bp, Artificial Sequence
  chemically synthesized
ggaacgactgtaaatggatg

SEQ ID NO: 20925 - DNA, 20 bp, Artificial Sequence
  chemically synthesized
gaacgactgtaaatggatgc

SEQ ID NO: 20926 - DNA, 20 bp, Artificial Sequence
  chemically synthesized
actgtaaatggatgcaggca

SEQ ID NO: 20927 - DNA, 20 bp, Artificial Sequence
  chemically synthesized
atgcaggcatggatgctatt

SEQ ID NO: 20928 - DNA, 20 bp, Artificial Sequence
  chemically synthesized
tgcaggcatggatgctattt

SEQ ID NO: 20929 - DNA, 20 bp, Artificial Sequence
  chemically synthesized
caggcatggatgctatttag

SEQ ID NO: 20930 - DNA, 20 bp, Artificial Sequence
  chemically synthesized
ggatgctatttaggagtgtc

SEQ ID NO: 20931 - DNA, 20 bp, Artificial Sequence
  chemically synthesized
gatgctatttaggagtgtcc

SEQ ID NO: 20932 - DNA, 20 bp, Artificial Sequence
  chemically synthesized
atgctatttaggagtgtcca

SEQ ID NO: 20933 - DNA, 20 bp, Artificial Sequence
  chemically synthesized
atttaggagtgtccagggcc

SEQ ID NO: 20934 - DNA, 20 bp, Artificial Sequence
  chemically synthesized
gtgtccagggccaagtaaat

SEQ ID NO: 20935 - DNA, 20 bp, Artificial Sequence
  chemically synthesized
ggccaagtaaatgagttgct

SEQ ID NO: 20936 - DNA, 20 bp, Artificial Sequence
  chemically synthesized
caagtaaatgagttgctgag

SEQ ID NO: 20937 - DNA, 20 bp, Artificial Sequence
  chemically synthesized
agtaaatgagttgctgagca

SEQ ID NO: 20938 - DNA, 20 bp, Artificial Sequence
  chemically synthesized
taaatgagttgctgagcaga

SEQ ID NO: 20939 - DNA, 20 bp, Artificial Sequence
  chemically synthesized
aaatgagttgctgagcagag

SEQ ID NO: 20940 - DNA, 20 bp, Artificial Sequence
  chemically synthesized
tgagttgctgagcagagagg

SEQ ID NO: 20941 - DNA, 20 bp, Artificial Sequence
  chemically synthesized
gagttgctgagcagagaggt

SEQ ID NO: 20942 - DNA, 20 bp, Artificial Sequence
  chemically synthesized
ttgctgagcagagaggtggg

SEQ ID NO: 20943 - DNA, 20 bp, Artificial Sequence
  chemically synthesized
gctgagcagagaggtgggtg

SEQ ID NO: 20944 - DNA, 20 bp, Artificial Sequence
  chemically synthesized
ctgagcagagaggtgggtgg

SEQ ID NO: 20945 - DNA, 20 bp, Artificial Sequence
  chemically synthesized
gagaggtgggtggaggctgt

SEQ ID NO: 20946 - DNA, 20 bp, Artificial Sequence
  chemically synthesized
agaggtgggtggaggctgtg

SEQ ID NO: 20947 - DNA, 20 bp, Artificial Sequence
  chemically synthesized
ggctgtgaggcatcaatatg

SEQ ID NO: 20948 - DNA, 20 bp, Artificial Sequence
  chemically synthesized
tgtgaggcatcaatatgtgg

SEQ ID NO: 20949 - DNA, 20 bp, Artificial Sequence
  chemically synthesized
ggtggcatccatctgcattt

SEQ ID NO: 20950 - DNA, 20 bp, Artificial Sequence
  chemically synthesized
ttggtgatttttttccttca

SEQ ID NO: 20951 - DNA, 20 bp, Artificial Sequence
  chemically synthesized
tttttttccttcacagtcct

SEQ ID NO: 20952 - DNA, 20 bp, Artificial Sequence
  chemically synthesized
cttcacagtcctcggctgtc

SEQ ID NO: 20953 - DNA, 20 bp, Artificial Sequence
  chemically synthesized
ttcacagtcctcggctgtct

SEQ ID NO: 20954 - DNA, 20 bp, Artificial Sequence
  chemically synthesized
acagtcctcggctgtctggg

SEQ ID NO: 20955 - DNA, 20 bp, Artificial Sequence
  chemically synthesized
agtcctcggctgtctgggaa

SEQ ID NO: 20956 - DNA, 20 bp, Artificial Sequence
  chemically synthesized
cctcggctgtctgggaagag

SEQ ID NO: 20957 - DNA, 20 bp, Artificial Sequence
  chemically synthesized
ctcggctgtctgggaagaga

SEQ ID NO: 20958 - DNA, 20 bp, Artificial Sequence
  chemically synthesized
tgtctgggaagagaaggatg

SEQ ID NO: 20959 - DNA, 20 bp, Artificial Sequence
  chemically synthesized
gtctgggaagagaaggatga

SEQ ID NO: 20960 - DNA, 20 bp, Artificial Sequence
  chemically synthesized
tgggaagagaaggatgaagg

SEQ ID NO: 20961 - DNA, 20 bp, Artificial Sequence
  chemically synthesized
aagagaaggatgaaggcaga

SEQ ID NO: 20962 - DNA, 20 bp, Artificial Sequence
  chemically synthesized
ggcagatggctgctccaatt

SEQ ID NO: 20963 - DNA, 20 bp, Artificial Sequence
  chemically synthesized
gcagatggctgctccaattt

SEQ ID NO: 20964 - DNA, 20 bp, Artificial Sequence
  chemically synthesized
cagatggctgctccaattta

SEQ ID NO: 20965 - DNA, 20 bp, Artificial Sequence
  chemically synthesized
agatggctgctccaatttag

SEQ ID NO: 20966 - DNA, 20 bp, Artificial Sequence
  chemically synthesized
ggctgctccaatttaggggc

SEQ ID NO: 20967 - DNA, 20 bp, Artificial Sequence
  chemically synthesized
gctgctccaatttaggggct

SEQ ID NO: 20968 - DNA, 20 bp, Artificial Sequence
  chemically synthesized
caatttaggggctaggattg

SEQ ID NO: 20969 - DNA, 20 bp, Artificial Sequence
  chemically synthesized
aatttaggggctaggattgc

SEQ ID NO: 20970 - DNA, 20 bp, Artificial Sequence
  chemically synthesized
atttaggggctaggattgca

SEQ ID NO: 20971 - DNA, 20 bp, Artificial Sequence
  chemically synthesized
taggggctaggattgcaggg

SEQ ID NO: 20972 - DNA, 20 bp, Artificial Sequence
  chemically synthesized
aggggctaggattgcagggt

SEQ ID NO: 20973 - DNA, 20 bp, Artificial Sequence
  chemically synthesized
ctaggattgcagggtgggca

SEQ ID NO: 20974 - DNA, 20 bp, Artificial Sequence
  chemically synthesized
gtgggcacagcattgcaaac

SEQ ID NO: 20975 - DNA, 20 bp, Artificial Sequence
  chemically synthesized
cacagcattgcaaacgagtg

SEQ ID NO: 20976 - DNA, 20 bp, Artificial Sequence
  chemically synthesized
acagcattgcaaacgagtga

SEQ ID NO: 20977 - DNA, 20 bp, Artificial Sequence
  chemically synthesized
gcaaacgagtgaaggaaatt

SEQ ID NO: 20978 - DNA, 20 bp, Artificial Sequence
  chemically synthesized
gtgaaggaaattgagaaata

SEQ ID NO: 20979 - DNA, 20 bp, Artificial Sequence
  chemically synthesized
attgagaaatatggccaatg

SEQ ID NO: 20980 - DNA, 20 bp, Artificial Sequence
  chemically synthesized
tgagaaatatggccaatgaa

SEQ ID NO: 20981 - DNA, 20 bp, Artificial Sequence
  chemically synthesized
atatggccaatgaagagttg

SEQ ID NO: 20982 - DNA, 20 bp, Artificial Sequence
  chemically synthesized
atggccaatgaagagttgaa

SEQ ID NO: 20983 - DNA, 20 bp, Artificial Sequence
  chemically synthesized
ggccaatgaagagttgaaga

SEQ ID NO: 20984 - DNA, 20 bp, Artificial Sequence
  chemically synthesized
gccaatgaagagttgaagag

SEQ ID NO: 20985 - DNA, 20 bp, Artificial Sequence
  chemically synthesized
tgaagagttgaagagaggcc

SEQ ID NO: 20986 - DNA, 20 bp, Artificial Sequence
  chemically synthesized
agttgaagagaggcctggca

SEQ ID NO: 20987 - DNA, 20 bp, Artificial Sequence
  chemically synthesized
tgaagagaggcctggcatgg

SEQ ID NO: 20988 - DNA, 20 bp, Artificial Sequence
  chemically synthesized
gtggctcacacctataatcc

SEQ ID NO: 20989 - DNA, 20 bp, Artificial Sequence
  chemically synthesized
acctataatcccagcacttt

SEQ ID NO: 20990 - DNA, 20 bp, Artificial Sequence
  chemically synthesized
ctataatcccagcactttca

SEQ ID NO: 20991 - DNA, 20 bp, Artificial Sequence
  chemically synthesized
tataatcccagcactttcag

SEQ ID NO: 20992 - DNA, 20 bp, Artificial Sequence
  chemically synthesized
tcccagcactttcagaggcc

SEQ ID NO: 20993 - DNA, 20 bp, Artificial Sequence
  chemically synthesized
cccagcactttcagaggccc

SEQ ID NO: 20994 - DNA, 20 bp, Artificial Sequence
  chemically synthesized
agcactttcagaggcccagg

SEQ ID NO: 20995 - DNA, 20 bp, Artificial Sequence
  chemically synthesized
gcactttcagaggcccaggc

SEQ ID NO: 20996 - DNA, 20 bp, Artificial Sequence
  chemically synthesized
ctttcagaggcccaggcagg

SEQ ID NO: 20997 - DNA, 20 bp, Artificial Sequence
  chemically synthesized
cccaggcaggcagatcactt

SEQ ID NO: 20998 - DNA, 20 bp, Artificial Sequence
  chemically synthesized
ccaggcaggcagatcacttg

SEQ ID NO: 20999 - DNA, 20 bp, Artificial Sequence
  chemically synthesized
gcaggcagatcacttgaggt

SEQ ID NO: 21000 - DNA, 20 bp, Artificial Sequence
  chemically synthesized
caggcagatcacttgaggtc

SEQ ID NO: 21001 - DNA, 20 bp, Artificial Sequence
  chemically synthesized
ggcagatcacttgaggtcag

SEQ ID NO: 21002 - DNA, 20 bp, Artificial Sequence
  chemically synthesized
tgaggtcaggagttcgacac

SEQ ID NO: 21003 - DNA, 20 bp, Artificial Sequence
  chemically synthesized
tcaggagttcgacaccagcc

SEQ ID NO: 21004 - DNA, 20 bp, Artificial Sequence
  chemically synthesized
tcgacaccagcctggccaac

SEQ ID NO: 21005 - DNA, 20 bp, Artificial Sequence
  chemically synthesized
cgacaccagcctggccaaca

SEQ ID NO: 21006 - DNA, 20 bp, Artificial Sequence
  chemically synthesized
gcctggccaacaaggtgaaa

SEQ ID NO: 21007 - DNA, 20 bp, Artificial Sequence
  chemically synthesized
aaggtgaaatggtgaaaccc

SEQ ID NO: 21008 - DNA, 20 bp, Artificial Sequence
  chemically synthesized
tttactaaaaatacaaaaat

SEQ ID NO: 21009 - DNA, 20 bp, Artificial Sequence
  chemically synthesized
ctaaaaatacaaaaattagc

SEQ ID NO: 21010 - DNA, 20 bp, Artificial Sequence
  chemically synthesized
taaaaatacaaaaattagct

SEQ ID NO: 21011 - DNA, 20 bp, Artificial Sequence
  chemically synthesized
atacaaaaattagctgggca

SEQ ID NO: 21012 - DNA, 20 bp, Artificial Sequence
  chemically synthesized
caaaaattagctgggcatgg

SEQ ID NO: 21013 - DNA, 20 bp, Artificial Sequence
  chemically synthesized
aaattagctgggcatggtgg

SEQ ID NO: 21014 - DNA, 20 bp, Artificial Sequence
  chemically synthesized
aattagctgggcatggtggc

SEQ ID NO: 21015 - DNA, 20 bp, Artificial Sequence
  chemically synthesized
gtggcgggtgcctgtaatcc

SEQ ID NO: 21016 - DNA, 20 bp, Artificial Sequence
  chemically synthesized
tgcctgtaatcccagctact

SEQ ID NO: 21017 - DNA, 20 bp, Artificial Sequence
  chemically synthesized
gcctgtaatcccagctactt

SEQ ID NO: 21018 - DNA, 20 bp, Artificial Sequence
  chemically synthesized
ctgtaatcccagctacttgg

SEQ ID NO: 21019 - DNA, 20 bp, Artificial Sequence
  chemically synthesized
tgtaatcccagctacttggg

SEQ ID NO: 21020 - DNA, 20 bp, Artificial Sequence
  chemically synthesized
tcccagctacttgggaggct

SEQ ID NO: 21021 - DNA, 20 bp, Artificial Sequence
  chemically synthesized
cccagctacttgggaggctg

SEQ ID NO: 21022 - DNA, 20 bp, Artificial Sequence
  chemically synthesized
agctacttgggaggctgagg

SEQ ID NO: 21023 - DNA, 20 bp, Artificial Sequence
  chemically synthesized
gctacttgggaggctgaggc

SEQ ID NO: 21024 - DNA, 20 bp, Artificial Sequence
  chemically synthesized
tacttgggaggctgaggcag

SEQ ID NO: 21025 - DNA, 20 bp, Artificial Sequence
  chemically synthesized
gggaggctgaggcaggagaa

SEQ ID NO: 21026 - DNA, 20 bp, Artificial Sequence
  chemically synthesized
gcaggagaatagcttgaacc

SEQ ID NO: 21027 - DNA, 20 bp, Artificial Sequence
  chemically synthesized
caggagaatagcttgaacct

SEQ ID NO: 21028 - DNA, 20 bp, Artificial Sequence
  chemically synthesized
ggagaatagcttgaacctgg

SEQ ID NO: 21029 - DNA, 20 bp, Artificial Sequence
  chemically synthesized
aatagcttgaacctgggaga

SEQ ID NO: 21030 - DNA, 20 bp, Artificial Sequence
  chemically synthesized
tagcttgaacctgggagatg

SEQ ID NO: 21031 - DNA, 20 bp, Artificial Sequence
  chemically synthesized
agcttgaacctgggagatgg

SEQ ID NO: 21032 - DNA, 20 bp, Artificial Sequence
  chemically synthesized
aacctgggagatggaggttg

SEQ ID NO: 21033 - DNA, 20 bp, Artificial Sequence
  chemically synthesized
tgggagatggaggttgcagt

SEQ ID NO: 21034 - DNA, 20 bp, Artificial Sequence
  chemically synthesized
gatggaggttgcagtgagct

SEQ ID NO: 21035 - DNA, 20 bp, Artificial Sequence
  chemically synthesized
gagatcgcaccactgcactc

SEQ ID NO: 21036 - DNA, 20 bp, Artificial Sequence
  chemically synthesized
cgcaccactgcactccagcc

SEQ ID NO: 21037 - DNA, 20 bp, Artificial Sequence
  chemically synthesized
gcaccactgcactccagcct

SEQ ID NO: 21038 - DNA, 20 bp, Artificial Sequence
  chemically synthesized
ctgcactccagcctgggcga

SEQ ID NO: 21039 - DNA, 20 bp, Artificial Sequence
  chemically synthesized
gcactccagcctgggcgaca

SEQ ID NO: 21040 - DNA, 20 bp, Artificial Sequence
  chemically synthesized
tccagcctgggcgacagagc

SEQ ID NO: 21041 - DNA, 20 bp, Artificial Sequence
  chemically synthesized
caagactctgtcaaaaaaaa

SEQ ID NO: 21042 - DNA, 20 bp, Artificial Sequence
  chemically synthesized
agactctgtcaaaaaaaaaa

SEQ ID NO: 21043 - DNA, 20 bp, Artificial Sequence
  chemically synthesized
tgtcaaaaaaaaaagagttg

SEQ ID NO: 21044 - DNA, 20 bp, Artificial Sequence
  chemically synthesized
tcaaaaaaaaaagagttgaa

SEQ ID NO: 21045 - DNA, 20 bp, Artificial Sequence
  chemically synthesized
aaaaaagagttgaagagaaa

SEQ ID NO: 21046 - DNA, 20 bp, Artificial Sequence
  chemically synthesized
agagttgaagagaaaaagtc

SEQ ID NO: 21047 - DNA, 20 bp, Artificial Sequence
  chemically synthesized
gagttgaagagaaaaagtct

SEQ ID NO: 21048 - DNA, 20 bp, Artificial Sequence
  chemically synthesized
aaaagtctaggctaaattca

SEQ ID NO: 21049 - DNA, 20 bp, Artificial Sequence
  chemically synthesized
aggctaaattcaaagaaaaa

SEQ ID NO: 21050 - DNA, 20 bp, Artificial Sequence
  chemically synthesized
taaattcaaagaaaaaaagt

SEQ ID NO: 21051 - DNA, 20 bp, Artificial Sequence
  chemically synthesized
aagaaaaaaagtgagcccaa

SEQ ID NO: 21052 - DNA, 20 bp, Artificial Sequence
  chemically synthesized
agaaaaaaagtgagcccaaa

SEQ ID NO: 21053 - DNA, 20 bp, Artificial Sequence
  chemically synthesized
gtgagcccaaaaggaacttg

SEQ ID NO: 21054 - DNA, 20 bp, Artificial Sequence
  chemically synthesized
gagcccaaaaggaacttgca

SEQ ID NO: 21055 - DNA, 20 bp, Artificial Sequence
  chemically synthesized
ccaaaaggaacttgcagagc

SEQ ID NO: 21056 - DNA, 20 bp, Artificial Sequence
  chemically synthesized
caaaaggaacttgcagagca

SEQ ID NO: 21057 - DNA, 20 bp, Artificial Sequence
  chemically synthesized
aaaaggaacttgcagagcaa

SEQ ID NO: 21058 - DNA, 20 bp, Artificial Sequence
  chemically synthesized
gaacttgcagagcaagggaa

SEQ ID NO: 21059 - DNA, 20 bp, Artificial Sequence
  chemically synthesized
cttgcagagcaagggaaaag

SEQ ID NO: 21060 - DNA, 20 bp, Artificial Sequence
  chemically synthesized
ttgcagagcaagggaaaagc

SEQ ID NO: 21061 - DNA, 20 bp, Artificial Sequence
  chemically synthesized
tgcagagcaagggaaaagca

SEQ ID NO: 21062 - DNA, 20 bp, Artificial Sequence
  chemically synthesized
aagggaaaagcagggatgtc

SEQ ID NO: 21063 - DNA, 20 bp, Artificial Sequence
  chemically synthesized
agggaaaagcagggatgtca

SEQ ID NO: 21064 - DNA, 20 bp, Artificial Sequence
  chemically synthesized
gggaaaagcagggatgtcaa

SEQ ID NO: 21065 - DNA, 20 bp, Artificial Sequence
  chemically synthesized
aagcagggatgtcaagggac

SEQ ID NO: 21066 - DNA, 20 bp, Artificial Sequence
  chemically synthesized
agggactagaacactccata

SEQ ID NO: 21067 - DNA, 20 bp, Artificial Sequence
  chemically synthesized
agaacactccataaagtgaa

SEQ ID NO: 21068 - DNA, 20 bp, Artificial Sequence
  chemically synthesized
tgaacagctgcaatgaaaat

SEQ ID NO: 21069 - DNA, 20 bp, Artificial Sequence
  chemically synthesized
gaacagctgcaatgaaaata

SEQ ID NO: 21070 - DNA, 20 bp, Artificial Sequence
  chemically synthesized
aacagctgcaatgaaaataa

SEQ ID NO: 21071 - DNA, 20 bp, Artificial Sequence
  chemically synthesized
agctgcaatgaaaataaggg

SEQ ID NO: 21072 - DNA, 20 bp, Artificial Sequence
  chemically synthesized
gcaatgaaaataagggaaga

SEQ ID NO: 21073 - DNA, 20 bp, Artificial Sequence
  chemically synthesized
gaaaataagggaagaaagtt

SEQ ID NO: 21074 - DNA, 20 bp, Artificial Sequence
  chemically synthesized
ctttcctttctcttcctttt

SEQ ID NO: 21075 - DNA, 20 bp, Artificial Sequence
  chemically synthesized
ttcctttctcttcctttttg

SEQ ID NO: 21076 - DNA, 20 bp, Artificial Sequence
  chemically synthesized
tcttcctttttggagttaat

SEQ ID NO: 21077 - DNA, 20 bp, Artificial Sequence
  chemically synthesized
cttcctttttggagttaatc

SEQ ID NO: 21078 - DNA, 20 bp, Artificial Sequence
  chemically synthesized
cctttttggagttaatcagg

SEQ ID NO: 21079 - DNA, 20 bp, Artificial Sequence
  chemically synthesized
ttttggagttaatcaggaag

SEQ ID NO: 21080 - DNA, 20 bp, Artificial Sequence
  chemically synthesized
ggaagtagtcccaaataccc

SEQ ID NO: 21081 - DNA, 20 bp, Artificial Sequence
  chemically synthesized
gtagtcccaaataccccaga

SEQ ID NO: 21082 - DNA, 20 bp, Artificial Sequence
  chemically synthesized
ccccagaaagttcatcttat

SEQ ID NO: 21083 - DNA, 20 bp, Artificial Sequence
  chemically synthesized
aagttcatcttataagccct

SEQ ID NO: 21084 - DNA, 20 bp, Artificial Sequence
  chemically synthesized
tataagcccttggtcctctt

SEQ ID NO: 21085 - DNA, 20 bp, Artificial Sequence
  chemically synthesized
agcccttggtcctcttgaga

SEQ ID NO: 21086 - DNA, 20 bp, Artificial Sequence
  chemically synthesized
tggtcctcttgagatggtat

SEQ ID NO: 21087 - DNA, 20 bp, Artificial Sequence
  chemically synthesized
gatggtatcagatatattgc

SEQ ID NO: 21088 - DNA, 20 bp, Artificial Sequence
  chemically synthesized
gatatattgctagacccttg

SEQ ID NO: 21089 - DNA, 20 bp, Artificial Sequence
  chemically synthesized
tattgctagacccttgaaga

SEQ ID NO: 21090 - DNA, 20 bp, Artificial Sequence
  chemically synthesized
attgctagacccttgaagaa

SEQ ID NO: 21091 - DNA, 20 bp, Artificial Sequence
  chemically synthesized
cttgaagaaaggaacaactc

SEQ ID NO: 21092 - DNA, 20 bp, Artificial Sequence
  chemically synthesized
ttgaagaaaggaacaactcc

SEQ ID NO: 21093 - DNA, 20 bp, Artificial Sequence
  chemically synthesized
acaactccaggcaacttctt

SEQ ID NO: 21094 - DNA, 20 bp, Artificial Sequence
  chemically synthesized
caaacacatgtgtgtgtata

SEQ ID NO: 21095 - DNA, 20 bp, Artificial Sequence
  chemically synthesized
agccatgcattccttaacaa

SEQ ID NO: 21096 - DNA, 20 bp, Artificial Sequence
  chemically synthesized
gccatgcattccttaacaat

SEQ ID NO: 21097 - DNA, 20 bp, Artificial Sequence
  chemically synthesized
ccatgcattccttaacaatg

SEQ ID NO: 21098 - DNA, 20 bp, Artificial Sequence
  chemically synthesized
taacaatggggatatattct

SEQ ID NO: 21099 - DNA, 20 bp, Artificial Sequence
  chemically synthesized
attctgagaaatgtgtcatt

SEQ ID NO: 21100 - DNA, 20 bp, Artificial Sequence
  chemically synthesized
tcatcattgtgcgaacataa

SEQ ID NO: 21101 - DNA, 20 bp, Artificial Sequence
  chemically synthesized
atcattgtgcgaacataata

SEQ ID NO: 21102 - DNA, 20 bp, Artificial Sequence
  chemically synthesized
tgtacttacctaaacctaaa

SEQ ID NO: 21103 - DNA, 20 bp, Artificial Sequence
  chemically synthesized
ttacctaaacctaaatggta

SEQ ID NO: 21104 - DNA, 20 bp, Artificial Sequence
  chemically synthesized
ggtatagcttactacatacc

SEQ ID NO: 21105 - DNA, 20 bp, Artificial Sequence
  chemically synthesized
gtatagcttactacatacct

SEQ ID NO: 21106 - DNA, 20 bp, Artificial Sequence
  chemically synthesized
atacctaggttgtattgatg

SEQ ID NO: 21107 - DNA, 20 bp, Artificial Sequence
  chemically synthesized
ttgatgtggcctattgctcc

SEQ ID NO: 21108 - DNA, 20 bp, Artificial Sequence
  chemically synthesized
tgatgtggcctattgctcct

SEQ ID NO: 21109 - DNA, 20 bp, Artificial Sequence
  chemically synthesized
gcctattgctcctaggctcc

SEQ ID NO: 21110 - DNA, 20 bp, Artificial Sequence
  chemically synthesized
cctattgctcctaggctcct

SEQ ID NO: 21111 - DNA, 20 bp, Artificial Sequence
  chemically synthesized
tcctgggctgcaaacctgta

SEQ ID NO: 21112 - DNA, 20 bp, Artificial Sequence
  chemically synthesized
tgtgactgtactgaacactg

SEQ ID NO: 21113 - DNA, 20 bp, Artificial Sequence
  chemically synthesized
gtgactgtactgaacactgt

SEQ ID NO: 21114 - DNA, 20 bp, Artificial Sequence
  chemically synthesized
gtactgaacactgtaggcaa

SEQ ID NO: 21115 - DNA, 20 bp, Artificial Sequence
  chemically synthesized
aacactgtaggcaatggtaa

SEQ ID NO: 21116 - DNA, 20 bp, Artificial Sequence
  chemically synthesized
actgtaggcaatggtaacag

SEQ ID NO: 21117 - DNA, 20 bp, Artificial Sequence
  chemically synthesized
ggtatttgtgtatctaaaca

SEQ ID NO: 21118 - DNA, 20 bp, Artificial Sequence
  chemically synthesized
ttgtgtatctaaacatagaa

SEQ ID NO: 21119 - DNA, 20 bp, Artificial Sequence
  chemically synthesized
tgtgtatctaaacatagaaa

SEQ ID NO: 21120 - DNA, 20 bp, Artificial Sequence
  chemically synthesized
atctaaacatagaaaaggta

SEQ ID NO: 21121 - DNA, 20 bp, Artificial Sequence
  chemically synthesized
gaaaaggtacagtgaaaata

SEQ ID NO: 21122 - DNA, 20 bp, Artificial Sequence
  chemically synthesized
aatacagtattataacctta

SEQ ID NO: 21123 - DNA, 20 bp, Artificial Sequence
  chemically synthesized
atacagtattataaccttat

SEQ ID NO: 21124 - DNA, 20 bp, Artificial Sequence
  chemically synthesized
gggaccactgtcgtataatg

SEQ ID NO: 21125 - DNA, 20 bp, Artificial Sequence
  chemically synthesized
ttgaccaaaatgtcattgtg

SEQ ID NO: 21126 - DNA, 20 bp, Artificial Sequence
  chemically synthesized
tatatgtacacacacacaca

SEQ ID NO: 21127 - DNA, 20 bp, Artificial Sequence
  chemically synthesized
tatgtacacacacacacata

SEQ ID NO: 21128 - DNA, 20 bp, Artificial Sequence
  chemically synthesized
tgtacacacacacacataga

SEQ ID NO: 21129 - DNA, 20 bp, Artificial Sequence
  chemically synthesized
tacacacacacacatagaga

SEQ ID NO: 21130 - DNA, 20 bp, Artificial Sequence
  chemically synthesized
cacacacacacatagagaga

SEQ ID NO: 21131 - DNA, 20 bp, Artificial Sequence
  chemically synthesized
cacacacacatagagagaga

SEQ ID NO: 21132 - DNA, 20 bp, Artificial Sequence
  chemically synthesized
cacacacatagagagagaga

SEQ ID NO: 21133 - DNA, 20 bp, Artificial Sequence
  chemically synthesized
cacacatagagagagagaga

SEQ ID NO: 21134 - DNA, 20 bp, Artificial Sequence
  chemically synthesized
acacatagagagagagagag

SEQ ID NO: 21135 - DNA, 20 bp, Artificial Sequence
  chemically synthesized
acatagagagagagagagag

SEQ ID NO: 21136 - DNA, 20 bp, Artificial Sequence
  chemically synthesized
atagagagagagagagagga

SEQ ID NO: 21137 - DNA, 20 bp, Artificial Sequence
  chemically synthesized
tagagagagagagagaggag

SEQ ID NO: 21138 - DNA, 20 bp, Artificial Sequence
  chemically synthesized
gagagagagagagaggagag

SEQ ID NO: 21139 - DNA, 20 bp, Artificial Sequence
  chemically synthesized
gagagagagagaggagagga

SEQ ID NO: 21140 - DNA, 20 bp, Artificial Sequence
  chemically synthesized
agagagagagaggagaggag

SEQ ID NO: 21141 - DNA, 20 bp, Artificial Sequence
  chemically synthesized
gagagagaggagaggagagg

SEQ ID NO: 21142 - DNA, 20 bp, Artificial Sequence
  chemically synthesized
agagagaggagaggagagga

SEQ ID NO: 21143 - DNA, 20 bp, Artificial Sequence
  chemically synthesized
agagaggagaggagaggaag

SEQ ID NO: 21144 - DNA, 20 bp, Artificial Sequence
  chemically synthesized
gagaggagaggagaggaagg

SEQ ID NO: 21145 - DNA, 20 bp, Artificial Sequence
  chemically synthesized
agaggagaggagaggaagga

SEQ ID NO: 21146 - DNA, 20 bp, Artificial Sequence
  chemically synthesized
aggagaggagaggaaggagg

SEQ ID NO: 21147 - DNA, 20 bp, Artificial Sequence
  chemically synthesized
ggagaggagaggaaggaggg

SEQ ID NO: 21148 - DNA, 20 bp, Artificial Sequence
  chemically synthesized
gagaggagaggaaggaggga

SEQ ID NO: 21149 - DNA, 20 bp, Artificial Sequence
  chemically synthesized
aggagaggaaggagggaggg

SEQ ID NO: 21150 - DNA, 20 bp, Artificial Sequence
  chemically synthesized
ggagaggaaggagggaggga

SEQ ID NO: 21151 - DNA, 20 bp, Artificial Sequence
  chemically synthesized
agaggaaggagggagggaag

SEQ ID NO: 21152 - DNA, 20 bp, Artificial Sequence
  chemically synthesized
agggaaggagaaatatgatt

SEQ ID NO: 21153 - DNA, 20 bp, Artificial Sequence
  chemically synthesized
aaggagaaatatgattcaga

SEQ ID NO: 21154 - DNA, 20 bp, Artificial Sequence
  chemically synthesized
ggagaaatatgattcagata

SEQ ID NO: 21155 - DNA, 20 bp, Artificial Sequence
  chemically synthesized
agatagagacatctatcctc

SEQ ID NO: 21156 - DNA, 20 bp, Artificial Sequence
  chemically synthesized
atagagacatctatcctcca

SEQ ID NO: 21157 - DNA, 20 bp, Artificial Sequence
  chemically synthesized
gacatctatcctccagagtt

SEQ ID NO: 21158 - DNA, 20 bp, Artificial Sequence
  chemically synthesized
acatctatcctccagagttc

SEQ ID NO: 21159 - DNA, 20 bp, Artificial Sequence
  chemically synthesized
atctatcctccagagttcag

SEQ ID NO: 21160 - DNA, 20 bp, Artificial Sequence
  chemically synthesized
agagttcaggagtgtctctt

SEQ ID NO: 21161 - DNA, 20 bp, Artificial Sequence
  chemically synthesized
tcaggagtgtctcttcagac

SEQ ID NO: 21162 - DNA, 20 bp, Artificial Sequence
  chemically synthesized
caggagtgtctcttcagact

SEQ ID NO: 21163 - DNA, 20 bp, Artificial Sequence
  chemically synthesized
gagtgtctcttcagactagg

SEQ ID NO: 21164 - DNA, 20 bp, Artificial Sequence
  chemically synthesized
ctcttcagactaggtagatg

SEQ ID NO: 21165 - DNA, 20 bp, Artificial Sequence
  chemically synthesized
aaaaaacatatcctgaattc

SEQ ID NO: 21166 - DNA, 20 bp, Artificial Sequence
  chemically synthesized
aaaacatatcctgaattcta

SEQ ID NO: 21167 - DNA, 20 bp, Artificial Sequence
  chemically synthesized
aacatatcctgaattctaga

SEQ ID NO: 21168 - DNA, 20 bp, Artificial Sequence
  chemically synthesized
cctataacacttgccaacca

SEQ ID NO: 21169 - DNA, 20 bp, Artificial Sequence
  chemically synthesized
ctataacacttgccaaccaa

SEQ ID NO: 21170 - DNA, 20 bp, Artificial Sequence
  chemically synthesized
attgcttttttaaattaatg

SEQ ID NO: 21171 - DNA, 20 bp, Artificial Sequence
  chemically synthesized
agtgatttttctttaacatc

SEQ ID NO: 21172 - DNA, 20 bp, Artificial Sequence
  chemically synthesized
ttttctttaacatctagtga

SEQ ID NO: 21173 - DNA, 20 bp, Artificial Sequence
  chemically synthesized
taacatctagtgacagacac

SEQ ID NO: 21174 - DNA, 20 bp, Artificial Sequence
  chemically synthesized
aacatctagtgacagacact

SEQ ID NO: 21175 - DNA, 20 bp, Artificial Sequence
  chemically synthesized
acatctagtgacagacactg

SEQ ID NO: 21176 - DNA, 20 bp, Artificial Sequence
  chemically synthesized
agacactggggtcacatttg

SEQ ID NO: 21177 - DNA, 20 bp, Artificial Sequence
  chemically synthesized
actggggtcacatttgcagc

SEQ ID NO: 21178 - DNA, 20 bp, Artificial Sequence
  chemically synthesized
atttgcagctggaccataat

SEQ ID NO: 21179 - DNA, 20 bp, Artificial Sequence
  chemically synthesized
tttgcagctggaccataatt

SEQ ID NO: 21180 - DNA, 20 bp, Artificial Sequence
  chemically synthesized
ataattaggcttctgttctt

SEQ ID NO: 21181 - DNA, 20 bp, Artificial Sequence
  chemically synthesized
taattaggcttctgttcttc

SEQ ID NO: 21182 - DNA, 20 bp, Artificial Sequence
  chemically synthesized
attaggcttctgttcttcag

SEQ ID NO: 21183 - DNA, 20 bp, Artificial Sequence
  chemically synthesized
cttcaggagacatttgttca

SEQ ID NO: 21184 - DNA, 20 bp, Artificial Sequence
  chemically synthesized
gacatttgttcaaagtcatt

SEQ ID NO: 21185 - DNA, 20 bp, Artificial Sequence
  chemically synthesized
acatttgttcaaagtcattt

SEQ ID NO: 21186 - DNA, 20 bp, Artificial Sequence
  chemically synthesized
gggcaaccatattctgaaaa

SEQ ID NO: 21187 - DNA, 20 bp, Artificial Sequence
  chemically synthesized
accatattctgaaaacagcc

SEQ ID NO: 21188 - DNA, 20 bp, Artificial Sequence
  chemically synthesized
tattctgaaaacagcccagc

SEQ ID NO: 21189 - DNA, 20 bp, Artificial Sequence
  chemically synthesized
attctgaaaacagcccagcc

SEQ ID NO: 21190 - DNA, 20 bp, Artificial Sequence
  chemically synthesized
ttctgaaaacagcccagcca

SEQ ID NO: 21191 - DNA, 20 bp, Artificial Sequence
  chemically synthesized
aaacagcccagccagggtga

SEQ ID NO: 21192 - DNA, 20 bp, Artificial Sequence
  chemically synthesized
gggtgatggatcactttgca

SEQ ID NO: 21193 - DNA, 20 bp, Artificial Sequence
  chemically synthesized
actttgcaaagatcctcaat

SEQ ID NO: 21194 - DNA, 20 bp, Artificial Sequence
  chemically synthesized
atcctcaatgagctattttc

SEQ ID NO: 21195 - DNA, 20 bp, Artificial Sequence
  chemically synthesized
gctattttcaagtgatgaca

SEQ ID NO: 21196 - DNA, 20 bp, Artificial Sequence
  chemically synthesized
tcaagtgatgacaaagtgtg

SEQ ID NO: 21197 - DNA, 20 bp, Artificial Sequence
  chemically synthesized
gtgaagttaaccgctcattt

SEQ ID NO: 21198 - DNA, 20 bp, Artificial Sequence
  chemically synthesized
agaactttctttttcatcca

SEQ ID NO: 21199 - DNA, 20 bp, Artificial Sequence
  chemically synthesized
aaagtaaattcaaatatgat

SEQ ID NO: 21200 - DNA, 20 bp, Artificial Sequence
  chemically synthesized
gaaatctgaccttttattac

SEQ ID NO: 21201 - DNA, 20 bp, Artificial Sequence
  chemically synthesized
actggaattctcttgactaa

SEQ ID NO: 21202 - DNA, 20 bp, Artificial Sequence
  chemically synthesized
cctaaatctccatgtgtata

SEQ ID NO: 21203 - DNA, 20 bp, Artificial Sequence
  chemically synthesized
tccatgtgtatacagtactg

SEQ ID NO: 21204 - DNA, 20 bp, Artificial Sequence
  chemically synthesized
ccatgtgtatacagtactgt

SEQ ID NO: 21205 - DNA, 20 bp, Artificial Sequence
  chemically synthesized
acagtactgtgggaacatca

SEQ ID NO: 21206 - DNA, 20 bp, Artificial Sequence
  chemically synthesized
tgtgggaacatcacagattt

SEQ ID NO: 21207 - DNA, 20 bp, Artificial Sequence
  chemically synthesized
gattttggctccatgcccta

SEQ ID NO: 21208 - DNA, 20 bp, Artificial Sequence
  chemically synthesized
ttttggctccatgccctaaa

SEQ ID NO: 21209 - DNA, 20 bp, Artificial Sequence
  chemically synthesized
tccatgccctaaagagaaat

SEQ ID NO: 21210 - DNA, 20 bp, Artificial Sequence
  chemically synthesized
cctaaagagaaattggcttt

SEQ ID NO: 21211 - DNA, 20 bp, Artificial Sequence
  chemically synthesized
aaattggctttcagattatt

SEQ ID NO: 21212 - DNA, 20 bp, Artificial Sequence
  chemically synthesized
gattatttggattaaaaaca

SEQ ID NO: 21213 - DNA, 20 bp, Artificial Sequence
  chemically synthesized
ttaaaaacaaagactttctt

SEQ ID NO: 21214 - DNA, 20 bp, Artificial Sequence
  chemically synthesized
aaaaacaaagactttcttaa

SEQ ID NO: 21215 - DNA, 20 bp, Artificial Sequence
  chemically synthesized
tttcttttttgctaaaacta

SEQ ID NO: 21216 - DNA, 20 bp, Artificial Sequence
  chemically synthesized
agaattattcttttacattt

SEQ ID NO: 21217 - DNA, 20 bp, Artificial Sequence
  chemically synthesized
acgccaacaaaattctgaat

SEQ ID NO: 21218 - DNA, 20 bp, Artificial Sequence
  chemically synthesized
acaaaattctgaatcggcca

SEQ ID NO: 21219 - DNA, 20 bp, Artificial Sequence
  chemically synthesized
aaaattctgaatcggccaaa

SEQ ID NO: 21220 - DNA, 20 bp, Artificial Sequence
  chemically synthesized
aaattctgaatcggccaaag

SEQ ID NO: 21221 - DNA, 20 bp, Artificial Sequence
  chemically synthesized
tcggccaaagaggtataatt

SEQ ID NO: 21222 - DNA, 20 bp, Artificial Sequence
  chemically synthesized
cggccaaagaggtataattc

SEQ ID NO: 21223 - DNA, 20 bp, Artificial Sequence
  chemically synthesized
gaggtataattcaggtaaat

SEQ ID NO: 21224 - DNA, 20 bp, Artificial Sequence
  chemically synthesized
gtataattcaggtaaattgg

SEQ ID NO: 21225 - DNA, 20 bp, Artificial Sequence
  chemically synthesized
ataattcaggtaaattggaa

SEQ ID NO: 21226 - DNA, 20 bp, Artificial Sequence
  chemically synthesized
taaattggaagagtttgttc

SEQ ID NO: 21227 - DNA, 20 bp, Artificial Sequence
  chemically synthesized
aaattggaagagtttgttca

SEQ ID NO: 21228 - DNA, 20 bp, Artificial Sequence
  chemically synthesized
aattggaagagtttgttcaa

SEQ ID NO: 21229 - DNA, 20 bp, Artificial Sequence
  chemically synthesized
agtttgttcaagggaacctt

SEQ ID NO: 21230 - DNA, 20 bp, Artificial Sequence
  chemically synthesized
tttgttcaagggaaccttga

SEQ ID NO: 21231 - DNA, 20 bp, Artificial Sequence
  chemically synthesized
tgttcaagggaaccttgaga

SEQ ID NO: 21232 - DNA, 20 bp, Artificial Sequence
  chemically synthesized
gaaccttgagagagaatgta

SEQ ID NO: 21233 - DNA, 20 bp, Artificial Sequence
  chemically synthesized
ccttgagagagaatgtatgg

SEQ ID NO: 21234 - DNA, 20 bp, Artificial Sequence
  chemically synthesized
agagagaatgtatggaagaa

SEQ ID NO: 21235 - DNA, 20 bp, Artificial Sequence
  chemically synthesized
gaatgtatggaagaaaagtg

SEQ ID NO: 21236 - DNA, 20 bp, Artificial Sequence
  chemically synthesized
ggaagaaaagtgtagttttg

SEQ ID NO: 21237 - DNA, 20 bp, Artificial Sequence
  chemically synthesized
agaaaagtgtagttttgaag

SEQ ID NO: 21238 - DNA, 20 bp, Artificial Sequence
  chemically synthesized
gtgtagttttgaagaagcac

SEQ ID NO: 21239 - DNA, 20 bp, Artificial Sequence
  chemically synthesized
tagttttgaagaagcacgag

SEQ ID NO: 21240 - DNA, 20 bp, Artificial Sequence
  chemically synthesized
gaagtttttgaaaacactga

SEQ ID NO: 21241 - DNA, 20 bp, Artificial Sequence
  chemically synthesized
tcttccatacattctctctc

SEQ ID NO: 21242 - DNA, 20 bp, Artificial Sequence
  chemically synthesized
cttccatacattctctctca

SEQ ID NO: 21243 - DNA, 20 bp, Artificial Sequence
  chemically synthesized
ttacctgaattatacctctt

SEQ ID NO: 21244 - DNA, 20 bp, Artificial Sequence
  chemically synthesized
ttatacctctttggccgatt

SEQ ID NO: 21245 - DNA, 20 bp, Artificial Sequence
  chemically synthesized
tggccgattcagaattttgt

SEQ ID NO: 21246 - DNA, 20 bp, Artificial Sequence
  chemically synthesized
ttgttggcgttttcatgatc

SEQ ID NO: 21247 - DNA, 20 bp, Artificial Sequence
  chemically synthesized
caagaaaaactgaaatgtaa

SEQ ID NO: 21248 - DNA, 20 bp, Artificial Sequence
  chemically synthesized
aatgtaaaagaataattctt

SEQ ID NO: 21249 - DNA, 20 bp, Artificial Sequence
  chemically synthesized
aaagaataattctttagttt

SEQ ID NO: 21250 - DNA, 20 bp, Artificial Sequence
  chemically synthesized
attctttagttttagcaaaa

SEQ ID NO: 21251 - DNA, 20 bp, Artificial Sequence
  chemically synthesized
atgaaaattttacatctctt

SEQ ID NO: 21252 - DNA, 20 bp, Artificial Sequence
  chemically synthesized
aaattttacatctcttaaga

SEQ ID NO: 21253 - DNA, 20 bp, Artificial Sequence
  chemically synthesized
ttttaatccaaataatctga

SEQ ID NO: 21254 - DNA, 20 bp, Artificial Sequence
  chemically synthesized
tctgaaagccaatttctctt

SEQ ID NO: 21255 - DNA, 20 bp, Artificial Sequence
  chemically synthesized
ctgaaagccaatttctcttt

SEQ ID NO: 21256 - DNA, 20 bp, Artificial Sequence
  chemically synthesized
tgaaagccaatttctcttta

SEQ ID NO: 21257 - DNA, 20 bp, Artificial Sequence
  chemically synthesized
gccaatttctctttagggca

SEQ ID NO: 21258 - DNA, 20 bp, Artificial Sequence
  chemically synthesized
caatttctctttagggcatg

SEQ ID NO: 21259 - DNA, 20 bp, Artificial Sequence
  chemically synthesized
caaaatctgtgatgttccca

SEQ ID NO: 21260 - DNA, 20 bp, Artificial Sequence
  chemically synthesized
cccacagtactgtatacaca

SEQ ID NO: 21261 - DNA, 20 bp, Artificial Sequence
  chemically synthesized
cacagtactgtatacacatg

SEQ ID NO: 21262 - DNA, 20 bp, Artificial Sequence
  chemically synthesized
actgtatacacatggagatt

SEQ ID NO: 21263 - DNA, 20 bp, Artificial Sequence
  chemically synthesized
ctgtatacacatggagattt

SEQ ID NO: 21264 - DNA, 20 bp, Artificial Sequence
  chemically synthesized
ttaaaattcaattttacttt

SEQ ID NO: 21265 - DNA, 20 bp, Artificial Sequence
  chemically synthesized
attcaattttacttttagtc

SEQ ID NO: 21266 - DNA, 20 bp, Artificial Sequence
  chemically synthesized
tcaattttacttttagtcaa

SEQ ID NO: 21267 - DNA, 20 bp, Artificial Sequence
  chemically synthesized
acttttagtcaagagaattc

SEQ ID NO: 21268 - DNA, 20 bp, Artificial Sequence
  chemically synthesized
caagagaattccagtaataa

SEQ ID NO: 21269 - DNA, 20 bp, Artificial Sequence
  chemically synthesized
aagagaattccagtaataaa

SEQ ID NO: 21270 - DNA, 20 bp, Artificial Sequence
  chemically synthesized
gaattccagtaataaaaggt

SEQ ID NO: 21271 - DNA, 20 bp, Artificial Sequence
  chemically synthesized
aatcatatttgaatttactt

SEQ ID NO: 21272 - DNA, 20 bp, Artificial Sequence
  chemically synthesized
tgaatttactttggatgaaa

SEQ ID NO: 21273 - DNA, 20 bp, Artificial Sequence
  chemically synthesized
tttactttggatgaaaaaga

SEQ ID NO: 21274 - DNA, 20 bp, Artificial Sequence
  chemically synthesized
gaaaaagaaagttctcaaat

SEQ ID NO: 21275 - DNA, 20 bp, Artificial Sequence
  chemically synthesized
aaagaaagttctcaaatgag

SEQ ID NO: 21276 - DNA, 20 bp, Artificial Sequence
  chemically synthesized
actttgtcatcacttgaaaa

SEQ ID NO: 21277 - DNA, 20 bp, Artificial Sequence
  chemically synthesized
tcacttgaaaatagctcatt

SEQ ID NO: 21278 - DNA, 20 bp, Artificial Sequence
  chemically synthesized
cacttgaaaatagctcattg

SEQ ID NO: 21279 - DNA, 20 bp, Artificial Sequence
  chemically synthesized
gctcattgaggatctttgca

SEQ ID NO: 21280 - DNA, 20 bp, Artificial Sequence
  chemically synthesized
tgcaaagtgatccatcaccc

SEQ ID NO: 21281 - DNA, 20 bp, Artificial Sequence
  chemically synthesized
aagtgatccatcaccctggc

SEQ ID NO: 21282 - DNA, 20 bp, Artificial Sequence
  chemically synthesized
agtgatccatcaccctggct

SEQ ID NO: 21283 - DNA, 20 bp, Artificial Sequence
  chemically synthesized
caccctggctgggctgtttt

SEQ ID NO: 21284 - DNA, 20 bp, Artificial Sequence
  chemically synthesized
gctgggctgttttcagaata

SEQ ID NO: 21285 - DNA, 20 bp, Artificial Sequence
  chemically synthesized
ctttgaacaaatgtctcctg

SEQ ID NO: 21286 - DNA, 20 bp, Artificial Sequence
  chemically synthesized
aacaaatgtctcctgaagaa

SEQ ID NO: 21287 - DNA, 20 bp, Artificial Sequence
  chemically synthesized
aaatgtctcctgaagaacag

SEQ ID NO: 21288 - DNA, 20 bp, Artificial Sequence
  chemically synthesized
gaagaacagaagcctaatta

SEQ ID NO: 21289 - DNA, 20 bp, Artificial Sequence
  chemically synthesized
acagaagcctaattatggtc

SEQ ID NO: 21290 - DNA, 20 bp, Artificial Sequence
  chemically synthesized
tccagctgcaaatgtgaccc

SEQ ID NO: 21291 - DNA, 20 bp, Artificial Sequence
  chemically synthesized
gtgaccccagtgtctgtcac

SEQ ID NO: 21292 - DNA, 20 bp, Artificial Sequence
  chemically synthesized
gtgtctgtcactagatgtta

SEQ ID NO: 21293 - DNA, 20 bp, Artificial Sequence
  chemically synthesized
atcactgcattaatttaaaa

SEQ ID NO: 21294 - DNA, 20 bp, Artificial Sequence
  chemically synthesized
ttaatttaaaaaagcaattt

SEQ ID NO: 21295 - DNA, 20 bp, Artificial Sequence
  chemically synthesized
aaaaagcaatttcagatcaa

SEQ ID NO: 21296 - DNA, 20 bp, Artificial Sequence
  chemically synthesized
tttcagatcaacagcacctt

SEQ ID NO: 21297 - DNA, 20 bp, Artificial Sequence
  chemically synthesized
agatcaacagcacctttggt

SEQ ID NO: 21298 - DNA, 20 bp, Artificial Sequence
  chemically synthesized
caacagcacctttggttggc

SEQ ID NO: 21299 - DNA, 20 bp, Artificial Sequence
  chemically synthesized
cctttggttggcaagtgtta

SEQ ID NO: 21300 - DNA, 20 bp, Artificial Sequence
  chemically synthesized
ctttggttggcaagtgttat

SEQ ID NO: 21301 - DNA, 20 bp, Artificial Sequence
  chemically synthesized
ggcaagtgttataggaattg

SEQ ID NO: 21302 - DNA, 20 bp, Artificial Sequence
  chemically synthesized
tataggaattgcagtgattt

SEQ ID NO: 21303 - DNA, 20 bp, Artificial Sequence
  chemically synthesized
cagtgatttaagcatctctc

SEQ ID NO: 21304 - DNA, 20 bp, Artificial Sequence
  chemically synthesized
ttaagcatctctctagaatt

SEQ ID NO: 21305 - DNA, 20 bp, Artificial Sequence
  chemically synthesized
taagcatctctctagaattc

SEQ ID NO: 21306 - DNA, 20 bp, Artificial Sequence
  chemically synthesized
attcaggatatgtttttttt

SEQ ID NO: 21307 - DNA, 20 bp, Artificial Sequence
  chemically synthesized
ttttttaagctacatctacc

SEQ ID NO: 21308 - DNA, 20 bp, Artificial Sequence
  chemically synthesized
agctacatctacctagtctg

SEQ ID NO: 21309 - DNA, 20 bp, Artificial Sequence
  chemically synthesized
ctacatctacctagtctgaa

SEQ ID NO: 21310 - DNA, 20 bp, Artificial Sequence
  chemically synthesized
gaagagacactcctgaactc

SEQ ID NO: 21311 - DNA, 20 bp, Artificial Sequence
  chemically synthesized
agagacactcctgaactctg

SEQ ID NO: 21312 - DNA, 20 bp, Artificial Sequence
  chemically synthesized
gagacactcctgaactctgg

SEQ ID NO: 21313 - DNA, 20 bp, Artificial Sequence
  chemically synthesized
cactcctgaactctggagga

SEQ ID NO: 21314 - DNA, 20 bp, Artificial Sequence
  chemically synthesized
tatcatatatatatatatat

SEQ ID NO: 21315 - DNA, 20 bp, Artificial Sequence
  chemically synthesized
tttgctgcacaatgacattt

SEQ ID NO: 21316 - DNA, 20 bp, Artificial Sequence
  chemically synthesized
aatgacattttggtcaatga

SEQ ID NO: 21317 - DNA, 20 bp, Artificial Sequence
  chemically synthesized
tgatggaccacattatacga

SEQ ID NO: 21318 - DNA, 20 bp, Artificial Sequence
  chemically synthesized
tggaccacattatacgacag

SEQ ID NO: 21319 - DNA, 20 bp, Artificial Sequence
  chemically synthesized
ttatacgacagtggtcccat

SEQ ID NO: 21320 - DNA, 20 bp, Artificial Sequence
  chemically synthesized
tatacgacagtggtcccata

SEQ ID NO: 21321 - DNA, 20 bp, Artificial Sequence
  chemically synthesized
cactgtaccttttctatgtt

SEQ ID NO: 21322 - DNA, 20 bp, Artificial Sequence
  chemically synthesized
accactgttaccattgccta

SEQ ID NO: 21323 - DNA, 20 bp, Artificial Sequence
  chemically synthesized
ttaccattgcctacagtgtt

SEQ ID NO: 21324 - DNA, 20 bp, Artificial Sequence
  chemically synthesized
attgcctacagtgttcagta

SEQ ID NO: 21325 - DNA, 20 bp, Artificial Sequence
  chemically synthesized
cagtacagtcacatgctgta

SEQ ID NO: 21326 - DNA, 20 bp, Artificial Sequence
  chemically synthesized
agtacagtcacatgctgtac

SEQ ID NO: 21327 - DNA, 20 bp, Artificial Sequence
  chemically synthesized
tcacatgctgtacaggtttg

SEQ ID NO: 21328 - DNA, 20 bp, Artificial Sequence
  chemically synthesized
tgctgtacaggtttgcagcc

SEQ ID NO: 21329 - DNA, 20 bp, Artificial Sequence
  chemically synthesized
gctgtacaggtttgcagccc

SEQ ID NO: 21330 - DNA, 20 bp, Artificial Sequence
  chemically synthesized
tgtacaggtttgcagcccag

SEQ ID NO: 21331 - DNA, 20 bp, Artificial Sequence
  chemically synthesized
aggtttgcagcccaggagcc

SEQ ID NO: 21332 - DNA, 20 bp, Artificial Sequence
  chemically synthesized
ggtttgcagcccaggagcct

SEQ ID NO: 21333 - DNA, 20 bp, Artificial Sequence
  chemically synthesized
tttgcagcccaggagcctag

SEQ ID NO: 21334 - DNA, 20 bp, Artificial Sequence
  chemically synthesized
gcccaggagcctaggagcaa

SEQ ID NO: 21335 - DNA, 20 bp, Artificial Sequence
  chemically synthesized
cccaggagcctaggagcaat

SEQ ID NO: 21336 - DNA, 20 bp, Artificial Sequence
  chemically synthesized
taggccacatcaatacaacc

SEQ ID NO: 21337 - DNA, 20 bp, Artificial Sequence
  chemically synthesized
aggccacatcaatacaacct

SEQ ID NO: 21338 - DNA, 20 bp, Artificial Sequence
  chemically synthesized
atcaatacaacctaggtatg

SEQ ID NO: 21339 - DNA, 20 bp, Artificial Sequence
  chemically synthesized
atacaacctaggtatgtagt

SEQ ID NO: 21340 - DNA, 20 bp, Artificial Sequence
  chemically synthesized
atgtagtaagctataccatt

SEQ ID NO: 21341 - DNA, 20 bp, Artificial Sequence
  chemically synthesized
tgtagtaagctataccattt

SEQ ID NO: 21342 - DNA, 20 bp, Artificial Sequence
  chemically synthesized
taagctataccatttaggtt

SEQ ID NO: 21343 - DNA, 20 bp, Artificial Sequence
  chemically synthesized
aagctataccatttaggttt

SEQ ID NO: 21344 - DNA, 20 bp, Artificial Sequence
  chemically synthesized
tataccatttaggtttaggt

SEQ ID NO: 21345 - DNA, 20 bp, Artificial Sequence
  chemically synthesized
ttgcttaatgacacatttct

SEQ ID NO: 21346 - DNA, 20 bp, Artificial Sequence
  chemically synthesized
cagaatatatccccattgtt

SEQ ID NO: 21347 - DNA, 20 bp, Artificial Sequence
  chemically synthesized
agaatatatccccattgtta

SEQ ID NO: 21348 - DNA, 20 bp, Artificial Sequence
  chemically synthesized
ccccattgttaaggaatgca

SEQ ID NO: 21349 - DNA, 20 bp, Artificial Sequence
  chemically synthesized
tgtatgtataaaattaataa

SEQ ID NO: 21350 - DNA, 20 bp, Artificial Sequence
  chemically synthesized
gtatgtataaaattaataac

SEQ ID NO: 21351 - DNA, 20 bp, Artificial Sequence
  chemically synthesized
tatgtataaaattaataaca

SEQ ID NO: 21352 - DNA, 20 bp, Artificial Sequence
  chemically synthesized
aaaattaataacagggactc

SEQ ID NO: 21353 - DNA, 20 bp, Artificial Sequence
  chemically synthesized
attaataacagggactcaag

SEQ ID NO: 21354 - DNA, 20 bp, Artificial Sequence
  chemically synthesized
cagggactcaagaagttgcc

SEQ ID NO: 21355 - DNA, 20 bp, Artificial Sequence
  chemically synthesized
gggactcaagaagttgcctg

SEQ ID NO: 21356 - DNA, 20 bp, Artificial Sequence
  chemically synthesized
ctggagttgttcctttcttc

SEQ ID NO: 21357 - DNA, 20 bp, Artificial Sequence
  chemically synthesized
tggagttgttcctttcttca

SEQ ID NO: 21358 - DNA, 20 bp, Artificial Sequence
  chemically synthesized
ggagttgttcctttcttcaa

SEQ ID NO: 21359 - DNA, 20 bp, Artificial Sequence
  chemically synthesized
tgttcctttcttcaagggtc

SEQ ID NO: 21360 - DNA, 20 bp, Artificial Sequence
  chemically synthesized
aatatatctgataccatctc

SEQ ID NO: 21361 - DNA, 20 bp, Artificial Sequence
  chemically synthesized
tatatctgataccatctcaa

SEQ ID NO: 21362 - DNA, 20 bp, Artificial Sequence
  chemically synthesized
atatctgataccatctcaag

SEQ ID NO: 21363 - DNA, 20 bp, Artificial Sequence
  chemically synthesized
gataccatctcaagaggacc

SEQ ID NO: 21364 - DNA, 20 bp, Artificial Sequence
  chemically synthesized
ataccatctcaagaggacca

SEQ ID NO: 21365 - DNA, 20 bp, Artificial Sequence
  chemically synthesized
taccatctcaagaggaccaa

SEQ ID NO: 21366 - DNA, 20 bp, Artificial Sequence
  chemically synthesized
caagaggaccaagggcttat

SEQ ID NO: 21367 - DNA, 20 bp, Artificial Sequence
  chemically synthesized
ggcttataagatgaactttc

SEQ ID NO: 21368 - DNA, 20 bp, Artificial Sequence
  chemically synthesized
gcttataagatgaactttct

SEQ ID NO: 21369 - DNA, 20 bp, Artificial Sequence
  chemically synthesized
cttataagatgaactttctg

SEQ ID NO: 21370 - DNA, 20 bp, Artificial Sequence
  chemically synthesized
gatgaactttctggggtatt

SEQ ID NO: 21371 - DNA, 20 bp, Artificial Sequence
  chemically synthesized
atgaactttctggggtattt

SEQ ID NO: 21372 - DNA, 20 bp, Artificial Sequence
  chemically synthesized
acttcctgattaactccaaa

SEQ ID NO: 21373 - DNA, 20 bp, Artificial Sequence
  chemically synthesized
cttcctgattaactccaaaa

SEQ ID NO: 21374 - DNA, 20 bp, Artificial Sequence
  chemically synthesized
cctgattaactccaaaaagg

SEQ ID NO: 21375 - DNA, 20 bp, Artificial Sequence
  chemically synthesized
tgattaactccaaaaaggaa

SEQ ID NO: 21376 - DNA, 20 bp, Artificial Sequence
  chemically synthesized
taactccaaaaaggaagaga

SEQ ID NO: 21377 - DNA, 20 bp, Artificial Sequence
  chemically synthesized
aactccaaaaaggaagagaa

SEQ ID NO: 21378 - DNA, 20 bp, Artificial Sequence
  chemically synthesized
ccaaaaaggaagagaaagga

SEQ ID NO: 21379 - DNA, 20 bp, Artificial Sequence
  chemically synthesized
ggaagagaaaggaaagtaaa

SEQ ID NO: 21380 - DNA, 20 bp, Artificial Sequence
  chemically synthesized
gaagagaaaggaaagtaaaa

SEQ ID NO: 21381 - DNA, 20 bp, Artificial Sequence
  chemically synthesized
agaaaggaaagtaaaaagga

SEQ ID NO: 21382 - DNA, 20 bp, Artificial Sequence
  chemically synthesized
gaaaggaaagtaaaaaggaa

SEQ ID NO: 21383 - DNA, 20 bp, Artificial Sequence
  chemically synthesized
ggaaagtaaaaaggaaagga

SEQ ID NO: 21384 - DNA, 20 bp, Artificial Sequence
  chemically synthesized
taaaaaggaaaggaaagaaa

SEQ ID NO: 21385 - DNA, 20 bp, Artificial Sequence
  chemically synthesized
aaaaggaaaggaaagaaacg

SEQ ID NO: 21386 - DNA, 20 bp, Artificial Sequence
  chemically synthesized
ttcttcccttattttcattg

SEQ ID NO: 21387 - DNA, 20 bp, Artificial Sequence
  chemically synthesized
cattgcagctgttcacttta

SEQ ID NO: 21388 - DNA, 20 bp, Artificial Sequence
  chemically synthesized
ttgcagctgttcactttatg

SEQ ID NO: 21389 - DNA, 20 bp, Artificial Sequence
  chemically synthesized
gttcactttatggagtgttc

SEQ ID NO: 21390 - DNA, 20 bp, Artificial Sequence
  chemically synthesized
ctgcttttcccttgctctgc

SEQ ID NO: 21391 - DNA, 20 bp, Artificial Sequence
  chemically synthesized
cttgctctgcaagttccttt

SEQ ID NO: 21392 - DNA, 20 bp, Artificial Sequence
  chemically synthesized
ttgctctgcaagttcctttt

SEQ ID NO: 21393 - DNA, 20 bp, Artificial Sequence
  chemically synthesized
tcactttttttctttgaatt

SEQ ID NO: 21394 - DNA, 20 bp, Artificial Sequence
  chemically synthesized
ttttttctttgaatttagcc

SEQ ID NO: 21395 - DNA, 20 bp, Artificial Sequence
  chemically synthesized
ttcaactcttttttttttga

SEQ ID NO: 21396 - DNA, 20 bp, Artificial Sequence
  chemically synthesized
caactcttttttttttgaca

SEQ ID NO: 21397 - DNA, 20 bp, Artificial Sequence
  chemically synthesized
cagagtcttgctctgtcgcc

SEQ ID NO: 21398 - DNA, 20 bp, Artificial Sequence
  chemically synthesized
agagtcttgctctgtcgccc

SEQ ID NO: 21399 - DNA, 20 bp, Artificial Sequence
  chemically synthesized
tcttgctctgtcgcccaggc

SEQ ID NO: 21400 - DNA, 20 bp, Artificial Sequence
  chemically synthesized
ttgctctgtcgcccaggctg

SEQ ID NO: 21401 - DNA, 20 bp, Artificial Sequence
  chemically synthesized
ctgtcgcccaggctggagtg

SEQ ID NO: 21402 - DNA, 20 bp, Artificial Sequence
  chemically synthesized
tcgcccaggctggagtgcag

SEQ ID NO: 21403 - DNA, 20 bp, Artificial Sequence
  chemically synthesized
ggagtgcagtggtgcgatct

SEQ ID NO: 21404 - DNA, 20 bp, Artificial Sequence
  chemically synthesized
tcactgcaacctccatctcc

SEQ ID NO: 21405 - DNA, 20 bp, Artificial Sequence
  chemically synthesized
cactgcaacctccatctccc

SEQ ID NO: 21406 - DNA, 20 bp, Artificial Sequence
  chemically synthesized
aacctccatctcccaggttc

SEQ ID NO: 21407 - DNA, 20 bp, Artificial Sequence
  chemically synthesized
ttcaagctattctcctgcct

SEQ ID NO: 21408 - DNA, 20 bp, Artificial Sequence
  chemically synthesized
ttctcctgcctcagcctccc

SEQ ID NO: 21409 - DNA, 20 bp, Artificial Sequence
  chemically synthesized
tcctgcctcagcctcccaag

SEQ ID NO: 21410 - DNA, 20 bp, Artificial Sequence
  chemically synthesized
gcctcagcctcccaagtagc

SEQ ID NO: 21411 - DNA, 20 bp, Artificial Sequence
  chemically synthesized
cctcagcctcccaagtagct

SEQ ID NO: 21412 - DNA, 20 bp, Artificial Sequence
  chemically synthesized
ctcccaagtagctgggatta

SEQ ID NO: 21413 - DNA, 20 bp, Artificial Sequence
  chemically synthesized
tcccaagtagctgggattac

SEQ ID NO: 21414 - DNA, 20 bp, Artificial Sequence
  chemically synthesized
caggcacccgccaccatgcc

SEQ ID NO: 21415 - DNA, 20 bp, Artificial Sequence
  chemically synthesized
ccagctaatttttgtatttt

SEQ ID NO: 21416 - DNA, 20 bp, Artificial Sequence
  chemically synthesized
taatttttgtatttttagta

SEQ ID NO: 21417 - DNA, 20 bp, Artificial Sequence
  chemically synthesized
ttttgtatttttagtaaagc

SEQ ID NO: 21418 - DNA, 20 bp, Artificial Sequence
  chemically synthesized
tttgtatttttagtaaagcc

SEQ ID NO: 21419 - DNA, 20 bp, Artificial Sequence
  chemically synthesized
ttgtatttttagtaaagccg

SEQ ID NO: 21420 - DNA, 20 bp, Artificial Sequence
  chemically synthesized
gtttcaccatttcaccttgt

SEQ ID NO: 21421 - DNA, 20 bp, Artificial Sequence
  chemically synthesized
caccatttcaccttgttggc

SEQ ID NO: 21422 - DNA, 20 bp, Artificial Sequence
  chemically synthesized
accatttcaccttgttggcc

SEQ ID NO: 21423 - DNA, 20 bp, Artificial Sequence
  chemically synthesized
tttcaccttgttggccaggc

SEQ ID NO: 21424 - DNA, 20 bp, Artificial Sequence
  chemically synthesized
ggtgtcgaactcctgacctc

SEQ ID NO: 21425 - DNA, 20 bp, Artificial Sequence
  chemically synthesized
cctcaagtgatctgcctgcc

SEQ ID NO: 21426 - DNA, 20 bp, Artificial Sequence
  chemically synthesized
ctcaagtgatctgcctgcct

SEQ ID NO: 21427 - DNA, 20 bp, Artificial Sequence
  chemically synthesized
ctgcctgcctgggcctctga

SEQ ID NO: 21428 - DNA, 20 bp, Artificial Sequence
  chemically synthesized
gcctgggcctctgaaagtgc

SEQ ID NO: 21429 - DNA, 20 bp, Artificial Sequence
  chemically synthesized
cctgggcctctgaaagtgct

SEQ ID NO: 21430 - DNA, 20 bp, Artificial Sequence
  chemically synthesized
ctctgaaagtgctgggatta

SEQ ID NO: 21431 - DNA, 20 bp, Artificial Sequence
  chemically synthesized
tctgaaagtgctgggattat

SEQ ID NO: 21432 - DNA, 20 bp, Artificial Sequence
  chemically synthesized
agtgctgggattataggtgt

SEQ ID NO: 21433 - DNA, 20 bp, Artificial Sequence
  chemically synthesized
ataggtgtgagccaccatgc

SEQ ID NO: 21434 - DNA, 20 bp, Artificial Sequence
  chemically synthesized
taggtgtgagccaccatgcc

SEQ ID NO: 21435 - DNA, 20 bp, Artificial Sequence
  chemically synthesized
gcctctcttcaactcttcat

SEQ ID NO: 21436 - DNA, 20 bp, Artificial Sequence
  chemically synthesized
ctgtgcccaccctgcaatcc

SEQ ID NO: 21437 - DNA, 20 bp, Artificial Sequence
  chemically synthesized
tgcaatcctagcccctaaat

SEQ ID NO: 21438 - DNA, 20 bp, Artificial Sequence
  chemically synthesized
caatcctagcccctaaattg

SEQ ID NO: 21439 - DNA, 20 bp, Artificial Sequence
  chemically synthesized
tcctagcccctaaattggag

SEQ ID NO: 21440 - DNA, 20 bp, Artificial Sequence
  chemically synthesized
tgccttcatccttctcttcc

SEQ ID NO: 21441 - DNA, 20 bp, Artificial Sequence
  chemically synthesized
ttcatccttctcttcccaga

SEQ ID NO: 21442 - DNA, 20 bp, Artificial Sequence
  chemically synthesized
ccttctcttcccagacagcc

SEQ ID NO: 21443 - DNA, 20 bp, Artificial Sequence
  chemically synthesized
cttctcttcccagacagccg

SEQ ID NO: 21444 - DNA, 20 bp, Artificial Sequence
  chemically synthesized
ccagacagccgaggactgtg

SEQ ID NO: 21445 - DNA, 20 bp, Artificial Sequence
  chemically synthesized
cagacagccgaggactgtga

SEQ ID NO: 21446 - DNA, 20 bp, Artificial Sequence
  chemically synthesized
ggaaaaaaatcaccaaaatg

SEQ ID NO: 21447 - DNA, 20 bp, Artificial Sequence
  chemically synthesized
aaaaatcaccaaaatgcaga

SEQ ID NO: 21448 - DNA, 20 bp, Artificial Sequence
  chemically synthesized
caccacatattgatgcctca

SEQ ID NO: 21449 - DNA, 20 bp, Artificial Sequence
  chemically synthesized
cctccacccacctctctgct

SEQ ID NO: 21450 - DNA, 20 bp, Artificial Sequence
  chemically synthesized
tgctcagcaactcatttact

SEQ ID NO: 21451 - DNA, 20 bp, Artificial Sequence
  chemically synthesized
gcaactcatttacttggccc

SEQ ID NO: 21452 - DNA, 20 bp, Artificial Sequence
  chemically synthesized
tggccctggacactcctaaa

SEQ ID NO: 21453 - DNA, 20 bp, Artificial Sequence
  chemically synthesized
tccatgcctgcatccattta

SEQ ID NO: 21454 - DNA, 20 bp, Artificial Sequence
  chemically synthesized
atccatttacagtcgttcct

SEQ ID NO: 21455 - DNA, 20 bp, Artificial Sequence
  chemically synthesized
cagtcgttcctcagtatcca

SEQ ID NO: 21456 - DNA, 20 bp, Artificial Sequence
  chemically synthesized
cctcagtatccatggaaaat

SEQ ID NO: 21457 - DNA, 20 bp, Artificial Sequence
  chemically synthesized
cagtatccatggaaaattgg

SEQ ID NO: 21458 - DNA, 20 bp, Artificial Sequence
  chemically synthesized
atccatggaaaattggtggc

SEQ ID NO: 21459 - DNA, 20 bp, Artificial Sequence
  chemically synthesized
caagaccccctgcaaatatc

SEQ ID NO: 21460 - DNA, 20 bp, Artificial Sequence
  chemically synthesized
cctgcaaatatcaagatctg

SEQ ID NO: 21461 - DNA, 20 bp, Artificial Sequence
  chemically synthesized
atcaagatctgtggatgctc

SEQ ID NO: 21462 - DNA, 20 bp, Artificial Sequence
  chemically synthesized
tcaagtctccgatataaaaa

SEQ ID NO: 21463 - DNA, 20 bp, Artificial Sequence
  chemically synthesized
tttgtactttaaatcatctc

SEQ ID NO: 21464 - DNA, 20 bp, Artificial Sequence
  chemically synthesized
ttgtactttaaatcatctct

SEQ ID NO: 21465 - DNA, 20 bp, Artificial Sequence
  chemically synthesized
catctctaggtttctcttaa

SEQ ID NO: 21466 - DNA, 20 bp, Artificial Sequence
  chemically synthesized
caatgtaaatgctatgtaaa

SEQ ID NO: 21467 - DNA, 20 bp, Artificial Sequence
  chemically synthesized
agttgttatgctgtattgtt

SEQ ID NO: 21468 - DNA, 20 bp, Artificial Sequence
  chemically synthesized
gttgttatgctgtattgttt

SEQ ID NO: 21469 - DNA, 20 bp, Artificial Sequence
  chemically synthesized
ttgttatgctgtattgttta

SEQ ID NO: 21470 - DNA, 20 bp, Artificial Sequence
  chemically synthesized
tattgtttagggaataatga

SEQ ID NO: 21471 - DNA, 20 bp, Artificial Sequence
  chemically synthesized
tagggaataatgaaagataa

SEQ ID NO: 21472 - DNA, 20 bp, Artificial Sequence
  chemically synthesized
gggaataatgaaagataaaa

SEQ ID NO: 21473 - DNA, 20 bp, Artificial Sequence
  chemically synthesized
taaaagagtctgtacatgtt

SEQ ID NO: 21474 - DNA, 20 bp, Artificial Sequence
  chemically synthesized
aagagtctgtacatgttcag

SEQ ID NO: 21475 - DNA, 20 bp, Artificial Sequence
  chemically synthesized
gagtctgtacatgttcagta

SEQ ID NO: 21476 - DNA, 20 bp, Artificial Sequence
  chemically synthesized
tcttgaatatttttgatctg

SEQ ID NO: 21477 - DNA, 20 bp, Artificial Sequence
  chemically synthesized
tctgcagttaattgaatctg

SEQ ID NO: 21478 - DNA, 20 bp, Artificial Sequence
  chemically synthesized
gttaattgaatctgtggctg

SEQ ID NO: 21479 - DNA, 20 bp, Artificial Sequence
  chemically synthesized
tctgtggctgtggaactcac

SEQ ID NO: 21480 - DNA, 20 bp, Artificial Sequence
  chemically synthesized
ctgtggctgtggaactcaca

SEQ ID NO: 21481 - DNA, 20 bp, Artificial Sequence
  chemically synthesized
gtggctgtggaactcacaag

SEQ ID NO: 21482 - DNA, 20 bp, Artificial Sequence
  chemically synthesized
ggctgtggaactcacaagga

SEQ ID NO: 21483 - DNA, 20 bp, Artificial Sequence
  chemically synthesized
cacaaggagagctgactgta

SEQ ID NO: 21484 - DNA, 20 bp, Artificial Sequence
  chemically synthesized
ggagagctgactgtacagtg

SEQ ID NO: 21485 - DNA, 20 bp, Artificial Sequence
  chemically synthesized
gctgactgtacagtgtggtt

SEQ ID NO: 21486 - DNA, 20 bp, Artificial Sequence
  chemically synthesized
agtgtggttgagtgaaaaaa

SEQ ID NO: 21487 - DNA, 20 bp, Artificial Sequence
  chemically synthesized
ttgagtgaaaaaacagactt

SEQ ID NO: 21488 - DNA, 20 bp, Artificial Sequence
  chemically synthesized
gaaaaaacagactttagaat

SEQ ID NO: 21489 - DNA, 20 bp, Artificial Sequence
  chemically synthesized
aacagactttagaatcagat

SEQ ID NO: 21490 - DNA, 20 bp, Artificial Sequence
  chemically synthesized
gactttagaatcagatcaga

SEQ ID NO: 21491 - DNA, 20 bp, Artificial Sequence
  chemically synthesized
agaatcagatcagacagaaa

SEQ ID NO: 21492 - DNA, 20 bp, Artificial Sequence
  chemically synthesized
gaatcagatcagacagaaat

SEQ ID NO: 21493 - DNA, 20 bp, Artificial Sequence
  chemically synthesized
gacagaaataggtttgaatc

SEQ ID NO: 21494 - DNA, 20 bp, Artificial Sequence
  chemically synthesized
aatcaagtatctgcctcctc

SEQ ID NO: 21495 - DNA, 20 bp, Artificial Sequence
  chemically synthesized
ctcctctagacctgtgacct

SEQ ID NO: 21496 - DNA, 20 bp, Artificial Sequence
  chemically synthesized
ctagacctgtgaccttggac

SEQ ID NO: 21497 - DNA, 20 bp, Artificial Sequence
  chemically synthesized
tgaccttggacaagtcacac

SEQ ID NO: 21498 - DNA, 20 bp, Artificial Sequence
  chemically synthesized
taactttgtcaaatgtaaat

SEQ ID NO: 21499 - DNA, 20 bp, Artificial Sequence
  chemically synthesized
aactttgtcaaatgtaaatt

SEQ ID NO: 21500 - DNA, 20 bp, Artificial Sequence
  chemically synthesized
caaatgtaaattaggtttaa

SEQ ID NO: 21501 - DNA, 20 bp, Artificial Sequence
  chemically synthesized
atgtaaattaggtttaacag

SEQ ID NO: 21502 - DNA, 20 bp, Artificial Sequence
  chemically synthesized
aggtttaacagtagtataat

SEQ ID NO: 21503 - DNA, 20 bp, Artificial Sequence
  chemically synthesized
taataagaatatctatctca

SEQ ID NO: 21504 - DNA, 20 bp, Artificial Sequence
  chemically synthesized
aataagaatatctatctcac

SEQ ID NO: 21505 - DNA, 20 bp, Artificial Sequence
  chemically synthesized
aatatctatctcacaggtgt

SEQ ID NO: 21506 - DNA, 20 bp, Artificial Sequence
  chemically synthesized
atctatctcacaggtgttgg

SEQ ID NO: 21507 - DNA, 20 bp, Artificial Sequence
  chemically synthesized
tctatctcacaggtgttggc

SEQ ID NO: 21508 - DNA, 20 bp, Artificial Sequence
  chemically synthesized
ctcacaggtgttggcaggat

SEQ ID NO: 21509 - DNA, 20 bp, Artificial Sequence
  chemically synthesized
caggtgttggcaggatcagt

SEQ ID NO: 21510 - DNA, 20 bp, Artificial Sequence
  chemically synthesized
ggatcagtgagacaatatgc

SEQ ID NO: 21511 - DNA, 20 bp, Artificial Sequence
  chemically synthesized
tctccctactcctttcatgt

SEQ ID NO: 21512 - DNA, 20 bp, Artificial Sequence
  chemically synthesized
ttaaatttctcaattctctt

SEQ ID NO: 21513 - DNA, 20 bp, Artificial Sequence
  chemically synthesized
gctctttaataacttctgtg

SEQ ID NO: 21514 - DNA, 20 bp, Artificial Sequence
  chemically synthesized
gaaatgactattgtcacaat

SEQ ID NO: 21515 - DNA, 20 bp, Artificial Sequence
  chemically synthesized
aaatgactattgtcacaatc

SEQ ID NO: 21516 - DNA, 20 bp, Artificial Sequence
  chemically synthesized
tcacaatcaggaatgaccta

SEQ ID NO: 21517 - DNA, 20 bp, Artificial Sequence
  chemically synthesized
atgacctaaagaataatttt

SEQ ID NO: 21518 - DNA, 20 bp, Artificial Sequence
  chemically synthesized
ttttgagtttatgtatttac

SEQ ID NO: 21519 - DNA, 20 bp, Artificial Sequence
  chemically synthesized
attgttgatctctccctttt

SEQ ID NO: 21520 - DNA, 20 bp, Artificial Sequence
  chemically synthesized
ttgttgatctctcccttttt

SEQ ID NO: 21521 - DNA, 20 bp, Artificial Sequence
  chemically synthesized
ttataataatcactctattc

SEQ ID NO: 21522 - DNA, 20 bp, Artificial Sequence
  chemically synthesized
tctaactcctgttatccatc

SEQ ID NO: 21523 - DNA, 20 bp, Artificial Sequence
  chemically synthesized
ttaactcctgttcctctcca

SEQ ID NO: 21524 - DNA, 20 bp, Artificial Sequence
  chemically synthesized
ctccatggcccttaaatgtc

SEQ ID NO: 21525 - DNA, 20 bp, Artificial Sequence
  chemically synthesized
tccatggcccttaaatgtcc

SEQ ID NO: 21526 - DNA, 20 bp, Artificial Sequence
  chemically synthesized
ccatggcccttaaatgtcca

SEQ ID NO: 21527 - DNA, 20 bp, Artificial Sequence
  chemically synthesized
ttaaatgtccagggttctcc

SEQ ID NO: 21528 - DNA, 20 bp, Artificial Sequence
  chemically synthesized
taaatgtccagggttctccc

SEQ ID NO: 21529 - DNA, 20 bp, Artificial Sequence
  chemically synthesized
tccagggttctcccaggctc

SEQ ID NO: 21530 - DNA, 20 bp, Artificial Sequence
  chemically synthesized
gttctcccaggctccagcct

SEQ ID NO: 21531 - DNA, 20 bp, Artificial Sequence
  chemically synthesized
ttcaccttatatatacttgc

SEQ ID NO: 21532 - DNA, 20 bp, Artificial Sequence
  chemically synthesized
tcaccttatatatacttgct

SEQ ID NO: 21533 - DNA, 20 bp, Artificial Sequence
  chemically synthesized
caccttatatatacttgcta

SEQ ID NO: 21534 - DNA, 20 bp, Artificial Sequence
  chemically synthesized
ttatatatacttgctagggc

SEQ ID NO: 21535 - DNA, 20 bp, Artificial Sequence
  chemically synthesized
tatatatacttgctagggct

SEQ ID NO: 21536 - DNA, 20 bp, Artificial Sequence
  chemically synthesized
atacttgctagggctgggac

SEQ ID NO: 21537 - DNA, 20 bp, Artificial Sequence
  chemically synthesized
acttgctagggctgggacaa

SEQ ID NO: 21538 - DNA, 20 bp, Artificial Sequence
  chemically synthesized
gggacaagagtgaaccaaac

SEQ ID NO: 21539 - DNA, 20 bp, Artificial Sequence
  chemically synthesized
ggacaagagtgaaccaaaca

SEQ ID NO: 21540 - DNA, 20 bp, Artificial Sequence
  chemically synthesized
agtgaaccaaacaaggcatg

SEQ ID NO: 21541 - DNA, 20 bp, Artificial Sequence
  chemically synthesized
gtgaaccaaacaaggcatgt

SEQ ID NO: 21542 - DNA, 20 bp, Artificial Sequence
  chemically synthesized
tgaaccaaacaaggcatgta

SEQ ID NO: 21543 - DNA, 20 bp, Artificial Sequence
  chemically synthesized
gcatgtagggcacaatattt

SEQ ID NO: 21544 - DNA, 20 bp, Artificial Sequence
  chemically synthesized
atgtagggcacaatatttaa

SEQ ID NO: 21545 - DNA, 20 bp, Artificial Sequence
  chemically synthesized
tgtagggcacaatatttaag

SEQ ID NO: 21546 - DNA, 20 bp, Artificial Sequence
  chemically synthesized
tttaagaggtcctcacttct

SEQ ID NO: 21547 - DNA, 20 bp, Artificial Sequence
  chemically synthesized
ttaagaggtcctcacttctc

SEQ ID NO: 21548 - DNA, 20 bp, Artificial Sequence
  chemically synthesized
taagaggtcctcacttctcg

SEQ ID NO: 21549 - DNA, 20 bp, Artificial Sequence
  chemically synthesized
cctcacttctcggggcatac

SEQ ID NO: 21550 - DNA, 20 bp, Artificial Sequence
  chemically synthesized
acaagtatatttatgcccta

SEQ ID NO: 21551 - DNA, 20 bp, Artificial Sequence
  chemically synthesized
caagtatatttatgccctac

SEQ ID NO: 21552 - DNA, 20 bp, Artificial Sequence
  chemically synthesized
cctacaggccttgcttacca

SEQ ID NO: 21553 - DNA, 20 bp, Artificial Sequence
  chemically synthesized
aggccttgcttaccacagtc

SEQ ID NO: 21554 - DNA, 20 bp, Artificial Sequence
  chemically synthesized
ttgcttaccacagtctagtc

SEQ ID NO: 21555 - DNA, 20 bp, Artificial Sequence
  chemically synthesized
ccctgtcaacaaaatttact

SEQ ID NO: 21556 - DNA, 20 bp, Artificial Sequence
  chemically synthesized
gagcatacaaccactactgc

SEQ ID NO: 21557 - DNA, 20 bp, Artificial Sequence
  chemically synthesized
agcatacaaccactactgcc

SEQ ID NO: 21558 - DNA, 20 bp, Artificial Sequence
  chemically synthesized
actactgccaggcactgtac

SEQ ID NO: 21559 - DNA, 20 bp, Artificial Sequence
  chemically synthesized
ctactgccaggcactgtact

SEQ ID NO: 21560 - DNA, 20 bp, Artificial Sequence
  chemically synthesized
caatatccatgctcactctc

SEQ ID NO: 21561 - DNA, 20 bp, Artificial Sequence
  chemically synthesized
tctccagatgcccacacacg

SEQ ID NO: 21562 - DNA, 20 bp, Artificial Sequence
  chemically synthesized
gtggctgtaactactgttta

SEQ ID NO: 21563 - DNA, 20 bp, Artificial Sequence
  chemically synthesized
actactgtttacagaacaat

SEQ ID NO: 21564 - DNA, 20 bp, Artificial Sequence
  chemically synthesized
gagttccaaatactcaccta

SEQ ID NO: 21565 - DNA, 20 bp, Artificial Sequence
  chemically synthesized
tccaaatactcacctatagt

SEQ ID NO: 21566 - DNA, 20 bp, Artificial Sequence
  chemically synthesized
cagatacgtctcctgaattt

SEQ ID NO: 21567 - DNA, 20 bp, Artificial Sequence
  chemically synthesized
cctaactgtatatcataatg

SEQ ID NO: 21568 - DNA, 20 bp, Artificial Sequence
  chemically synthesized
actgtatatcataatgtagc

SEQ ID NO: 21569 - DNA, 20 bp, Artificial Sequence
  chemically synthesized
tatcataatgtagccagtaa

SEQ ID NO: 21570 - DNA, 20 bp, Artificial Sequence
  chemically synthesized
atgtaatgcttctgctgtgt

SEQ ID NO: 21571 - DNA, 20 bp, Artificial Sequence
  chemically synthesized
gctgtgttggacactgtgct

SEQ ID NO: 21572 - DNA, 20 bp, Artificial Sequence
  chemically synthesized
atctcacttcatcctcacaa

SEQ ID NO: 21573 - DNA, 20 bp, Artificial Sequence
  chemically synthesized
catcctcacaaaagtcccac

SEQ ID NO: 21574 - DNA, 20 bp, Artificial Sequence
  chemically synthesized
ctcacaaaagtcccacgaga

SEQ ID NO: 21575 - DNA, 20 bp, Artificial Sequence
  chemically synthesized
tcacaaaagtcccacgagat

SEQ ID NO: 21576 - DNA, 20 bp, Artificial Sequence
  chemically synthesized
gtcatcttatttttatgaat

SEQ ID NO: 21577 - DNA, 20 bp, Artificial Sequence
  chemically synthesized
tcatcttatttttatgaatg

SEQ ID NO: 21578 - DNA, 20 bp, Artificial Sequence
  chemically synthesized
tcttatttttatgaatgagg

SEQ ID NO: 21579 - DNA, 20 bp, Artificial Sequence
  chemically synthesized
atttttatgaatgaggaaga

SEQ ID NO: 21580 - DNA, 20 bp, Artificial Sequence
  chemically synthesized
gaatgaggaagatagattca

SEQ ID NO: 21581 - DNA, 20 bp, Artificial Sequence
  chemically synthesized
atgaggaagatagattcata

SEQ ID NO: 21582 - DNA, 20 bp, Artificial Sequence
  chemically synthesized
tgaggaagatagattcatag

SEQ ID NO: 21583 - DNA, 20 bp, Artificial Sequence
  chemically synthesized
aagatagattcatagaggct

SEQ ID NO: 21584 - DNA, 20 bp, Artificial Sequence
  chemically synthesized
agatagattcatagaggcta

SEQ ID NO: 21585 - DNA, 20 bp, Artificial Sequence
  chemically synthesized
gatagattcatagaggctaa

SEQ ID NO: 21586 - DNA, 20 bp, Artificial Sequence
  chemically synthesized
agaggctaagggctttgccc

SEQ ID NO: 21587 - DNA, 20 bp, Artificial Sequence
  chemically synthesized
gaggctaagggctttgccca

SEQ ID NO: 21588 - DNA, 20 bp, Artificial Sequence
  chemically synthesized
aggtaacatactaaaacatt

SEQ ID NO: 21589 - DNA, 20 bp, Artificial Sequence
  chemically synthesized
ggtaacatactaaaacattc

SEQ ID NO: 21590 - DNA, 20 bp, Artificial Sequence
  chemically synthesized
atactaaaacattcaggatt

SEQ ID NO: 21591 - DNA, 20 bp, Artificial Sequence
  chemically synthesized
aacattcaggattcagactc

SEQ ID NO: 21592 - DNA, 20 bp, Artificial Sequence
  chemically synthesized
attcaggattcagactctgg

SEQ ID NO: 21593 - DNA, 20 bp, Artificial Sequence
  chemically synthesized
aggattcagactctggcagt

SEQ ID NO: 21594 - DNA, 20 bp, Artificial Sequence
  chemically synthesized
agactctggcagtcagacta

SEQ ID NO: 21595 - DNA, 20 bp, Artificial Sequence
  chemically synthesized
actctggcagtcagactaaa

SEQ ID NO: 21596 - DNA, 20 bp, Artificial Sequence
  chemically synthesized
tggcagtcagactaaagagc

SEQ ID NO: 21597 - DNA, 20 bp, Artificial Sequence
  chemically synthesized
gactaaagagccagttctct

SEQ ID NO: 21598 - DNA, 20 bp, Artificial Sequence
  chemically synthesized
ttctcttagacattattctg

SEQ ID NO: 21599 - DNA, 20 bp, Artificial Sequence
  chemically synthesized
ccataatcacatcaaacaca

SEQ ID NO: 21600 - DNA, 20 bp, Artificial Sequence
  chemically synthesized
acatcaaacacaaagtcccc

SEQ ID NO: 21601 - DNA, 20 bp, Artificial Sequence
  chemically synthesized
acacaaagtccccaagactc

SEQ ID NO: 21602 - DNA, 20 bp, Artificial Sequence
  chemically synthesized
gccatttccccttccatacc

SEQ ID NO: 21603 - DNA, 20 bp, Artificial Sequence
  chemically synthesized
tttccccttccatacccaga

SEQ ID NO: 21604 - DNA, 20 bp, Artificial Sequence
  chemically synthesized
ccttccatacccagatggtt

SEQ ID NO: 21605 - DNA, 20 bp, Artificial Sequence
  chemically synthesized
ttttttgtactgctactgtt

SEQ ID NO: 21606 - DNA, 20 bp, Artificial Sequence
  chemically synthesized
tttttgtactgctactgttc

SEQ ID NO: 21607 - DNA, 20 bp, Artificial Sequence
  chemically synthesized
tactgctactgttcaggttc

SEQ ID NO: 21608 - DNA, 20 bp, Artificial Sequence
  chemically synthesized
tctagcctttatgtctcccg

SEQ ID NO: 21609 - DNA, 20 bp, Artificial Sequence
  chemically synthesized
tctcccgcagataattgcaa

SEQ ID NO: 21610 - DNA, 20 bp, Artificial Sequence
  chemically synthesized
gcagataattgcaatagtct

SEQ ID NO: 21611 - DNA, 20 bp, Artificial Sequence
  chemically synthesized
cagataattgcaatagtctc

SEQ ID NO: 21612 - DNA, 20 bp, Artificial Sequence
  chemically synthesized
gtctcaggactgctctctcc

SEQ ID NO: 21613 - DNA, 20 bp, Artificial Sequence
  chemically synthesized
ggactgctctctcctagtct

SEQ ID NO: 21614 - DNA, 20 bp, Artificial Sequence
  chemically synthesized
gctctctcctagtcttggta

SEQ ID NO: 21615 - DNA, 20 bp, Artificial Sequence
  chemically synthesized
ctcccccactatcatttcat

SEQ ID NO: 21616 - DNA, 20 bp, Artificial Sequence
  chemically synthesized
tcatttcattagcgtgttgc

SEQ ID NO: 21617 - DNA, 20 bp, Artificial Sequence
  chemically synthesized
tcattagcgtgttgccagac

SEQ ID NO: 21618 - DNA, 20 bp, Artificial Sequence
  chemically synthesized
cattagcgtgttgccagact

SEQ ID NO: 21619 - DNA, 20 bp, Artificial Sequence
  chemically synthesized
ccagactgggcatcctaaat

SEQ ID NO: 21620 - DNA, 20 bp, Artificial Sequence
  chemically synthesized
gggcatcctaaatcagccat

SEQ ID NO: 21621 - DNA, 20 bp, Artificial Sequence
  chemically synthesized
catcctaaatcagccatcag

SEQ ID NO: 21622 - DNA, 20 bp, Artificial Sequence
  chemically synthesized
attttattgtccaatctcct

SEQ ID NO: 21623 - DNA, 20 bp, Artificial Sequence
  chemically synthesized
ttttattgtccaatctcctt

SEQ ID NO: 21624 - DNA, 20 bp, Artificial Sequence
  chemically synthesized
tgacttcattatctgatgac

SEQ ID NO: 21625 - DNA, 20 bp, Artificial Sequence
  chemically synthesized
atctgatgaccagctctgcc

SEQ ID NO: 21626 - DNA, 20 bp, Artificial Sequence
  chemically synthesized
tttacctgtctcacttgtca

SEQ ID NO: 21627 - DNA, 20 bp, Artificial Sequence
  chemically synthesized
ctcacttgtcatagtccata

SEQ ID NO: 21628 - DNA, 20 bp, Artificial Sequence
  chemically synthesized
cctcacgttcttgcaaatct

SEQ ID NO: 21629 - DNA, 20 bp, Artificial Sequence
  chemically synthesized
gcaaatctgagtctttgcac

SEQ ID NO: 21630 - DNA, 20 bp, Artificial Sequence
  chemically synthesized
tgcataaaatgcccttatat

SEQ ID NO: 21631 - DNA, 20 bp, Artificial Sequence
  chemically synthesized
gcccttatatcagacattta

SEQ ID NO: 21632 - DNA, 20 bp, Artificial Sequence
  chemically synthesized
ccttatatcagacatttaaa

SEQ ID NO: 21633 - DNA, 20 bp, Artificial Sequence
  chemically synthesized
ttatatcagacatttaaaga

SEQ ID NO: 21634 - DNA, 20 bp, Artificial Sequence
  chemically synthesized
atatcagacatttaaagaga

SEQ ID NO: 21635 - DNA, 20 bp, Artificial Sequence
  chemically synthesized
agaacgcctactcatctttt

SEQ ID NO: 21636 - DNA, 20 bp, Artificial Sequence
  chemically synthesized
cctactcatcttttaagacc

SEQ ID NO: 21637 - DNA, 20 bp, Artificial Sequence
  chemically synthesized
ttcctttctctatgatccct

SEQ ID NO: 21638 - DNA, 20 bp, Artificial Sequence
  chemically synthesized
ctctatgatcccttagtacc

SEQ ID NO: 21639 - DNA, 20 bp, Artificial Sequence
  chemically synthesized
ttatattgaaacctctcacc

SEQ ID NO: 21640 - DNA, 20 bp, Artificial Sequence
  chemically synthesized
cacctggcctcatgctgctt

SEQ ID NO: 21641 - DNA, 20 bp, Artificial Sequence
  chemically synthesized
cctcatgctgctttagatca

SEQ ID NO: 21642 - DNA, 20 bp, Artificial Sequence
  chemically synthesized
tcatgctgctttagatcaaa

SEQ ID NO: 21643 - DNA, 20 bp, Artificial Sequence
  chemically synthesized
catgctgctttagatcaaag

SEQ ID NO: 21644 - DNA, 20 bp, Artificial Sequence
  chemically synthesized
atgctgctttagatcaaaga

SEQ ID NO: 21645 - DNA, 20 bp, Artificial Sequence
  chemically synthesized
gctgctttagatcaaagagg

SEQ ID NO: 21646 - DNA, 20 bp, Artificial Sequence
  chemically synthesized
tttagatcaaagagggagtc

SEQ ID NO: 21647 - DNA, 20 bp, Artificial Sequence
  chemically synthesized
ctggtttatccccatacccc

SEQ ID NO: 21648 - DNA, 20 bp, Artificial Sequence
  chemically synthesized
atacccctagtaccctgaca

SEQ ID NO: 21649 - DNA, 20 bp, Artificial Sequence
  chemically synthesized
tagtaccctgacacagtacc

SEQ ID NO: 21650 - DNA, 20 bp, Artificial Sequence
  chemically synthesized
tgacacagtacctggcacca

SEQ ID NO: 21651 - DNA, 20 bp, Artificial Sequence
  chemically synthesized
ctggcaccatagttgtaact

SEQ ID NO: 21652 - DNA, 20 bp, Artificial Sequence
  chemically synthesized
aactcagtaatgtctgaatg

SEQ ID NO: 21653 - DNA, 20 bp, Artificial Sequence
  chemically synthesized
actcagtaatgtctgaatga

SEQ ID NO: 21654 - DNA, 20 bp, Artificial Sequence
  chemically synthesized
tacactttacaaaactaaac

SEQ ID NO: 21655 - DNA, 20 bp, Artificial Sequence
  chemically synthesized
acaaaactaaactggtttta

SEQ ID NO: 21656 - DNA, 20 bp, Artificial Sequence
  chemically synthesized
aactgttgcaataataccta

SEQ ID NO: 21657 - DNA, 20 bp, Artificial Sequence
  chemically synthesized
actgttgcaataatacctaa

SEQ ID NO: 21658 - DNA, 20 bp, Artificial Sequence
  chemically synthesized
gttgcaataatacctaaagg

SEQ ID NO: 21659 - DNA, 20 bp, Artificial Sequence
  chemically synthesized
gcaataatacctaaaggcag

SEQ ID NO: 21660 - DNA, 20 bp, Artificial Sequence
  chemically synthesized
gccatgaaaatgcaacatct

SEQ ID NO: 21661 - DNA, 20 bp, Artificial Sequence
  chemically synthesized
tcactcaccgaaactccttt

SEQ ID NO: 21662 - DNA, 20 bp, Artificial Sequence
  chemically synthesized
ctcaccgaaactccttttag

SEQ ID NO: 21663 - DNA, 20 bp, Artificial Sequence
  chemically synthesized
aactccttttagaagccaat

SEQ ID NO: 21664 - DNA, 20 bp, Artificial Sequence
  chemically synthesized
ctccttttagaagccaatga

SEQ ID NO: 21665 - DNA, 20 bp, Artificial Sequence
  chemically synthesized
agaagccaatgagagtttaa

SEQ ID NO: 21666 - DNA, 20 bp, Artificial Sequence
  chemically synthesized
agccaatgagagtttaatag

SEQ ID NO: 21667 - DNA, 20 bp, Artificial Sequence
  chemically synthesized
caatgagagtttaatagcag

SEQ ID NO: 21668 - DNA, 20 bp, Artificial Sequence
  chemically synthesized
atgagagtttaatagcagaa

SEQ ID NO: 21669 - DNA, 20 bp, Artificial Sequence
  chemically synthesized
gagagtttaatagcagaaga

SEQ ID NO: 21670 - DNA, 20 bp, Artificial Sequence
  chemically synthesized
gcattaatactgtctatcct

SEQ ID NO: 21671 - DNA, 20 bp, Artificial Sequence
  chemically synthesized
tatccttagaaaaattcccc

SEQ ID NO: 21672 - DNA, 20 bp, Artificial Sequence
  chemically synthesized
attcccctggccccttcctc

SEQ ID NO: 21673 - DNA, 20 bp, Artificial Sequence
  chemically synthesized
ttcccctggccccttcctca

SEQ ID NO: 21674 - DNA, 20 bp, Artificial Sequence
  chemically synthesized
tcccctggccccttcctcaa

SEQ ID NO: 21675 - DNA, 20 bp, Artificial Sequence
  chemically synthesized
cctcaagggcttattatctc

SEQ ID NO: 21676 - DNA, 20 bp, Artificial Sequence
  chemically synthesized
cttattatctctggctacaa

SEQ ID NO: 21677 - DNA, 20 bp, Artificial Sequence
  chemically synthesized
atctctggctacaatggctg

SEQ ID NO: 21678 - DNA, 20 bp, Artificial Sequence
  chemically synthesized
aatcacattgcctttctcct

SEQ ID NO: 21679 - DNA, 20 bp, Artificial Sequence
  chemically synthesized
cctttctccttagtattatc

SEQ ID NO: 21680 - DNA, 20 bp, Artificial Sequence
  chemically synthesized
ctttctccttagtattatct

SEQ ID NO: 21681 - DNA, 20 bp, Artificial Sequence
  chemically synthesized
tttctccttagtattatctg

SEQ ID NO: 21682 - DNA, 20 bp, Artificial Sequence
  chemically synthesized
tcgtatacttaacttccctt

SEQ ID NO: 21683 - DNA, 20 bp, Artificial Sequence
  chemically synthesized
cgtatacttaacttcccttc

SEQ ID NO: 21684 - DNA, 20 bp, Artificial Sequence
  chemically synthesized
cttcccttcaggtttatcgc

SEQ ID NO: 21685 - DNA, 20 bp, Artificial Sequence
  chemically synthesized
tatcgctagtcattatttcc

SEQ ID NO: 21686 - DNA, 20 bp, Artificial Sequence
  chemically synthesized
atcgctagtcattatttccc

SEQ ID NO: 21687 - DNA, 20 bp, Artificial Sequence
  chemically synthesized
cattatttcccaggctccaa

SEQ ID NO: 21688 - DNA, 20 bp, Artificial Sequence
  chemically synthesized
tttcccaggctccaaaagcc

SEQ ID NO: 21689 - DNA, 20 bp, Artificial Sequence
  chemically synthesized
attcttatctatcctttccc

SEQ ID NO: 21690 - DNA, 20 bp, Artificial Sequence
  chemically synthesized
tatcctttccccagcatctg

SEQ ID NO: 21691 - DNA, 20 bp, Artificial Sequence
  chemically synthesized
ccccagcatctgaagtcttc

SEQ ID NO: 21692 - DNA, 20 bp, Artificial Sequence
  chemically synthesized
cccagcatctgaagtcttca

SEQ ID NO: 21693 - DNA, 20 bp, Artificial Sequence
  chemically synthesized
ccagcatctgaagtcttcaa

SEQ ID NO: 21694 - DNA, 20 bp, Artificial Sequence
  chemically synthesized
cagcatctgaagtcttcaag

SEQ ID NO: 21695 - DNA, 20 bp, Artificial Sequence
  chemically synthesized
agcatctgaagtcttcaagg

SEQ ID NO: 21696 - DNA, 20 bp, Artificial Sequence
  chemically synthesized
atctgaagtcttcaaggggg

SEQ ID NO: 21697 - DNA, 20 bp, Artificial Sequence
  chemically synthesized
tgaagtcttcaagggggcag

SEQ ID NO: 21698 - DNA, 20 bp, Artificial Sequence
  chemically synthesized
tcatcatctcaccacttata

SEQ ID NO: 21699 - DNA, 20 bp, Artificial Sequence
  chemically synthesized
tcatctcaccacttatatag

SEQ ID NO: 21700 - DNA, 20 bp, Artificial Sequence
  chemically synthesized
ctcaccacttatatagaaga

SEQ ID NO: 21701 - DNA, 20 bp, Artificial Sequence
  chemically synthesized
tcaccacttatatagaagaa

SEQ ID NO: 21702 - DNA, 20 bp, Artificial Sequence
  chemically synthesized
caccacttatatagaagaaa

SEQ ID NO: 21703 - DNA, 20 bp, Artificial Sequence
  chemically synthesized
cttatatagaagaaagggtt

SEQ ID NO: 21704 - DNA, 20 bp, Artificial Sequence
  chemically synthesized
gtttggatgctttgtcctcc

SEQ ID NO: 21705 - DNA, 20 bp, Artificial Sequence
  chemically synthesized
ctcccagatgtcacactaat

SEQ ID NO: 21706 - DNA, 20 bp, Artificial Sequence
  chemically synthesized
cactaatgagatatatctaa

SEQ ID NO: 21707 - DNA, 20 bp, Artificial Sequence
  chemically synthesized
tgctttatgtcctgctttgt

SEQ ID NO: 21708 - DNA, 20 bp, Artificial Sequence
  chemically synthesized
cttgactttactcactttgc

SEQ ID NO: 21709 - DNA, 20 bp, Artificial Sequence
  chemically synthesized
atttttttttatcgttattt

SEQ ID NO: 21710 - DNA, 20 bp, Artificial Sequence
  chemically synthesized
ttatcgttatttcagcattt

SEQ ID NO: 21711 - DNA, 20 bp, Artificial Sequence
  chemically synthesized
agcatttcagtctgatttca

SEQ ID NO: 21712 - DNA, 20 bp, Artificial Sequence
  chemically synthesized
ttcacagctgacatcatgtc

SEQ ID NO: 21713 - DNA, 20 bp, Artificial Sequence
  chemically synthesized
cacagctgacatcatgtctg

SEQ ID NO: 21714 - DNA, 20 bp, Artificial Sequence
  chemically synthesized
agctgacatcatgtctggag

SEQ ID NO: 21715 - DNA, 20 bp, Artificial Sequence
  chemically synthesized
gctgacatcatgtctggagt

SEQ ID NO: 21716 - DNA, 20 bp, Artificial Sequence
  chemically synthesized
catgtctggagtgggaacca

SEQ ID NO: 21717 - DNA, 20 bp, Artificial Sequence
  chemically synthesized
atgtctggagtgggaaccac

SEQ ID NO: 21718 - DNA, 20 bp, Artificial Sequence
  chemically synthesized
tgtctggagtgggaaccaca

SEQ ID NO: 21719 - DNA, 20 bp, Artificial Sequence
  chemically synthesized
tggagtgggaaccacagggc

SEQ ID NO: 21720 - DNA, 20 bp, Artificial Sequence
  chemically synthesized
gtgggaaccacagggccagt

SEQ ID NO: 21721 - DNA, 20 bp, Artificial Sequence
  chemically synthesized
cacagggccagtcagctttc

SEQ ID NO: 21722 - DNA, 20 bp, Artificial Sequence
  chemically synthesized
acagggccagtcagctttct

SEQ ID NO: 21723 - DNA, 20 bp, Artificial Sequence
  chemically synthesized
cagggccagtcagctttctg

SEQ ID NO: 21724 - DNA, 20 bp, Artificial Sequence
  chemically synthesized
agggccagtcagctttctgg

SEQ ID NO: 21725 - DNA, 20 bp, Artificial Sequence
  chemically synthesized
gtcagctttctgggggtgct

SEQ ID NO: 21726 - DNA, 20 bp, Artificial Sequence
  chemically synthesized
tcagctttctgggggtgctt

SEQ ID NO: 21727 - DNA, 20 bp, Artificial Sequence
  chemically synthesized
cagctttctgggggtgctta

SEQ ID NO: 21728 - DNA, 20 bp, Artificial Sequence
  chemically synthesized
tttctgggggtgcttagggt

SEQ ID NO: 21729 - DNA, 20 bp, Artificial Sequence
  chemically synthesized
agggttggcacccctgatcc

SEQ ID NO: 21730 - DNA, 20 bp, Artificial Sequence
  chemically synthesized
acccctgatcctggtactgt

SEQ ID NO: 21731 - DNA, 20 bp, Artificial Sequence
  chemically synthesized
atcctggtactgtcagctac

SEQ ID NO: 21732 - DNA, 20 bp, Artificial Sequence
  chemically synthesized
tcagctactagatttgattc

SEQ ID NO: 21733 - DNA, 20 bp, Artificial Sequence
  chemically synthesized
ctactagatttgattctaga

SEQ ID NO: 21734 - DNA, 20 bp, Artificial Sequence
  chemically synthesized
tttgattctagaaagttgac

SEQ ID NO: 21735 - DNA, 20 bp, Artificial Sequence
  chemically synthesized
attctagaaagttgacaagt

SEQ ID NO: 21736 - DNA, 20 bp, Artificial Sequence
  chemically synthesized
gtgtgataaatgcttcctgt

SEQ ID NO: 21737 - DNA, 20 bp, Artificial Sequence
  chemically synthesized
gaacatgctgtttgtccaaa

SEQ ID NO: 21738 - DNA, 20 bp, Artificial Sequence
  chemically synthesized
aacatgctgtttgtccaaat

SEQ ID NO: 21739 - DNA, 20 bp, Artificial Sequence
  chemically synthesized
cttccctgtatgccttcctc

SEQ ID NO: 21740 - DNA, 20 bp, Artificial Sequence
  chemically synthesized
ttccctgtatgccttcctct

SEQ ID NO: 21741 - DNA, 20 bp, Artificial Sequence
  chemically synthesized
cttcctctgggaaatacata

SEQ ID NO: 21742 - DNA, 20 bp, Artificial Sequence
  chemically synthesized
ggaaatacataaagtcactg

SEQ ID NO: 21743 - DNA, 20 bp, Artificial Sequence
  chemically synthesized
actgtagttgtgaaaaaaca

SEQ ID NO: 21744 - DNA, 20 bp, Artificial Sequence
  chemically synthesized
caaagtgatatatgttgcat

SEQ ID NO: 21745 - DNA, 20 bp, Artificial Sequence
  chemically synthesized
tactctttatgtcaattctt

SEQ ID NO: 21746 - DNA, 20 bp, Artificial Sequence
  chemically synthesized
ttaagcttgcttttctcccc

SEQ ID NO: 21747 - DNA, 20 bp, Artificial Sequence
  chemically synthesized
taagcttgcttttctcccct

SEQ ID NO: 21748 - DNA, 20 bp, Artificial Sequence
  chemically synthesized
aagcttgcttttctccccta

SEQ ID NO: 21749 - DNA, 20 bp, Artificial Sequence
  chemically synthesized
ctcccctagggaactcaact

SEQ ID NO: 21750 - DNA, 20 bp, Artificial Sequence
  chemically synthesized
tttccccaaatatcaactcc

SEQ ID NO: 21751 - DNA, 20 bp, Artificial Sequence
  chemically synthesized
caactccaagatgtttgaca

SEQ ID NO: 21752 - DNA, 20 bp, Artificial Sequence
  chemically synthesized
actccaagatgtttgacata

SEQ ID NO: 21753 - DNA, 20 bp, Artificial Sequence
  chemically synthesized
attttttcctaatccatgaa

SEQ ID NO: 21754 - DNA, 20 bp, Artificial Sequence
  chemically synthesized
tcctaatccatgaaaagctt

SEQ ID NO: 21755 - DNA, 20 bp, Artificial Sequence
  chemically synthesized
aaagctttggtgataactaa

SEQ ID NO: 21756 - DNA, 20 bp, Artificial Sequence
  chemically synthesized
aactaacagcttgctaatga

SEQ ID NO: 21757 - DNA, 20 bp, Artificial Sequence
  chemically synthesized
actaacagcttgctaatgaa

SEQ ID NO: 21758 - DNA, 20 bp, Artificial Sequence
  chemically synthesized
ttaactaaaactttaaattg

SEQ ID NO: 21759 - DNA, 20 bp, Artificial Sequence
  chemically synthesized
agatatataatttaaaaaat

SEQ ID NO: 21760 - DNA, 20 bp, Artificial Sequence
  chemically synthesized
atatataatttaaaaaatta

SEQ ID NO: 21761 - DNA, 20 bp, Artificial Sequence
  chemically synthesized
aatgtcatatatcttaaaat

SEQ ID NO: 21762 - DNA, 20 bp, Artificial Sequence
  chemically synthesized
atcagactttttgtgtaaat

SEQ ID NO: 21763 - DNA, 20 bp, Artificial Sequence
  chemically synthesized
tcagactttttgtgtaaata

SEQ ID NO: 21764 - DNA, 20 bp, Artificial Sequence
  chemically synthesized
tgtttcccattttgatttca

SEQ ID NO: 21765 - DNA, 20 bp, Artificial Sequence
  chemically synthesized
ttcccattttgatttcaaag

SEQ ID NO: 21766 - DNA, 20 bp, Artificial Sequence
  chemically synthesized
cattttgatttcaaagtggt

SEQ ID NO: 21767 - DNA, 20 bp, Artificial Sequence
  chemically synthesized
aagtccaaacaaaaataatg

SEQ ID NO: 21768 - DNA, 20 bp, Artificial Sequence
  chemically synthesized
acttttaatttttttaaacc

SEQ ID NO: 21769 - DNA, 20 bp, Artificial Sequence
  chemically synthesized
cttttaatttttttaaacca

SEQ ID NO: 21770 - DNA, 20 bp, Artificial Sequence
  chemically synthesized
tttaatttttttaaaccaag

SEQ ID NO: 21771 - DNA, 20 bp, Artificial Sequence
  chemically synthesized
aggagatgaatgttttctaa

SEQ ID NO: 21772 - DNA, 20 bp, Artificial Sequence
  chemically synthesized
ggagatgaatgttttctaac

SEQ ID NO: 21773 - DNA, 20 bp, Artificial Sequence
  chemically synthesized
tgaccaaatcatgaactgaa

SEQ ID NO: 21774 - DNA, 20 bp, Artificial Sequence
  chemically synthesized
attaaacataaatgcatcat

SEQ ID NO: 21775 - DNA, 20 bp, Artificial Sequence
  chemically synthesized
ataagcattgtcgatctatt

SEQ ID NO: 21776 - DNA, 20 bp, Artificial Sequence
  chemically synthesized
tctatttagttttaaaaatg

SEQ ID NO: 21777 - DNA, 20 bp, Artificial Sequence
  chemically synthesized
atttagttttaaaaatgaag

SEQ ID NO: 21778 - DNA, 20 bp, Artificial Sequence
  chemically synthesized
tagttttaaaaatgaagaag

SEQ ID NO: 21779 - DNA, 20 bp, Artificial Sequence
  chemically synthesized
aaatgaagaagaagaaaacc

SEQ ID NO: 21780 - DNA, 20 bp, Artificial Sequence
  chemically synthesized
agaagaaaacctagctaaca

SEQ ID NO: 21781 - DNA, 20 bp, Artificial Sequence
  chemically synthesized
aaacctagctaacaaagaac

SEQ ID NO: 21782 - DNA, 20 bp, Artificial Sequence
  chemically synthesized
gtacttaccaacctgcgtgc

SEQ ID NO: 21783 - DNA, 20 bp, Artificial Sequence
  chemically synthesized
ccaacctgcgtgctggctgt

SEQ ID NO: 21784 - DNA, 20 bp, Artificial Sequence
  chemically synthesized
caaatcatgtaatcaaaatt

SEQ ID NO: 21785 - DNA, 20 bp, Artificial Sequence
  chemically synthesized
catgtaatcaaaatttagtg

SEQ ID NO: 21786 - DNA, 20 bp, Artificial Sequence
  chemically synthesized
gtaatcaaaatttagtgaag

SEQ ID NO: 21787 - DNA, 20 bp, Artificial Sequence
  chemically synthesized
tcaaaatttagtgaagaaga

SEQ ID NO: 21788 - DNA, 20 bp, Artificial Sequence
  chemically synthesized
tttagtgaagaagacagcat

SEQ ID NO: 21789 - DNA, 20 bp, Artificial Sequence
  chemically synthesized
tcagatatttctatatctaa

SEQ ID NO: 21790 - DNA, 20 bp, Artificial Sequence
  chemically synthesized
cagatatttctatatctaaa

SEQ ID NO: 21791 - DNA, 20 bp, Artificial Sequence
  chemically synthesized
tatttctatatctaaaaggc

SEQ ID NO: 21792 - DNA, 20 bp, Artificial Sequence
  chemically synthesized
atactcaatgtattttaaaa

SEQ ID NO: 21793 - DNA, 20 bp, Artificial Sequence
  chemically synthesized
tactcaatgtattttaaaaa

SEQ ID NO: 21794 - DNA, 20 bp, Artificial Sequence
  chemically synthesized
aggaaacaaacctgtacatt

SEQ ID NO: 21795 - DNA, 20 bp, Artificial Sequence
  chemically synthesized
aaacctgtacattcagcact

SEQ ID NO: 21796 - DNA, 20 bp, Artificial Sequence
  chemically synthesized
cctgtacattcagcactgag

SEQ ID NO: 21797 - DNA, 20 bp, Artificial Sequence
  chemically synthesized
gcactgagtagatatcctaa

SEQ ID NO: 21798 - DNA, 20 bp, Artificial Sequence
  chemically synthesized
cactgagtagatatcctaaa

SEQ ID NO: 21799 - DNA, 20 bp, Artificial Sequence
  chemically synthesized
tgagtagatatcctaaaagg

SEQ ID NO: 21800 - DNA, 20 bp, Artificial Sequence
  chemically synthesized
tagatatcctaaaaggcaga

SEQ ID NO: 21801 - DNA, 20 bp, Artificial Sequence
  chemically synthesized
cctaaaaggcagatggtgat

SEQ ID NO: 21802 - DNA, 20 bp, Artificial Sequence
  chemically synthesized
ctaaaaggcagatggtgatg

SEQ ID NO: 21803 - DNA, 20 bp, Artificial Sequence
  chemically synthesized
aggcagatggtgatgaggcc

SEQ ID NO: 21804 - DNA, 20 bp, Artificial Sequence
  chemically synthesized
acgcgctgcataacctttgc

SEQ ID NO: 21805 - DNA, 20 bp, Artificial Sequence
  chemically synthesized
cgctgcataacctttgctag

SEQ ID NO: 21806 - DNA, 20 bp, Artificial Sequence
  chemically synthesized
cctttgctagcagattgtga

SEQ ID NO: 21807 - DNA, 20 bp, Artificial Sequence
  chemically synthesized
ttgctagcagattgtgaaag

SEQ ID NO: 21808 - DNA, 20 bp, Artificial Sequence
  chemically synthesized
gcgcgtgaacatgatcatgg

SEQ ID NO: 21809 - DNA, 20 bp, Artificial Sequence
  chemically synthesized
cctcatcaccatctgccttt

SEQ ID NO: 21810 - DNA, 20 bp, Artificial Sequence
  chemically synthesized
tttaggatatctactcagtg

SEQ ID NO: 21811 - DNA, 20 bp, Artificial Sequence
  chemically synthesized
gtttccttttttaaaataca

SEQ ID NO: 21812 - DNA, 20 bp, Artificial Sequence
  chemically synthesized
atgatttgacagcaatattg

SEQ ID NO: 21813 - DNA, 20 bp, Artificial Sequence
  chemically synthesized
gtgggaaaacaaagaaatag

SEQ ID NO: 21814 - DNA, 20 bp, Artificial Sequence
  chemically synthesized
agttatcaccaaagcttttc

SEQ ID NO: 21815 - DNA, 20 bp, Artificial Sequence
  chemically synthesized
tgtctctatgtcaaacatct

SEQ ID NO: 21816 - DNA, 20 bp, Artificial Sequence
  chemically synthesized
tggggaaacacaatactcag

SEQ ID NO: 21817 - DNA, 20 bp, Artificial Sequence
  chemically synthesized
taggggagaaaagcaagctt

SEQ ID NO: 21818 - DNA, 20 bp, Artificial Sequence
  chemically synthesized
caagcttaagaattgacata

SEQ ID NO: 21819 - DNA, 20 bp, Artificial Sequence
  chemically synthesized
acacttacttgtcaactttc

SEQ ID NO: 21820 - DNA, 20 bp, Artificial Sequence
  chemically synthesized
aatctagtagctgacagtac

SEQ ID NO: 21821 - DNA, 20 bp, Artificial Sequence
  chemically synthesized
tagctgacagtaccaggatc

SEQ ID NO: 21822 - DNA, 20 bp, Artificial Sequence
  chemically synthesized
acagaggttaaactagcaaa

SEQ ID NO: 21823 - DNA, 20 bp, Artificial Sequence
  chemically synthesized
tagcaaagtgagtaaagtca

SEQ ID NO: 21824 - DNA, 20 bp, Artificial Sequence
  chemically synthesized
aagacttcagatgctgggga

SEQ ID NO: 21825 - DNA, 20 bp, Artificial Sequence
  chemically synthesized
atgctggggaaaggatagat

SEQ ID NO: 21826 - DNA, 20 bp, Artificial Sequence
  chemically synthesized
gggaaaggatagataagaat

SEQ ID NO: 21827 - DNA, 20 bp, Artificial Sequence
  chemically synthesized
gcccttgaggaaggggccag

SEQ ID NO: 21828 - DNA, 20 bp, Artificial Sequence
  chemically synthesized
ggggccaggggaatttttct

SEQ ID NO: 21829 - DNA, 20 bp, Artificial Sequence
  chemically synthesized
aactctcattggcttctaaa

SEQ ID NO: 21830 - DNA, 20 bp, Artificial Sequence
  chemically synthesized
ggcttctaaaaggagtttcg

SEQ ID NO: 21831 - DNA, 20 bp, Artificial Sequence
  chemically synthesized
taggtattattgcaacagtt

SEQ ID NO: 21832 - DNA, 20 bp, Artificial Sequence
  chemically synthesized
tgtccttcattcagacatta

SEQ ID NO: 21833 - DNA, 20 bp, Artificial Sequence
  chemically synthesized
tatggtgccaggtactgtgt

SEQ ID NO: 21834 - DNA, 20 bp, Artificial Sequence
  chemically synthesized
aggtactgtgtcagggtact

SEQ ID NO: 21835 - DNA, 20 bp, Artificial Sequence
  chemically synthesized
tgtcagggtactaggggtat

SEQ ID NO: 21836 - DNA, 20 bp, Artificial Sequence
  chemically synthesized
aaaatgtgcactaggtacta

SEQ ID NO: 21837 - DNA, 20 bp, Artificial Sequence
  chemically synthesized
ggggaaacaattgatagaga

SEQ ID NO: 21838 - DNA, 20 bp, Artificial Sequence
  chemically synthesized
tagagagagaatattttcat

SEQ ID NO: 21839 - DNA, 20 bp, Artificial Sequence
  chemically synthesized
tttcatctgggtcttaaaag

SEQ ID NO: 21840 - DNA, 20 bp, Artificial Sequence
  chemically synthesized
ataagggcattttatgcaaa

SEQ ID NO: 21841 - DNA, 20 bp, Artificial Sequence
  chemically synthesized
gcaagaacgtgaggtatttc

SEQ ID NO: 21842 - DNA, 20 bp, Artificial Sequence
  chemically synthesized
ggtatcgaagtataaacata

SEQ ID NO: 21843 - DNA, 20 bp, Artificial Sequence
  chemically synthesized
agtaccactgatggctgatt

SEQ ID NO: 21844 - DNA, 20 bp, Artificial Sequence
  chemically synthesized
gtagcagtacaaaaaaagag

SEQ ID NO: 21845 - DNA, 20 bp, Artificial Sequence
  chemically synthesized
aagtggtatgacttaaccat

SEQ ID NO: 21846 - DNA, 20 bp, Artificial Sequence
  chemically synthesized
ggtatggaaggggaaatggc

SEQ ID NO: 21847 - DNA, 20 bp, Artificial Sequence
  chemically synthesized
tttgatgtgattatggacca

SEQ ID NO: 21848 - DNA, 20 bp, Artificial Sequence
  chemically synthesized
tggctctttagtctgactgc

SEQ ID NO: 21849 - DNA, 20 bp, Artificial Sequence
  chemically synthesized
tttagtctgactgccagagt

SEQ ID NO: 21850 - DNA, 20 bp, Artificial Sequence
  chemically synthesized
tgactgccagagtctgaatc

SEQ ID NO: 21851 - DNA, 20 bp, Artificial Sequence
  chemically synthesized
gggcaaagcccttagcctct

SEQ ID NO: 21852 - DNA, 20 bp, Artificial Sequence
  chemically synthesized
ctatctcgtgggacttttgt

SEQ ID NO: 21853 - DNA, 20 bp, Artificial Sequence
  chemically synthesized
tgtgaggatgaagtgagata

SEQ ID NO: 21854 - DNA, 20 bp, Artificial Sequence
  chemically synthesized
tacattatgatatacagtta

SEQ ID NO: 21855 - DNA, 20 bp, Artificial Sequence
  chemically synthesized
ggagacgtatctgactatag

SEQ ID NO: 21856 - DNA, 20 bp, Artificial Sequence
  chemically synthesized
gccacgtgtgtgggcatctg

SEQ ID NO: 21857 - DNA, 20 bp, Artificial Sequence
  chemically synthesized
tgggcatctggagagtgagc

SEQ ID NO: 21858 - DNA, 20 bp, Artificial Sequence
  chemically synthesized
tgctcagtaaattttgttga

SEQ ID NO: 21859 - DNA, 20 bp, Artificial Sequence
  chemically synthesized
taagggccatggagaggaac

SEQ ID NO: 21860 - DNA, 20 bp, Artificial Sequence
  chemically synthesized
ggagttaatcaattcaagtg

SEQ ID NO: 21861 - DNA, 20 bp, Artificial Sequence
  chemically synthesized
ttaatcaattcaagtgctgg

SEQ ID NO: 21862 - DNA, 20 bp, Artificial Sequence
  chemically synthesized
tcaagtgctggatggataac

SEQ ID NO: 21863 - DNA, 20 bp, Artificial Sequence
  chemically synthesized
gttagagcaaagcggggaac

SEQ ID NO: 21864 - DNA, 20 bp, Artificial Sequence
  chemically synthesized
agcaaagcggggaaccagaa

SEQ ID NO: 21865 - DNA, 20 bp, Artificial Sequence
  chemically synthesized
aatagagtgattattataaa

SEQ ID NO: 21866 - DNA, 20 bp, Artificial Sequence
  chemically synthesized
gaagttattaaagagctaaa

SEQ ID NO: 21867 - DNA, 20 bp, Artificial Sequence
  chemically synthesized
gaaagtagggccaacatgaa

SEQ ID NO: 21868 - DNA, 20 bp, Artificial Sequence
  chemically synthesized
ctgtacagtcagctctcctt

SEQ ID NO: 21869 - DNA, 20 bp, Artificial Sequence
  chemically synthesized
caaaaatattcaagaaaaaa

SEQ ID NO: 21870 - DNA, 20 bp, Artificial Sequence
  chemically synthesized
agatgatttaaagtacaaag

SEQ ID NO: 21871 - DNA, 20 bp, Artificial Sequence
  chemically synthesized
cacagatcttgatatttgca

SEQ ID NO: 21872 - DNA, 20 bp, Artificial Sequence
  chemically synthesized
ggtcttgccaccaattttcc

SEQ ID NO: 21873 - DNA, 20 bp, Artificial Sequence
  chemically synthesized
atactgaggaacgactgtaa

SEQ ID NO: 21874 - DNA, 20 bp, Artificial Sequence
  chemically synthesized
gactgtaaatggatgcaggc

SEQ ID NO: 21875 - DNA, 20 bp, Artificial Sequence
  chemically synthesized
tgcaggcatggatgctattt

SEQ ID NO: 21876 - DNA, 20 bp, Artificial Sequence
  chemically synthesized
gagtgtccagggccaagtaa

SEQ ID NO: 21877 - DNA, 20 bp, Artificial Sequence
  chemically synthesized
atgagttgctgagcagagag

SEQ ID NO: 21878 - DNA, 20 bp, Artificial Sequence
  chemically synthesized
cctcggctgtctgggaagag

SEQ ID NO: 21879 - DNA, 20 bp, Artificial Sequence
  chemically synthesized
ggctgctccaatttaggggc

SEQ ID NO: 21880 - DNA, 20 bp, Artificial Sequence
  chemically synthesized
caatttaggggctaggattg

SEQ ID NO: 21881 - DNA, 20 bp, Artificial Sequence
  chemically synthesized
gggtgggcacagcattgcaa

SEQ ID NO: 21882 - DNA, 20 bp, Artificial Sequence
  chemically synthesized
attgagaaatatggccaatg

SEQ ID NO: 21883 - DNA, 20 bp, Artificial Sequence
  chemically synthesized
caggcagatcacttgaggtc

SEQ ID NO: 21884 - DNA, 20 bp, Artificial Sequence
  chemically synthesized
aaaattagctgggcatggtg

SEQ ID NO: 21885 - DNA, 20 bp, Artificial Sequence
  chemically synthesized
tacttgggaggctgaggcag

SEQ ID NO: 21886 - DNA, 20 bp, Artificial Sequence
  chemically synthesized
caagactctgtcaaaaaaaa

SEQ ID NO: 21887 - DNA, 20 bp, Artificial Sequence
  chemically synthesized
ttgcagagcaagggaaaagc

SEQ ID NO: 21888 - DNA, 20 bp, Artificial Sequence
  chemically synthesized
ctttcctttctcttcctttt

SEQ ID NO: 21889 - DNA, 20 bp, Artificial Sequence
  chemically synthesized
gaacaactccaggcaacttc

SEQ ID NO: 21890 - DNA, 20 bp, Artificial Sequence
  chemically synthesized
gccatgcattccttaacaat

SEQ ID NO: 21891 - DNA, 20 bp, Artificial Sequence
  chemically synthesized
tcatcattgtgcgaacataa

SEQ ID NO: 21892 - DNA, 20 bp, Artificial Sequence
  chemically synthesized
agatagagacatctatcctc

SEQ ID NO: 21893 - DNA, 20 bp, Artificial Sequence
  chemically synthesized
acatctatcctccagagttc

SEQ ID NO: 21894 - DNA, 20 bp, Artificial Sequence
  chemically synthesized
tagcttaaaaaaaacatatc

SEQ ID NO: 21895 - DNA, 20 bp, Artificial Sequence
  chemically synthesized
taacatctagtgacagacac

SEQ ID NO: 21896 - DNA, 20 bp, Artificial Sequence
  chemically synthesized
tattctgaaaacagcccagc

SEQ ID NO: 21897 - DNA, 20 bp, Artificial Sequence
  chemically synthesized
aaaacagcccagccagggtg

SEQ ID NO: 21898 - DNA, 20 bp, Artificial Sequence
  chemically synthesized
gaaatctgaccttttattac

SEQ ID NO: 21899 - DNA, 20 bp, Artificial Sequence
  chemically synthesized
tctcttgactaaaagtaaaa

SEQ ID NO: 21900 - DNA, 20 bp, Artificial Sequence
  chemically synthesized
gaaattggctttcagattat

SEQ ID NO: 21901 - DNA, 20 bp, Artificial Sequence
  chemically synthesized
tttcttttttgctaaaacta

SEQ ID NO: 21902 - DNA, 20 bp, Artificial Sequence
  chemically synthesized
atgaaaacgccaacaaaatt

SEQ ID NO: 21903 - DNA, 20 bp, Artificial Sequence
  chemically synthesized
gtataattcaggtaaattgg

SEQ ID NO: 21904 - DNA, 20 bp, Artificial Sequence
  chemically synthesized
tgttcaagggaaccttgaga

SEQ ID NO: 21905 - DNA, 20 bp, Artificial Sequence
  chemically synthesized
aacaaactcttccaatttac

SEQ ID NO: 21906 - DNA, 20 bp, Artificial Sequence
  chemically synthesized
ttatacctctttggccgatt

SEQ ID NO: 21907 - DNA, 20 bp, Artificial Sequence
  chemically synthesized
caagaaaaactgaaatgtaa

SEQ ID NO: 21908 - DNA, 20 bp, Artificial Sequence
  chemically synthesized
ctgtatacacatggagattt

SEQ ID NO: 21909 - DNA, 20 bp, Artificial Sequence
  chemically synthesized
tcaattttacttttagtcaa

SEQ ID NO: 21910 - DNA, 20 bp, Artificial Sequence
  chemically synthesized
ggtcagatttctaatcatat

SEQ ID NO: 21911 - DNA, 20 bp, Artificial Sequence
  chemically synthesized
taatcatatttgaatttact

SEQ ID NO: 21912 - DNA, 20 bp, Artificial Sequence
  chemically synthesized
tcacttgaaaatagctcatt

SEQ ID NO: 21913 - DNA, 20 bp, Artificial Sequence
  chemically synthesized
caccctggctgggctgtttt

SEQ ID NO: 21914 - DNA, 20 bp, Artificial Sequence
  chemically synthesized
ctttggttggcaagtgttat

SEQ ID NO: 21915 - DNA, 20 bp, Artificial Sequence
  chemically synthesized
cagtgatttaagcatctctc

SEQ ID NO: 21916 - DNA, 20 bp, Artificial Sequence
  chemically synthesized
ttaagcatctctctagaatt

SEQ ID NO: 21917 - DNA, 20 bp, Artificial Sequence
  chemically synthesized
agagacactcctgaactctg

SEQ ID NO: 21918 - DNA, 20 bp, Artificial Sequence
  chemically synthesized
tggaggatagatgtctctat

SEQ ID NO: 21919 - DNA, 20 bp, Artificial Sequence
  chemically synthesized
ttgcttaatgacacatttct

SEQ ID NO: 21920 - DNA, 20 bp, Artificial Sequence
  chemically synthesized
agaatatatccccattgtta

SEQ ID NO: 21921 - DNA, 20 bp, Artificial Sequence
  chemically synthesized
cagggactcaagaagttgcc

SEQ ID NO: 21922 - DNA, 20 bp, Artificial Sequence
  chemically synthesized
ctggagttgttcctttcttc

SEQ ID NO: 21923 - DNA, 20 bp, Artificial Sequence
  chemically synthesized
ggcttataagatgaactttc

SEQ ID NO: 21924 - DNA, 20 bp, Artificial Sequence
  chemically synthesized
cattgcagctgttcacttta

SEQ ID NO: 21925 - DNA, 20 bp, Artificial Sequence
  chemically synthesized
tttgggctcactttttttct

SEQ ID NO: 21926 - DNA, 20 bp, Artificial Sequence
  chemically synthesized
ttcaactcttttttttttga

SEQ ID NO: 21927 - DNA, 20 bp, Artificial Sequence
  chemically synthesized
tcttgctctgtcgcccaggc

SEQ ID NO: 21928 - DNA, 20 bp, Artificial Sequence
  chemically synthesized
gcctcagcctcccaagtagc

SEQ ID NO: 21929 - DNA, 20 bp, Artificial Sequence
  chemically synthesized
ttttgtatttttagtaaagc

SEQ ID NO: 21930 - DNA, 20 bp, Artificial Sequence
  chemically synthesized
gcctgggcctctgaaagtgc

SEQ ID NO: 21931 - DNA, 20 bp, Artificial Sequence
  chemically synthesized
aaaaaatcaccaaaatgcag

SEQ ID NO: 21932 - DNA, 20 bp, Artificial Sequence
  chemically synthesized
ccctgcaaatatcaagatct

SEQ ID NO: 21933 - DNA, 20 bp, Artificial Sequence
  chemically synthesized
ttgttatgctgtattgttta

SEQ ID NO: 21934 - DNA, 20 bp, Artificial Sequence
  chemically synthesized
tagggaataatgaaagataa

SEQ ID NO: 21935 - DNA, 20 bp, Artificial Sequence
  chemically synthesized
tgcaaccatccatttttttc

SEQ ID NO: 21936 - DNA, 20 bp, Artificial Sequence
  chemically synthesized
tatttttgatctgcagttaa

SEQ ID NO: 21937 - DNA, 20 bp, Artificial Sequence
  chemically synthesized
gagctgactgtacagtgtgg

SEQ ID NO: 21938 - DNA, 20 bp, Artificial Sequence
  chemically synthesized
ttgagtgaaaaaacagactt

SEQ ID NO: 21939 - DNA, 20 bp, Artificial Sequence
  chemically synthesized
cagatcagacagaaataggt

SEQ ID NO: 21940 - DNA, 20 bp, Artificial Sequence
  chemically synthesized
aggtttaacagtagtataat

SEQ ID NO: 21941 - DNA, 20 bp, Artificial Sequence
  chemically synthesized
atctatctcacaggtgttgg

SEQ ID NO: 21942 - DNA, 20 bp, Artificial Sequence
  chemically synthesized
aaatgactattgtcacaatc

SEQ ID NO: 21943 - DNA, 20 bp, Artificial Sequence
  chemically synthesized
tcacaatcaggaatgaccta

SEQ ID NO: 21944 - DNA, 20 bp, Artificial Sequence
  chemically synthesized
gaatgacctaaagaataatt

SEQ ID NO: 21945 - DNA, 20 bp, Artificial Sequence
  chemically synthesized
tcctgttatccatccagcac

SEQ ID NO: 21946 - DNA, 20 bp, Artificial Sequence
  chemically synthesized
ctccatggcccttaaatgtc

SEQ ID NO: 21947 - DNA, 20 bp, Artificial Sequence
  chemically synthesized
atacttgctagggctgggac

SEQ ID NO: 21948 - DNA, 20 bp, Artificial Sequence
  chemically synthesized
taactactgtttacagaaca

SEQ ID NO: 21949 - DNA, 20 bp, Artificial Sequence
  chemically synthesized
cctatagtcagatacgtctc

SEQ ID NO: 21950 - DNA, 20 bp, Artificial Sequence
  chemically synthesized
ggcactgtcatcttattttt

SEQ ID NO: 21951 - DNA, 20 bp, Artificial Sequence
  chemically synthesized
aggtaacatactaaaacatt

SEQ ID NO: 21952 - DNA, 20 bp, Artificial Sequence
  chemically synthesized
tacctcacgttcttgcaaat

SEQ ID NO: 21953 - DNA, 20 bp, Artificial Sequence
  chemically synthesized
ttgcaaatctgagtctttgc

SEQ ID NO: 21954 - DNA, 20 bp, Artificial Sequence
  chemically synthesized
atgctgctttagatcaaaga

SEQ ID NO: 21955 - DNA, 20 bp, Artificial Sequence
  chemically synthesized
tagttgtaactcagtaatgt

SEQ ID NO: 21956 - DNA, 20 bp, Artificial Sequence
  chemically synthesized
aactccttttagaagccaat

SEQ ID NO: 21957 - DNA, 20 bp, Artificial Sequence
  chemically synthesized
atgagagtttaatagcagaa

SEQ ID NO: 21958 - DNA, 20 bp, Artificial Sequence
  chemically synthesized
atctctggctacaatggctg

SEQ ID NO: 21959 - DNA, 20 bp, Artificial Sequence
  chemically synthesized
ctttctccttagtattatct

SEQ ID NO: 21960 - DNA, 20 bp, Artificial Sequence
  chemically synthesized
ctcaccacttatatagaaga

SEQ ID NO: 21961 - DNA, 20 bp, Artificial Sequence
  chemically synthesized
acttatatagaagaaagggt

SEQ ID NO: 21962 - DNA, 20 bp, Artificial Sequence
  chemically synthesized
cttgctttatgtcctgcttt

SEQ ID NO: 21963 - DNA, 20 bp, Artificial Sequence
  chemically synthesized
ttcacagctgacatcatgtc

SEQ ID NO: 21964 - DNA, 20 bp, Artificial Sequence
  chemically synthesized
acagggccagtcagctttct

SEQ ID NO: 21965 - DNA, 20 bp, Artificial Sequence
  chemically synthesized
gtcagctttctgggggtgct

SEQ ID NO: 21966 - DNA, 20 bp, Artificial Sequence
  chemically synthesized
gaacatgctgtttgtccaaa

SEQ ID NO: 21967 - DNA, 20 bp, Artificial Sequence
  chemically synthesized
ttctcccctagggaactcaa

SEQ ID NO: 21968 - DNA, 20 bp, Artificial Sequence
  chemically synthesized
aatttttttaaaccaaggag

SEQ ID NO: 21969 - DNA, 20 bp, Artificial Sequence
  chemically synthesized
ggagatgaatgttttctaac

SEQ ID NO: 21970 - DNA, 20 bp, Artificial Sequence
  chemically synthesized
acaaacctgtacattcagca

SEQ ID NO: 21971 - DNA, 20 bp, Artificial Sequence
  chemically synthesized
agcgcgtgaacatgatcatg

SEQ ID NO: 21972 - DNA, 20 bp, Artificial Sequence
  chemically synthesized
agtatgcttgccttttagat

SEQ ID NO: 21973 - DNA, 20 bp, Artificial Sequence
  chemically synthesized
atttggtcatgtaattcctg

SEQ ID NO: 21974 - DNA, 20 bp, Artificial Sequence
  chemically synthesized
aaaattaaaagtgggaaaac

SEQ ID NO: 21975 - DNA, 20 bp, Artificial Sequence
  chemically synthesized
agtgggaaaacaaagaaata

SEQ ID NO: 21976 - DNA, 20 bp, Artificial Sequence
  chemically synthesized
actcagttgagttccctagg

SEQ ID NO: 21977 - DNA, 20 bp, Artificial Sequence
  chemically synthesized
ctaggggagaaaagcaagct

SEQ ID NO: 21978 - DNA, 20 bp, Artificial Sequence
  chemically synthesized
cccagaggaaggcatacagg

SEQ ID NO: 21979 - DNA, 20 bp, Artificial Sequence
  chemically synthesized
cacacttacttgtcaacttt

SEQ ID NO: 21980 - DNA, 20 bp, Artificial Sequence
  chemically synthesized
ggtgccaaccctaagcaccc

SEQ ID NO: 21981 - DNA, 20 bp, Artificial Sequence
  chemically synthesized
agtgagtaaagtcaagggat

SEQ ID NO: 21982 - DNA, 20 bp, Artificial Sequence
  chemically synthesized
gatgctggggaaaggataga

SEQ ID NO: 21983 - DNA, 20 bp, Artificial Sequence
  chemically synthesized
cgatccccagataatactaa

SEQ ID NO: 21984 - DNA, 20 bp, Artificial Sequence
  chemically synthesized
actaggtactaagggatcat

SEQ ID NO: 21985 - DNA, 20 bp, Artificial Sequence
  chemically synthesized
tggggaaacaattgatagag

SEQ ID NO: 21986 - DNA, 20 bp, Artificial Sequence
  chemically synthesized
gtttgatgtgattatggacc

SEQ ID NO: 21987 - DNA, 20 bp, Artificial Sequence
  chemically synthesized
agttagagcaaagcggggaa

SEQ ID NO: 21988 - DNA, 20 bp, Artificial Sequence
  chemically synthesized
aaaaagggagagatcaacaa

SEQ ID NO: 21989 - DNA, 20 bp, Artificial Sequence
  chemically synthesized
agaagttattaaagagctaa

SEQ ID NO: 21990 - DNA, 20 bp, Artificial Sequence
  chemically synthesized
attaaagagctaaagagaat

SEQ ID NO: 21991 - DNA, 20 bp, Artificial Sequence
  chemically synthesized
gaattgagaaatttaaaaca

SEQ ID NO: 21992 - DNA, 20 bp, Artificial Sequence
  chemically synthesized
ggccaacatgaaaggagtag

SEQ ID NO: 21993 - DNA, 20 bp, Artificial Sequence
  chemically synthesized
aactgcagatcaaaaatatt

SEQ ID NO: 21994 - DNA, 20 bp, Artificial Sequence
  chemically synthesized
ttacattgtattagctatta

SEQ ID NO: 21995 - DNA, 20 bp, Artificial Sequence
  chemically synthesized
tgcaaacgagtgaaggaaat

SEQ ID NO: 21996 - DNA, 20 bp, Artificial Sequence
  chemically synthesized
ctacttgggaggctgaggca

SEQ ID NO: 21997 - DNA, 20 bp, Artificial Sequence
  chemically synthesized
gtcaaaaaaaaaagagttga

SEQ ID NO: 21998 - DNA, 20 bp, Artificial Sequence
  chemically synthesized
aaaaagtctaggctaaattc

SEQ ID NO: 21999 - DNA, 20 bp, Artificial Sequence
  chemically synthesized
cagctgcaatgaaaataagg

SEQ ID NO: 22000 - DNA, 20 bp, Artificial Sequence
  chemically synthesized
aggaagtagtcccaaatacc

SEQ ID NO: 22001 - DNA, 20 bp, Artificial Sequence
  chemically synthesized
agatatattgctagaccctt

SEQ ID NO: 22002 - DNA, 20 bp, Artificial Sequence
  chemically synthesized
ttaacaatggggatatattc

SEQ ID NO: 22003 - DNA, 20 bp, Artificial Sequence
  chemically synthesized
tggtatttgtgtatctaaac

SEQ ID NO: 22004 - DNA, 20 bp, Artificial Sequence
  chemically synthesized
gagaggaaggagggagggaa

SEQ ID NO: 22005 - DNA, 20 bp, Artificial Sequence
  chemically synthesized
caaagtaaattcaaatatga

SEQ ID NO: 22006 - DNA, 20 bp, Artificial Sequence
  chemically synthesized
attttggctccatgccctaa

SEQ ID NO: 22007 - DNA, 20 bp, Artificial Sequence
  chemically synthesized
ttttcttttttgctaaaact

SEQ ID NO: 22008 - DNA, 20 bp, Artificial Sequence
  chemically synthesized
ttgttcaagggaaccttgag

SEQ ID NO: 22009 - DNA, 20 bp, Artificial Sequence
  chemically synthesized
accttgagagagaatgtatg

SEQ ID NO: 22010 - DNA, 20 bp, Artificial Sequence
  chemically synthesized
attatacctctttggccgat

SEQ ID NO: 22011 - DNA, 20 bp, Artificial Sequence
  chemically synthesized
tttgttggcgttttcatgat

SEQ ID NO: 22012 - DNA, 20 bp, Artificial Sequence
  chemically synthesized
tcaagaaaaactgaaatgta

SEQ ID NO: 22013 - DNA, 20 bp, Artificial Sequence
  chemically synthesized
aattctttagttttagcaaa

SEQ ID NO: 22014 - DNA, 20 bp, Artificial Sequence
  chemically synthesized
catgaaaattttacatctct

SEQ ID NO: 22015 - DNA, 20 bp, Artificial Sequence
  chemically synthesized
ttcaattttacttttagtca

SEQ ID NO: 22016 - DNA, 20 bp, Artificial Sequence
  chemically synthesized
ttgaatttactttggatgaa

SEQ ID NO: 22017 - DNA, 20 bp, Artificial Sequence
  chemically synthesized
tcaccctggctgggctgttt

SEQ ID NO: 22018 - DNA, 20 bp, Artificial Sequence
  chemically synthesized
agtgtctgtcactagatgtt

SEQ ID NO: 22019 - DNA, 20 bp, Artificial Sequence
  chemically synthesized
gcagtgatttaagcatctct

SEQ ID NO: 22020 - DNA, 20 bp, Artificial Sequence
  chemically synthesized
attgcttaatgacacatttc

SEQ ID NO: 22021 - DNA, 20 bp, Artificial Sequence
  chemically synthesized
ctgattaactccaaaaagga

SEQ ID NO: 22022 - DNA, 20 bp, Artificial Sequence
  chemically synthesized
aggaaagtaaaaaggaaagg

SEQ ID NO: 22023 - DNA, 20 bp, Artificial Sequence
  chemically synthesized
gttgagtgaaaaaacagact

SEQ ID NO: 22024 - DNA, 20 bp, Artificial Sequence
  chemically synthesized
agactttagaatcagatcag

SEQ ID NO: 22025 - DNA, 20 bp, Artificial Sequence
  chemically synthesized
taggtttaacagtagtataa

SEQ ID NO: 22026 - DNA, 20 bp, Artificial Sequence
  chemically synthesized
gtcacaatcaggaatgacct

SEQ ID NO: 22027 - DNA, 20 bp, Artificial Sequence
  chemically synthesized
tgcattaatactgtctatcc

SEQ ID NO: 22028 - DNA, 20 bp, Artificial Sequence
  chemically synthesized
tatctctggctacaatggct

SEQ ID NO: 22029 - DNA, 20 bp, Artificial Sequence
  chemically synthesized
atcatctcaccacttatata

SEQ ID NO: 22030 - DNA, 20 bp, Artificial Sequence
  chemically synthesized
gtcagctactagatttgatt

SEQ ID NO: 22031 - DNA, 20 bp, Artificial Sequence
  chemically synthesized
ttagttttaaaaatgaagaa

SEQ ID NO: 22032 - DNA, 20 bp, Artificial Sequence
  chemically synthesized
gttttcttcttcttcatttt

SEQ ID NO: 22033 - DNA, 20 bp, Artificial Sequence
  chemically synthesized
tggtcatgtaattcctgtta

SEQ ID NO: 22034 - DNA, 20 bp, Artificial Sequence
  chemically synthesized
tttaaaaaaattaaaagtgg

SEQ ID NO: 22035 - DNA, 20 bp, Artificial Sequence
  chemically synthesized
cttcaatttaaagttttagt

SEQ ID NO: 22036 - DNA, 20 bp, Artificial Sequence
  chemically synthesized
gggataaagaaaatttgttg

SEQ ID NO: 22037 - DNA, 20 bp, Artificial Sequence
  chemically synthesized
acagtttggaattttgaaat

SEQ ID NO: 22038 - DNA, 20 bp, Artificial Sequence
  chemically synthesized
ttgaaattaaaacagttctg

SEQ ID NO: 22039 - DNA, 20 bp, Artificial Sequence
  chemically synthesized
ctaaagagaattgagaaatt

SEQ ID NO: 22040 - DNA, 20 bp, Artificial Sequence
  chemically synthesized
acacatatatgtatatacat

SEQ ID NO: 22041 - DNA, 20 bp, Artificial Sequence
  chemically synthesized
ctaggtagatgtagcttaaa

SEQ ID NO: 22042 - DNA, 20 bp, Artificial Sequence
  chemically synthesized
catttgggcaaccatattct

SEQ ID NO: 22043 - DNA, 20 bp, Artificial Sequence
  chemically synthesized
gctttcagattatttggatt

SEQ ID NO: 22044 - DNA, 20 bp, Artificial Sequence
  chemically synthesized
catgatgttttcttttttgc

SEQ ID NO: 22045 - DNA, 20 bp, Artificial Sequence
  chemically synthesized
tttcagtttttcttgatcat

SEQ ID NO: 22046 - DNA, 20 bp, Artificial Sequence
  chemically synthesized
aagaagcacgagaagttttt

SEQ ID NO: 22047 - DNA, 20 bp, Artificial Sequence
  chemically synthesized
aaaaacttctcgtgcttctt

SEQ ID NO: 22048 - DNA, 20 bp, Artificial Sequence
  chemically synthesized
ttggcgttttcatgatcaag

SEQ ID NO: 22049 - DNA, 20 bp, Artificial Sequence
  chemically synthesized
tctttagttttagcaaaaaa

SEQ ID NO: 22050 - DNA, 20 bp, Artificial Sequence
  chemically synthesized
tgtacagtgtggttgagtga

SEQ ID NO: 22051 - DNA, 20 bp, Artificial Sequence
  chemically synthesized
ctttgcccaaggtaacatac

SEQ ID NO: 22052 - DNA, 20 bp, Artificial Sequence
  chemically synthesized
atagtccatatggaaccata

SEQ ID NO: 22053 - DNA, 20 bp, Artificial Sequence
  chemically synthesized
tctttgatgcatacacttta

SEQ ID NO: 22054 - DNA, 20 bp, Artificial Sequence
  chemically synthesized
taaagtcactgtagttgtga

SEQ ID NO: 22055 - DNA, 20 bp, Artificial Sequence
  chemically synthesized
gttaatctttatgttttaac

SEQ ID NO: 22056 - DNA, 20 bp, Artificial Sequence
  chemically synthesized
gttttaaaaatgaagaagaa

SEQ ID NO: 22057 - DNA, 20 bp, Artificial Sequence
  chemically synthesized
atctactcagtgctgaatgt

SEQ ID NO: 22058 - DNA, 20 bp, Artificial Sequence
  chemically synthesized
actcagtgctgaatgtacag

SEQ ID NO: 22059 - DNA, 20 bp, Artificial Sequence
  chemically synthesized
ccttttttaaaatacattga

SEQ ID NO: 22060 - DNA, 20 bp, Artificial Sequence
  chemically synthesized
atgctgtcttcttcactaaa

SEQ ID NO: 22061 - DNA, 20 bp, Artificial Sequence
  chemically synthesized
ttcttcactaaattttgatt

SEQ ID NO: 22062 - DNA, 20 bp, Artificial Sequence
  chemically synthesized
aagtactggttctttgttag

SEQ ID NO: 22063 - DNA, 20 bp, Artificial Sequence
  chemically synthesized
tttaaaactaaatagatcga

SEQ ID NO: 22064 - DNA, 20 bp, Artificial Sequence
  chemically synthesized
cgacaatgcttatgatgcat

SEQ ID NO: 22065 - DNA, 20 bp, Artificial Sequence
  chemically synthesized
tttaataaacactgttcagt

SEQ ID NO: 22066 - DNA, 20 bp, Artificial Sequence
  chemically synthesized
tgttagaaaacattcatctc

SEQ ID NO: 22067 - DNA, 20 bp, Artificial Sequence
  chemically synthesized
aaaaaaaataaccacattat

SEQ ID NO: 22068 - DNA, 20 bp, Artificial Sequence
  chemically synthesized
tggccttatttacacaaaaa

SEQ ID NO: 22069 - DNA, 20 bp, Artificial Sequence
  chemically synthesized
ttttaagatatatgacattt

SEQ ID NO: 22070 - DNA, 20 bp, Artificial Sequence
  chemically synthesized
taaattatatatcttcaatt

SEQ ID NO: 22071 - DNA, 20 bp, Artificial Sequence
  chemically synthesized
ttaaagttttagttaaaaca

SEQ ID NO: 22072 - DNA, 20 bp, Artificial Sequence
  chemically synthesized
agcaagctgttagttatcac

SEQ ID NO: 22073 - DNA, 20 bp, Artificial Sequence
  chemically synthesized
tagttatcaccaaagctttt

SEQ ID NO: 22074 - DNA, 20 bp, Artificial Sequence
  chemically synthesized
gagttccctaggggagaaaa

SEQ ID NO: 22075 - DNA, 20 bp, Artificial Sequence
  chemically synthesized
agctaatgcaacatatatca

SEQ ID NO: 22076 - DNA, 20 bp, Artificial Sequence
  chemically synthesized
tgagatgatgaaggttgtaa

SEQ ID NO: 22077 - DNA, 20 bp, Artificial Sequence
  chemically synthesized
tagataagaataaggatgaa

SEQ ID NO: 22078 - DNA, 20 bp, Artificial Sequence
  chemically synthesized
taatactaaggagaaaggca

SEQ ID NO: 22079 - DNA, 20 bp, Artificial Sequence
  chemically synthesized
tcttctgctattaaactctc

SEQ ID NO: 22080 - DNA, 20 bp, Artificial Sequence
  chemically synthesized
aactctcattggcttctaaa

SEQ ID NO: 22081 - DNA, 20 bp, Artificial Sequence
  chemically synthesized
cttctaaaaggagtttcggt

SEQ ID NO: 22082 - DNA, 20 bp, Artificial Sequence
  chemically synthesized
ctgcctttaggtattattgc

SEQ ID NO: 22083 - DNA, 20 bp, Artificial Sequence
  chemically synthesized
aattaaaacagttctgtaaa

SEQ ID NO: 22084 - DNA, 20 bp, Artificial Sequence
  chemically synthesized
aaacagttctgtaaaaccag

SEQ ID NO: 22085 - DNA, 20 bp, Artificial Sequence
  chemically synthesized
aagcagcatgaggccaggtg

SEQ ID NO: 22086 - DNA, 20 bp, Artificial Sequence
  chemically synthesized
gaggatcactcgtgcaaaga

SEQ ID NO: 22087 - DNA, 20 bp, Artificial Sequence
  chemically synthesized
gcaagaacgtgaggtatttc

SEQ ID NO: 22088 - DNA, 20 bp, Artificial Sequence
  chemically synthesized
ataatgaagtcattaaccta

SEQ ID NO: 22089 - DNA, 20 bp, Artificial Sequence
  chemically synthesized
acataaggagtaccactgat

SEQ ID NO: 22090 - DNA, 20 bp, Artificial Sequence
  chemically synthesized
tggctagagtcttggggact

SEQ ID NO: 22091 - DNA, 20 bp, Artificial Sequence
  chemically synthesized
tcttggggactttgtgtttg

SEQ ID NO: 22092 - DNA, 20 bp, Artificial Sequence
  chemically synthesized
actgccagagtctgaatcct

SEQ ID NO: 22093 - DNA, 20 bp, Artificial Sequence
  chemically synthesized
taaatattgtgccctacatg

SEQ ID NO: 22094 - DNA, 20 bp, Artificial Sequence
  chemically synthesized
caaagcggggaaccagaata

SEQ ID NO: 22095 - DNA, 20 bp, Artificial Sequence
  chemically synthesized
aatagagtgattattataaa

SEQ ID NO: 22096 - DNA, 20 bp, Artificial Sequence
  chemically synthesized
aaaattattctttaggtcat

SEQ ID NO: 22097 - DNA, 20 bp, Artificial Sequence
  chemically synthesized
atagtcatttcattatataa

SEQ ID NO: 22098 - DNA, 20 bp, Artificial Sequence
  chemically synthesized
catttgacaaagttaaggtt

SEQ ID NO: 22099 - DNA, 20 bp, Artificial Sequence
  chemically synthesized
caggtctagaggaggcagat

SEQ ID NO: 22100 - DNA, 20 bp, Artificial Sequence
  chemically synthesized
ttcaaacctatttctgtctg

SEQ ID NO: 22101 - DNA, 20 bp, Artificial Sequence
  chemically synthesized
ctgtctgatctgattctaaa

SEQ ID NO: 22102 - DNA, 20 bp, Artificial Sequence
  chemically synthesized
ctccttgtgagttccacagc

SEQ ID NO: 22103 - DNA, 20 bp, Artificial Sequence
  chemically synthesized
agctattaagagaaacctag

SEQ ID NO: 22104 - DNA, 20 bp, Artificial Sequence
  chemically synthesized
gatttaaagtacaaaggagg

SEQ ID NO: 22105 - DNA, 20 bp, Artificial Sequence
  chemically synthesized
ggtggcatccatctgcattt

SEQ ID NO: 22106 - DNA, 20 bp, Artificial Sequence
  chemically synthesized
tggctgctccaatttagggg

SEQ ID NO: 22107 - DNA, 20 bp, Artificial Sequence
  chemically synthesized
acaaggtgaaatggtgaaac

SEQ ID NO: 22108 - DNA, 20 bp, Artificial Sequence
  chemically synthesized
ttgggaggctgaggcaggag

SEQ ID NO: 22109 - DNA, 20 bp, Artificial Sequence
  chemically synthesized
ctgcaatgaaaataagggaa

SEQ ID NO: 22110 - DNA, 20 bp, Artificial Sequence
  chemically synthesized
gggaagaaagtttagttcat

SEQ ID NO: 22111 - DNA, 20 bp, Artificial Sequence
  chemically synthesized
acttacctaaacctaaatgg

SEQ ID NO: 22112 - DNA, 20 bp, Artificial Sequence
  chemically synthesized
ccaaaatgtcattgtgcagc

SEQ ID NO: 22113 - DNA, 20 bp, Artificial Sequence
  chemically synthesized
aaggagggagggaaggagaa

SEQ ID NO: 22114 - DNA, 20 bp, Artificial Sequence
  chemically synthesized
gtctcttcagactaggtaga

SEQ ID NO: 22115 - DNA, 20 bp, Artificial Sequence
  chemically synthesized
acatatcctgaattctagag

SEQ ID NO: 22116 - DNA, 20 bp, Artificial Sequence
  chemically synthesized
caaaggtgctgttgatctga

SEQ ID NO: 22117 - DNA, 20 bp, Artificial Sequence
  chemically synthesized
attgcttttttaaattaatg

SEQ ID NO: 22118 - DNA, 20 bp, Artificial Sequence
  chemically synthesized
catttgcagctggaccataa

SEQ ID NO: 22119 - DNA, 20 bp, Artificial Sequence
  chemically synthesized
ttcatccaaagtaaattcaa

SEQ ID NO: 22120 - DNA, 20 bp, Artificial Sequence
  chemically synthesized
atacagtactgtgggaacat

SEQ ID NO: 22121 - DNA, 20 bp, Artificial Sequence
  chemically synthesized
gctccatgccctaaagagaa

SEQ ID NO: 22122 - DNA, 20 bp, Artificial Sequence
  chemically synthesized
gccctaaagagaaattggct

SEQ ID NO: 22123 - DNA, 20 bp, Artificial Sequence
  chemically synthesized
agaaattggctttcagatta

SEQ ID NO: 22124 - DNA, 20 bp, Artificial Sequence
  chemically synthesized
taagagatgtaaaattttca

SEQ ID NO: 22125 - DNA, 20 bp, Artificial Sequence
  chemically synthesized
aaagaattattcttttacat

SEQ ID NO: 22126 - DNA, 20 bp, Artificial Sequence
  chemically synthesized
gtataattcaggtaaattgg

SEQ ID NO: 22127 - DNA, 20 bp, Artificial Sequence
  chemically synthesized
gagaatgtatggaagaaaag

SEQ ID NO: 22128 - DNA, 20 bp, Artificial Sequence
  chemically synthesized
tgtagttttgaagaagcacg

SEQ ID NO: 22129 - DNA, 20 bp, Artificial Sequence
  chemically synthesized
tcagtgttttcaaaaacttc

SEQ ID NO: 22130 - DNA, 20 bp, Artificial Sequence
  chemically synthesized
tacctgaattatacctcttt

SEQ ID NO: 22131 - DNA, 20 bp, Artificial Sequence
  chemically synthesized
tggccgattcagaattttgt

SEQ ID NO: 22132 - DNA, 20 bp, Artificial Sequence
  chemically synthesized
gaaatgtaaaagaataattc

SEQ ID NO: 22133 - DNA, 20 bp, Artificial Sequence
  chemically synthesized
tttacatctcttaagaaagt

SEQ ID NO: 22134 - DNA, 20 bp, Artificial Sequence
  chemically synthesized
cccacagtactgtatacaca

SEQ ID NO: 22135 - DNA, 20 bp, Artificial Sequence
  chemically synthesized
gagaattccagtaataaaag

SEQ ID NO: 22136 - DNA, 20 bp, Artificial Sequence
  chemically synthesized
gtgatccatcaccctggctg

SEQ ID NO: 22137 - DNA, 20 bp, Artificial Sequence
  chemically synthesized
ggcaagtgttataggaattg

SEQ ID NO: 22138 - DNA, 20 bp, Artificial Sequence
  chemically synthesized
gcatctctctagaattcagg

SEQ ID NO: 22139 - DNA, 20 bp, Artificial Sequence
  chemically synthesized
gtattttcactgtacctttt

SEQ ID NO: 22140 - DNA, 20 bp, Artificial Sequence
  chemically synthesized
tcagtacagtcacatgctgt

SEQ ID NO: 22141 - DNA, 20 bp, Artificial Sequence
  chemically synthesized
tatgtagtaagctataccat

SEQ ID NO: 22142 - DNA, 20 bp, Artificial Sequence
  chemically synthesized
ttatgttcgcacaatgatga

SEQ ID NO: 22143 - DNA, 20 bp, Artificial Sequence
  chemically synthesized
gcatggctgtatacacacac

SEQ ID NO: 22144 - DNA, 20 bp, Artificial Sequence
  chemically synthesized
gtatacacacacatgtgttt

SEQ ID NO: 22145 - DNA, 20 bp, Artificial Sequence
  chemically synthesized
gataccatctcaagaggacc

SEQ ID NO: 22146 - DNA, 20 bp, Artificial Sequence
  chemically synthesized
ctggggtatttgggactact

SEQ ID NO: 22147 - DNA, 20 bp, Artificial Sequence
  chemically synthesized
gtgttctagtcccttgacat

SEQ ID NO: 22148 - DNA, 20 bp, Artificial Sequence
  chemically synthesized
tgcctcagcctcccaagtag

SEQ ID NO: 22149 - DNA, 20 bp, Artificial Sequence
  chemically synthesized
ttttgtatttttagtaaagc

SEQ ID NO: 22150 - DNA, 20 bp, Artificial Sequence
  chemically synthesized
tgcctgggcctctgaaagtg

SEQ ID NO: 22151 - DNA, 20 bp, Artificial Sequence
  chemically synthesized
catatttctcaatttccttc

SEQ ID NO: 22152 - DNA, 20 bp, Artificial Sequence
  chemically synthesized
gctcaagtctccgatataaa

SEQ ID NO: 22153 - DNA, 20 bp, Artificial Sequence
  chemically synthesized
ctttgtactttaaatcatct

SEQ ID NO: 22154 - DNA, 20 bp, Artificial Sequence
  chemically synthesized
tgtaaatagttgttatgctg

SEQ ID NO: 22155 - DNA, 20 bp, Artificial Sequence
  chemically synthesized
tagaatcagatcagacagaa

SEQ ID NO: 22156 - DNA, 20 bp, Artificial Sequence
  chemically synthesized
ttaactttgtcaaatgtaaa

SEQ ID NO: 22157 - DNA, 20 bp, Artificial Sequence
  chemically synthesized
ttcatgttggccctactttc

SEQ ID NO: 22158 - DNA, 20 bp, Artificial Sequence
  chemically synthesized
gaatgacctaaagaataatt

SEQ ID NO: 22159 - DNA, 20 bp, Artificial Sequence
  chemically synthesized
ataatcactctattctggtt

SEQ ID NO: 22160 - DNA, 20 bp, Artificial Sequence
  chemically synthesized
tgttatccatccagcacttg

SEQ ID NO: 22161 - DNA, 20 bp, Artificial Sequence
  chemically synthesized
gggttctcccaggctccagc

SEQ ID NO: 22162 - DNA, 20 bp, Artificial Sequence
  chemically synthesized
gtatatttatgccctacagg

SEQ ID NO: 22163 - DNA, 20 bp, Artificial Sequence
  chemically synthesized
cccacacacgtggctgtaac

SEQ ID NO: 22164 - DNA, 20 bp, Artificial Sequence
  chemically synthesized
gtcagatacgtctcctgaat

SEQ ID NO: 22165 - DNA, 20 bp, Artificial Sequence
  chemically synthesized
agtaatagctaatgtatatg

SEQ ID NO: 22166 - DNA, 20 bp, Artificial Sequence
  chemically synthesized
ttatttttatgaatgaggaa

SEQ ID NO: 22167 - DNA, 20 bp, Artificial Sequence
  chemically synthesized
aagatagattcatagaggct

SEQ ID NO: 22168 - DNA, 20 bp, Artificial Sequence
  chemically synthesized
aaggtaacatactaaaacat

SEQ ID NO: 22169 - DNA, 20 bp, Artificial Sequence
  chemically synthesized
tcagccatcagtggtactcc

SEQ ID NO: 22170 - DNA, 20 bp, Artificial Sequence
  chemically synthesized
ttatctgatgaccagctctg

SEQ ID NO: 22171 - DNA, 20 bp, Artificial Sequence
  chemically synthesized
gaaaatattctctctctatc

SEQ ID NO: 22172 - DNA, 20 bp, Artificial Sequence
  chemically synthesized
aaacctctcacctggcctca

SEQ ID NO: 22173 - DNA, 20 bp, Artificial Sequence
  chemically synthesized
gctttagatcaaagagggag

SEQ ID NO: 22174 - DNA, 20 bp, Artificial Sequence
  chemically synthesized
catacactttacaaaactaa

SEQ ID NO: 22175 - DNA, 20 bp, Artificial Sequence
  chemically synthesized
aaactaaactggttttacag

SEQ ID NO: 22176 - DNA, 20 bp, Artificial Sequence
  chemically synthesized
aactccttttagaagccaat

SEQ ID NO: 22177 - DNA, 20 bp, Artificial Sequence
  chemically synthesized
attcccctggccccttcctc

SEQ ID NO: 22178 - DNA, 20 bp, Artificial Sequence
  chemically synthesized
atcgtatacttaacttccct

SEQ ID NO: 22179 - DNA, 20 bp, Artificial Sequence
  chemically synthesized
ctcaccacttatatagaaga

SEQ ID NO: 22180 - DNA, 20 bp, Artificial Sequence
  chemically synthesized
ttatatagaagaaagggttt

SEQ ID NO: 22181 - DNA, 20 bp, Artificial Sequence
  chemically synthesized
taatgagatatatctaatgg

SEQ ID NO: 22182 - DNA, 20 bp, Artificial Sequence
  chemically synthesized
tctaatggccttgctttatg

SEQ ID NO: 22183 - DNA, 20 bp, Artificial Sequence
  chemically synthesized
cttgctttatgtcctgcttt

SEQ ID NO: 22184 - DNA, 20 bp, Artificial Sequence
  chemically synthesized
cccttgactttactcacttt

SEQ ID NO: 22185 - DNA, 20 bp, Artificial Sequence
  chemically synthesized
atcgttatttcagcatttca

SEQ ID NO: 22186 - DNA, 20 bp, Artificial Sequence
  chemically synthesized
gagtgggaaccacagggcca

SEQ ID NO: 22187 - DNA, 20 bp, Artificial Sequence
  chemically synthesized
agggccagtcagctttctgg

SEQ ID NO: 22188 - DNA, 20 bp, Artificial Sequence
  chemically synthesized
tgatcctggtactgtcagct

SEQ ID NO: 22189 - DNA, 20 bp, Artificial Sequence
  chemically synthesized
ctggtactgtcagctactag

SEQ ID NO: 22190 - DNA, 20 bp, Artificial Sequence
  chemically synthesized
agttgacaagtaagtgtgat

SEQ ID NO: 22191 - DNA, 20 bp, Artificial Sequence
  chemically synthesized
aaatgcttcctgtgagaaca

SEQ ID NO: 22192 - DNA, 20 bp, Artificial Sequence
  chemically synthesized
cctactctttatgtcaattc

SEQ ID NO: 22193 - DNA, 20 bp, Artificial Sequence
  chemically synthesized
ctctttatgtcaattcttaa

SEQ ID NO: 22194 - DNA, 20 bp, Artificial Sequence
  chemically synthesized
ctagggaactcaactgagta

SEQ ID NO: 22195 - DNA, 20 bp, Artificial Sequence
  chemically synthesized
ttccccaaatatcaactcca

SEQ ID NO: 22196 - DNA, 20 bp, Artificial Sequence
  chemically synthesized
agatgtttgacatagagaca

SEQ ID NO: 22197 - DNA, 20 bp, Artificial Sequence
  chemically synthesized
tgattttttcctaatccatg

SEQ ID NO: 22198 - DNA, 20 bp, Artificial Sequence
  chemically synthesized
gaaaagctttggtgataact

SEQ ID NO: 22199 - DNA, 20 bp, Artificial Sequence
  chemically synthesized
tgctaatgaaaggttaatct

SEQ ID NO: 22200 - DNA, 20 bp, Artificial Sequence
  chemically synthesized
actttttgtgtaaataaggc

SEQ ID NO: 22201 - DNA, 20 bp, Artificial Sequence
  chemically synthesized
tgtgtaaataaggccattgt

SEQ ID NO: 22202 - DNA, 20 bp, Artificial Sequence
  chemically synthesized
aataaggccattgtttgtgc

SEQ ID NO: 22203 - DNA, 20 bp, Artificial Sequence
  chemically synthesized
gtttgtgcttttgtttccca

SEQ ID NO: 22204 - DNA, 20 bp, Artificial Sequence
  chemically synthesized
ttcactatattctgctattt

SEQ ID NO: 22205 - DNA, 20 bp, Artificial Sequence
  chemically synthesized
tttttttaaaccaaggagat

SEQ ID NO: 22206 - DNA, 20 bp, Artificial Sequence
  chemically synthesized
tgaccaaatcatgaactgaa

SEQ ID NO: 22207 - DNA, 20 bp, Artificial Sequence
  chemically synthesized
tcataagcattgtcgatcta

SEQ ID NO: 22208 - DNA, 20 bp, Artificial Sequence
  chemically synthesized
aggcagatggtgatgaggcc

SEQ ID NO: 22209 - DNA, 20 bp, Artificial Sequence
  chemically synthesized
cgcgctgcataacctttgct

SEQ ID NO: 22210 - DNA, 22 bp, Artificial Sequence
  chemically synthesized
tcacaatctgctagcaaaggtt

SEQ ID NO: 22211 - DNA, 22 bp, Artificial Sequence
  chemically synthesized
cacaatctgctagcaaaggtta

SEQ ID NO: 22212 - DNA, 22 bp, Artificial Sequence
  chemically synthesized
acaatctgctagcaaaggttat

SEQ ID NO: 22213 - DNA, 22 bp, Artificial Sequence
  chemically synthesized
ctagcaaaggttatgcagcgcg

SEQ ID NO: 22214 - DNA, 22 bp, Artificial Sequence
  chemically synthesized
gcaaaggttatgcagcgcgtga

SEQ ID NO: 22215 - DNA, 22 bp, Artificial Sequence
  chemically synthesized
tgcagcgcgtgaacatgatcat

SEQ ID NO: 22216 - DNA, 22 bp, Artificial Sequence
  chemically synthesized
atcaccatctgccttttaggat

SEQ ID NO: 22217 - DNA, 22 bp, Artificial Sequence
  chemically synthesized
ccttttaggatatctactcagt

SEQ ID NO: 22218 - DNA, 22 bp, Artificial Sequence
  chemically synthesized
ttaggatatctactcagtgctg

SEQ ID NO: 22219 - DNA, 22 bp, Artificial Sequence
  chemically synthesized
taggatatctactcagtgctga

SEQ ID NO: 22220 - DNA, 22 bp, Artificial Sequence
  chemically synthesized
aggatatctactcagtgctgaa

SEQ ID NO: 22221 - DNA, 22 bp, Artificial Sequence
  chemically synthesized
ggatatctactcagtgctgaat

SEQ ID NO: 22222 - DNA, 22 bp, Artificial Sequence
  chemically synthesized
ctcagtgctgaatgtacaggtt

SEQ ID NO: 22223 - DNA, 22 bp, Artificial Sequence
  chemically synthesized
agtgctgaatgtacaggtttgt

SEQ ID NO: 22224 - DNA, 22 bp, Artificial Sequence
  chemically synthesized
aatgtacaggtttgtttccttt

SEQ ID NO: 22225 - DNA, 22 bp, Artificial Sequence
  chemically synthesized
gtttccttttttaaaatacatt

SEQ ID NO: 22226 - DNA, 22 bp, Artificial Sequence
  chemically synthesized
tttccttttttaaaatacattg

SEQ ID NO: 22227 - DNA, 22 bp, Artificial Sequence
  chemically synthesized
ccttttttaaaatacattgagt

SEQ ID NO: 22228 - DNA, 22 bp, Artificial Sequence
  chemically synthesized
cttttttaaaatacattgagta

SEQ ID NO: 22229 - DNA, 22 bp, Artificial Sequence
  chemically synthesized
ttttaaaatacattgagtatgc

SEQ ID NO: 22230 - DNA, 22 bp, Artificial Sequence
  chemically synthesized
tttaaaatacattgagtatgct

SEQ ID NO: 22231 - DNA, 22 bp, Artificial Sequence
  chemically synthesized
ttaaaatacattgagtatgctt

SEQ ID NO: 22232 - DNA, 22 bp, Artificial Sequence
  chemically synthesized
taaaatacattgagtatgcttg

SEQ ID NO: 22233 - DNA, 22 bp, Artificial Sequence
  chemically synthesized
aaaatacattgagtatgcttgc

SEQ ID NO: 22234 - DNA, 22 bp, Artificial Sequence
  chemically synthesized
aaatacattgagtatgcttgcc

SEQ ID NO: 22235 - DNA, 22 bp, Artificial Sequence
  chemically synthesized
agtatgcttgccttttagatat

SEQ ID NO: 22236 - DNA, 22 bp, Artificial Sequence
  chemically synthesized
gccttttagatatagaaatatc

SEQ ID NO: 22237 - DNA, 22 bp, Artificial Sequence
  chemically synthesized
ccttttagatatagaaatatct

SEQ ID NO: 22238 - DNA, 22 bp, Artificial Sequence
  chemically synthesized
ttagatatagaaatatctgatg

SEQ ID NO: 22239 - DNA, 22 bp, Artificial Sequence
  chemically synthesized
tagatatagaaatatctgatgc

SEQ ID NO: 22240 - DNA, 22 bp, Artificial Sequence
  chemically synthesized
agatatagaaatatctgatgct

SEQ ID NO: 22241 - DNA, 22 bp, Artificial Sequence
  chemically synthesized
gatatagaaatatctgatgctg

SEQ ID NO: 22242 - DNA, 22 bp, Artificial Sequence
  chemically synthesized
atgctgtcttcttcactaaatt

SEQ ID NO: 22243 - DNA, 22 bp, Artificial Sequence
  chemically synthesized
tcttcttcactaaattttgatt

SEQ ID NO: 22244 - DNA, 22 bp, Artificial Sequence
  chemically synthesized
cttcactaaattttgattacat

SEQ ID NO: 22245 - DNA, 22 bp, Artificial Sequence
  chemically synthesized
ttcactaaattttgattacatg

SEQ ID NO: 22246 - DNA, 22 bp, Artificial Sequence
  chemically synthesized
cactaaattttgattacatgat

SEQ ID NO: 22247 - DNA, 22 bp, Artificial Sequence
  chemically synthesized
actaaattttgattacatgatt

SEQ ID NO: 22248 - DNA, 22 bp, Artificial Sequence
  chemically synthesized
aattttgattacatgatttgac

SEQ ID NO: 22249 - DNA, 22 bp, Artificial Sequence
  chemically synthesized
tgattacatgatttgacagcaa

SEQ ID NO: 22250 - DNA, 22 bp, Artificial Sequence
  chemically synthesized
gattacatgatttgacagcaat

SEQ ID NO: 22251 - DNA, 22 bp, Artificial Sequence
  chemically synthesized
attacatgatttgacagcaata

SEQ ID NO: 22252 - DNA, 22 bp, Artificial Sequence
  chemically synthesized
catgatttgacagcaatattga

SEQ ID NO: 22253 - DNA, 22 bp, Artificial Sequence
  chemically synthesized
gacagcaatattgaagagtcta

SEQ ID NO: 22254 - DNA, 22 bp, Artificial Sequence
  chemically synthesized
acagcaatattgaagagtctaa

SEQ ID NO: 22255 - DNA, 22 bp, Artificial Sequence
  chemically synthesized
aagagtctaacagccagcacgc

SEQ ID NO: 22256 - DNA, 22 bp, Artificial Sequence
  chemically synthesized
acagccagcacgcaggttggta

SEQ ID NO: 22257 - DNA, 22 bp, Artificial Sequence
  chemically synthesized
gtaagtactggttctttgttag

SEQ ID NO: 22258 - DNA, 22 bp, Artificial Sequence
  chemically synthesized
gttctttgttagctaggttttc

SEQ ID NO: 22259 - DNA, 22 bp, Artificial Sequence
  chemically synthesized
tttgttagctaggttttcttct

SEQ ID NO: 22260 - DNA, 22 bp, Artificial Sequence
  chemically synthesized
tgttagctaggttttcttcttc

SEQ ID NO: 22261 - DNA, 22 bp, Artificial Sequence
  chemically synthesized
gttagctaggttttcttcttct

SEQ ID NO: 22262 - DNA, 22 bp, Artificial Sequence
  chemically synthesized
ttagctaggttttcttcttctt

SEQ ID NO: 22263 - DNA, 22 bp, Artificial Sequence
  chemically synthesized
gctaggttttcttcttcttcat

SEQ ID NO: 22264 - DNA, 22 bp, Artificial Sequence
  chemically synthesized
ggttttcttcttcttcattttt

SEQ ID NO: 22265 - DNA, 22 bp, Artificial Sequence
  chemically synthesized
tcttcttcttcatttttaaaac

SEQ ID NO: 22266 - DNA, 22 bp, Artificial Sequence
  chemically synthesized
cttcttcttcatttttaaaact

SEQ ID NO: 22267 - DNA, 22 bp, Artificial Sequence
  chemically synthesized
ttcttcttcatttttaaaacta

SEQ ID NO: 22268 - DNA, 22 bp, Artificial Sequence
  chemically synthesized
cttcttcatttttaaaactaaa

SEQ ID NO: 22269 - DNA, 22 bp, Artificial Sequence
  chemically synthesized
ttcttcatttttaaaactaaat

SEQ ID NO: 22270 - DNA, 22 bp, Artificial Sequence
  chemically synthesized
cttcatttttaaaactaaatag

SEQ ID NO: 22271 - DNA, 22 bp, Artificial Sequence
  chemically synthesized
ttcatttttaaaactaaataga

SEQ ID NO: 22272 - DNA, 22 bp, Artificial Sequence
  chemically synthesized
catttttaaaactaaatagatc

SEQ ID NO: 22273 - DNA, 22 bp, Artificial Sequence
  chemically synthesized
atttttaaaactaaatagatcg

SEQ ID NO: 22274 - DNA, 22 bp, Artificial Sequence
  chemically synthesized
ttaaaactaaatagatcgacaa

SEQ ID NO: 22275 - DNA, 22 bp, Artificial Sequence
  chemically synthesized
taaaactaaatagatcgacaat

SEQ ID NO: 22276 - DNA, 22 bp, Artificial Sequence
  chemically synthesized
aaaactaaatagatcgacaatg

SEQ ID NO: 22277 - DNA, 22 bp, Artificial Sequence
  chemically synthesized
aaactaaatagatcgacaatgc

SEQ ID NO: 22278 - DNA, 22 bp, Artificial Sequence
  chemically synthesized
aatagatcgacaatgcttatga

SEQ ID NO: 22279 - DNA, 22 bp, Artificial Sequence
  chemically synthesized
atgatgcatttatgtttaataa

SEQ ID NO: 22280 - DNA, 22 bp, Artificial Sequence
  chemically synthesized
tgatgcatttatgtttaataaa

SEQ ID NO: 22281 - DNA, 22 bp, Artificial Sequence
  chemically synthesized
atgtttaataaacactgttcag

SEQ ID NO: 22282 - DNA, 22 bp, Artificial Sequence
  chemically synthesized
tgtttaataaacactgttcagt

SEQ ID NO: 22283 - DNA, 22 bp, Artificial Sequence
  chemically synthesized
aataaacactgttcagttcatg

SEQ ID NO: 22284 - DNA, 22 bp, Artificial Sequence
  chemically synthesized
ataaacactgttcagttcatga

SEQ ID NO: 22285 - DNA, 22 bp, Artificial Sequence
  chemically synthesized
ttcagttcatgatttggtcatg

SEQ ID NO: 22286 - DNA, 22 bp, Artificial Sequence
  chemically synthesized
agttcatgatttggtcatgtaa

SEQ ID NO: 22287 - DNA, 22 bp, Artificial Sequence
  chemically synthesized
atgatttggtcatgtaattcct

SEQ ID NO: 22288 - DNA, 22 bp, Artificial Sequence
  chemically synthesized
ggtcatgtaattcctgttagaa

SEQ ID NO: 22289 - DNA, 22 bp, Artificial Sequence
  chemically synthesized
gtcatgtaattcctgttagaaa

SEQ ID NO: 22290 - DNA, 22 bp, Artificial Sequence
  chemically synthesized
ctgttagaaaacattcatctcc

SEQ ID NO: 22291 - DNA, 22 bp, Artificial Sequence
  chemically synthesized
ttagaaaacattcatctccttg

SEQ ID NO: 22292 - DNA, 22 bp, Artificial Sequence
  chemically synthesized
gaaaacattcatctccttggtt

SEQ ID NO: 22293 - DNA, 22 bp, Artificial Sequence
  chemically synthesized
atctccttggtttaaaaaaatt

SEQ ID NO: 22294 - DNA, 22 bp, Artificial Sequence
  chemically synthesized
cttggtttaaaaaaattaaaag

SEQ ID NO: 22295 - DNA, 22 bp, Artificial Sequence
  chemically synthesized
ggtttaaaaaaattaaaagtgg

SEQ ID NO: 22296 - DNA, 22 bp, Artificial Sequence
  chemically synthesized
gtttaaaaaaattaaaagtggg

SEQ ID NO: 22297 - DNA, 22 bp, Artificial Sequence
  chemically synthesized
aaaaaaattaaaagtgggaaaa

SEQ ID NO: 22298 - DNA, 22 bp, Artificial Sequence
  chemically synthesized
aaaaaattaaaagtgggaaaac

SEQ ID NO: 22299 - DNA, 22 bp, Artificial Sequence
  chemically synthesized
aaagtgggaaaacaaagaaata

SEQ ID NO: 22300 - DNA, 22 bp, Artificial Sequence
  chemically synthesized
tttttgtttggacttaccactt

SEQ ID NO: 22301 - DNA, 22 bp, Artificial Sequence
  chemically synthesized
ttgtttggacttaccactttga

SEQ ID NO: 22302 - DNA, 22 bp, Artificial Sequence
  chemically synthesized
tgtttggacttaccactttgaa

SEQ ID NO: 22303 - DNA, 22 bp, Artificial Sequence
  chemically synthesized
gtttggacttaccactttgaaa

SEQ ID NO: 22304 - DNA, 22 bp, Artificial Sequence
  chemically synthesized
tttggacttaccactttgaaat

SEQ ID NO: 22305 - DNA, 22 bp, Artificial Sequence
  chemically synthesized
ggacttaccactttgaaatcaa

SEQ ID NO: 22306 - DNA, 22 bp, Artificial Sequence
  chemically synthesized
gacttaccactttgaaatcaaa

SEQ ID NO: 22307 - DNA, 22 bp, Artificial Sequence
  chemically synthesized
accactttgaaatcaaaatggg

SEQ ID NO: 22308 - DNA, 22 bp, Artificial Sequence
  chemically synthesized
ccactttgaaatcaaaatggga

SEQ ID NO: 22309 - DNA, 22 bp, Artificial Sequence
  chemically synthesized
tgaaatcaaaatgggaaacaaa

SEQ ID NO: 22310 - DNA, 22 bp, Artificial Sequence
  chemically synthesized
gaaatcaaaatgggaaacaaaa

SEQ ID NO: 22311 - DNA, 22 bp, Artificial Sequence
  chemically synthesized
aaatcaaaatgggaaacaaaag

SEQ ID NO: 22312 - DNA, 22 bp, Artificial Sequence
  chemically synthesized
atttacacaaaaagtctgattt

SEQ ID NO: 22313 - DNA, 22 bp, Artificial Sequence
  chemically synthesized
tttacacaaaaagtctgatttt

SEQ ID NO: 22314 - DNA, 22 bp, Artificial Sequence
  chemically synthesized
acacaaaaagtctgattttaag

SEQ ID NO: 22315 - DNA, 22 bp, Artificial Sequence
  chemically synthesized
cacaaaaagtctgattttaaga

SEQ ID NO: 22316 - DNA, 22 bp, Artificial Sequence
  chemically synthesized
attttaagatatatgacatttc

SEQ ID NO: 22317 - DNA, 22 bp, Artificial Sequence
  chemically synthesized
taagatatatgacatttcaagg

SEQ ID NO: 22318 - DNA, 22 bp, Artificial Sequence
  chemically synthesized
aagatatatgacatttcaaggt

SEQ ID NO: 22319 - DNA, 22 bp, Artificial Sequence
  chemically synthesized
agatatatgacatttcaaggtt

SEQ ID NO: 22320 - DNA, 22 bp, Artificial Sequence
  chemically synthesized
caaggtttcagaagtatgtaat

SEQ ID NO: 22321 - DNA, 22 bp, Artificial Sequence
  chemically synthesized
aaggtttcagaagtatgtaatg

SEQ ID NO: 22322 - DNA, 22 bp, Artificial Sequence
  chemically synthesized
cagaagtatgtaatgaggtgtg

SEQ ID NO: 22323 - DNA, 22 bp, Artificial Sequence
  chemically synthesized
agaagtatgtaatgaggtgtgt

SEQ ID NO: 22324 - DNA, 22 bp, Artificial Sequence
  chemically synthesized
taattttttaaattatatatct

SEQ ID NO: 22325 - DNA, 22 bp, Artificial Sequence
  chemically synthesized
attttttaaattatatatcttc

SEQ ID NO: 22326 - DNA, 22 bp, Artificial Sequence
  chemically synthesized
tttaaattatatatcttcaatt

SEQ ID NO: 22327 - DNA, 22 bp, Artificial Sequence
  chemically synthesized
ttaaattatatatcttcaattt

SEQ ID NO: 22328 - DNA, 22 bp, Artificial Sequence
  chemically synthesized
taaattatatatcttcaattta

SEQ ID NO: 22329 - DNA, 22 bp, Artificial Sequence
  chemically synthesized
aaattatatatcttcaatttaa

SEQ ID NO: 22330 - DNA, 22 bp, Artificial Sequence
  chemically synthesized
aattatatatcttcaatttaaa

SEQ ID NO: 22331 - DNA, 22 bp, Artificial Sequence
  chemically synthesized
tatatcttcaatttaaagtttt

SEQ ID NO: 22332 - DNA, 22 bp, Artificial Sequence
  chemically synthesized
caatttaaagttttagttaaaa

SEQ ID NO: 22333 - DNA, 22 bp, Artificial Sequence
  chemically synthesized
aatttaaagttttagttaaaac

SEQ ID NO: 22334 - DNA, 22 bp, Artificial Sequence
  chemically synthesized
aaagttttagttaaaacataaa

SEQ ID NO: 22335 - DNA, 22 bp, Artificial Sequence
  chemically synthesized
aagttttagttaaaacataaag

SEQ ID NO: 22336 - DNA, 22 bp, Artificial Sequence
  chemically synthesized
tagttaaaacataaagattaac

SEQ ID NO: 22337 - DNA, 22 bp, Artificial Sequence
  chemically synthesized
agttaaaacataaagattaacc

SEQ ID NO: 22338 - DNA, 22 bp, Artificial Sequence
  chemically synthesized
gttaaaacataaagattaacct

SEQ ID NO: 22339 - DNA, 22 bp, Artificial Sequence
  chemically synthesized
aaacataaagattaacctttca

SEQ ID NO: 22340 - DNA, 22 bp, Artificial Sequence
  chemically synthesized
acctttcattagcaagctgtta

SEQ ID NO: 22341 - DNA, 22 bp, Artificial Sequence
  chemically synthesized
tcattagcaagctgttagttat

SEQ ID NO: 22342 - DNA, 22 bp, Artificial Sequence
  chemically synthesized
cattagcaagctgttagttatc

SEQ ID NO: 22343 - DNA, 22 bp, Artificial Sequence
  chemically synthesized
attagcaagctgttagttatca

SEQ ID NO: 22344 - DNA, 22 bp, Artificial Sequence
  chemically synthesized
gcaagctgttagttatcaccaa

SEQ ID NO: 22345 - DNA, 22 bp, Artificial Sequence
  chemically synthesized
ttagttatcaccaaagcttttc

SEQ ID NO: 22346 - DNA, 22 bp, Artificial Sequence
  chemically synthesized
gttatcaccaaagcttttcatg

SEQ ID NO: 22347 - DNA, 22 bp, Artificial Sequence
  chemically synthesized
tcaccaaagcttttcatggatt

SEQ ID NO: 22348 - DNA, 22 bp, Artificial Sequence
  chemically synthesized
ttcatggattaggaaaaaatca

SEQ ID NO: 22349 - DNA, 22 bp, Artificial Sequence
  chemically synthesized
tcatggattaggaaaaaatcat

SEQ ID NO: 22350 - DNA, 22 bp, Artificial Sequence
  chemically synthesized
catggattaggaaaaaatcatt

SEQ ID NO: 22351 - DNA, 22 bp, Artificial Sequence
  chemically synthesized
atggattaggaaaaaatcattt

SEQ ID NO: 22352 - DNA, 22 bp, Artificial Sequence
  chemically synthesized
ggaaaaaatcattttgtctcta

SEQ ID NO: 22353 - DNA, 22 bp, Artificial Sequence
  chemically synthesized
tgtctctatgtcaaacatcttg

SEQ ID NO: 22354 - DNA, 22 bp, Artificial Sequence
  chemically synthesized
gtctctatgtcaaacatcttgg

SEQ ID NO: 22355 - DNA, 22 bp, Artificial Sequence
  chemically synthesized
tctctatgtcaaacatcttgga

SEQ ID NO: 22356 - DNA, 22 bp, Artificial Sequence
  chemically synthesized
tatgtcaaacatcttggagttg

SEQ ID NO: 22357 - DNA, 22 bp, Artificial Sequence
  chemically synthesized
tgtcaaacatcttggagttgat

SEQ ID NO: 22358 - DNA, 22 bp, Artificial Sequence
  chemically synthesized
ggagttgatatttggggaaaca

SEQ ID NO: 22359 - DNA, 22 bp, Artificial Sequence
  chemically synthesized
gagttgatatttggggaaacac

SEQ ID NO: 22360 - DNA, 22 bp, Artificial Sequence
  chemically synthesized
atatttggggaaacacaatact

SEQ ID NO: 22361 - DNA, 22 bp, Artificial Sequence
  chemically synthesized
ggggaaacacaatactcagttg

SEQ ID NO: 22362 - DNA, 22 bp, Artificial Sequence
  chemically synthesized
gggaaacacaatactcagttga

SEQ ID NO: 22363 - DNA, 22 bp, Artificial Sequence
  chemically synthesized
agttgagttccctaggggagaa

SEQ ID NO: 22364 - DNA, 22 bp, Artificial Sequence
  chemically synthesized
agttccctaggggagaaaagca

SEQ ID NO: 22365 - DNA, 22 bp, Artificial Sequence
  chemically synthesized
cctaggggagaaaagcaagctt

SEQ ID NO: 22366 - DNA, 22 bp, Artificial Sequence
  chemically synthesized
ggggagaaaagcaagcttaaga

SEQ ID NO: 22367 - DNA, 22 bp, Artificial Sequence
  chemically synthesized
aagaattgacataaagagtagg

SEQ ID NO: 22368 - DNA, 22 bp, Artificial Sequence
  chemically synthesized
agaattgacataaagagtagga

SEQ ID NO: 22369 - DNA, 22 bp, Artificial Sequence
  chemically synthesized
acataaagagtaggaagttagc

SEQ ID NO: 22370 - DNA, 22 bp, Artificial Sequence
  chemically synthesized
gctaatgcaacatatatcactt

SEQ ID NO: 22371 - DNA, 22 bp, Artificial Sequence
  chemically synthesized
atgcaacatatatcactttgtt

SEQ ID NO: 22372 - DNA, 22 bp, Artificial Sequence
  chemically synthesized
tgttttttcacaactacagtga

SEQ ID NO: 22373 - DNA, 22 bp, Artificial Sequence
  chemically synthesized
gttttttcacaactacagtgac

SEQ ID NO: 22374 - DNA, 22 bp, Artificial Sequence
  chemically synthesized
ttttttcacaactacagtgact

SEQ ID NO: 22375 - DNA, 22 bp, Artificial Sequence
  chemically synthesized
tttcacaactacagtgacttta

SEQ ID NO: 22376 - DNA, 22 bp, Artificial Sequence
  chemically synthesized
ttcacaactacagtgactttat

SEQ ID NO: 22377 - DNA, 22 bp, Artificial Sequence
  chemically synthesized
tcacaactacagtgactttatg

SEQ ID NO: 22378 - DNA, 22 bp, Artificial Sequence
  chemically synthesized
cacaactacagtgactttatgt

SEQ ID NO: 22379 - DNA, 22 bp, Artificial Sequence
  chemically synthesized
acaactacagtgactttatgta

SEQ ID NO: 22380 - DNA, 22 bp, Artificial Sequence
  chemically synthesized
cagtgactttatgtatttccca

SEQ ID NO: 22381 - DNA, 22 bp, Artificial Sequence
  chemically synthesized
tatgtatttcccagaggaaggc

SEQ ID NO: 22382 - DNA, 22 bp, Artificial Sequence
  chemically synthesized
atgtatttcccagaggaaggca

SEQ ID NO: 22383 - DNA, 22 bp, Artificial Sequence
  chemically synthesized
tgtatttcccagaggaaggcat

SEQ ID NO: 22384 - DNA, 22 bp, Artificial Sequence
  chemically synthesized
cccagaggaaggcatacaggga

SEQ ID NO: 22385 - DNA, 22 bp, Artificial Sequence
  chemically synthesized
ccagaggaaggcatacagggaa

SEQ ID NO: 22386 - DNA, 22 bp, Artificial Sequence
  chemically synthesized
tcccatttggacaaacagcatg

SEQ ID NO: 22387 - DNA, 22 bp, Artificial Sequence
  chemically synthesized
ggacaaacagcatgttctcaca

SEQ ID NO: 22388 - DNA, 22 bp, Artificial Sequence
  chemically synthesized
gacaaacagcatgttctcacag

SEQ ID NO: 22389 - DNA, 22 bp, Artificial Sequence
  chemically synthesized
tcacaggaagcatttatcacac

SEQ ID NO: 22390 - DNA, 22 bp, Artificial Sequence
  chemically synthesized
acaggaagcatttatcacactt

SEQ ID NO: 22391 - DNA, 22 bp, Artificial Sequence
  chemically synthesized
atcacacttacttgtcaacttt

SEQ ID NO: 22392 - DNA, 22 bp, Artificial Sequence
  chemically synthesized
tcacacttacttgtcaactttc

SEQ ID NO: 22393 - DNA, 22 bp, Artificial Sequence
  chemically synthesized
acttgtcaactttctagaatca

SEQ ID NO: 22394 - DNA, 22 bp, Artificial Sequence
  chemically synthesized
cttgtcaactttctagaatcaa

SEQ ID NO: 22395 - DNA, 22 bp, Artificial Sequence
  chemically synthesized
gtcaactttctagaatcaaatc

SEQ ID NO: 22396 - DNA, 22 bp, Artificial Sequence
  chemically synthesized
tcaactttctagaatcaaatct

SEQ ID NO: 22397 - DNA, 22 bp, Artificial Sequence
  chemically synthesized
tctagaatcaaatctagtagct

SEQ ID NO: 22398 - DNA, 22 bp, Artificial Sequence
  chemically synthesized
ctagaatcaaatctagtagctg

SEQ ID NO: 22399 - DNA, 22 bp, Artificial Sequence
  chemically synthesized
tagaatcaaatctagtagctga

SEQ ID NO: 22400 - DNA, 22 bp, Artificial Sequence
  chemically synthesized
gaatcaaatctagtagctgaca

SEQ ID NO: 22401 - DNA, 22 bp, Artificial Sequence
  chemically synthesized
gtagctgacagtaccaggatca

SEQ ID NO: 22402 - DNA, 22 bp, Artificial Sequence
  chemically synthesized
acagtaccaggatcaggggtgc

SEQ ID NO: 22403 - DNA, 22 bp, Artificial Sequence
  chemically synthesized
agcacccccagaaagctgactg

SEQ ID NO: 22404 - DNA, 22 bp, Artificial Sequence
  chemically synthesized
actggccctgtggttcccactc

SEQ ID NO: 22405 - DNA, 22 bp, Artificial Sequence
  chemically synthesized
gccctgtggttcccactccaga

SEQ ID NO: 22406 - DNA, 22 bp, Artificial Sequence
  chemically synthesized
tggttcccactccagacatgat

SEQ ID NO: 22407 - DNA, 22 bp, Artificial Sequence
  chemically synthesized
ccactccagacatgatgtcagc

SEQ ID NO: 22408 - DNA, 22 bp, Artificial Sequence
  chemically synthesized
cagacatgatgtcagctgtgaa

SEQ ID NO: 22409 - DNA, 22 bp, Artificial Sequence
  chemically synthesized
tgaaatcagactgaaatgctga

SEQ ID NO: 22410 - DNA, 22 bp, Artificial Sequence
  chemically synthesized
aaatgctgaaataacgataaaa

SEQ ID NO: 22411 - DNA, 22 bp, Artificial Sequence
  chemically synthesized
aaataacgataaaaaaaaatac

SEQ ID NO: 22412 - DNA, 22 bp, Artificial Sequence
  chemically synthesized
aactagcaaagtgagtaaagtc

SEQ ID NO: 22413 - DNA, 22 bp, Artificial Sequence
  chemically synthesized
gcaaagtgagtaaagtcaaggg

SEQ ID NO: 22414 - DNA, 22 bp, Artificial Sequence
  chemically synthesized
gttggaaaactcacaaagcagg

SEQ ID NO: 22415 - DNA, 22 bp, Artificial Sequence
  chemically synthesized
ttggaaaactcacaaagcagga

SEQ ID NO: 22416 - DNA, 22 bp, Artificial Sequence
  chemically synthesized
gaaaactcacaaagcaggacat

SEQ ID NO: 22417 - DNA, 22 bp, Artificial Sequence
  chemically synthesized
acaaagcaggacataaagcaag

SEQ ID NO: 22418 - DNA, 22 bp, Artificial Sequence
  chemically synthesized
gatatatctcattagtgtgaca

SEQ ID NO: 22419 - DNA, 22 bp, Artificial Sequence
  chemically synthesized
attagtgtgacatctgggagga

SEQ ID NO: 22420 - DNA, 22 bp, Artificial Sequence
  chemically synthesized
gtgtgacatctgggaggacaaa

SEQ ID NO: 22421 - DNA, 22 bp, Artificial Sequence
  chemically synthesized
ggaggacaaagcatccaaaccc

SEQ ID NO: 22422 - DNA, 22 bp, Artificial Sequence
  chemically synthesized
tcttctatataagtggtgagat

SEQ ID NO: 22423 - DNA, 22 bp, Artificial Sequence
  chemically synthesized
cttctatataagtggtgagatg

SEQ ID NO: 22424 - DNA, 22 bp, Artificial Sequence
  chemically synthesized
ttctatataagtggtgagatga

SEQ ID NO: 22425 - DNA, 22 bp, Artificial Sequence
  chemically synthesized
ctatataagtggtgagatgatg

SEQ ID NO: 22426 - DNA, 22 bp, Artificial Sequence
  chemically synthesized
tatataagtggtgagatgatga

SEQ ID NO: 22427 - DNA, 22 bp, Artificial Sequence
  chemically synthesized
tataagtggtgagatgatgaag

SEQ ID NO: 22428 - DNA, 22 bp, Artificial Sequence
  chemically synthesized
taagagggcttctgcccccttg

SEQ ID NO: 22429 - DNA, 22 bp, Artificial Sequence
  chemically synthesized
ctgcccccttgaagacttcaga

SEQ ID NO: 22430 - DNA, 22 bp, Artificial Sequence
  chemically synthesized
tgcccccttgaagacttcagat

SEQ ID NO: 22431 - DNA, 22 bp, Artificial Sequence
  chemically synthesized
cccccttgaagacttcagatgc

SEQ ID NO: 22432 - DNA, 22 bp, Artificial Sequence
  chemically synthesized
gaagacttcagatgctggggaa

SEQ ID NO: 22433 - DNA, 22 bp, Artificial Sequence
  chemically synthesized
aagacttcagatgctggggaaa

SEQ ID NO: 22434 - DNA, 22 bp, Artificial Sequence
  chemically synthesized
cagatgctggggaaaggataga

SEQ ID NO: 22435 - DNA, 22 bp, Artificial Sequence
  chemically synthesized
agatgctggggaaaggatagat

SEQ ID NO: 22436 - DNA, 22 bp, Artificial Sequence
  chemically synthesized
gggaaaggatagataagaataa

SEQ ID NO: 22437 - DNA, 22 bp, Artificial Sequence
  chemically synthesized
ttggagcctgggaaataatgac

SEQ ID NO: 22438 - DNA, 22 bp, Artificial Sequence
  chemically synthesized
tggagcctgggaaataatgact

SEQ ID NO: 22439 - DNA, 22 bp, Artificial Sequence
  chemically synthesized
ggagcctgggaaataatgacta

SEQ ID NO: 22440 - DNA, 22 bp, Artificial Sequence
  chemically synthesized
gagcctgggaaataatgactag

SEQ ID NO: 22441 - DNA, 22 bp, Artificial Sequence
  chemically synthesized
ggaaataatgactagcgataaa

SEQ ID NO: 22442 - DNA, 22 bp, Artificial Sequence
  chemically synthesized
gcgataaacctgaagggaagtt

SEQ ID NO: 22443 - DNA, 22 bp, Artificial Sequence
  chemically synthesized
aagggaagttaagtatacgatc

SEQ ID NO: 22444 - DNA, 22 bp, Artificial Sequence
  chemically synthesized
agtatacgatccccagataata

SEQ ID NO: 22445 - DNA, 22 bp, Artificial Sequence
  chemically synthesized
aggagaaaggcaatgtgattct

SEQ ID NO: 22446 - DNA, 22 bp, Artificial Sequence
  chemically synthesized
tgcagccattgtagccagagat

SEQ ID NO: 22447 - DNA, 22 bp, Artificial Sequence
  chemically synthesized
cagccattgtagccagagataa

SEQ ID NO: 22448 - DNA, 22 bp, Artificial Sequence
  chemically synthesized
tagccagagataataagccctt

SEQ ID NO: 22449 - DNA, 22 bp, Artificial Sequence
  chemically synthesized
gaggaaggggccaggggaattt

SEQ ID NO: 22450 - DNA, 22 bp, Artificial Sequence
  chemically synthesized
aggaaggggccaggggaatttt

SEQ ID NO: 22451 - DNA, 22 bp, Artificial Sequence
  chemically synthesized
ttctaaggatagacagtattaa

SEQ ID NO: 22452 - DNA, 22 bp, Artificial Sequence
  chemically synthesized
tctaaggatagacagtattaat

SEQ ID NO: 22453 - DNA, 22 bp, Artificial Sequence
  chemically synthesized
ctaaggatagacagtattaatg

SEQ ID NO: 22454 - DNA, 22 bp, Artificial Sequence
  chemically synthesized
taaggatagacagtattaatgc

SEQ ID NO: 22455 - DNA, 22 bp, Artificial Sequence
  chemically synthesized
aggatagacagtattaatgcag

SEQ ID NO: 22456 - DNA, 22 bp, Artificial Sequence
  chemically synthesized
atgcagcactctcttctgctat

SEQ ID NO: 22457 - DNA, 22 bp, Artificial Sequence
  chemically synthesized
tcttctgctattaaactctcat

SEQ ID NO: 22458 - DNA, 22 bp, Artificial Sequence
  chemically synthesized
ttctgctattaaactctcattg

SEQ ID NO: 22459 - DNA, 22 bp, Artificial Sequence
  chemically synthesized
ctgctattaaactctcattggc

SEQ ID NO: 22460 - DNA, 22 bp, Artificial Sequence
  chemically synthesized
tgctattaaactctcattggct

SEQ ID NO: 22461 - DNA, 22 bp, Artificial Sequence
  chemically synthesized
ctattaaactctcattggcttc

SEQ ID NO: 22462 - DNA, 22 bp, Artificial Sequence
  chemically synthesized
ttaaactctcattggcttctaa

SEQ ID NO: 22463 - DNA, 22 bp, Artificial Sequence
  chemically synthesized
aactctcattggcttctaaaag

SEQ ID NO: 22464 - DNA, 22 bp, Artificial Sequence
  chemically synthesized
tcattggcttctaaaaggagtt

SEQ ID NO: 22465 - DNA, 22 bp, Artificial Sequence
  chemically synthesized
attggcttctaaaaggagtttc

SEQ ID NO: 22466 - DNA, 22 bp, Artificial Sequence
  chemically synthesized
gcttctaaaaggagtttcggtg

SEQ ID NO: 22467 - DNA, 22 bp, Artificial Sequence
  chemically synthesized
ctaaaaggagtttcggtgagtg

SEQ ID NO: 22468 - DNA, 22 bp, Artificial Sequence
  chemically synthesized
taaaaggagtttcggtgagtga

SEQ ID NO: 22469 - DNA, 22 bp, Artificial Sequence
  chemically synthesized
aaaggagtttcggtgagtgatt

SEQ ID NO: 22470 - DNA, 22 bp, Artificial Sequence
  chemically synthesized
cggtgagtgatttgctgagatg

SEQ ID NO: 22471 - DNA, 22 bp, Artificial Sequence
  chemically synthesized
ggtgagtgatttgctgagatgt

SEQ ID NO: 22472 - DNA, 22 bp, Artificial Sequence
  chemically synthesized
gctgagatgttgcattttcatg

SEQ ID NO: 22473 - DNA, 22 bp, Artificial Sequence
  chemically synthesized
ctgagatgttgcattttcatgg

SEQ ID NO: 22474 - DNA, 22 bp, Artificial Sequence
  chemically synthesized
agatgttgcattttcatggctg

SEQ ID NO: 22475 - DNA, 22 bp, Artificial Sequence
  chemically synthesized
cattttcatggctgctgccttt

SEQ ID NO: 22476 - DNA, 22 bp, Artificial Sequence
  chemically synthesized
tcatggctgctgcctttaggta

SEQ ID NO: 22477 - DNA, 22 bp, Artificial Sequence
  chemically synthesized
catggctgctgcctttaggtat

SEQ ID NO: 22478 - DNA, 22 bp, Artificial Sequence
  chemically synthesized
atggctgctgcctttaggtatt

SEQ ID NO: 22479 - DNA, 22 bp, Artificial Sequence
  chemically synthesized
ctgcctttaggtattattgcaa

SEQ ID NO: 22480 - DNA, 22 bp, Artificial Sequence
  chemically synthesized
cctttaggtattattgcaacag

SEQ ID NO: 22481 - DNA, 22 bp, Artificial Sequence
  chemically synthesized
taggtattattgcaacagtttg

SEQ ID NO: 22482 - DNA, 22 bp, Artificial Sequence
  chemically synthesized
aggtattattgcaacagtttgg

SEQ ID NO: 22483 - DNA, 22 bp, Artificial Sequence
  chemically synthesized
ggtattattgcaacagtttgga

SEQ ID NO: 22484 - DNA, 22 bp, Artificial Sequence
  chemically synthesized
ttgcaacagtttggaattttga

SEQ ID NO: 22485 - DNA, 22 bp, Artificial Sequence
  chemically synthesized
caacagtttggaattttgaaat

SEQ ID NO: 22486 - DNA, 22 bp, Artificial Sequence
  chemically synthesized
ggaattttgaaattaaaacagt

SEQ ID NO: 22487 - DNA, 22 bp, Artificial Sequence
  chemically synthesized
gaattttgaaattaaaacagtt

SEQ ID NO: 22488 - DNA, 22 bp, Artificial Sequence
  chemically synthesized
tgaaattaaaacagttctgtaa

SEQ ID NO: 22489 - DNA, 22 bp, Artificial Sequence
  chemically synthesized
gaaattaaaacagttctgtaaa

SEQ ID NO: 22490 - DNA, 22 bp, Artificial Sequence
  chemically synthesized
aaattaaaacagttctgtaaaa

SEQ ID NO: 22491 - DNA, 22 bp, Artificial Sequence
  chemically synthesized
aaacagttctgtaaaaccagtt

SEQ ID NO: 22492 - DNA, 22 bp, Artificial Sequence
  chemically synthesized
tgtaaaaccagtttagttttgt

SEQ ID NO: 22493 - DNA, 22 bp, Artificial Sequence
  chemically synthesized
taaaaccagtttagttttgtaa

SEQ ID NO: 22494 - DNA, 22 bp, Artificial Sequence
  chemically synthesized
agttttgtaaagtgtatgcatc

SEQ ID NO: 22495 - DNA, 22 bp, Artificial Sequence
  chemically synthesized
gttttgtaaagtgtatgcatca

SEQ ID NO: 22496 - DNA, 22 bp, Artificial Sequence
  chemically synthesized
tgtaaagtgtatgcatcaaaga

SEQ ID NO: 22497 - DNA, 22 bp, Artificial Sequence
  chemically synthesized
gtaaagtgtatgcatcaaagat

SEQ ID NO: 22498 - DNA, 22 bp, Artificial Sequence
  chemically synthesized
taaagtgtatgcatcaaagatg

SEQ ID NO: 22499 - DNA, 22 bp, Artificial Sequence
  chemically synthesized
cattcagacattactgagttac

SEQ ID NO: 22500 - DNA, 22 bp, Artificial Sequence
  chemically synthesized
attcagacattactgagttaca

SEQ ID NO: 22501 - DNA, 22 bp, Artificial Sequence
  chemically synthesized
agacattactgagttacaacta

SEQ ID NO: 22502 - DNA, 22 bp, Artificial Sequence
  chemically synthesized
ctgagttacaactatggtgcca

SEQ ID NO: 22503 - DNA, 22 bp, Artificial Sequence
  chemically synthesized
agttacaactatggtgccaggt

SEQ ID NO: 22504 - DNA, 22 bp, Artificial Sequence
  chemically synthesized
caactatggtgccaggtactgt

SEQ ID NO: 22505 - DNA, 22 bp, Artificial Sequence
  chemically synthesized
tggtgccaggtactgtgtcagg

SEQ ID NO: 22506 - DNA, 22 bp, Artificial Sequence
  chemically synthesized
tgtcagggtactaggggtatgg

SEQ ID NO: 22507 - DNA, 22 bp, Artificial Sequence
  chemically synthesized
ggggtatggggataaaccagac

SEQ ID NO: 22508 - DNA, 22 bp, Artificial Sequence
  chemically synthesized
cctctttgatctaaagcagcat

SEQ ID NO: 22509 - DNA, 22 bp, Artificial Sequence
  chemically synthesized
tttgatctaaagcagcatgagg

SEQ ID NO: 22510 - DNA, 22 bp, Artificial Sequence
  chemically synthesized
tgatctaaagcagcatgaggcc

SEQ ID NO: 22511 - DNA, 22 bp, Artificial Sequence
  chemically synthesized
gatctaaagcagcatgaggcca

SEQ ID NO: 22512 - DNA, 22 bp, Artificial Sequence
  chemically synthesized
atctaaagcagcatgaggccag

SEQ ID NO: 22513 - DNA, 22 bp, Artificial Sequence
  chemically synthesized
aagcagcatgaggccaggtgag

SEQ ID NO: 22514 - DNA, 22 bp, Artificial Sequence
  chemically synthesized
caatataatgtgataaaatgtg

SEQ ID NO: 22515 - DNA, 22 bp, Artificial Sequence
  chemically synthesized
aatataatgtgataaaatgtgc

SEQ ID NO: 22516 - DNA, 22 bp, Artificial Sequence
  chemically synthesized
ggtactaagggatcatagagaa

SEQ ID NO: 22517 - DNA, 22 bp, Artificial Sequence
  chemically synthesized
agggatcatagagaaaggaaca

SEQ ID NO: 22518 - DNA, 22 bp, Artificial Sequence
  chemically synthesized
aatggggaaacaattgatagag

SEQ ID NO: 22519 - DNA, 22 bp, Artificial Sequence
  chemically synthesized
atagagagagaatattttcatc

SEQ ID NO: 22520 - DNA, 22 bp, Artificial Sequence
  chemically synthesized
tcatctgggtcttaaaagatga

SEQ ID NO: 22521 - DNA, 22 bp, Artificial Sequence
  chemically synthesized
catctgggtcttaaaagatgag

SEQ ID NO: 22522 - DNA, 22 bp, Artificial Sequence
  chemically synthesized
atctgggtcttaaaagatgagt

SEQ ID NO: 22523 - DNA, 22 bp, Artificial Sequence
  chemically synthesized
ggtcttaaaagatgagtaggcg

SEQ ID NO: 22524 - DNA, 22 bp, Artificial Sequence
  chemically synthesized
aaaagatgagtaggcgttctct

SEQ ID NO: 22525 - DNA, 22 bp, Artificial Sequence
  chemically synthesized
aaagatgagtaggcgttctctc

SEQ ID NO: 22526 - DNA, 22 bp, Artificial Sequence
  chemically synthesized
tctctctttaaatgtctgatat

SEQ ID NO: 22527 - DNA, 22 bp, Artificial Sequence
  chemically synthesized
tctctttaaatgtctgatataa

SEQ ID NO: 22528 - DNA, 22 bp, Artificial Sequence
  chemically synthesized
tctttaaatgtctgatataagg

SEQ ID NO: 22529 - DNA, 22 bp, Artificial Sequence
  chemically synthesized
tttaaatgtctgatataagggc

SEQ ID NO: 22530 - DNA, 22 bp, Artificial Sequence
  chemically synthesized
taaatgtctgatataagggcat

SEQ ID NO: 22531 - DNA, 22 bp, Artificial Sequence
  chemically synthesized
aaatgtctgatataagggcatt

SEQ ID NO: 22532 - DNA, 22 bp, Artificial Sequence
  chemically synthesized
aatgtctgatataagggcattt

SEQ ID NO: 22533 - DNA, 22 bp, Artificial Sequence
  chemically synthesized
atataagggcattttatgcaaa

SEQ ID NO: 22534 - DNA, 22 bp, Artificial Sequence
  chemically synthesized
tatgcaaagaggatcactcgtg

SEQ ID NO: 22535 - DNA, 22 bp, Artificial Sequence
  chemically synthesized
atgcaaagaggatcactcgtgc

SEQ ID NO: 22536 - DNA, 22 bp, Artificial Sequence
  chemically synthesized
tgcaaagaggatcactcgtgca

SEQ ID NO: 22537 - DNA, 22 bp, Artificial Sequence
  chemically synthesized
gtgcaaagactcagatttgcaa

SEQ ID NO: 22538 - DNA, 22 bp, Artificial Sequence
  chemically synthesized
agatttgcaagaacgtgaggta

SEQ ID NO: 22539 - DNA, 22 bp, Artificial Sequence
  chemically synthesized
gcaagaacgtgaggtatttcag

SEQ ID NO: 22540 - DNA, 22 bp, Artificial Sequence
  chemically synthesized
caagaacgtgaggtatttcagg

SEQ ID NO: 22541 - DNA, 22 bp, Artificial Sequence
  chemically synthesized
caggagttttgtatggttccat

SEQ ID NO: 22542 - DNA, 22 bp, Artificial Sequence
  chemically synthesized
aggagttttgtatggttccata

SEQ ID NO: 22543 - DNA, 22 bp, Artificial Sequence
  chemically synthesized
tgtatggttccatatggactat

SEQ ID NO: 22544 - DNA, 22 bp, Artificial Sequence
  chemically synthesized
gtatggttccatatggactatg

SEQ ID NO: 22545 - DNA, 22 bp, Artificial Sequence
  chemically synthesized
tatggttccatatggactatga

SEQ ID NO: 22546 - DNA, 22 bp, Artificial Sequence
  chemically synthesized
catatggactatgacaagtgag

SEQ ID NO: 22547 - DNA, 22 bp, Artificial Sequence
  chemically synthesized
tgacaagtgagacaggtaaact

SEQ ID NO: 22548 - DNA, 22 bp, Artificial Sequence
  chemically synthesized
ggcagagctggtcatcagataa

SEQ ID NO: 22549 - DNA, 22 bp, Artificial Sequence
  chemically synthesized
gtcatcagataatgaagtcatt

SEQ ID NO: 22550 - DNA, 22 bp, Artificial Sequence
  chemically synthesized
acctaaggagattggacaataa

SEQ ID NO: 22551 - DNA, 22 bp, Artificial Sequence
  chemically synthesized
aggagattggacaataaaatgc

SEQ ID NO: 22552 - DNA, 22 bp, Artificial Sequence
  chemically synthesized
gacaataaaatgcaatatggag

SEQ ID NO: 22553 - DNA, 22 bp, Artificial Sequence
  chemically synthesized
atggctgatttaggatgcccag

SEQ ID NO: 22554 - DNA, 22 bp, Artificial Sequence
  chemically synthesized
atttaggatgcccagtctggca

SEQ ID NO: 22555 - DNA, 22 bp, Artificial Sequence
  chemically synthesized
aggatgcccagtctggcaacac

SEQ ID NO: 22556 - DNA, 22 bp, Artificial Sequence
  chemically synthesized
ggatgcccagtctggcaacacg

SEQ ID NO: 22557 - DNA, 22 bp, Artificial Sequence
  chemically synthesized
gcaacacgctaatgaaatgata

SEQ ID NO: 22558 - DNA, 22 bp, Artificial Sequence
  chemically synthesized
atgaaatgatagtgggggaggg

SEQ ID NO: 22559 - DNA, 22 bp, Artificial Sequence
  chemically synthesized
ggagagagcagtcctgagacta

SEQ ID NO: 22560 - DNA, 22 bp, Artificial Sequence
  chemically synthesized
agactattgcaattatctgcgg

SEQ ID NO: 22561 - DNA, 22 bp, Artificial Sequence
  chemically synthesized
ttgcaattatctgcgggagaca

SEQ ID NO: 22562 - DNA, 22 bp, Artificial Sequence
  chemically synthesized
caattatctgcgggagacataa

SEQ ID NO: 22563 - DNA, 22 bp, Artificial Sequence
  chemically synthesized
tctgcgggagacataaaggcta

SEQ ID NO: 22564 - DNA, 22 bp, Artificial Sequence
  chemically synthesized
cgggagacataaaggctagaac

SEQ ID NO: 22565 - DNA, 22 bp, Artificial Sequence
  chemically synthesized
gaacctgaacagtagcagtaca

SEQ ID NO: 22566 - DNA, 22 bp, Artificial Sequence
  chemically synthesized
aacagtagcagtacaaaaaaag

SEQ ID NO: 22567 - DNA, 22 bp, Artificial Sequence
  chemically synthesized
aaatgatattaaggaagtagaa

SEQ ID NO: 22568 - DNA, 22 bp, Artificial Sequence
  chemically synthesized
aggaagtagaagtggtatgact

SEQ ID NO: 22569 - DNA, 22 bp, Artificial Sequence
  chemically synthesized
aaccatctgggtatggaagggg

SEQ ID NO: 22570 - DNA, 22 bp, Artificial Sequence
  chemically synthesized
accatctgggtatggaagggga

SEQ ID NO: 22571 - DNA, 22 bp, Artificial Sequence
  chemically synthesized
ggtatggaaggggaaatggcta

SEQ ID NO: 22572 - DNA, 22 bp, Artificial Sequence
  chemically synthesized
gagtcttggggactttgtgttt

SEQ ID NO: 22573 - DNA, 22 bp, Artificial Sequence
  chemically synthesized
ggggactttgtgtttgatgtga

SEQ ID NO: 22574 - DNA, 22 bp, Artificial Sequence
  chemically synthesized
gggactttgtgtttgatgtgat

SEQ ID NO: 22575 - DNA, 22 bp, Artificial Sequence
  chemically synthesized
tgtgtttgatgtgattatggac

SEQ ID NO: 22576 - DNA, 22 bp, Artificial Sequence
  chemically synthesized
gtgtttgatgtgattatggacc

SEQ ID NO: 22577 - DNA, 22 bp, Artificial Sequence
  chemically synthesized
tgtttgatgtgattatggacca

SEQ ID NO: 22578 - DNA, 22 bp, Artificial Sequence
  chemically synthesized
gatgtgattatggaccacagaa

SEQ ID NO: 22579 - DNA, 22 bp, Artificial Sequence
  chemically synthesized
atgtgattatggaccacagaat

SEQ ID NO: 22580 - DNA, 22 bp, Artificial Sequence
  chemically synthesized
tggaccacagaataatgtctaa

SEQ ID NO: 22581 - DNA, 22 bp, Artificial Sequence
  chemically synthesized
agagaactggctctttagtctg

SEQ ID NO: 22582 - DNA, 22 bp, Artificial Sequence
  chemically synthesized
gctctttagtctgactgccaga

SEQ ID NO: 22583 - DNA, 22 bp, Artificial Sequence
  chemically synthesized
tttagtctgactgccagagtct

SEQ ID NO: 22584 - DNA, 22 bp, Artificial Sequence
  chemically synthesized
tagtctgactgccagagtctga

SEQ ID NO: 22585 - DNA, 22 bp, Artificial Sequence
  chemically synthesized
agtctgactgccagagtctgaa

SEQ ID NO: 22586 - DNA, 22 bp, Artificial Sequence
  chemically synthesized
gtctgactgccagagtctgaat

SEQ ID NO: 22587 - DNA, 22 bp, Artificial Sequence
  chemically synthesized
actgccagagtctgaatcctga

SEQ ID NO: 22588 - DNA, 22 bp, Artificial Sequence
  chemically synthesized
ccagagtctgaatcctgaatgt

SEQ ID NO: 22589 - DNA, 22 bp, Artificial Sequence
  chemically synthesized
aatcctgaatgttttagtatgt

SEQ ID NO: 22590 - DNA, 22 bp, Artificial Sequence
  chemically synthesized
aatgttttagtatgttaccttg

SEQ ID NO: 22591 - DNA, 22 bp, Artificial Sequence
  chemically synthesized
tagtatgttaccttgggcaaag

SEQ ID NO: 22592 - DNA, 22 bp, Artificial Sequence
  chemically synthesized
agtatgttaccttgggcaaagc

SEQ ID NO: 22593 - DNA, 22 bp, Artificial Sequence
  chemically synthesized
gtatgttaccttgggcaaagcc

SEQ ID NO: 22594 - DNA, 22 bp, Artificial Sequence
  chemically synthesized
ccttgggcaaagcccttagcct

SEQ ID NO: 22595 - DNA, 22 bp, Artificial Sequence
  chemically synthesized
gggcaaagcccttagcctctat

SEQ ID NO: 22596 - DNA, 22 bp, Artificial Sequence
  chemically synthesized
ggcaaagcccttagcctctatg

SEQ ID NO: 22597 - DNA, 22 bp, Artificial Sequence
  chemically synthesized
agcctctatgaatctatcttcc

SEQ ID NO: 22598 - DNA, 22 bp, Artificial Sequence
  chemically synthesized
gcctctatgaatctatcttcct

SEQ ID NO: 22599 - DNA, 22 bp, Artificial Sequence
  chemically synthesized
tatgaatctatcttcctcattc

SEQ ID NO: 22600 - DNA, 22 bp, Artificial Sequence
  chemically synthesized
tgaatctatcttcctcattcat

SEQ ID NO: 22601 - DNA, 22 bp, Artificial Sequence
  chemically synthesized
tcttcctcattcataaaaataa

SEQ ID NO: 22602 - DNA, 22 bp, Artificial Sequence
  chemically synthesized
cctcattcataaaaataagatg

SEQ ID NO: 22603 - DNA, 22 bp, Artificial Sequence
  chemically synthesized
ctcattcataaaaataagatga

SEQ ID NO: 22604 - DNA, 22 bp, Artificial Sequence
  chemically synthesized
attcataaaaataagatgacag

SEQ ID NO: 22605 - DNA, 22 bp, Artificial Sequence
  chemically synthesized
ataaaaataagatgacagtgcc

SEQ ID NO: 22606 - DNA, 22 bp, Artificial Sequence
  chemically synthesized
tctcgtgggacttttgtgagga

SEQ ID NO: 22607 - DNA, 22 bp, Artificial Sequence
  chemically synthesized
gtgggacttttgtgaggatgaa

SEQ ID NO: 22608 - DNA, 22 bp, Artificial Sequence
  chemically synthesized
ttgtgaggatgaagtgagataa

SEQ ID NO: 22609 - DNA, 22 bp, Artificial Sequence
  chemically synthesized
tgtgaggatgaagtgagataat

SEQ ID NO: 22610 - DNA, 22 bp, Artificial Sequence
  chemically synthesized
gtgaggatgaagtgagataatg

SEQ ID NO: 22611 - DNA, 22 bp, Artificial Sequence
  chemically synthesized
tgaggatgaagtgagataatgg

SEQ ID NO: 22612 - DNA, 22 bp, Artificial Sequence
  chemically synthesized
ctgagcacagtgtccaacacag

SEQ ID NO: 22613 - DNA, 22 bp, Artificial Sequence
  chemically synthesized
agcacagtgtccaacacagcag

SEQ ID NO: 22614 - DNA, 22 bp, Artificial Sequence
  chemically synthesized
catatacattagctattactgg

SEQ ID NO: 22615 - DNA, 22 bp, Artificial Sequence
  chemically synthesized
gctattactggctacattatga

SEQ ID NO: 22616 - DNA, 22 bp, Artificial Sequence
  chemically synthesized
ttactggctacattatgatata

SEQ ID NO: 22617 - DNA, 22 bp, Artificial Sequence
  chemically synthesized
ctggctacattatgatatacag

SEQ ID NO: 22618 - DNA, 22 bp, Artificial Sequence
  chemically synthesized
gctacattatgatatacagtta

SEQ ID NO: 22619 - DNA, 22 bp, Artificial Sequence
  chemically synthesized
cattatgatatacagttaggga

SEQ ID NO: 22620 - DNA, 22 bp, Artificial Sequence
  chemically synthesized
tgatatacagttagggagttgg

SEQ ID NO: 22621 - DNA, 22 bp, Artificial Sequence
  chemically synthesized
gggagttggaaagataatctga

SEQ ID NO: 22622 - DNA, 22 bp, Artificial Sequence
  chemically synthesized
gaaagataatctgaaattcagg

SEQ ID NO: 22623 - DNA, 22 bp, Artificial Sequence
  chemically synthesized
aaattcaggagacgtatctgac

SEQ ID NO: 22624 - DNA, 22 bp, Artificial Sequence
  chemically synthesized
aggagacgtatctgactatagg

SEQ ID NO: 22625 - DNA, 22 bp, Artificial Sequence
  chemically synthesized
actataggtgagtatttggaac

SEQ ID NO: 22626 - DNA, 22 bp, Artificial Sequence
  chemically synthesized
taggtgagtatttggaactcat

SEQ ID NO: 22627 - DNA, 22 bp, Artificial Sequence
  chemically synthesized
ggaactcattgttctgtaaaca

SEQ ID NO: 22628 - DNA, 22 bp, Artificial Sequence
  chemically synthesized
gaactcattgttctgtaaacag

SEQ ID NO: 22629 - DNA, 22 bp, Artificial Sequence
  chemically synthesized
attgttctgtaaacagtagtta

SEQ ID NO: 22630 - DNA, 22 bp, Artificial Sequence
  chemically synthesized
ttctgtaaacagtagttacagc

SEQ ID NO: 22631 - DNA, 22 bp, Artificial Sequence
  chemically synthesized
tgtaaacagtagttacagccac

SEQ ID NO: 22632 - DNA, 22 bp, Artificial Sequence
  chemically synthesized
taaacagtagttacagccacgt

SEQ ID NO: 22633 - DNA, 22 bp, Artificial Sequence
  chemically synthesized
cagccacgtgtgtgggcatctg

SEQ ID NO: 22634 - DNA, 22 bp, Artificial Sequence
  chemically synthesized
gagagtgagcatggatattgtg

SEQ ID NO: 22635 - DNA, 22 bp, Artificial Sequence
  chemically synthesized
tgatacctagtacagtgcctgg

SEQ ID NO: 22636 - DNA, 22 bp, Artificial Sequence
  chemically synthesized
gtacagtgcctggcagtagtgg

SEQ ID NO: 22637 - DNA, 22 bp, Artificial Sequence
  chemically synthesized
gcagtagtggttgtatgctcag

SEQ ID NO: 22638 - DNA, 22 bp, Artificial Sequence
  chemically synthesized
tatgctcagtaaattttgttga

SEQ ID NO: 22639 - DNA, 22 bp, Artificial Sequence
  chemically synthesized
agtaaattttgttgacagggtc

SEQ ID NO: 22640 - DNA, 22 bp, Artificial Sequence
  chemically synthesized
tgttgacagggtcagggccgga

SEQ ID NO: 22641 - DNA, 22 bp, Artificial Sequence
  chemically synthesized
gttgacagggtcagggccggac

SEQ ID NO: 22642 - DNA, 22 bp, Artificial Sequence
  chemically synthesized
ttgacagggtcagggccggact

SEQ ID NO: 22643 - DNA, 22 bp, Artificial Sequence
  chemically synthesized
acagggtcagggccggactaga

SEQ ID NO: 22644 - DNA, 22 bp, Artificial Sequence
  chemically synthesized
gactgtggtaagcaaggcctgt

SEQ ID NO: 22645 - DNA, 22 bp, Artificial Sequence
  chemically synthesized
tggtaagcaaggcctgtagggc

SEQ ID NO: 22646 - DNA, 22 bp, Artificial Sequence
  chemically synthesized
tagggcataaatatacttgtat

SEQ ID NO: 22647 - DNA, 22 bp, Artificial Sequence
  chemically synthesized
gtatgccccgagaagtgaggac

SEQ ID NO: 22648 - DNA, 22 bp, Artificial Sequence
  chemically synthesized
tatgccccgagaagtgaggacc

SEQ ID NO: 22649 - DNA, 22 bp, Artificial Sequence
  chemically synthesized
ttaaatattgtgccctacatgc

SEQ ID NO: 22650 - DNA, 22 bp, Artificial Sequence
  chemically synthesized
aaatattgtgccctacatgcct

SEQ ID NO: 22651 - DNA, 22 bp, Artificial Sequence
  chemically synthesized
aatattgtgccctacatgcctt

SEQ ID NO: 22652 - DNA, 22 bp, Artificial Sequence
  chemically synthesized
tgccctacatgccttgtttggt

SEQ ID NO: 22653 - DNA, 22 bp, Artificial Sequence
  chemically synthesized
catgccttgtttggttcactct

SEQ ID NO: 22654 - DNA, 22 bp, Artificial Sequence
  chemically synthesized
gtttggttcactcttgtcccag

SEQ ID NO: 22655 - DNA, 22 bp, Artificial Sequence
  chemically synthesized
tttggttcactcttgtcccagc

SEQ ID NO: 22656 - DNA, 22 bp, Artificial Sequence
  chemically synthesized
ggttcactcttgtcccagccct

SEQ ID NO: 22657 - DNA, 22 bp, Artificial Sequence
  chemically synthesized
gttcactcttgtcccagcccta

SEQ ID NO: 22658 - DNA, 22 bp, Artificial Sequence
  chemically synthesized
actcttgtcccagccctagcaa

SEQ ID NO: 22659 - DNA, 22 bp, Artificial Sequence
  chemically synthesized
ttgtcccagccctagcaagtat

SEQ ID NO: 22660 - DNA, 22 bp, Artificial Sequence
  chemically synthesized
gtcccagccctagcaagtatat

SEQ ID NO: 22661 - DNA, 22 bp, Artificial Sequence
  chemically synthesized
tcccagccctagcaagtatata

SEQ ID NO: 22662 - DNA, 22 bp, Artificial Sequence
  chemically synthesized
gcaagtatatataaggtgaaaa

SEQ ID NO: 22663 - DNA, 22 bp, Artificial Sequence
  chemically synthesized
aggctggagcctgggagaaccc

SEQ ID NO: 22664 - DNA, 22 bp, Artificial Sequence
  chemically synthesized
gagcctgggagaaccctggaca

SEQ ID NO: 22665 - DNA, 22 bp, Artificial Sequence
  chemically synthesized
ggagaaccctggacatttaagg

SEQ ID NO: 22666 - DNA, 22 bp, Artificial Sequence
  chemically synthesized
gacatttaagggccatggagag

SEQ ID NO: 22667 - DNA, 22 bp, Artificial Sequence
  chemically synthesized
aagggccatggagaggaacagg

SEQ ID NO: 22668 - DNA, 22 bp, Artificial Sequence
  chemically synthesized
agggccatggagaggaacagga

SEQ ID NO: 22669 - DNA, 22 bp, Artificial Sequence
  chemically synthesized
atcaattcaagtgctggatgga

SEQ ID NO: 22670 - DNA, 22 bp, Artificial Sequence
  chemically synthesized
aagtgctggatggataacagga

SEQ ID NO: 22671 - DNA, 22 bp, Artificial Sequence
  chemically synthesized
gatggataacaggagttagagc

SEQ ID NO: 22672 - DNA, 22 bp, Artificial Sequence
  chemically synthesized
gagcaaagcggggaaccagaat

SEQ ID NO: 22673 - DNA, 22 bp, Artificial Sequence
  chemically synthesized
ttataaaaagagtttcctaaaa

SEQ ID NO: 22674 - DNA, 22 bp, Artificial Sequence
  chemically synthesized
taaaaagagtttcctaaaaagg

SEQ ID NO: 22675 - DNA, 22 bp, Artificial Sequence
  chemically synthesized
cctaaaaagggagagatcaaca

SEQ ID NO: 22676 - DNA, 22 bp, Artificial Sequence
  chemically synthesized
ctaaaaagggagagatcaacaa

SEQ ID NO: 22677 - DNA, 22 bp, Artificial Sequence
  chemically synthesized
aaaagggagagatcaacaatta

SEQ ID NO: 22678 - DNA, 22 bp, Artificial Sequence
  chemically synthesized
gaaattatttagagcagccagt

SEQ ID NO: 22679 - DNA, 22 bp, Artificial Sequence
  chemically synthesized
tttagagcagccagtaaataca

SEQ ID NO: 22680 - DNA, 22 bp, Artificial Sequence
  chemically synthesized
agagcagccagtaaatacataa

SEQ ID NO: 22681 - DNA, 22 bp, Artificial Sequence
  chemically synthesized
gagcagccagtaaatacataaa

SEQ ID NO: 22682 - DNA, 22 bp, Artificial Sequence
  chemically synthesized
aaaattattctttaggtcattc

SEQ ID NO: 22683 - DNA, 22 bp, Artificial Sequence
  chemically synthesized
ttctttaggtcattcctgattg

SEQ ID NO: 22684 - DNA, 22 bp, Artificial Sequence
  chemically synthesized
tttaggtcattcctgattgtga

SEQ ID NO: 22685 - DNA, 22 bp, Artificial Sequence
  chemically synthesized
taggtcattcctgattgtgaca

SEQ ID NO: 22686 - DNA, 22 bp, Artificial Sequence
  chemically synthesized
aggtcattcctgattgtgacaa

SEQ ID NO: 22687 - DNA, 22 bp, Artificial Sequence
  chemically synthesized
ggtcattcctgattgtgacaat

SEQ ID NO: 22688 - DNA, 22 bp, Artificial Sequence
  chemically synthesized
ctgattgtgacaatagtcattt

SEQ ID NO: 22689 - DNA, 22 bp, Artificial Sequence
  chemically synthesized
attgtgacaatagtcatttcat

SEQ ID NO: 22690 - DNA, 22 bp, Artificial Sequence
  chemically synthesized
tgacaatagtcatttcattata

SEQ ID NO: 22691 - DNA, 22 bp, Artificial Sequence
  chemically synthesized
cattatataaatgtgattaagg

SEQ ID NO: 22692 - DNA, 22 bp, Artificial Sequence
  chemically synthesized
attatataaatgtgattaagga

SEQ ID NO: 22693 - DNA, 22 bp, Artificial Sequence
  chemically synthesized
tataaatgtgattaaggaagga

SEQ ID NO: 22694 - DNA, 22 bp, Artificial Sequence
  chemically synthesized
aggaaggaaaagagctacacag

SEQ ID NO: 22695 - DNA, 22 bp, Artificial Sequence
  chemically synthesized
cacagaagttattaaagagcta

SEQ ID NO: 22696 - DNA, 22 bp, Artificial Sequence
  chemically synthesized
ttaaagagctaaagagaattga

SEQ ID NO: 22697 - DNA, 22 bp, Artificial Sequence
  chemically synthesized
aagagctaaagagaattgagaa

SEQ ID NO: 22698 - DNA, 22 bp, Artificial Sequence
  chemically synthesized
aagagaattgagaaatttaaaa

SEQ ID NO: 22699 - DNA, 22 bp, Artificial Sequence
  chemically synthesized
agaaatttaaaacagaagaaag

SEQ ID NO: 22700 - DNA, 22 bp, Artificial Sequence
  chemically synthesized
aaaacagaagaaagtagggcca

SEQ ID NO: 22701 - DNA, 22 bp, Artificial Sequence
  chemically synthesized
aaacagaagaaagtagggccaa

SEQ ID NO: 22702 - DNA, 22 bp, Artificial Sequence
  chemically synthesized
tctcactgatcctgccaacacc

SEQ ID NO: 22703 - DNA, 22 bp, Artificial Sequence
  chemically synthesized
actgatcctgccaacacctgtg

SEQ ID NO: 22704 - DNA, 22 bp, Artificial Sequence
  chemically synthesized
atcctgccaacacctgtgagat

SEQ ID NO: 22705 - DNA, 22 bp, Artificial Sequence
  chemically synthesized
ccaacacctgtgagatagatat

SEQ ID NO: 22706 - DNA, 22 bp, Artificial Sequence
  chemically synthesized
tgagatagatattcttattata

SEQ ID NO: 22707 - DNA, 22 bp, Artificial Sequence
  chemically synthesized
ttattatactactgttaaacct

SEQ ID NO: 22708 - DNA, 22 bp, Artificial Sequence
  chemically synthesized
attatactactgttaaacctaa

SEQ ID NO: 22709 - DNA, 22 bp, Artificial Sequence
  chemically synthesized
ttatactactgttaaacctaat

SEQ ID NO: 22710 - DNA, 22 bp, Artificial Sequence
  chemically synthesized
tactactgttaaacctaattta

SEQ ID NO: 22711 - DNA, 22 bp, Artificial Sequence
  chemically synthesized
ctgttaaacctaatttacattt

SEQ ID NO: 22712 - DNA, 22 bp, Artificial Sequence
  chemically synthesized
ttaaacctaatttacatttgac

SEQ ID NO: 22713 - DNA, 22 bp, Artificial Sequence
  chemically synthesized
aacctaatttacatttgacaaa

SEQ ID NO: 22714 - DNA, 22 bp, Artificial Sequence
  chemically synthesized
atttacatttgacaaagttaag

SEQ ID NO: 22715 - DNA, 22 bp, Artificial Sequence
  chemically synthesized
acatttgacaaagttaaggttc

SEQ ID NO: 22716 - DNA, 22 bp, Artificial Sequence
  chemically synthesized
catttgacaaagttaaggttca

SEQ ID NO: 22717 - DNA, 22 bp, Artificial Sequence
  chemically synthesized
gacaaagttaaggttcagagct

SEQ ID NO: 22718 - DNA, 22 bp, Artificial Sequence
  chemically synthesized
acaaagttaaggttcagagctt

SEQ ID NO: 22719 - DNA, 22 bp, Artificial Sequence
  chemically synthesized
aggttcagagcttgtgtgactt

SEQ ID NO: 22720 - DNA, 22 bp, Artificial Sequence
  chemically synthesized
agagcttgtgtgacttgtccaa

SEQ ID NO: 22721 - DNA, 22 bp, Artificial Sequence
  chemically synthesized
gtgtgacttgtccaaggtcaca

SEQ ID NO: 22722 - DNA, 22 bp, Artificial Sequence
  chemically synthesized
tgtgacttgtccaaggtcacag

SEQ ID NO: 22723 - DNA, 22 bp, Artificial Sequence
  chemically synthesized
gtccaaggtcacaggtctagag

SEQ ID NO: 22724 - DNA, 22 bp, Artificial Sequence
  chemically synthesized
tccaaggtcacaggtctagagg

SEQ ID NO: 22725 - DNA, 22 bp, Artificial Sequence
  chemically synthesized
gaggaggcagatacttgattca

SEQ ID NO: 22726 - DNA, 22 bp, Artificial Sequence
  chemically synthesized
gattcaaacctatttctgtctg

SEQ ID NO: 22727 - DNA, 22 bp, Artificial Sequence
  chemically synthesized
attcaaacctatttctgtctga

SEQ ID NO: 22728 - DNA, 22 bp, Artificial Sequence
  chemically synthesized
aaacctatttctgtctgatctg

SEQ ID NO: 22729 - DNA, 22 bp, Artificial Sequence
  chemically synthesized
tttctgtctgatctgattctaa

SEQ ID NO: 22730 - DNA, 22 bp, Artificial Sequence
  chemically synthesized
ctgtctgatctgattctaaagt

SEQ ID NO: 22731 - DNA, 22 bp, Artificial Sequence
  chemically synthesized
tgtctgatctgattctaaagtc

SEQ ID NO: 22732 - DNA, 22 bp, Artificial Sequence
  chemically synthesized
tctgatctgattctaaagtctg

SEQ ID NO: 22733 - DNA, 22 bp, Artificial Sequence
  chemically synthesized
atctgattctaaagtctgtttt

SEQ ID NO: 22734 - DNA, 22 bp, Artificial Sequence
  chemically synthesized
attctaaagtctgttttttcac

SEQ ID NO: 22735 - DNA, 22 bp, Artificial Sequence
  chemically synthesized
taaagtctgttttttcactcaa

SEQ ID NO: 22736 - DNA, 22 bp, Artificial Sequence
  chemically synthesized
aagtctgttttttcactcaacc

SEQ ID NO: 22737 - DNA, 22 bp, Artificial Sequence
  chemically synthesized
ttttttcactcaaccacactgt

SEQ ID NO: 22738 - DNA, 22 bp, Artificial Sequence
  chemically synthesized
tttcactcaaccacactgtaca

SEQ ID NO: 22739 - DNA, 22 bp, Artificial Sequence
  chemically synthesized
ttcactcaaccacactgtacag

SEQ ID NO: 22740 - DNA, 22 bp, Artificial Sequence
  chemically synthesized
tcactcaaccacactgtacagt

SEQ ID NO: 22741 - DNA, 22 bp, Artificial Sequence
  chemically synthesized
cactcaaccacactgtacagtc

SEQ ID NO: 22742 - DNA, 22 bp, Artificial Sequence
  chemically synthesized
actcaaccacactgtacagtca

SEQ ID NO: 22743 - DNA, 22 bp, Artificial Sequence
  chemically synthesized
aaccacactgtacagtcagctc

SEQ ID NO: 22744 - DNA, 22 bp, Artificial Sequence
  chemically synthesized
tacagtcagctctccttgtgag

SEQ ID NO: 22745 - DNA, 22 bp, Artificial Sequence
  chemically synthesized
tccttgtgagttccacagccac

SEQ ID NO: 22746 - DNA, 22 bp, Artificial Sequence
  chemically synthesized
cttgtgagttccacagccacag

SEQ ID NO: 22747 - DNA, 22 bp, Artificial Sequence
  chemically synthesized
gtgagttccacagccacagatt

SEQ ID NO: 22748 - DNA, 22 bp, Artificial Sequence
  chemically synthesized
tgagttccacagccacagattc

SEQ ID NO: 22749 - DNA, 22 bp, Artificial Sequence
  chemically synthesized
cacagccacagattcaattaac

SEQ ID NO: 22750 - DNA, 22 bp, Artificial Sequence
  chemically synthesized
aattaactgcagatcaaaaata

SEQ ID NO: 22751 - DNA, 22 bp, Artificial Sequence
  chemically synthesized
actgcagatcaaaaatattcaa

SEQ ID NO: 22752 - DNA, 22 bp, Artificial Sequence
  chemically synthesized
cagatcaaaaatattcaagaaa

SEQ ID NO: 22753 - DNA, 22 bp, Artificial Sequence
  chemically synthesized
aagaaaaaaatggatggttgca

SEQ ID NO: 22754 - DNA, 22 bp, Artificial Sequence
  chemically synthesized
catctctactgaacatgtacag

SEQ ID NO: 22755 - DNA, 22 bp, Artificial Sequence
  chemically synthesized
tactgaacatgtacagactctt

SEQ ID NO: 22756 - DNA, 22 bp, Artificial Sequence
  chemically synthesized
ctgaacatgtacagactctttt

SEQ ID NO: 22757 - DNA, 22 bp, Artificial Sequence
  chemically synthesized
aacatgtacagactcttttatc

SEQ ID NO: 22758 - DNA, 22 bp, Artificial Sequence
  chemically synthesized
ttttatctttcattattcccta

SEQ ID NO: 22759 - DNA, 22 bp, Artificial Sequence
  chemically synthesized
ttatctttcattattccctaaa

SEQ ID NO: 22760 - DNA, 22 bp, Artificial Sequence
  chemically synthesized
tatctttcattattccctaaac

SEQ ID NO: 22761 - DNA, 22 bp, Artificial Sequence
  chemically synthesized
atctttcattattccctaaaca

SEQ ID NO: 22762 - DNA, 22 bp, Artificial Sequence
  chemically synthesized
tctttcattattccctaaacaa

SEQ ID NO: 22763 - DNA, 22 bp, Artificial Sequence
  chemically synthesized
tcattattccctaaacaataca

SEQ ID NO: 22764 - DNA, 22 bp, Artificial Sequence
  chemically synthesized
cattattccctaaacaatacag

SEQ ID NO: 22765 - DNA, 22 bp, Artificial Sequence
  chemically synthesized
attattccctaaacaatacagc

SEQ ID NO: 22766 - DNA, 22 bp, Artificial Sequence
  chemically synthesized
ttccctaaacaatacagcataa

SEQ ID NO: 22767 - DNA, 22 bp, Artificial Sequence
  chemically synthesized
cctaaacaatacagcataacaa

SEQ ID NO: 22768 - DNA, 22 bp, Artificial Sequence
  chemically synthesized
aacaatacagcataacaactat

SEQ ID NO: 22769 - DNA, 22 bp, Artificial Sequence
  chemically synthesized
tttacatagcatttacattgta

SEQ ID NO: 22770 - DNA, 22 bp, Artificial Sequence
  chemically synthesized
acatagcatttacattgtatta

SEQ ID NO: 22771 - DNA, 22 bp, Artificial Sequence
  chemically synthesized
catagcatttacattgtattag

SEQ ID NO: 22772 - DNA, 22 bp, Artificial Sequence
  chemically synthesized
acattgtattagctattaagag

SEQ ID NO: 22773 - DNA, 22 bp, Artificial Sequence
  chemically synthesized
cattgtattagctattaagaga

SEQ ID NO: 22774 - DNA, 22 bp, Artificial Sequence
  chemically synthesized
tattagctattaagagaaacct

SEQ ID NO: 22775 - DNA, 22 bp, Artificial Sequence
  chemically synthesized
gctattaagagaaacctagaga

SEQ ID NO: 22776 - DNA, 22 bp, Artificial Sequence
  chemically synthesized
ttaagagaaacctagagatgat

SEQ ID NO: 22777 - DNA, 22 bp, Artificial Sequence
  chemically synthesized
agagaaacctagagatgattta

SEQ ID NO: 22778 - DNA, 22 bp, Artificial Sequence
  chemically synthesized
gagatgatttaaagtacaaagg

SEQ ID NO: 22779 - DNA, 22 bp, Artificial Sequence
  chemically synthesized
aaagtacaaaggaggatgtgtt

SEQ ID NO: 22780 - DNA, 22 bp, Artificial Sequence
  chemically synthesized
aagtacaaaggaggatgtgttt

SEQ ID NO: 22781 - DNA, 22 bp, Artificial Sequence
  chemically synthesized
aggttatatgcaaatagtaagc

SEQ ID NO: 22782 - DNA, 22 bp, Artificial Sequence
  chemically synthesized
ggttatatgcaaatagtaagcc

SEQ ID NO: 22783 - DNA, 22 bp, Artificial Sequence
  chemically synthesized
tatgcaaatagtaagccatttt

SEQ ID NO: 22784 - DNA, 22 bp, Artificial Sequence
  chemically synthesized
ttatatcggagacttgagcatc

SEQ ID NO: 22785 - DNA, 22 bp, Artificial Sequence
  chemically synthesized
tatatcggagacttgagcatcc

SEQ ID NO: 22786 - DNA, 22 bp, Artificial Sequence
  chemically synthesized
atatcggagacttgagcatcca

SEQ ID NO: 22787 - DNA, 22 bp, Artificial Sequence
  chemically synthesized
tatcggagacttgagcatccac

SEQ ID NO: 22788 - DNA, 22 bp, Artificial Sequence
  chemically synthesized
gagcatccacagatcttgatat

SEQ ID NO: 22789 - DNA, 22 bp, Artificial Sequence
  chemically synthesized
agcatccacagatcttgatatt

SEQ ID NO: 22790 - DNA, 22 bp, Artificial Sequence
  chemically synthesized
gatatttgcagggggtcttgcc

SEQ ID NO: 22791 - DNA, 22 bp, Artificial Sequence
  chemically synthesized
atatttgcagggggtcttgcca

SEQ ID NO: 22792 - DNA, 22 bp, Artificial Sequence
  chemically synthesized
gcagggggtcttgccaccaatt

SEQ ID NO: 22793 - DNA, 22 bp, Artificial Sequence
  chemically synthesized
cagggggtcttgccaccaattt

SEQ ID NO: 22794 - DNA, 22 bp, Artificial Sequence
  chemically synthesized
gccaccaattttccatggatac

SEQ ID NO: 22795 - DNA, 22 bp, Artificial Sequence
  chemically synthesized
ccaccaattttccatggatact

SEQ ID NO: 22796 - DNA, 22 bp, Artificial Sequence
  chemically synthesized
tccatggatactgaggaacgac

SEQ ID NO: 22797 - DNA, 22 bp, Artificial Sequence
  chemically synthesized
ccatggatactgaggaacgact

SEQ ID NO: 22798 - DNA, 22 bp, Artificial Sequence
  chemically synthesized
catggatactgaggaacgactg

SEQ ID NO: 22799 - DNA, 22 bp, Artificial Sequence
  chemically synthesized
aggaacgactgtaaatggatgc

SEQ ID NO: 22800 - DNA, 22 bp, Artificial Sequence
  chemically synthesized
taaatggatgcaggcatggatg

SEQ ID NO: 22801 - DNA, 22 bp, Artificial Sequence
  chemically synthesized
tttaggagtgtccagggccaag

SEQ ID NO: 22802 - DNA, 22 bp, Artificial Sequence
  chemically synthesized
aggagtgtccagggccaagtaa

SEQ ID NO: 22803 - DNA, 22 bp, Artificial Sequence
  chemically synthesized
ggagtgtccagggccaagtaaa

SEQ ID NO: 22804 - DNA, 22 bp, Artificial Sequence
  chemically synthesized
ctgagcagagaggtgggtggag

SEQ ID NO: 22805 - DNA, 22 bp, Artificial Sequence
  chemically synthesized
agcagagaggtgggtggaggct

SEQ ID NO: 22806 - DNA, 22 bp, Artificial Sequence
  chemically synthesized
tgaggcatcaatatgtggtggc

SEQ ID NO: 22807 - DNA, 22 bp, Artificial Sequence
  chemically synthesized
cattttggtgatttttttcctt

SEQ ID NO: 22808 - DNA, 22 bp, Artificial Sequence
  chemically synthesized
tggtgatttttttccttcacag

SEQ ID NO: 22809 - DNA, 22 bp, Artificial Sequence
  chemically synthesized
ggtgatttttttccttcacagt

SEQ ID NO: 22810 - DNA, 22 bp, Artificial Sequence
  chemically synthesized
gtgatttttttccttcacagtc

SEQ ID NO: 22811 - DNA, 22 bp, Artificial Sequence
  chemically synthesized
ttttccttcacagtcctcggct

SEQ ID NO: 22812 - DNA, 22 bp, Artificial Sequence
  chemically synthesized
tttccttcacagtcctcggctg

SEQ ID NO: 22813 - DNA, 22 bp, Artificial Sequence
  chemically synthesized
ttccttcacagtcctcggctgt

SEQ ID NO: 22814 - DNA, 22 bp, Artificial Sequence
  chemically synthesized
tccttcacagtcctcggctgtc

SEQ ID NO: 22815 - DNA, 22 bp, Artificial Sequence
  chemically synthesized
ccttcacagtcctcggctgtct

SEQ ID NO: 22816 - DNA, 22 bp, Artificial Sequence
  chemically synthesized
cttcacagtcctcggctgtctg

SEQ ID NO: 22817 - DNA, 22 bp, Artificial Sequence
  chemically synthesized
cacagtcctcggctgtctggga

SEQ ID NO: 22818 - DNA, 22 bp, Artificial Sequence
  chemically synthesized
acagtcctcggctgtctgggaa

SEQ ID NO: 22819 - DNA, 22 bp, Artificial Sequence
  chemically synthesized
ggctgtctgggaagagaaggat

SEQ ID NO: 22820 - DNA, 22 bp, Artificial Sequence
  chemically synthesized
tctgggaagagaaggatgaagg

SEQ ID NO: 22821 - DNA, 22 bp, Artificial Sequence
  chemically synthesized
ggaagagaaggatgaaggcaga

SEQ ID NO: 22822 - DNA, 22 bp, Artificial Sequence
  chemically synthesized
ctccaatttaggggctaggatt

SEQ ID NO: 22823 - DNA, 22 bp, Artificial Sequence
  chemically synthesized
caatttaggggctaggattgca

SEQ ID NO: 22824 - DNA, 22 bp, Artificial Sequence
  chemically synthesized
aggggctaggattgcagggtgg

SEQ ID NO: 22825 - DNA, 22 bp, Artificial Sequence
  chemically synthesized
ggggctaggattgcagggtggg

SEQ ID NO: 22826 - DNA, 22 bp, Artificial Sequence
  chemically synthesized
ggattgcagggtgggcacagca

SEQ ID NO: 22827 - DNA, 22 bp, Artificial Sequence
  chemically synthesized
cagggtgggcacagcattgcaa

SEQ ID NO: 22828 - DNA, 22 bp, Artificial Sequence
  chemically synthesized
caaacgagtgaaggaaattgag

SEQ ID NO: 22829 - DNA, 22 bp, Artificial Sequence
  chemically synthesized
agaaatatggccaatgaagagt

SEQ ID NO: 22830 - DNA, 22 bp, Artificial Sequence
  chemically synthesized
aagagaggcctggcatggtggc

SEQ ID NO: 22831 - DNA, 22 bp, Artificial Sequence
  chemically synthesized
gcatggtggctcacacctataa

SEQ ID NO: 22832 - DNA, 22 bp, Artificial Sequence
  chemically synthesized
acacctataatcccagcacttt

SEQ ID NO: 22833 - DNA, 22 bp, Artificial Sequence
  chemically synthesized
taatcccagcactttcagaggc

SEQ ID NO: 22834 - DNA, 22 bp, Artificial Sequence
  chemically synthesized
tcagaggcccaggcaggcagat

SEQ ID NO: 22835 - DNA, 22 bp, Artificial Sequence
  chemically synthesized
cagaggcccaggcaggcagatc

SEQ ID NO: 22836 - DNA, 22 bp, Artificial Sequence
  chemically synthesized
agaggcccaggcaggcagatca

SEQ ID NO: 22837 - DNA, 22 bp, Artificial Sequence
  chemically synthesized
gaggtcaggagttcgacaccag

SEQ ID NO: 22838 - DNA, 22 bp, Artificial Sequence
  chemically synthesized
aggtcaggagttcgacaccagc

SEQ ID NO: 22839 - DNA, 22 bp, Artificial Sequence
  chemically synthesized
gacaccagcctggccaacaagg

SEQ ID NO: 22840 - DNA, 22 bp, Artificial Sequence
  chemically synthesized
gccaacaaggtgaaatggtgaa

SEQ ID NO: 22841 - DNA, 22 bp, Artificial Sequence
  chemically synthesized
tactaaaaatacaaaaattagc

SEQ ID NO: 22842 - DNA, 22 bp, Artificial Sequence
  chemically synthesized
actaaaaatacaaaaattagct

SEQ ID NO: 22843 - DNA, 22 bp, Artificial Sequence
  chemically synthesized
ctaaaaatacaaaaattagctg

SEQ ID NO: 22844 - DNA, 22 bp, Artificial Sequence
  chemically synthesized
aaaatacaaaaattagctgggc

SEQ ID NO: 22845 - DNA, 22 bp, Artificial Sequence
  chemically synthesized
gctgggcatggtggcgggtgcc

SEQ ID NO: 22846 - DNA, 22 bp, Artificial Sequence
  chemically synthesized
ggcatggtggcgggtgcctgta

SEQ ID NO: 22847 - DNA, 22 bp, Artificial Sequence
  chemically synthesized
taatcccagctacttgggaggc

SEQ ID NO: 22848 - DNA, 22 bp, Artificial Sequence
  chemically synthesized
cttgggaggctgaggcaggaga

SEQ ID NO: 22849 - DNA, 22 bp, Artificial Sequence
  chemically synthesized
gggaggctgaggcaggagaata

SEQ ID NO: 22850 - DNA, 22 bp, Artificial Sequence
  chemically synthesized
ggaggctgaggcaggagaatag

SEQ ID NO: 22851 - DNA, 22 bp, Artificial Sequence
  chemically synthesized
aggcaggagaatagcttgaacc

SEQ ID NO: 22852 - DNA, 22 bp, Artificial Sequence
  chemically synthesized
gaacctgggagatggaggttgc

SEQ ID NO: 22853 - DNA, 22 bp, Artificial Sequence
  chemically synthesized
aacctgggagatggaggttgca

SEQ ID NO: 22854 - DNA, 22 bp, Artificial Sequence
  chemically synthesized
ggagatggaggttgcagtgagc

SEQ ID NO: 22855 - DNA, 22 bp, Artificial Sequence
  chemically synthesized
cagtgagctgagatcgcaccac

SEQ ID NO: 22856 - DNA, 22 bp, Artificial Sequence
  chemically synthesized
agatcgcaccactgcactccag

SEQ ID NO: 22857 - DNA, 22 bp, Artificial Sequence
  chemically synthesized
cactccagcctgggcgacagag

SEQ ID NO: 22858 - DNA, 22 bp, Artificial Sequence
  chemically synthesized
cagcctgggcgacagagcaaga

SEQ ID NO: 22859 - DNA, 22 bp, Artificial Sequence
  chemically synthesized
ggcgacagagcaagactctgtc

SEQ ID NO: 22860 - DNA, 22 bp, Artificial Sequence
  chemically synthesized
tgtcaaaaaaaaaagagttgaa

SEQ ID NO: 22861 - DNA, 22 bp, Artificial Sequence
  chemically synthesized
tcaaaaaaaaaagagttgaaga

SEQ ID NO: 22862 - DNA, 22 bp, Artificial Sequence
  chemically synthesized
aagagaaaaagtctaggctaaa

SEQ ID NO: 22863 - DNA, 22 bp, Artificial Sequence
  chemically synthesized
ggctaaattcaaagaaaaaaag

SEQ ID NO: 22864 - DNA, 22 bp, Artificial Sequence
  chemically synthesized
aattcaaagaaaaaaagtgagc

SEQ ID NO: 22865 - DNA, 22 bp, Artificial Sequence
  chemically synthesized
aaagaaaaaaagtgagcccaaa

SEQ ID NO: 22866 - DNA, 22 bp, Artificial Sequence
  chemically synthesized
gcagagcaagggaaaagcaggg

SEQ ID NO: 22867 - DNA, 22 bp, Artificial Sequence
  chemically synthesized
cagagcaagggaaaagcaggga

SEQ ID NO: 22868 - DNA, 22 bp, Artificial Sequence
  chemically synthesized
gaacactccataaagtgaacag

SEQ ID NO: 22869 - DNA, 22 bp, Artificial Sequence
  chemically synthesized
cataaagtgaacagctgcaatg

SEQ ID NO: 22870 - DNA, 22 bp, Artificial Sequence
  chemically synthesized
caatgaaaataagggaagaaag

SEQ ID NO: 22871 - DNA, 22 bp, Artificial Sequence
  chemically synthesized
agttcatctccgtttctttcct

SEQ ID NO: 22872 - DNA, 22 bp, Artificial Sequence
  chemically synthesized
gttcatctccgtttctttcctt

SEQ ID NO: 22873 - DNA, 22 bp, Artificial Sequence
  chemically synthesized
atctccgtttctttcctttcct

SEQ ID NO: 22874 - DNA, 22 bp, Artificial Sequence
  chemically synthesized
cgtttctttcctttccttttta

SEQ ID NO: 22875 - DNA, 22 bp, Artificial Sequence
  chemically synthesized
ctttcctttcctttttactttc

SEQ ID NO: 22876 - DNA, 22 bp, Artificial Sequence
  chemically synthesized
tttcctttcctttttactttcc

SEQ ID NO: 22877 - DNA, 22 bp, Artificial Sequence
  chemically synthesized
tcctttcctttttactttcctt

SEQ ID NO: 22878 - DNA, 22 bp, Artificial Sequence
  chemically synthesized
cctttcctttttactttccttt

SEQ ID NO: 22879 - DNA, 22 bp, Artificial Sequence
  chemically synthesized
ctttcctttttactttcctttc

SEQ ID NO: 22880 - DNA, 22 bp, Artificial Sequence
  chemically synthesized
tcctttttactttcctttctct

SEQ ID NO: 22881 - DNA, 22 bp, Artificial Sequence
  chemically synthesized
cctttttactttcctttctctt

SEQ ID NO: 22882 - DNA, 22 bp, Artificial Sequence
  chemically synthesized
ctttttactttcctttctcttc

SEQ ID NO: 22883 - DNA, 22 bp, Artificial Sequence
  chemically synthesized
tttactttcctttctcttcctt

SEQ ID NO: 22884 - DNA, 22 bp, Artificial Sequence
  chemically synthesized
ttactttcctttctcttccttt

SEQ ID NO: 22885 - DNA, 22 bp, Artificial Sequence
  chemically synthesized
tactttcctttctcttcctttt

SEQ ID NO: 22886 - DNA, 22 bp, Artificial Sequence
  chemically synthesized
actttcctttctcttccttttt

SEQ ID NO: 22887 - DNA, 22 bp, Artificial Sequence
  chemically synthesized
ctttcctttctcttcctttttg

SEQ ID NO: 22888 - DNA, 22 bp, Artificial Sequence
  chemically synthesized
tcctttctcttcctttttggag

SEQ ID NO: 22889 - DNA, 22 bp, Artificial Sequence
  chemically synthesized
cctttctcttcctttttggagt

SEQ ID NO: 22890 - DNA, 22 bp, Artificial Sequence
  chemically synthesized
ctttctcttcctttttggagtt

SEQ ID NO: 22891 - DNA, 22 bp, Artificial Sequence
  chemically synthesized
tctcttcctttttggagttaat

SEQ ID NO: 22892 - DNA, 22 bp, Artificial Sequence
  chemically synthesized
ctcttcctttttggagttaatc

SEQ ID NO: 22893 - DNA, 22 bp, Artificial Sequence
  chemically synthesized
tcttcctttttggagttaatca

SEQ ID NO: 22894 - DNA, 22 bp, Artificial Sequence
  chemically synthesized
ttcctttttggagttaatcagg

SEQ ID NO: 22895 - DNA, 22 bp, Artificial Sequence
  chemically synthesized
cctttttggagttaatcaggaa

SEQ ID NO: 22896 - DNA, 22 bp, Artificial Sequence
  chemically synthesized
ctttttggagttaatcaggaag

SEQ ID NO: 22897 - DNA, 22 bp, Artificial Sequence
  chemically synthesized
tttggagttaatcaggaagtag

SEQ ID NO: 22898 - DNA, 22 bp, Artificial Sequence
  chemically synthesized
ttggagttaatcaggaagtagt

SEQ ID NO: 22899 - DNA, 22 bp, Artificial Sequence
  chemically synthesized
tggagttaatcaggaagtagtc

SEQ ID NO: 22900 - DNA, 22 bp, Artificial Sequence
  chemically synthesized
ggagttaatcaggaagtagtcc

SEQ ID NO: 22901 - DNA, 22 bp, Artificial Sequence
  chemically synthesized
gagttaatcaggaagtagtccc

SEQ ID NO: 22902 - DNA, 22 bp, Artificial Sequence
  chemically synthesized
atcaggaagtagtcccaaatac

SEQ ID NO: 22903 - DNA, 22 bp, Artificial Sequence
  chemically synthesized
atcttataagcccttggtcctc

SEQ ID NO: 22904 - DNA, 22 bp, Artificial Sequence
  chemically synthesized
ataagcccttggtcctcttgag

SEQ ID NO: 22905 - DNA, 22 bp, Artificial Sequence
  chemically synthesized
taagcccttggtcctcttgaga

SEQ ID NO: 22906 - DNA, 22 bp, Artificial Sequence
  chemically synthesized
ggtcctcttgagatggtatcag

SEQ ID NO: 22907 - DNA, 22 bp, Artificial Sequence
  chemically synthesized
gtcctcttgagatggtatcaga

SEQ ID NO: 22908 - DNA, 22 bp, Artificial Sequence
  chemically synthesized
ttgagatggtatcagatatatt

SEQ ID NO: 22909 - DNA, 22 bp, Artificial Sequence
  chemically synthesized
gagatggtatcagatatattgc

SEQ ID NO: 22910 - DNA, 22 bp, Artificial Sequence
  chemically synthesized
agatggtatcagatatattgct

SEQ ID NO: 22911 - DNA, 22 bp, Artificial Sequence
  chemically synthesized
ctagacccttgaagaaaggaac

SEQ ID NO: 22912 - DNA, 22 bp, Artificial Sequence
  chemically synthesized
gacccttgaagaaaggaacaac

SEQ ID NO: 22913 - DNA, 22 bp, Artificial Sequence
  chemically synthesized
gaagaaaggaacaactccaggc

SEQ ID NO: 22914 - DNA, 22 bp, Artificial Sequence
  chemically synthesized
aagaaaggaacaactccaggca

SEQ ID NO: 22915 - DNA, 22 bp, Artificial Sequence
  chemically synthesized
caggcaacttcttgagtccctg

SEQ ID NO: 22916 - DNA, 22 bp, Artificial Sequence
  chemically synthesized
cttgagtccctgttattaattt

SEQ ID NO: 22917 - DNA, 22 bp, Artificial Sequence
  chemically synthesized
ttgagtccctgttattaatttt

SEQ ID NO: 22918 - DNA, 22 bp, Artificial Sequence
  chemically synthesized
gagtccctgttattaattttat

SEQ ID NO: 22919 - DNA, 22 bp, Artificial Sequence
  chemically synthesized
agtccctgttattaattttata

SEQ ID NO: 22920 - DNA, 22 bp, Artificial Sequence
  chemically synthesized
ttattaattttatacatacaca

SEQ ID NO: 22921 - DNA, 22 bp, Artificial Sequence
  chemically synthesized
ttaattttatacatacacacac

SEQ ID NO: 22922 - DNA, 22 bp, Artificial Sequence
  chemically synthesized
attttatacatacacacacata

SEQ ID NO: 22923 - DNA, 22 bp, Artificial Sequence
  chemically synthesized
tatacatacacacacatatatg

SEQ ID NO: 22924 - DNA, 22 bp, Artificial Sequence
  chemically synthesized
atacatacacacacatatatgt

SEQ ID NO: 22925 - DNA, 22 bp, Artificial Sequence
  chemically synthesized
tacatacacacacatatatgta

SEQ ID NO: 22926 - DNA, 22 bp, Artificial Sequence
  chemically synthesized
cttaacaatggggatatattct

SEQ ID NO: 22927 - DNA, 22 bp, Artificial Sequence
  chemically synthesized
aacaatggggatatattctgag

SEQ ID NO: 22928 - DNA, 22 bp, Artificial Sequence
  chemically synthesized
acaatggggatatattctgaga

SEQ ID NO: 22929 - DNA, 22 bp, Artificial Sequence
  chemically synthesized
tgagaaatgtgtcattaagcaa

SEQ ID NO: 22930 - DNA, 22 bp, Artificial Sequence
  chemically synthesized
agaaatgtgtcattaagcaatt

SEQ ID NO: 22931 - DNA, 22 bp, Artificial Sequence
  chemically synthesized
agcaatttcatcattgtgcgaa

SEQ ID NO: 22932 - DNA, 22 bp, Artificial Sequence
  chemically synthesized
catcattgtgcgaacataatag

SEQ ID NO: 22933 - DNA, 22 bp, Artificial Sequence
  chemically synthesized
atcattgtgcgaacataataga

SEQ ID NO: 22934 - DNA, 22 bp, Artificial Sequence
  chemically synthesized
tgcgaacataatagagtgtact

SEQ ID NO: 22935 - DNA, 22 bp, Artificial Sequence
  chemically synthesized
acctaaacctaaatggtatagc

SEQ ID NO: 22936 - DNA, 22 bp, Artificial Sequence
  chemically synthesized
cctaaacctaaatggtatagct

SEQ ID NO: 22937 - DNA, 22 bp, Artificial Sequence
  chemically synthesized
aacctaaatggtatagcttact

SEQ ID NO: 22938 - DNA, 22 bp, Artificial Sequence
  chemically synthesized
aatggtatagcttactacatac

SEQ ID NO: 22939 - DNA, 22 bp, Artificial Sequence
  chemically synthesized
actacatacctaggttgtattg

SEQ ID NO: 22940 - DNA, 22 bp, Artificial Sequence
  chemically synthesized
ctacatacctaggttgtattga

SEQ ID NO: 22941 - DNA, 22 bp, Artificial Sequence
  chemically synthesized
catacctaggttgtattgatgt

SEQ ID NO: 22942 - DNA, 22 bp, Artificial Sequence
  chemically synthesized
ggttgtattgatgtggcctatt

SEQ ID NO: 22943 - DNA, 22 bp, Artificial Sequence
  chemically synthesized
tattgatgtggcctattgctcc

SEQ ID NO: 22944 - DNA, 22 bp, Artificial Sequence
  chemically synthesized
atgtggcctattgctcctaggc

SEQ ID NO: 22945 - DNA, 22 bp, Artificial Sequence
  chemically synthesized
ttgctcctaggctcctgggctg

SEQ ID NO: 22946 - DNA, 22 bp, Artificial Sequence
  chemically synthesized
ctcctaggctcctgggctgcaa

SEQ ID NO: 22947 - DNA, 22 bp, Artificial Sequence
  chemically synthesized
ctaggctcctgggctgcaaacc

SEQ ID NO: 22948 - DNA, 22 bp, Artificial Sequence
  chemically synthesized
ggctcctgggctgcaaacctgt

SEQ ID NO: 22949 - DNA, 22 bp, Artificial Sequence
  chemically synthesized
ctgggctgcaaacctgtacagc

SEQ ID NO: 22950 - DNA, 22 bp, Artificial Sequence
  chemically synthesized
ggctgcaaacctgtacagcatg

SEQ ID NO: 22951 - DNA, 22 bp, Artificial Sequence
  chemically synthesized
caaacctgtacagcatgtgact

SEQ ID NO: 22952 - DNA, 22 bp, Artificial Sequence
  chemically synthesized
tacagcatgtgactgtactgaa

SEQ ID NO: 22953 - DNA, 22 bp, Artificial Sequence
  chemically synthesized
tactgaacactgtaggcaatgg

SEQ ID NO: 22954 - DNA, 22 bp, Artificial Sequence
  chemically synthesized
aacactgtaggcaatggtaaca

SEQ ID NO: 22955 - DNA, 22 bp, Artificial Sequence
  chemically synthesized
taggcaatggtaacagtggtat

SEQ ID NO: 22956 - DNA, 22 bp, Artificial Sequence
  chemically synthesized
gtgtatctaaacatagaaaagg

SEQ ID NO: 22957 - DNA, 22 bp, Artificial Sequence
  chemically synthesized
tgtatctaaacatagaaaaggt

SEQ ID NO: 22958 - DNA, 22 bp, Artificial Sequence
  chemically synthesized
aacatagaaaaggtacagtgaa

SEQ ID NO: 22959 - DNA, 22 bp, Artificial Sequence
  chemically synthesized
taaccttatgggaccactgtcg

SEQ ID NO: 22960 - DNA, 22 bp, Artificial Sequence
  chemically synthesized
atgggaccactgtcgtataatg

SEQ ID NO: 22961 - DNA, 22 bp, Artificial Sequence
  chemically synthesized
tgggaccactgtcgtataatgt

SEQ ID NO: 22962 - DNA, 22 bp, Artificial Sequence
  chemically synthesized
tcgtataatgtggtccatcatt

SEQ ID NO: 22963 - DNA, 22 bp, Artificial Sequence
  chemically synthesized
accaaaatgtcattgtgcagca

SEQ ID NO: 22964 - DNA, 22 bp, Artificial Sequence
  chemically synthesized
tgcagcaaatgattatctcata

SEQ ID NO: 22965 - DNA, 22 bp, Artificial Sequence
  chemically synthesized
tctcatatatatatatatatga

SEQ ID NO: 22966 - DNA, 22 bp, Artificial Sequence
  chemically synthesized
atatatatatatatatgatatg

SEQ ID NO: 22967 - DNA, 22 bp, Artificial Sequence
  chemically synthesized
agatagagacatctatcctcca

SEQ ID NO: 22968 - DNA, 22 bp, Artificial Sequence
  chemically synthesized
tcctccagagttcaggagtgtc

SEQ ID NO: 22969 - DNA, 22 bp, Artificial Sequence
  chemically synthesized
cagagttcaggagtgtctcttc

SEQ ID NO: 22970 - DNA, 22 bp, Artificial Sequence
  chemically synthesized
aggagtgtctcttcagactagg

SEQ ID NO: 22971 - DNA, 22 bp, Artificial Sequence
  chemically synthesized
ttcagactaggtagatgtagct

SEQ ID NO: 22972 - DNA, 22 bp, Artificial Sequence
  chemically synthesized
cagactaggtagatgtagctta

SEQ ID NO: 22973 - DNA, 22 bp, Artificial Sequence
  chemically synthesized
agactaggtagatgtagcttaa

SEQ ID NO: 22974 - DNA, 22 bp, Artificial Sequence
  chemically synthesized
ggtagatgtagcttaaaaaaaa

SEQ ID NO: 22975 - DNA, 22 bp, Artificial Sequence
  chemically synthesized
aaaaaaaacatatcctgaattc

SEQ ID NO: 22976 - DNA, 22 bp, Artificial Sequence
  chemically synthesized
aaaaaaacatatcctgaattct

SEQ ID NO: 22977 - DNA, 22 bp, Artificial Sequence
  chemically synthesized
aattctagagagatgcttaaat

SEQ ID NO: 22978 - DNA, 22 bp, Artificial Sequence
  chemically synthesized
tagagagatgcttaaatcactg

SEQ ID NO: 22979 - DNA, 22 bp, Artificial Sequence
  chemically synthesized
gagagatgcttaaatcactgca

SEQ ID NO: 22980 - DNA, 22 bp, Artificial Sequence
  chemically synthesized
aaatcactgcaattcctataac

SEQ ID NO: 22981 - DNA, 22 bp, Artificial Sequence
  chemically synthesized
aatcactgcaattcctataaca

SEQ ID NO: 22982 - DNA, 22 bp, Artificial Sequence
  chemically synthesized
caattcctataacacttgccaa

SEQ ID NO: 22983 - DNA, 22 bp, Artificial Sequence
  chemically synthesized
ctataacacttgccaaccaaag

SEQ ID NO: 22984 - DNA, 22 bp, Artificial Sequence
  chemically synthesized
taacacttgccaaccaaaggtg

SEQ ID NO: 22985 - DNA, 22 bp, Artificial Sequence
  chemically synthesized
gccaaccaaaggtgctgttgat

SEQ ID NO: 22986 - DNA, 22 bp, Artificial Sequence
  chemically synthesized
ccaaccaaaggtgctgttgatc

SEQ ID NO: 22987 - DNA, 22 bp, Artificial Sequence
  chemically synthesized
ttgatctgaaattgctttttta

SEQ ID NO: 22988 - DNA, 22 bp, Artificial Sequence
  chemically synthesized
atctgaaattgcttttttaaat

SEQ ID NO: 22989 - DNA, 22 bp, Artificial Sequence
  chemically synthesized
aaattgcttttttaaattaatg

SEQ ID NO: 22990 - DNA, 22 bp, Artificial Sequence
  chemically synthesized
cttttttaaattaatgcagtga

SEQ ID NO: 22991 - DNA, 22 bp, Artificial Sequence
  chemically synthesized
ttttaaattaatgcagtgattt

SEQ ID NO: 22992 - DNA, 22 bp, Artificial Sequence
  chemically synthesized
tttaaattaatgcagtgatttt

SEQ ID NO: 22993 - DNA, 22 bp, Artificial Sequence
  chemically synthesized
ttaaattaatgcagtgattttt

SEQ ID NO: 22994 - DNA, 22 bp, Artificial Sequence
  chemically synthesized
taaattaatgcagtgatttttc

SEQ ID NO: 22995 - DNA, 22 bp, Artificial Sequence
  chemically synthesized
aaattaatgcagtgatttttct

SEQ ID NO: 22996 - DNA, 22 bp, Artificial Sequence
  chemically synthesized
aattaatgcagtgatttttctt

SEQ ID NO: 22997 - DNA, 22 bp, Artificial Sequence
  chemically synthesized
atgcagtgatttttctttaaca

SEQ ID NO: 22998 - DNA, 22 bp, Artificial Sequence
  chemically synthesized
ttctttaacatctagtgacaga

SEQ ID NO: 22999 - DNA, 22 bp, Artificial Sequence
  chemically synthesized
tctttaacatctagtgacagac

SEQ ID NO: 23000 - DNA, 22 bp, Artificial Sequence
  chemically synthesized
ctttaacatctagtgacagaca

SEQ ID NO: 23001 - DNA, 22 bp, Artificial Sequence
  chemically synthesized
tttaacatctagtgacagacac

SEQ ID NO: 23002 - DNA, 22 bp, Artificial Sequence
  chemically synthesized
taacatctagtgacagacactg

SEQ ID NO: 23003 - DNA, 22 bp, Artificial Sequence
  chemically synthesized
aacatctagtgacagacactgg

SEQ ID NO: 23004 - DNA, 22 bp, Artificial Sequence
  chemically synthesized
acatctagtgacagacactggg

SEQ ID NO: 23005 - DNA, 22 bp, Artificial Sequence
  chemically synthesized
gtgacagacactggggtcacat

SEQ ID NO: 23006 - DNA, 22 bp, Artificial Sequence
  chemically synthesized
gggtcacatttgcagctggacc

SEQ ID NO: 23007 - DNA, 22 bp, Artificial Sequence
  chemically synthesized
gcagctggaccataattaggct

SEQ ID NO: 23008 - DNA, 22 bp, Artificial Sequence
  chemically synthesized
cagctggaccataattaggctt

SEQ ID NO: 23009 - DNA, 22 bp, Artificial Sequence
  chemically synthesized
gaccataattaggcttctgttc

SEQ ID NO: 23010 - DNA, 22 bp, Artificial Sequence
  chemically synthesized
ggcttctgttcttcaggagaca

SEQ ID NO: 23011 - DNA, 22 bp, Artificial Sequence
  chemically synthesized
ctgttcttcaggagacatttgt

SEQ ID NO: 23012 - DNA, 22 bp, Artificial Sequence
  chemically synthesized
tgttcttcaggagacatttgtt

SEQ ID NO: 23013 - DNA, 22 bp, Artificial Sequence
  chemically synthesized
ttcttcaggagacatttgttca

SEQ ID NO: 23014 - DNA, 22 bp, Artificial Sequence
  chemically synthesized
ttcaggagacatttgttcaaag

SEQ ID NO: 23015 - DNA, 22 bp, Artificial Sequence
  chemically synthesized
caggagacatttgttcaaagtc

SEQ ID NO: 23016 - DNA, 22 bp, Artificial Sequence
  chemically synthesized
aggagacatttgttcaaagtca

SEQ ID NO: 23017 - DNA, 22 bp, Artificial Sequence
  chemically synthesized
gttcaaagtcatttgggcaacc

SEQ ID NO: 23018 - DNA, 22 bp, Artificial Sequence
  chemically synthesized
ttcaaagtcatttgggcaacca

SEQ ID NO: 23019 - DNA, 22 bp, Artificial Sequence
  chemically synthesized
aaagtcatttgggcaaccatat

SEQ ID NO: 23020 - DNA, 22 bp, Artificial Sequence
  chemically synthesized
gggcaaccatattctgaaaaca

SEQ ID NO: 23021 - DNA, 22 bp, Artificial Sequence
  chemically synthesized
ggcaaccatattctgaaaacag

SEQ ID NO: 23022 - DNA, 22 bp, Artificial Sequence
  chemically synthesized
tgaaaacagcccagccagggtg

SEQ ID NO: 23023 - DNA, 22 bp, Artificial Sequence
  chemically synthesized
aaaacagcccagccagggtgat

SEQ ID NO: 23024 - DNA, 22 bp, Artificial Sequence
  chemically synthesized
tgcaaagatcctcaatgagcta

SEQ ID NO: 23025 - DNA, 22 bp, Artificial Sequence
  chemically synthesized
gcaaagatcctcaatgagctat

SEQ ID NO: 23026 - DNA, 22 bp, Artificial Sequence
  chemically synthesized
caaagatcctcaatgagctatt

SEQ ID NO: 23027 - DNA, 22 bp, Artificial Sequence
  chemically synthesized
aatgagctattttcaagtgatg

SEQ ID NO: 23028 - DNA, 22 bp, Artificial Sequence
  chemically synthesized
ttttcaagtgatgacaaagtgt

SEQ ID NO: 23029 - DNA, 22 bp, Artificial Sequence
  chemically synthesized
tcaagtgatgacaaagtgtgaa

SEQ ID NO: 23030 - DNA, 22 bp, Artificial Sequence
  chemically synthesized
caagtgatgacaaagtgtgaag

SEQ ID NO: 23031 - DNA, 22 bp, Artificial Sequence
  chemically synthesized
aagtgatgacaaagtgtgaagt

SEQ ID NO: 23032 - DNA, 22 bp, Artificial Sequence
  chemically synthesized
accgctcatttgagaactttct

SEQ ID NO: 23033 - DNA, 22 bp, Artificial Sequence
  chemically synthesized
atttgagaactttctttttcat

SEQ ID NO: 23034 - DNA, 22 bp, Artificial Sequence
  chemically synthesized
gagaactttctttttcatccaa

SEQ ID NO: 23035 - DNA, 22 bp, Artificial Sequence
  chemically synthesized
agaactttctttttcatccaaa

SEQ ID NO: 23036 - DNA, 22 bp, Artificial Sequence
  chemically synthesized
tctttttcatccaaagtaaatt

SEQ ID NO: 23037 - DNA, 22 bp, Artificial Sequence
  chemically synthesized
ctttttcatccaaagtaaattc

SEQ ID NO: 23038 - DNA, 22 bp, Artificial Sequence
  chemically synthesized
tttttcatccaaagtaaattca

SEQ ID NO: 23039 - DNA, 22 bp, Artificial Sequence
  chemically synthesized
tttcatccaaagtaaattcaaa

SEQ ID NO: 23040 - DNA, 22 bp, Artificial Sequence
  chemically synthesized
ttcatccaaagtaaattcaaat

SEQ ID NO: 23041 - DNA, 22 bp, Artificial Sequence
  chemically synthesized
tcatccaaagtaaattcaaata

SEQ ID NO: 23042 - DNA, 22 bp, Artificial Sequence
  chemically synthesized
catccaaagtaaattcaaatat

SEQ ID NO: 23043 - DNA, 22 bp, Artificial Sequence
  chemically synthesized
atccaaagtaaattcaaatatg

SEQ ID NO: 23044 - DNA, 22 bp, Artificial Sequence
  chemically synthesized
aaatatgattagaaatctgacc

SEQ ID NO: 23045 - DNA, 22 bp, Artificial Sequence
  chemically synthesized
gaaatctgaccttttattactg

SEQ ID NO: 23046 - DNA, 22 bp, Artificial Sequence
  chemically synthesized
accttttattactggaattctc

SEQ ID NO: 23047 - DNA, 22 bp, Artificial Sequence
  chemically synthesized
ttattactggaattctcttgac

SEQ ID NO: 23048 - DNA, 22 bp, Artificial Sequence
  chemically synthesized
tattactggaattctcttgact

SEQ ID NO: 23049 - DNA, 22 bp, Artificial Sequence
  chemically synthesized
attactggaattctcttgacta

SEQ ID NO: 23050 - DNA, 22 bp, Artificial Sequence
  chemically synthesized
ttactggaattctcttgactaa

SEQ ID NO: 23051 - DNA, 22 bp, Artificial Sequence
  chemically synthesized
ctggaattctcttgactaaaag

SEQ ID NO: 23052 - DNA, 22 bp, Artificial Sequence
  chemically synthesized
gaattctcttgactaaaagtaa

SEQ ID NO: 23053 - DNA, 22 bp, Artificial Sequence
  chemically synthesized
tcttgactaaaagtaaaattga

SEQ ID NO: 23054 - DNA, 22 bp, Artificial Sequence
  chemically synthesized
ttgactaaaagtaaaattgaat

SEQ ID NO: 23055 - DNA, 22 bp, Artificial Sequence
  chemically synthesized
gactaaaagtaaaattgaattt

SEQ ID NO: 23056 - DNA, 22 bp, Artificial Sequence
  chemically synthesized
actaaaagtaaaattgaatttt

SEQ ID NO: 23057 - DNA, 22 bp, Artificial Sequence
  chemically synthesized
aaagtaaaattgaattttaatt

SEQ ID NO: 23058 - DNA, 22 bp, Artificial Sequence
  chemically synthesized
aattttaattcctaaatctcca

SEQ ID NO: 23059 - DNA, 22 bp, Artificial Sequence
  chemically synthesized
taattcctaaatctccatgtgt

SEQ ID NO: 23060 - DNA, 22 bp, Artificial Sequence
  chemically synthesized
aattcctaaatctccatgtgta

SEQ ID NO: 23061 - DNA, 22 bp, Artificial Sequence
  chemically synthesized
attcctaaatctccatgtgtat

SEQ ID NO: 23062 - DNA, 22 bp, Artificial Sequence
  chemically synthesized
ctaaatctccatgtgtatacag

SEQ ID NO: 23063 - DNA, 22 bp, Artificial Sequence
  chemically synthesized
aatctccatgtgtatacagtac

SEQ ID NO: 23064 - DNA, 22 bp, Artificial Sequence
  chemically synthesized
catgtgtatacagtactgtggg

SEQ ID NO: 23065 - DNA, 22 bp, Artificial Sequence
  chemically synthesized
tgggaacatcacagattttggc

SEQ ID NO: 23066 - DNA, 22 bp, Artificial Sequence
  chemically synthesized
tggctccatgccctaaagagaa

SEQ ID NO: 23067 - DNA, 22 bp, Artificial Sequence
  chemically synthesized
ggctccatgccctaaagagaaa

SEQ ID NO: 23068 - DNA, 22 bp, Artificial Sequence
  chemically synthesized
gctccatgccctaaagagaaat

SEQ ID NO: 23069 - DNA, 22 bp, Artificial Sequence
  chemically synthesized
catgccctaaagagaaattggc

SEQ ID NO: 23070 - DNA, 22 bp, Artificial Sequence
  chemically synthesized
aagagaaattggctttcagatt

SEQ ID NO: 23071 - DNA, 22 bp, Artificial Sequence
  chemically synthesized
gctttcagattatttggattaa

SEQ ID NO: 23072 - DNA, 22 bp, Artificial Sequence
  chemically synthesized
tcagattatttggattaaaaac

SEQ ID NO: 23073 - DNA, 22 bp, Artificial Sequence
  chemically synthesized
cagattatttggattaaaaaca

SEQ ID NO: 23074 - DNA, 22 bp, Artificial Sequence
  chemically synthesized
agattatttggattaaaaacaa

SEQ ID NO: 23075 - DNA, 22 bp, Artificial Sequence
  chemically synthesized
tttggattaaaaacaaagactt

SEQ ID NO: 23076 - DNA, 22 bp, Artificial Sequence
  chemically synthesized
ggattaaaaacaaagactttct

SEQ ID NO: 23077 - DNA, 22 bp, Artificial Sequence
  chemically synthesized
gattaaaaacaaagactttctt

SEQ ID NO: 23078 - DNA, 22 bp, Artificial Sequence
  chemically synthesized
aaaacaaagactttcttaagag

SEQ ID NO: 23079 - DNA, 22 bp, Artificial Sequence
  chemically synthesized
tcttaagagatgtaaaattttc

SEQ ID NO: 23080 - DNA, 22 bp, Artificial Sequence
  chemically synthesized
cttaagagatgtaaaattttca

SEQ ID NO: 23081 - DNA, 22 bp, Artificial Sequence
  chemically synthesized
ttaagagatgtaaaattttcat

SEQ ID NO: 23082 - DNA, 22 bp, Artificial Sequence
  chemically synthesized
aagagatgtaaaattttcatga

SEQ ID NO: 23083 - DNA, 22 bp, Artificial Sequence
  chemically synthesized
agagatgtaaaattttcatgat

SEQ ID NO: 23084 - DNA, 22 bp, Artificial Sequence
  chemically synthesized
tcatgatgttttcttttttgct

SEQ ID NO: 23085 - DNA, 22 bp, Artificial Sequence
  chemically synthesized
catgatgttttcttttttgcta

SEQ ID NO: 23086 - DNA, 22 bp, Artificial Sequence
  chemically synthesized
atgatgttttcttttttgctaa

SEQ ID NO: 23087 - DNA, 22 bp, Artificial Sequence
  chemically synthesized
tcttttttgctaaaactaaaga

SEQ ID NO: 23088 - DNA, 22 bp, Artificial Sequence
  chemically synthesized
cttttttgctaaaactaaagaa

SEQ ID NO: 23089 - DNA, 22 bp, Artificial Sequence
  chemically synthesized
ttttttgctaaaactaaagaat

SEQ ID NO: 23090 - DNA, 22 bp, Artificial Sequence
  chemically synthesized
ttttgctaaaactaaagaatta

SEQ ID NO: 23091 - DNA, 22 bp, Artificial Sequence
  chemically synthesized
tttgctaaaactaaagaattat

SEQ ID NO: 23092 - DNA, 22 bp, Artificial Sequence
  chemically synthesized
ttgctaaaactaaagaattatt

SEQ ID NO: 23093 - DNA, 22 bp, Artificial Sequence
  chemically synthesized
tgctaaaactaaagaattattc

SEQ ID NO: 23094 - DNA, 22 bp, Artificial Sequence
  chemically synthesized
gctaaaactaaagaattattct

SEQ ID NO: 23095 - DNA, 22 bp, Artificial Sequence
  chemically synthesized
ctaaaactaaagaattattctt

SEQ ID NO: 23096 - DNA, 22 bp, Artificial Sequence
  chemically synthesized
aaactaaagaattattctttta

SEQ ID NO: 23097 - DNA, 22 bp, Artificial Sequence
  chemically synthesized
aagaattattcttttacatttc

SEQ ID NO: 23098 - DNA, 22 bp, Artificial Sequence
  chemically synthesized
ttcttttacatttcagtttttc

SEQ ID NO: 23099 - DNA, 22 bp, Artificial Sequence
  chemically synthesized
ttttacatttcagtttttcttg

SEQ ID NO: 23100 - DNA, 22 bp, Artificial Sequence
  chemically synthesized
ttacatttcagtttttcttgat

SEQ ID NO: 23101 - DNA, 22 bp, Artificial Sequence
  chemically synthesized
tacatttcagtttttcttgatc

SEQ ID NO: 23102 - DNA, 22 bp, Artificial Sequence
  chemically synthesized
acatttcagtttttcttgatca

SEQ ID NO: 23103 - DNA, 22 bp, Artificial Sequence
  chemically synthesized
catttcagtttttcttgatcat

SEQ ID NO: 23104 - DNA, 22 bp, Artificial Sequence
  chemically synthesized
cagtttttcttgatcatgaaaa

SEQ ID NO: 23105 - DNA, 22 bp, Artificial Sequence
  chemically synthesized
agtttttcttgatcatgaaaac

SEQ ID NO: 23106 - DNA, 22 bp, Artificial Sequence
  chemically synthesized
ttcttgatcatgaaaacgccaa

SEQ ID NO: 23107 - DNA, 22 bp, Artificial Sequence
  chemically synthesized
tcttgatcatgaaaacgccaac

SEQ ID NO: 23108 - DNA, 22 bp, Artificial Sequence
  chemically synthesized
cttgatcatgaaaacgccaaca

SEQ ID NO: 23109 - DNA, 22 bp, Artificial Sequence
  chemically synthesized
ttgatcatgaaaacgccaacaa

SEQ ID NO: 23110 - DNA, 22 bp, Artificial Sequence
  chemically synthesized
gatcatgaaaacgccaacaaaa

SEQ ID NO: 23111 - DNA, 22 bp, Artificial Sequence
  chemically synthesized
atcatgaaaacgccaacaaaat

SEQ ID NO: 23112 - DNA, 22 bp, Artificial Sequence
  chemically synthesized
tgaatcggccaaagaggtataa

SEQ ID NO: 23113 - DNA, 22 bp, Artificial Sequence
  chemically synthesized
aatcggccaaagaggtataatt

SEQ ID NO: 23114 - DNA, 22 bp, Artificial Sequence
  chemically synthesized
aggtaaattggaagagtttgtt

SEQ ID NO: 23115 - DNA, 22 bp, Artificial Sequence
  chemically synthesized
gaagagtttgttcaagggaacc

SEQ ID NO: 23116 - DNA, 22 bp, Artificial Sequence
  chemically synthesized
gttcaagggaaccttgagagag

SEQ ID NO: 23117 - DNA, 22 bp, Artificial Sequence
  chemically synthesized
ttcaagggaaccttgagagaga

SEQ ID NO: 23118 - DNA, 22 bp, Artificial Sequence
  chemically synthesized
aagggaaccttgagagagaatg

SEQ ID NO: 23119 - DNA, 22 bp, Artificial Sequence
  chemically synthesized
gagagagaatgtatggaagaaa

SEQ ID NO: 23120 - DNA, 22 bp, Artificial Sequence
  chemically synthesized
agagagaatgtatggaagaaaa

SEQ ID NO: 23121 - DNA, 22 bp, Artificial Sequence
  chemically synthesized
tgaagaagcacgagaagttttt

SEQ ID NO: 23122 - DNA, 22 bp, Artificial Sequence
  chemically synthesized
gaagaagcacgagaagtttttg

SEQ ID NO: 23123 - DNA, 22 bp, Artificial Sequence
  chemically synthesized
aagaagcacgagaagtttttga

SEQ ID NO: 23124 - DNA, 22 bp, Artificial Sequence
  chemically synthesized
tttcagtgttttcaaaaacttc

SEQ ID NO: 23125 - DNA, 22 bp, Artificial Sequence
  chemically synthesized
tcagtgttttcaaaaacttctc

SEQ ID NO: 23126 - DNA, 22 bp, Artificial Sequence
  chemically synthesized
cagtgttttcaaaaacttctcg

SEQ ID NO: 23127 - DNA, 22 bp, Artificial Sequence
  chemically synthesized
agtgttttcaaaaacttctcgt

SEQ ID NO: 23128 - DNA, 22 bp, Artificial Sequence
  chemically synthesized
tcaaaaacttctcgtgcttctt

SEQ ID NO: 23129 - DNA, 22 bp, Artificial Sequence
  chemically synthesized
caaaaacttctcgtgcttcttc

SEQ ID NO: 23130 - DNA, 22 bp, Artificial Sequence
  chemically synthesized
aaaaacttctcgtgcttcttca

SEQ ID NO: 23131 - DNA, 22 bp, Artificial Sequence
  chemically synthesized
ctcgtgcttcttcaaaactaca

SEQ ID NO: 23132 - DNA, 22 bp, Artificial Sequence
  chemically synthesized
tcgtgcttcttcaaaactacac

SEQ ID NO: 23133 - DNA, 22 bp, Artificial Sequence
  chemically synthesized
gtgcttcttcaaaactacactt

SEQ ID NO: 23134 - DNA, 22 bp, Artificial Sequence
  chemically synthesized
cttcaaaactacacttttcttc

SEQ ID NO: 23135 - DNA, 22 bp, Artificial Sequence
  chemically synthesized
ttcaaaactacacttttcttcc

SEQ ID NO: 23136 - DNA, 22 bp, Artificial Sequence
  chemically synthesized
caaaactacacttttcttccat

SEQ ID NO: 23137 - DNA, 22 bp, Artificial Sequence
  chemically synthesized
aaaactacacttttcttccata

SEQ ID NO: 23138 - DNA, 22 bp, Artificial Sequence
  chemically synthesized
cacttttcttccatacattctc

SEQ ID NO: 23139 - DNA, 22 bp, Artificial Sequence
  chemically synthesized
ttcttccatacattctctctca

SEQ ID NO: 23140 - DNA, 22 bp, Artificial Sequence
  chemically synthesized
tcttccatacattctctctcaa

SEQ ID NO: 23141 - DNA, 22 bp, Artificial Sequence
  chemically synthesized
cttccatacattctctctcaag

SEQ ID NO: 23142 - DNA, 22 bp, Artificial Sequence
  chemically synthesized
ttccatacattctctctcaagg

SEQ ID NO: 23143 - DNA, 22 bp, Artificial Sequence
  chemically synthesized
ccatacattctctctcaaggtt

SEQ ID NO: 23144 - DNA, 22 bp, Artificial Sequence
  chemically synthesized
catacattctctctcaaggttc

SEQ ID NO: 23145 - DNA, 22 bp, Artificial Sequence
  chemically synthesized
tctctcaaggttcccttgaaca

SEQ ID NO: 23146 - DNA, 22 bp, Artificial Sequence
  chemically synthesized
tctcaaggttcccttgaacaaa

SEQ ID NO: 23147 - DNA, 22 bp, Artificial Sequence
  chemically synthesized
tcaaggttcccttgaacaaact

SEQ ID NO: 23148 - DNA, 22 bp, Artificial Sequence
  chemically synthesized
aaggttcccttgaacaaactct

SEQ ID NO: 23149 - DNA, 22 bp, Artificial Sequence
  chemically synthesized
ccttgaacaaactcttccaatt

SEQ ID NO: 23150 - DNA, 22 bp, Artificial Sequence
  chemically synthesized
gaacaaactcttccaatttacc

SEQ ID NO: 23151 - DNA, 22 bp, Artificial Sequence
  chemically synthesized
aacaaactcttccaatttacct

SEQ ID NO: 23152 - DNA, 22 bp, Artificial Sequence
  chemically synthesized
ttccaatttacctgaattatac

SEQ ID NO: 23153 - DNA, 22 bp, Artificial Sequence
  chemically synthesized
ccaatttacctgaattatacct

SEQ ID NO: 23154 - DNA, 22 bp, Artificial Sequence
  chemically synthesized
caatttacctgaattatacctc

SEQ ID NO: 23155 - DNA, 22 bp, Artificial Sequence
  chemically synthesized
acctgaattatacctctttggc

SEQ ID NO: 23156 - DNA, 22 bp, Artificial Sequence
  chemically synthesized
cctgaattatacctctttggcc

SEQ ID NO: 23157 - DNA, 22 bp, Artificial Sequence
  chemically synthesized
aattatacctctttggccgatt

SEQ ID NO: 23158 - DNA, 22 bp, Artificial Sequence
  chemically synthesized
tacctctttggccgattcagaa

SEQ ID NO: 23159 - DNA, 22 bp, Artificial Sequence
  chemically synthesized
tttggccgattcagaattttgt

SEQ ID NO: 23160 - DNA, 22 bp, Artificial Sequence
  chemically synthesized
tggccgattcagaattttgttg

SEQ ID NO: 23161 - DNA, 22 bp, Artificial Sequence
  chemically synthesized
ggccgattcagaattttgttgg

SEQ ID NO: 23162 - DNA, 22 bp, Artificial Sequence
  chemically synthesized
gccgattcagaattttgttggc

SEQ ID NO: 23163 - DNA, 22 bp, Artificial Sequence
  chemically synthesized
agaattttgttggcgttttcat

SEQ ID NO: 23164 - DNA, 22 bp, Artificial Sequence
  chemically synthesized
tgttggcgttttcatgatcaag

SEQ ID NO: 23165 - DNA, 22 bp, Artificial Sequence
  chemically synthesized
gttggcgttttcatgatcaaga

SEQ ID NO: 23166 - DNA, 22 bp, Artificial Sequence
  chemically synthesized
ttggcgttttcatgatcaagaa

SEQ ID NO: 23167 - DNA, 22 bp, Artificial Sequence
  chemically synthesized
gcgttttcatgatcaagaaaaa

SEQ ID NO: 23168 - DNA, 22 bp, Artificial Sequence
  chemically synthesized
tcatgatcaagaaaaactgaaa

SEQ ID NO: 23169 - DNA, 22 bp, Artificial Sequence
  chemically synthesized
catgatcaagaaaaactgaaat

SEQ ID NO: 23170 - DNA, 22 bp, Artificial Sequence
  chemically synthesized
atgatcaagaaaaactgaaatg

SEQ ID NO: 23171 - DNA, 22 bp, Artificial Sequence
  chemically synthesized
aaatgtaaaagaataattcttt

SEQ ID NO: 23172 - DNA, 22 bp, Artificial Sequence
  chemically synthesized
tttagttttagcaaaaaagaaa

SEQ ID NO: 23173 - DNA, 22 bp, Artificial Sequence
  chemically synthesized
tagttttagcaaaaaagaaaac

SEQ ID NO: 23174 - DNA, 22 bp, Artificial Sequence
  chemically synthesized
agttttagcaaaaaagaaaaca

SEQ ID NO: 23175 - DNA, 22 bp, Artificial Sequence
  chemically synthesized
gttttagcaaaaaagaaaacat

SEQ ID NO: 23176 - DNA, 22 bp, Artificial Sequence
  chemically synthesized
tagcaaaaaagaaaacatcatg

SEQ ID NO: 23177 - DNA, 22 bp, Artificial Sequence
  chemically synthesized
agcaaaaaagaaaacatcatga

SEQ ID NO: 23178 - DNA, 22 bp, Artificial Sequence
  chemically synthesized
gcaaaaaagaaaacatcatgaa

SEQ ID NO: 23179 - DNA, 22 bp, Artificial Sequence
  chemically synthesized
tacatctcttaagaaagtcttt

SEQ ID NO: 23180 - DNA, 22 bp, Artificial Sequence
  chemically synthesized
acatctcttaagaaagtctttg

SEQ ID NO: 23181 - DNA, 22 bp, Artificial Sequence
  chemically synthesized
catctcttaagaaagtctttgt

SEQ ID NO: 23182 - DNA, 22 bp, Artificial Sequence
  chemically synthesized
ttaagaaagtctttgtttttaa

SEQ ID NO: 23183 - DNA, 22 bp, Artificial Sequence
  chemically synthesized
aagaaagtctttgtttttaatc

SEQ ID NO: 23184 - DNA, 22 bp, Artificial Sequence
  chemically synthesized
agaaagtctttgtttttaatcc

SEQ ID NO: 23185 - DNA, 22 bp, Artificial Sequence
  chemically synthesized
tgtttttaatccaaataatctg

SEQ ID NO: 23186 - DNA, 22 bp, Artificial Sequence
  chemically synthesized
gtttttaatccaaataatctga

SEQ ID NO: 23187 - DNA, 22 bp, Artificial Sequence
  chemically synthesized
tttttaatccaaataatctgaa

SEQ ID NO: 23188 - DNA, 22 bp, Artificial Sequence
  chemically synthesized
ttaatccaaataatctgaaagc

SEQ ID NO: 23189 - DNA, 22 bp, Artificial Sequence
  chemically synthesized
taatccaaataatctgaaagcc

SEQ ID NO: 23190 - DNA, 22 bp, Artificial Sequence
  chemically synthesized
aatccaaataatctgaaagcca

SEQ ID NO: 23191 - DNA, 22 bp, Artificial Sequence
  chemically synthesized
atccaaataatctgaaagccaa

SEQ ID NO: 23192 - DNA, 22 bp, Artificial Sequence
  chemically synthesized
aaagccaatttctctttagggc

SEQ ID NO: 23193 - DNA, 22 bp, Artificial Sequence
  chemically synthesized
ctctttagggcatggagccaaa

SEQ ID NO: 23194 - DNA, 22 bp, Artificial Sequence
  chemically synthesized
tctttagggcatggagccaaaa

SEQ ID NO: 23195 - DNA, 22 bp, Artificial Sequence
  chemically synthesized
tttagggcatggagccaaaatc

SEQ ID NO: 23196 - DNA, 22 bp, Artificial Sequence
  chemically synthesized
tagggcatggagccaaaatctg

SEQ ID NO: 23197 - DNA, 22 bp, Artificial Sequence
  chemically synthesized
agggcatggagccaaaatctgt

SEQ ID NO: 23198 - DNA, 22 bp, Artificial Sequence
  chemically synthesized
gggcatggagccaaaatctgtg

SEQ ID NO: 23199 - DNA, 22 bp, Artificial Sequence
  chemically synthesized
tgatgttcccacagtactgtat

SEQ ID NO: 23200 - DNA, 22 bp, Artificial Sequence
  chemically synthesized
ccacagtactgtatacacatgg

SEQ ID NO: 23201 - DNA, 22 bp, Artificial Sequence
  chemically synthesized
tatacacatggagatttaggaa

SEQ ID NO: 23202 - DNA, 22 bp, Artificial Sequence
  chemically synthesized
aggaattaaaattcaattttac

SEQ ID NO: 23203 - DNA, 22 bp, Artificial Sequence
  chemically synthesized
ggaattaaaattcaattttact

SEQ ID NO: 23204 - DNA, 22 bp, Artificial Sequence
  chemically synthesized
aaattcaattttacttttagtc

SEQ ID NO: 23205 - DNA, 22 bp, Artificial Sequence
  chemically synthesized
aattttacttttagtcaagaga

SEQ ID NO: 23206 - DNA, 22 bp, Artificial Sequence
  chemically synthesized
tacttttagtcaagagaattcc

SEQ ID NO: 23207 - DNA, 22 bp, Artificial Sequence
  chemically synthesized
acttttagtcaagagaattcca

SEQ ID NO: 23208 - DNA, 22 bp, Artificial Sequence
  chemically synthesized
cttttagtcaagagaattccag

SEQ ID NO: 23209 - DNA, 22 bp, Artificial Sequence
  chemically synthesized
ttagtcaagagaattccagtaa

SEQ ID NO: 23210 - DNA, 22 bp, Artificial Sequence
  chemically synthesized
tagtcaagagaattccagtaat

SEQ ID NO: 23211 - DNA, 22 bp, Artificial Sequence
  chemically synthesized
agtcaagagaattccagtaata

SEQ ID NO: 23212 - DNA, 22 bp, Artificial Sequence
  chemically synthesized
gtcaagagaattccagtaataa

SEQ ID NO: 23213 - DNA, 22 bp, Artificial Sequence
  chemically synthesized
cagtaataaaaggtcagatttc

SEQ ID NO: 23214 - DNA, 22 bp, Artificial Sequence
  chemically synthesized
ctaatcatatttgaatttactt

SEQ ID NO: 23215 - DNA, 22 bp, Artificial Sequence
  chemically synthesized
taatcatatttgaatttacttt

SEQ ID NO: 23216 - DNA, 22 bp, Artificial Sequence
  chemically synthesized
atcatatttgaatttactttgg

SEQ ID NO: 23217 - DNA, 22 bp, Artificial Sequence
  chemically synthesized
gaatttactttggatgaaaaag

SEQ ID NO: 23218 - DNA, 22 bp, Artificial Sequence
  chemically synthesized
aatttactttggatgaaaaaga

SEQ ID NO: 23219 - DNA, 22 bp, Artificial Sequence
  chemically synthesized
actttggatgaaaaagaaagtt

SEQ ID NO: 23220 - DNA, 22 bp, Artificial Sequence
  chemically synthesized
ctttggatgaaaaagaaagttc

SEQ ID NO: 23221 - DNA, 22 bp, Artificial Sequence
  chemically synthesized
tggatgaaaaagaaagttctca

SEQ ID NO: 23222 - DNA, 22 bp, Artificial Sequence
  chemically synthesized
ggatgaaaaagaaagttctcaa

SEQ ID NO: 23223 - DNA, 22 bp, Artificial Sequence
  chemically synthesized
gatgaaaaagaaagttctcaaa

SEQ ID NO: 23224 - DNA, 22 bp, Artificial Sequence
  chemically synthesized
tcaaatgagcggttaacttcac

SEQ ID NO: 23225 - DNA, 22 bp, Artificial Sequence
  chemically synthesized
aaatgagcggttaacttcacac

SEQ ID NO: 23226 - DNA, 22 bp, Artificial Sequence
  chemically synthesized
acttcacactttgtcatcactt

SEQ ID NO: 23227 - DNA, 22 bp, Artificial Sequence
  chemically synthesized
cacactttgtcatcacttgaaa

SEQ ID NO: 23228 - DNA, 22 bp, Artificial Sequence
  chemically synthesized
acactttgtcatcacttgaaaa

SEQ ID NO: 23229 - DNA, 22 bp, Artificial Sequence
  chemically synthesized
tgtcatcacttgaaaatagctc

SEQ ID NO: 23230 - DNA, 22 bp, Artificial Sequence
  chemically synthesized
gtcatcacttgaaaatagctca

SEQ ID NO: 23231 - DNA, 22 bp, Artificial Sequence
  chemically synthesized
tcatcacttgaaaatagctcat

SEQ ID NO: 23232 - DNA, 22 bp, Artificial Sequence
  chemically synthesized
gaaaatagctcattgaggatct

SEQ ID NO: 23233 - DNA, 22 bp, Artificial Sequence
  chemically synthesized
aaaatagctcattgaggatctt

SEQ ID NO: 23234 - DNA, 22 bp, Artificial Sequence
  chemically synthesized
attgaggatctttgcaaagtga

SEQ ID NO: 23235 - DNA, 22 bp, Artificial Sequence
  chemically synthesized
aggatctttgcaaagtgatcca

SEQ ID NO: 23236 - DNA, 22 bp, Artificial Sequence
  chemically synthesized
tgcaaagtgatccatcaccctg

SEQ ID NO: 23237 - DNA, 22 bp, Artificial Sequence
  chemically synthesized
gcaaagtgatccatcaccctgg

SEQ ID NO: 23238 - DNA, 22 bp, Artificial Sequence
  chemically synthesized
caaagtgatccatcaccctggc

SEQ ID NO: 23239 - DNA, 22 bp, Artificial Sequence
  chemically synthesized
gctgggctgttttcagaatatg

SEQ ID NO: 23240 - DNA, 22 bp, Artificial Sequence
  chemically synthesized
ggctgttttcagaatatggttg

SEQ ID NO: 23241 - DNA, 22 bp, Artificial Sequence
  chemically synthesized
ttttcagaatatggttgcccaa

SEQ ID NO: 23242 - DNA, 22 bp, Artificial Sequence
  chemically synthesized
tcagaatatggttgcccaaatg

SEQ ID NO: 23243 - DNA, 22 bp, Artificial Sequence
  chemically synthesized
cagaatatggttgcccaaatga

SEQ ID NO: 23244 - DNA, 22 bp, Artificial Sequence
  chemically synthesized
agaatatggttgcccaaatgac

SEQ ID NO: 23245 - DNA, 22 bp, Artificial Sequence
  chemically synthesized
cccaaatgactttgaacaaatg

SEQ ID NO: 23246 - DNA, 22 bp, Artificial Sequence
  chemically synthesized
tgaacaaatgtctcctgaagaa

SEQ ID NO: 23247 - DNA, 22 bp, Artificial Sequence
  chemically synthesized
gaacaaatgtctcctgaagaac

SEQ ID NO: 23248 - DNA, 22 bp, Artificial Sequence
  chemically synthesized
aacaaatgtctcctgaagaaca

SEQ ID NO: 23249 - DNA, 22 bp, Artificial Sequence
  chemically synthesized
ctgaagaacagaagcctaatta

SEQ ID NO: 23250 - DNA, 22 bp, Artificial Sequence
  chemically synthesized
aagaacagaagcctaattatgg

SEQ ID NO: 23251 - DNA, 22 bp, Artificial Sequence
  chemically synthesized
attatggtccagctgcaaatgt

SEQ ID NO: 23252 - DNA, 22 bp, Artificial Sequence
  chemically synthesized
tggtccagctgcaaatgtgacc

SEQ ID NO: 23253 - DNA, 22 bp, Artificial Sequence
  chemically synthesized
caaatgtgaccccagtgtctgt

SEQ ID NO: 23254 - DNA, 22 bp, Artificial Sequence
  chemically synthesized
tcactagatgttaaagaaaaat

SEQ ID NO: 23255 - DNA, 22 bp, Artificial Sequence
  chemically synthesized
gatgttaaagaaaaatcactgc

SEQ ID NO: 23256 - DNA, 22 bp, Artificial Sequence
  chemically synthesized
aagaaaaatcactgcattaatt

SEQ ID NO: 23257 - DNA, 22 bp, Artificial Sequence
  chemically synthesized
cattaatttaaaaaagcaattt

SEQ ID NO: 23258 - DNA, 22 bp, Artificial Sequence
  chemically synthesized
atttaaaaaagcaatttcagat

SEQ ID NO: 23259 - DNA, 22 bp, Artificial Sequence
  chemically synthesized
aaaaaagcaatttcagatcaac

SEQ ID NO: 23260 - DNA, 22 bp, Artificial Sequence
  chemically synthesized
aaaaagcaatttcagatcaaca

SEQ ID NO: 23261 - DNA, 22 bp, Artificial Sequence
  chemically synthesized
cagatcaacagcacctttggtt

SEQ ID NO: 23262 - DNA, 22 bp, Artificial Sequence
  chemically synthesized
agatcaacagcacctttggttg

SEQ ID NO: 23263 - DNA, 22 bp, Artificial Sequence
  chemically synthesized
tggttggcaagtgttataggaa

SEQ ID NO: 23264 - DNA, 22 bp, Artificial Sequence
  chemically synthesized
ggttggcaagtgttataggaat

SEQ ID NO: 23265 - DNA, 22 bp, Artificial Sequence
  chemically synthesized
gttggcaagtgttataggaatt

SEQ ID NO: 23266 - DNA, 22 bp, Artificial Sequence
  chemically synthesized
gcaagtgttataggaattgcag

SEQ ID NO: 23267 - DNA, 22 bp, Artificial Sequence
  chemically synthesized
taggaattgcagtgatttaagc

SEQ ID NO: 23268 - DNA, 22 bp, Artificial Sequence
  chemically synthesized
cagtgatttaagcatctctcta

SEQ ID NO: 23269 - DNA, 22 bp, Artificial Sequence
  chemically synthesized
aagcatctctctagaattcagg

SEQ ID NO: 23270 - DNA, 22 bp, Artificial Sequence
  chemically synthesized
agcatctctctagaattcagga

SEQ ID NO: 23271 - DNA, 22 bp, Artificial Sequence
  chemically synthesized
tctagaattcaggatatgtttt

SEQ ID NO: 23272 - DNA, 22 bp, Artificial Sequence
  chemically synthesized
tagaattcaggatatgtttttt

SEQ ID NO: 23273 - DNA, 22 bp, Artificial Sequence
  chemically synthesized
gaattcaggatatgtttttttt

SEQ ID NO: 23274 - DNA, 22 bp, Artificial Sequence
  chemically synthesized
aggatatgttttttttaagcta

SEQ ID NO: 23275 - DNA, 22 bp, Artificial Sequence
  chemically synthesized
tttttaagctacatctacctag

SEQ ID NO: 23276 - DNA, 22 bp, Artificial Sequence
  chemically synthesized
ttttaagctacatctacctagt

SEQ ID NO: 23277 - DNA, 22 bp, Artificial Sequence
  chemically synthesized
tttaagctacatctacctagtc

SEQ ID NO: 23278 - DNA, 22 bp, Artificial Sequence
  chemically synthesized
ttaagctacatctacctagtct

SEQ ID NO: 23279 - DNA, 22 bp, Artificial Sequence
  chemically synthesized
taagctacatctacctagtctg

SEQ ID NO: 23280 - DNA, 22 bp, Artificial Sequence
  chemically synthesized
aagctacatctacctagtctga

SEQ ID NO: 23281 - DNA, 22 bp, Artificial Sequence
  chemically synthesized
agctacatctacctagtctgaa

SEQ ID NO: 23282 - DNA, 22 bp, Artificial Sequence
  chemically synthesized
catctacctagtctgaagagac

SEQ ID NO: 23283 - DNA, 22 bp, Artificial Sequence
  chemically synthesized
cctagtctgaagagacactcct

SEQ ID NO: 23284 - DNA, 22 bp, Artificial Sequence
  chemically synthesized
gtctgaagagacactcctgaac

SEQ ID NO: 23285 - DNA, 22 bp, Artificial Sequence
  chemically synthesized
aagagacactcctgaactctgg

SEQ ID NO: 23286 - DNA, 22 bp, Artificial Sequence
  chemically synthesized
ctgaactctggaggatagatgt

SEQ ID NO: 23287 - DNA, 22 bp, Artificial Sequence
  chemically synthesized
aactctggaggatagatgtctc

SEQ ID NO: 23288 - DNA, 22 bp, Artificial Sequence
  chemically synthesized
tggaggatagatgtctctatct

SEQ ID NO: 23289 - DNA, 22 bp, Artificial Sequence
  chemically synthesized
gaggatagatgtctctatctga

SEQ ID NO: 23290 - DNA, 22 bp, Artificial Sequence
  chemically synthesized
tatctgaatcatatttctcctt

SEQ ID NO: 23291 - DNA, 22 bp, Artificial Sequence
  chemically synthesized
tctgaatcatatttctccttcc

SEQ ID NO: 23292 - DNA, 22 bp, Artificial Sequence
  chemically synthesized
aatcatatttctccttccctcc

SEQ ID NO: 23293 - DNA, 22 bp, Artificial Sequence
  chemically synthesized
ctccttccctccctccttcctc

SEQ ID NO: 23294 - DNA, 22 bp, Artificial Sequence
  chemically synthesized
tccttccctccctccttcctct

SEQ ID NO: 23295 - DNA, 22 bp, Artificial Sequence
  chemically synthesized
cttccctccctccttcctctcc

SEQ ID NO: 23296 - DNA, 22 bp, Artificial Sequence
  chemically synthesized
ccctccctccttcctctcctct

SEQ ID NO: 23297 - DNA, 22 bp, Artificial Sequence
  chemically synthesized
cctccctccttcctctcctctc

SEQ ID NO: 23298 - DNA, 22 bp, Artificial Sequence
  chemically synthesized
cctccttcctctcctctcctct

SEQ ID NO: 23299 - DNA, 22 bp, Artificial Sequence
  chemically synthesized
cttcctctcctctcctctctct

SEQ ID NO: 23300 - DNA, 22 bp, Artificial Sequence
  chemically synthesized
cctctcctctcctctctctctc

SEQ ID NO: 23301 - DNA, 22 bp, Artificial Sequence
  chemically synthesized
ctctcctctcctctctctctct

SEQ ID NO: 23302 - DNA, 22 bp, Artificial Sequence
  chemically synthesized
tcctctcctctctctctctctc

SEQ ID NO: 23303 - DNA, 22 bp, Artificial Sequence
  chemically synthesized
ctctcctctctctctctctcta

SEQ ID NO: 23304 - DNA, 22 bp, Artificial Sequence
  chemically synthesized
tcctctctctctctctctatgt

SEQ ID NO: 23305 - DNA, 22 bp, Artificial Sequence
  chemically synthesized
ctctctctctctctctatgtgt

SEQ ID NO: 23306 - DNA, 22 bp, Artificial Sequence
  chemically synthesized
tctctctctctctatgtgtgtg

SEQ ID NO: 23307 - DNA, 22 bp, Artificial Sequence
  chemically synthesized
tctctctctctatgtgtgtgtg

SEQ ID NO: 23308 - DNA, 22 bp, Artificial Sequence
  chemically synthesized
tctctctctatgtgtgtgtgtg

SEQ ID NO: 23309 - DNA, 22 bp, Artificial Sequence
  chemically synthesized
tctctctatgtgtgtgtgtgta

SEQ ID NO: 23310 - DNA, 22 bp, Artificial Sequence
  chemically synthesized
tctctatgtgtgtgtgtgtaca

SEQ ID NO: 23311 - DNA, 22 bp, Artificial Sequence
  chemically synthesized
tctatgtgtgtgtgtgtacata

SEQ ID NO: 23312 - DNA, 22 bp, Artificial Sequence
  chemically synthesized
tatgtgtgtgtgtgtacatata

SEQ ID NO: 23313 - DNA, 22 bp, Artificial Sequence
  chemically synthesized
tgtgtgtgtgtgtacatatata

SEQ ID NO: 23314 - DNA, 22 bp, Artificial Sequence
  chemically synthesized
gctgcacaatgacattttggtc

SEQ ID NO: 23315 - DNA, 22 bp, Artificial Sequence
  chemically synthesized
ctgcacaatgacattttggtca

SEQ ID NO: 23316 - DNA, 22 bp, Artificial Sequence
  chemically synthesized
cacaatgacattttggtcaatg

SEQ ID NO: 23317 - DNA, 22 bp, Artificial Sequence
  chemically synthesized
tggtcaatgatggaccacatta

SEQ ID NO: 23318 - DNA, 22 bp, Artificial Sequence
  chemically synthesized
ggtcaatgatggaccacattat

SEQ ID NO: 23319 - DNA, 22 bp, Artificial Sequence
  chemically synthesized
gtcaatgatggaccacattata

SEQ ID NO: 23320 - DNA, 22 bp, Artificial Sequence
  chemically synthesized
tacgacagtggtcccataaggt

SEQ ID NO: 23321 - DNA, 22 bp, Artificial Sequence
  chemically synthesized
taatactgtattttcactgtac

SEQ ID NO: 23322 - DNA, 22 bp, Artificial Sequence
  chemically synthesized
tattttcactgtaccttttcta

SEQ ID NO: 23323 - DNA, 22 bp, Artificial Sequence
  chemically synthesized
tcactgtaccttttctatgttt

SEQ ID NO: 23324 - DNA, 22 bp, Artificial Sequence
  chemically synthesized
cactgtaccttttctatgttta

SEQ ID NO: 23325 - DNA, 22 bp, Artificial Sequence
  chemically synthesized
actgtaccttttctatgtttag

SEQ ID NO: 23326 - DNA, 22 bp, Artificial Sequence
  chemically synthesized
taccttttctatgtttagatac

SEQ ID NO: 23327 - DNA, 22 bp, Artificial Sequence
  chemically synthesized
ttctatgtttagatacacaaat

SEQ ID NO: 23328 - DNA, 22 bp, Artificial Sequence
  chemically synthesized
tctatgtttagatacacaaata

SEQ ID NO: 23329 - DNA, 22 bp, Artificial Sequence
  chemically synthesized
ctatgtttagatacacaaatac

SEQ ID NO: 23330 - DNA, 22 bp, Artificial Sequence
  chemically synthesized
tatgtttagatacacaaatacc

SEQ ID NO: 23331 - DNA, 22 bp, Artificial Sequence
  chemically synthesized
tgtttagatacacaaataccac

SEQ ID NO: 23332 - DNA, 22 bp, Artificial Sequence
  chemically synthesized
agatacacaaataccactgtta

SEQ ID NO: 23333 - DNA, 22 bp, Artificial Sequence
  chemically synthesized
gatacacaaataccactgttac

SEQ ID NO: 23334 - DNA, 22 bp, Artificial Sequence
  chemically synthesized
ttaccattgcctacagtgttca

SEQ ID NO: 23335 - DNA, 22 bp, Artificial Sequence
  chemically synthesized
ccattgcctacagtgttcagta

SEQ ID NO: 23336 - DNA, 22 bp, Artificial Sequence
  chemically synthesized
cctacagtgttcagtacagtca

SEQ ID NO: 23337 - DNA, 22 bp, Artificial Sequence
  chemically synthesized
cagtgttcagtacagtcacatg

SEQ ID NO: 23338 - DNA, 22 bp, Artificial Sequence
  chemically synthesized
agtacagtcacatgctgtacag

SEQ ID NO: 23339 - DNA, 22 bp, Artificial Sequence
  chemically synthesized
tacaggtttgcagcccaggagc

SEQ ID NO: 23340 - DNA, 22 bp, Artificial Sequence
  chemically synthesized
gcagcccaggagcctaggagca

SEQ ID NO: 23341 - DNA, 22 bp, Artificial Sequence
  chemically synthesized
cagcccaggagcctaggagcaa

SEQ ID NO: 23342 - DNA, 22 bp, Artificial Sequence
  chemically synthesized
ggagcaataggccacatcaata

SEQ ID NO: 23343 - DNA, 22 bp, Artificial Sequence
  chemically synthesized
ggtatgtagtaagctataccat

SEQ ID NO: 23344 - DNA, 22 bp, Artificial Sequence
  chemically synthesized
taccatttaggtttaggtaagt

SEQ ID NO: 23345 - DNA, 22 bp, Artificial Sequence
  chemically synthesized
aggtttaggtaagtacactcta

SEQ ID NO: 23346 - DNA, 22 bp, Artificial Sequence
  chemically synthesized
ggtttaggtaagtacactctat

SEQ ID NO: 23347 - DNA, 22 bp, Artificial Sequence
  chemically synthesized
aggtaagtacactctattatgt

SEQ ID NO: 23348 - DNA, 22 bp, Artificial Sequence
  chemically synthesized
ggtaagtacactctattatgtt

SEQ ID NO: 23349 - DNA, 22 bp, Artificial Sequence
  chemically synthesized
tattatgttcgcacaatgatga

SEQ ID NO: 23350 - DNA, 22 bp, Artificial Sequence
  chemically synthesized
ttatgttcgcacaatgatgaaa

SEQ ID NO: 23351 - DNA, 22 bp, Artificial Sequence
  chemically synthesized
tgttcgcacaatgatgaaattg

SEQ ID NO: 23352 - DNA, 22 bp, Artificial Sequence
  chemically synthesized
gcacaatgatgaaattgcttaa

SEQ ID NO: 23353 - DNA, 22 bp, Artificial Sequence
  chemically synthesized
cttaatgacacatttctcagaa

SEQ ID NO: 23354 - DNA, 22 bp, Artificial Sequence
  chemically synthesized
aatgacacatttctcagaatat

SEQ ID NO: 23355 - DNA, 22 bp, Artificial Sequence
  chemically synthesized
atgacacatttctcagaatata

SEQ ID NO: 23356 - DNA, 22 bp, Artificial Sequence
  chemically synthesized
ctcagaatatatccccattgtt

SEQ ID NO: 23357 - DNA, 22 bp, Artificial Sequence
  chemically synthesized
tcagaatatatccccattgtta

SEQ ID NO: 23358 - DNA, 22 bp, Artificial Sequence
  chemically synthesized
agaatatatccccattgttaag

SEQ ID NO: 23359 - DNA, 22 bp, Artificial Sequence
  chemically synthesized
ttaaggaatgcatggctgtata

SEQ ID NO: 23360 - DNA, 22 bp, Artificial Sequence
  chemically synthesized
aggaatgcatggctgtatacac

SEQ ID NO: 23361 - DNA, 22 bp, Artificial Sequence
  chemically synthesized
tatacacacacatgtgtttgtg

SEQ ID NO: 23362 - DNA, 22 bp, Artificial Sequence
  chemically synthesized
gtgtgttttcatgtatatacat

SEQ ID NO: 23363 - DNA, 22 bp, Artificial Sequence
  chemically synthesized
tgtgttttcatgtatatacata

SEQ ID NO: 23364 - DNA, 22 bp, Artificial Sequence
  chemically synthesized
tcatgtatatacatatatgtgt

SEQ ID NO: 23365 - DNA, 22 bp, Artificial Sequence
  chemically synthesized
catgtatatacatatatgtgtg

SEQ ID NO: 23366 - DNA, 22 bp, Artificial Sequence
  chemically synthesized
atgtatatacatatatgtgtgt

SEQ ID NO: 23367 - DNA, 22 bp, Artificial Sequence
  chemically synthesized
ataacagggactcaagaagttg

SEQ ID NO: 23368 - DNA, 22 bp, Artificial Sequence
  chemically synthesized
aagaagttgcctggagttgttc

SEQ ID NO: 23369 - DNA, 22 bp, Artificial Sequence
  chemically synthesized
cctggagttgttcctttcttca

SEQ ID NO: 23370 - DNA, 22 bp, Artificial Sequence
  chemically synthesized
gagttgttcctttcttcaaggg

SEQ ID NO: 23371 - DNA, 22 bp, Artificial Sequence
  chemically synthesized
ttcctttcttcaagggtctagc

SEQ ID NO: 23372 - DNA, 22 bp, Artificial Sequence
  chemically synthesized
ctttcttcaagggtctagcaat

SEQ ID NO: 23373 - DNA, 22 bp, Artificial Sequence
  chemically synthesized
tcttcaagggtctagcaatata

SEQ ID NO: 23374 - DNA, 22 bp, Artificial Sequence
  chemically synthesized
cttcaagggtctagcaatatat

SEQ ID NO: 23375 - DNA, 22 bp, Artificial Sequence
  chemically synthesized
ttcaagggtctagcaatatatc

SEQ ID NO: 23376 - DNA, 22 bp, Artificial Sequence
  chemically synthesized
caagggtctagcaatatatctg

SEQ ID NO: 23377 - DNA, 22 bp, Artificial Sequence
  chemically synthesized
aagggtctagcaatatatctga

SEQ ID NO: 23378 - DNA, 22 bp, Artificial Sequence
  chemically synthesized
gcaatatatctgataccatctc

SEQ ID NO: 23379 - DNA, 22 bp, Artificial Sequence
  chemically synthesized
ataccatctcaagaggaccaag

SEQ ID NO: 23380 - DNA, 22 bp, Artificial Sequence
  chemically synthesized
aagaggaccaagggcttataag

SEQ ID NO: 23381 - DNA, 22 bp, Artificial Sequence
  chemically synthesized
ataagatgaactttctggggta

SEQ ID NO: 23382 - DNA, 22 bp, Artificial Sequence
  chemically synthesized
taagatgaactttctggggtat

SEQ ID NO: 23383 - DNA, 22 bp, Artificial Sequence
  chemically synthesized
tctggggtatttgggactactt

SEQ ID NO: 23384 - DNA, 22 bp, Artificial Sequence
  chemically synthesized
ctggggtatttgggactacttc

SEQ ID NO: 23385 - DNA, 22 bp, Artificial Sequence
  chemically synthesized
tggggtatttgggactacttcc

SEQ ID NO: 23386 - DNA, 22 bp, Artificial Sequence
  chemically synthesized
gggtatttgggactacttcctg

SEQ ID NO: 23387 - DNA, 22 bp, Artificial Sequence
  chemically synthesized
gggactacttcctgattaactc

SEQ ID NO: 23388 - DNA, 22 bp, Artificial Sequence
  chemically synthesized
ggactacttcctgattaactcc

SEQ ID NO: 23389 - DNA, 22 bp, Artificial Sequence
  chemically synthesized
cttcctgattaactccaaaaag

SEQ ID NO: 23390 - DNA, 22 bp, Artificial Sequence
  chemically synthesized
cctgattaactccaaaaaggaa

SEQ ID NO: 23391 - DNA, 22 bp, Artificial Sequence
  chemically synthesized
ctgattaactccaaaaaggaag

SEQ ID NO: 23392 - DNA, 22 bp, Artificial Sequence
  chemically synthesized
attaactccaaaaaggaagaga

SEQ ID NO: 23393 - DNA, 22 bp, Artificial Sequence
  chemically synthesized
actccaaaaaggaagagaaagg

SEQ ID NO: 23394 - DNA, 22 bp, Artificial Sequence
  chemically synthesized
caaaaaggaagagaaaggaaag

SEQ ID NO: 23395 - DNA, 22 bp, Artificial Sequence
  chemically synthesized
aactttcttcccttattttcat

SEQ ID NO: 23396 - DNA, 22 bp, Artificial Sequence
  chemically synthesized
tcttcccttattttcattgcag

SEQ ID NO: 23397 - DNA, 22 bp, Artificial Sequence
  chemically synthesized
cttcccttattttcattgcagc

SEQ ID NO: 23398 - DNA, 22 bp, Artificial Sequence
  chemically synthesized
ttcccttattttcattgcagct

SEQ ID NO: 23399 - DNA, 22 bp, Artificial Sequence
  chemically synthesized
cccttattttcattgcagctgt

SEQ ID NO: 23400 - DNA, 22 bp, Artificial Sequence
  chemically synthesized
ccttattttcattgcagctgtt

SEQ ID NO: 23401 - DNA, 22 bp, Artificial Sequence
  chemically synthesized
attttcattgcagctgttcact

SEQ ID NO: 23402 - DNA, 22 bp, Artificial Sequence
  chemically synthesized
ttttcattgcagctgttcactt

SEQ ID NO: 23403 - DNA, 22 bp, Artificial Sequence
  chemically synthesized
tcattgcagctgttcactttat

SEQ ID NO: 23404 - DNA, 22 bp, Artificial Sequence
  chemically synthesized
cattgcagctgttcactttatg

SEQ ID NO: 23405 - DNA, 22 bp, Artificial Sequence
  chemically synthesized
attgcagctgttcactttatgg

SEQ ID NO: 23406 - DNA, 22 bp, Artificial Sequence
  chemically synthesized
cagctgttcactttatggagtg

SEQ ID NO: 23407 - DNA, 22 bp, Artificial Sequence
  chemically synthesized
ttcactttatggagtgttctag

SEQ ID NO: 23408 - DNA, 22 bp, Artificial Sequence
  chemically synthesized
actttatggagtgttctagtcc

SEQ ID NO: 23409 - DNA, 22 bp, Artificial Sequence
  chemically synthesized
tatggagtgttctagtcccttg

SEQ ID NO: 23410 - DNA, 22 bp, Artificial Sequence
  chemically synthesized
atggagtgttctagtcccttga

SEQ ID NO: 23411 - DNA, 22 bp, Artificial Sequence
  chemically synthesized
tggagtgttctagtcccttgac

SEQ ID NO: 23412 - DNA, 22 bp, Artificial Sequence
  chemically synthesized
tagtcccttgacatccctgctt

SEQ ID NO: 23413 - DNA, 22 bp, Artificial Sequence
  chemically synthesized
gtcccttgacatccctgctttt

SEQ ID NO: 23414 - DNA, 22 bp, Artificial Sequence
  chemically synthesized
gacatccctgcttttcccttgc

SEQ ID NO: 23415 - DNA, 22 bp, Artificial Sequence
  chemically synthesized
acatccctgcttttcccttgct

SEQ ID NO: 23416 - DNA, 22 bp, Artificial Sequence
  chemically synthesized
cttttcccttgctctgcaagtt

SEQ ID NO: 23417 - DNA, 22 bp, Artificial Sequence
  chemically synthesized
ttcccttgctctgcaagttcct

SEQ ID NO: 23418 - DNA, 22 bp, Artificial Sequence
  chemically synthesized
tcccttgctctgcaagttcctt

SEQ ID NO: 23419 - DNA, 22 bp, Artificial Sequence
  chemically synthesized
cccttgctctgcaagttccttt

SEQ ID NO: 23420 - DNA, 22 bp, Artificial Sequence
  chemically synthesized
ccttgctctgcaagttcctttt

SEQ ID NO: 23421 - DNA, 22 bp, Artificial Sequence
  chemically synthesized
gctctgcaagttccttttgggc

SEQ ID NO: 23422 - DNA, 22 bp, Artificial Sequence
  chemically synthesized
ctctgcaagttccttttgggct

SEQ ID NO: 23423 - DNA, 22 bp, Artificial Sequence
  chemically synthesized
tgcaagttccttttgggctcac

SEQ ID NO: 23424 - DNA, 22 bp, Artificial Sequence
  chemically synthesized
caagttccttttgggctcactt

SEQ ID NO: 23425 - DNA, 22 bp, Artificial Sequence
  chemically synthesized
cttttgggctcactttttttct

SEQ ID NO: 23426 - DNA, 22 bp, Artificial Sequence
  chemically synthesized
ttgggctcactttttttctttg

SEQ ID NO: 23427 - DNA, 22 bp, Artificial Sequence
  chemically synthesized
tgggctcactttttttctttga

SEQ ID NO: 23428 - DNA, 22 bp, Artificial Sequence
  chemically synthesized
gggctcactttttttctttgaa

SEQ ID NO: 23429 - DNA, 22 bp, Artificial Sequence
  chemically synthesized
ggctcactttttttctttgaat

SEQ ID NO: 23430 - DNA, 22 bp, Artificial Sequence
  chemically synthesized
actttttttctttgaatttagc

SEQ ID NO: 23431 - DNA, 22 bp, Artificial Sequence
  chemically synthesized
tttttctttgaatttagcctag

SEQ ID NO: 23432 - DNA, 22 bp, Artificial Sequence
  chemically synthesized
ttttctttgaatttagcctaga

SEQ ID NO: 23433 - DNA, 22 bp, Artificial Sequence
  chemically synthesized
tttctttgaatttagcctagac

SEQ ID NO: 23434 - DNA, 22 bp, Artificial Sequence
  chemically synthesized
ttctttgaatttagcctagact

SEQ ID NO: 23435 - DNA, 22 bp, Artificial Sequence
  chemically synthesized
tctttgaatttagcctagactt

SEQ ID NO: 23436 - DNA, 22 bp, Artificial Sequence
  chemically synthesized
ctttgaatttagcctagacttt

SEQ ID NO: 23437 - DNA, 22 bp, Artificial Sequence
  chemically synthesized
tttgaatttagcctagactttt

SEQ ID NO: 23438 - DNA, 22 bp, Artificial Sequence
  chemically synthesized
tgaatttagcctagactttttc

SEQ ID NO: 23439 - DNA, 22 bp, Artificial Sequence
  chemically synthesized
gaatttagcctagactttttct

SEQ ID NO: 23440 - DNA, 22 bp, Artificial Sequence
  chemically synthesized
aatttagcctagactttttctc

SEQ ID NO: 23441 - DNA, 22 bp, Artificial Sequence
  chemically synthesized
agcctagactttttctcttcaa

SEQ ID NO: 23442 - DNA, 22 bp, Artificial Sequence
  chemically synthesized
gcctagactttttctcttcaac

SEQ ID NO: 23443 - DNA, 22 bp, Artificial Sequence
  chemically synthesized
gactttttctcttcaactcttt

SEQ ID NO: 23444 - DNA, 22 bp, Artificial Sequence
  chemically synthesized
tttctcttcaactctttttttt

SEQ ID NO: 23445 - DNA, 22 bp, Artificial Sequence
  chemically synthesized
ttctcttcaactcttttttttt

SEQ ID NO: 23446 - DNA, 22 bp, Artificial Sequence
  chemically synthesized
tctcttcaactctttttttttt

SEQ ID NO: 23447 - DNA, 22 bp, Artificial Sequence
  chemically synthesized
ctcttcaactcttttttttttg

SEQ ID NO: 23448 - DNA, 22 bp, Artificial Sequence
  chemically synthesized
tcttcaactcttttttttttga

SEQ ID NO: 23449 - DNA, 22 bp, Artificial Sequence
  chemically synthesized
ttcaactcttttttttttgaca

SEQ ID NO: 23450 - DNA, 22 bp, Artificial Sequence
  chemically synthesized
caactcttttttttttgacaga

SEQ ID NO: 23451 - DNA, 22 bp, Artificial Sequence
  chemically synthesized
aactcttttttttttgacagag

SEQ ID NO: 23452 - DNA, 22 bp, Artificial Sequence
  chemically synthesized
ttttttttttgacagagtcttg

SEQ ID NO: 23453 - DNA, 22 bp, Artificial Sequence
  chemically synthesized
ttttttttgacagagtcttgct

SEQ ID NO: 23454 - DNA, 22 bp, Artificial Sequence
  chemically synthesized
tttttttgacagagtcttgctc

SEQ ID NO: 23455 - DNA, 22 bp, Artificial Sequence
  chemically synthesized
ttttttgacagagtcttgctct

SEQ ID NO: 23456 - DNA, 22 bp, Artificial Sequence
  chemically synthesized
tttttgacagagtcttgctctg

SEQ ID NO: 23457 - DNA, 22 bp, Artificial Sequence
  chemically synthesized
ttttgacagagtcttgctctgt

SEQ ID NO: 23458 - DNA, 22 bp, Artificial Sequence
  chemically synthesized
tttgacagagtcttgctctgtc

SEQ ID NO: 23459 - DNA, 22 bp, Artificial Sequence
  chemically synthesized
ttgacagagtcttgctctgtcg

SEQ ID NO: 23460 - DNA, 22 bp, Artificial Sequence
  chemically synthesized
tgacagagtcttgctctgtcgc

SEQ ID NO: 23461 - DNA, 22 bp, Artificial Sequence
  chemically synthesized
gacagagtcttgctctgtcgcc

SEQ ID NO: 23462 - DNA, 22 bp, Artificial Sequence
  chemically synthesized
acagagtcttgctctgtcgccc

SEQ ID NO: 23463 - DNA, 22 bp, Artificial Sequence
  chemically synthesized
gctctgtcgcccaggctggagt

SEQ ID NO: 23464 - DNA, 22 bp, Artificial Sequence
  chemically synthesized
ctctgtcgcccaggctggagtg

SEQ ID NO: 23465 - DNA, 22 bp, Artificial Sequence
  chemically synthesized
tgtcgcccaggctggagtgcag

SEQ ID NO: 23466 - DNA, 22 bp, Artificial Sequence
  chemically synthesized
tcgcccaggctggagtgcagtg

SEQ ID NO: 23467 - DNA, 22 bp, Artificial Sequence
  chemically synthesized
gagtgcagtggtgcgatctcag

SEQ ID NO: 23468 - DNA, 22 bp, Artificial Sequence
  chemically synthesized
agctcactgcaacctccatctc

SEQ ID NO: 23469 - DNA, 22 bp, Artificial Sequence
  chemically synthesized
actgcaacctccatctcccagg

SEQ ID NO: 23470 - DNA, 22 bp, Artificial Sequence
  chemically synthesized
caacctccatctcccaggttca

SEQ ID NO: 23471 - DNA, 22 bp, Artificial Sequence
  chemically synthesized
catctcccaggttcaagctatt

SEQ ID NO: 23472 - DNA, 22 bp, Artificial Sequence
  chemically synthesized
ccaggttcaagctattctcctg

SEQ ID NO: 23473 - DNA, 22 bp, Artificial Sequence
  chemically synthesized
aagctattctcctgcctcagcc

SEQ ID NO: 23474 - DNA, 22 bp, Artificial Sequence
  chemically synthesized
ttctcctgcctcagcctcccaa

SEQ ID NO: 23475 - DNA, 22 bp, Artificial Sequence
  chemically synthesized
tcctgcctcagcctcccaagta

SEQ ID NO: 23476 - DNA, 22 bp, Artificial Sequence
  chemically synthesized
ctgcctcagcctcccaagtagc

SEQ ID NO: 23477 - DNA, 22 bp, Artificial Sequence
  chemically synthesized
cctcagcctcccaagtagctgg

SEQ ID NO: 23478 - DNA, 22 bp, Artificial Sequence
  chemically synthesized
agcctcccaagtagctgggatt

SEQ ID NO: 23479 - DNA, 22 bp, Artificial Sequence
  chemically synthesized
ccaagtagctgggattacaggc

SEQ ID NO: 23480 - DNA, 22 bp, Artificial Sequence
  chemically synthesized
ggattacaggcacccgccacca

SEQ ID NO: 23481 - DNA, 22 bp, Artificial Sequence
  chemically synthesized
caggcacccgccaccatgccca

SEQ ID NO: 23482 - DNA, 22 bp, Artificial Sequence
  chemically synthesized
atttttgtatttttagtaaagc

SEQ ID NO: 23483 - DNA, 22 bp, Artificial Sequence
  chemically synthesized
ttgtatttttagtaaagccggg

SEQ ID NO: 23484 - DNA, 22 bp, Artificial Sequence
  chemically synthesized
tgtatttttagtaaagccgggg

SEQ ID NO: 23485 - DNA, 22 bp, Artificial Sequence
  chemically synthesized
gtatttttagtaaagccggggt

SEQ ID NO: 23486 - DNA, 22 bp, Artificial Sequence
  chemically synthesized
tatttttagtaaagccggggtt

SEQ ID NO: 23487 - DNA, 22 bp, Artificial Sequence
  chemically synthesized
ttagtaaagccggggtttcacc

SEQ ID NO: 23488 - DNA, 22 bp, Artificial Sequence
  chemically synthesized
tagtaaagccggggtttcacca

SEQ ID NO: 23489 - DNA, 22 bp, Artificial Sequence
  chemically synthesized
agtaaagccggggtttcaccat

SEQ ID NO: 23490 - DNA, 22 bp, Artificial Sequence
  chemically synthesized
gtaaagccggggtttcaccatt

SEQ ID NO: 23491 - DNA, 22 bp, Artificial Sequence
  chemically synthesized
caccatttcaccttgttggcca

SEQ ID NO: 23492 - DNA, 22 bp, Artificial Sequence
  chemically synthesized
accatttcaccttgttggccag

SEQ ID NO: 23493 - DNA, 22 bp, Artificial Sequence
  chemically synthesized
caccttgttggccaggctggtg

SEQ ID NO: 23494 - DNA, 22 bp, Artificial Sequence
  chemically synthesized
accttgttggccaggctggtgt

SEQ ID NO: 23495 - DNA, 22 bp, Artificial Sequence
  chemically synthesized
gttggccaggctggtgtcgaac

SEQ ID NO: 23496 - DNA, 22 bp, Artificial Sequence
  chemically synthesized
ttggccaggctggtgtcgaact

SEQ ID NO: 23497 - DNA, 22 bp, Artificial Sequence
  chemically synthesized
gccaggctggtgtcgaactcct

SEQ ID NO: 23498 - DNA, 22 bp, Artificial Sequence
  chemically synthesized
gtgtcgaactcctgacctcaag

SEQ ID NO: 23499 - DNA, 22 bp, Artificial Sequence
  chemically synthesized
ctgacctcaagtgatctgcctg

SEQ ID NO: 23500 - DNA, 22 bp, Artificial Sequence
  chemically synthesized
acctcaagtgatctgcctgcct

SEQ ID NO: 23501 - DNA, 22 bp, Artificial Sequence
  chemically synthesized
aagtgatctgcctgcctgggcc

SEQ ID NO: 23502 - DNA, 22 bp, Artificial Sequence
  chemically synthesized
cctgcctgggcctctgaaagtg

SEQ ID NO: 23503 - DNA, 22 bp, Artificial Sequence
  chemically synthesized
cctgggcctctgaaagtgctgg

SEQ ID NO: 23504 - DNA, 22 bp, Artificial Sequence
  chemically synthesized
ggcctctgaaagtgctgggatt

SEQ ID NO: 23505 - DNA, 22 bp, Artificial Sequence
  chemically synthesized
tgaaagtgctgggattataggt

SEQ ID NO: 23506 - DNA, 22 bp, Artificial Sequence
  chemically synthesized
aaagtgctgggattataggtgt

SEQ ID NO: 23507 - DNA, 22 bp, Artificial Sequence
  chemically synthesized
ggattataggtgtgagccacca

SEQ ID NO: 23508 - DNA, 22 bp, Artificial Sequence
  chemically synthesized
taggtgtgagccaccatgccag

SEQ ID NO: 23509 - DNA, 22 bp, Artificial Sequence
  chemically synthesized
tcttcaactcttcattggccat

SEQ ID NO: 23510 - DNA, 22 bp, Artificial Sequence
  chemically synthesized
ttcaactcttcattggccatat

SEQ ID NO: 23511 - DNA, 22 bp, Artificial Sequence
  chemically synthesized
caactcttcattggccatattt

SEQ ID NO: 23512 - DNA, 22 bp, Artificial Sequence
  chemically synthesized
aactcttcattggccatatttc

SEQ ID NO: 23513 - DNA, 22 bp, Artificial Sequence
  chemically synthesized
ttcattggccatatttctcaat

SEQ ID NO: 23514 - DNA, 22 bp, Artificial Sequence
  chemically synthesized
cattggccatatttctcaattt

SEQ ID NO: 23515 - DNA, 22 bp, Artificial Sequence
  chemically synthesized
attggccatatttctcaatttc

SEQ ID NO: 23516 - DNA, 22 bp, Artificial Sequence
  chemically synthesized
gccatatttctcaatttccttc

SEQ ID NO: 23517 - DNA, 22 bp, Artificial Sequence
  chemically synthesized
ctcaatttccttcactcgtttg

SEQ ID NO: 23518 - DNA, 22 bp, Artificial Sequence
  chemically synthesized
tcaatttccttcactcgtttgc

SEQ ID NO: 23519 - DNA, 22 bp, Artificial Sequence
  chemically synthesized
aatttccttcactcgtttgcaa

SEQ ID NO: 23520 - DNA, 22 bp, Artificial Sequence
  chemically synthesized
ccttcactcgtttgcaatgctg

SEQ ID NO: 23521 - DNA, 22 bp, Artificial Sequence
  chemically synthesized
cttcactcgtttgcaatgctgt

SEQ ID NO: 23522 - DNA, 22 bp, Artificial Sequence
  chemically synthesized
cactcgtttgcaatgctgtgcc

SEQ ID NO: 23523 - DNA, 22 bp, Artificial Sequence
  chemically synthesized
actcgtttgcaatgctgtgccc

SEQ ID NO: 23524 - DNA, 22 bp, Artificial Sequence
  chemically synthesized
gtttgcaatgctgtgcccaccc

SEQ ID NO: 23525 - DNA, 22 bp, Artificial Sequence
  chemically synthesized
gcaatgctgtgcccaccctgca

SEQ ID NO: 23526 - DNA, 22 bp, Artificial Sequence
  chemically synthesized
caatgctgtgcccaccctgcaa

SEQ ID NO: 23527 - DNA, 22 bp, Artificial Sequence
  chemically synthesized
tgcccaccctgcaatcctagcc

SEQ ID NO: 23528 - DNA, 22 bp, Artificial Sequence
  chemically synthesized
caatcctagcccctaaattgga

SEQ ID NO: 23529 - DNA, 22 bp, Artificial Sequence
  chemically synthesized
gcccctaaattggagcagccat

SEQ ID NO: 23530 - DNA, 22 bp, Artificial Sequence
  chemically synthesized
aattggagcagccatctgcctt

SEQ ID NO: 23531 - DNA, 22 bp, Artificial Sequence
  chemically synthesized
gagcagccatctgccttcatcc

SEQ ID NO: 23532 - DNA, 22 bp, Artificial Sequence
  chemically synthesized
ccttcatccttctcttcccaga

SEQ ID NO: 23533 - DNA, 22 bp, Artificial Sequence
  chemically synthesized
catccttctcttcccagacagc

SEQ ID NO: 23534 - DNA, 22 bp, Artificial Sequence
  chemically synthesized
atccttctcttcccagacagcc

SEQ ID NO: 23535 - DNA, 22 bp, Artificial Sequence
  chemically synthesized
ctcttcccagacagccgaggac

SEQ ID NO: 23536 - DNA, 22 bp, Artificial Sequence
  chemically synthesized
tcttcccagacagccgaggact

SEQ ID NO: 23537 - DNA, 22 bp, Artificial Sequence
  chemically synthesized
ttcccagacagccgaggactgt

SEQ ID NO: 23538 - DNA, 22 bp, Artificial Sequence
  chemically synthesized
cccagacagccgaggactgtga

SEQ ID NO: 23539 - DNA, 22 bp, Artificial Sequence
  chemically synthesized
ccagacagccgaggactgtgaa

SEQ ID NO: 23540 - DNA, 22 bp, Artificial Sequence
  chemically synthesized
tgaaggaaaaaaatcaccaaaa

SEQ ID NO: 23541 - DNA, 22 bp, Artificial Sequence
  chemically synthesized
atgcctcacagcctccacccac

SEQ ID NO: 23542 - DNA, 22 bp, Artificial Sequence
  chemically synthesized
acagcctccacccacctctctg

SEQ ID NO: 23543 - DNA, 22 bp, Artificial Sequence
  chemically synthesized
cacccacctctctgctcagcaa

SEQ ID NO: 23544 - DNA, 22 bp, Artificial Sequence
  chemically synthesized
tctgctcagcaactcatttact

SEQ ID NO: 23545 - DNA, 22 bp, Artificial Sequence
  chemically synthesized
tgctcagcaactcatttacttg

SEQ ID NO: 23546 - DNA, 22 bp, Artificial Sequence
  chemically synthesized
ctcagcaactcatttacttggc

SEQ ID NO: 23547 - DNA, 22 bp, Artificial Sequence
  chemically synthesized
agcaactcatttacttggccct

SEQ ID NO: 23548 - DNA, 22 bp, Artificial Sequence
  chemically synthesized
atttacttggccctggacactc

SEQ ID NO: 23549 - DNA, 22 bp, Artificial Sequence
  chemically synthesized
acttggccctggacactcctaa

SEQ ID NO: 23550 - DNA, 22 bp, Artificial Sequence
  chemically synthesized
cttggccctggacactcctaaa

SEQ ID NO: 23551 - DNA, 22 bp, Artificial Sequence
  chemically synthesized
ggccctggacactcctaaatag

SEQ ID NO: 23552 - DNA, 22 bp, Artificial Sequence
  chemically synthesized
gccctggacactcctaaatagc

SEQ ID NO: 23553 - DNA, 22 bp, Artificial Sequence
  chemically synthesized
gacactcctaaatagcatccat

SEQ ID NO: 23554 - DNA, 22 bp, Artificial Sequence
  chemically synthesized
ctaaatagcatccatgcctgca

SEQ ID NO: 23555 - DNA, 22 bp, Artificial Sequence
  chemically synthesized
aatagcatccatgcctgcatcc

SEQ ID NO: 23556 - DNA, 22 bp, Artificial Sequence
  chemically synthesized
catccatttacagtcgttcctc

SEQ ID NO: 23557 - DNA, 22 bp, Artificial Sequence
  chemically synthesized
acagtcgttcctcagtatccat

SEQ ID NO: 23558 - DNA, 22 bp, Artificial Sequence
  chemically synthesized
cagtcgttcctcagtatccatg

SEQ ID NO: 23559 - DNA, 22 bp, Artificial Sequence
  chemically synthesized
ctcagtatccatggaaaattgg

SEQ ID NO: 23560 - DNA, 22 bp, Artificial Sequence
  chemically synthesized
agtatccatggaaaattggtgg

SEQ ID NO: 23561 - DNA, 22 bp, Artificial Sequence
  chemically synthesized
gtggcaagaccccctgcaaata

SEQ ID NO: 23562 - DNA, 22 bp, Artificial Sequence
  chemically synthesized
caaatatcaagatctgtggatg

SEQ ID NO: 23563 - DNA, 22 bp, Artificial Sequence
  chemically synthesized
tggatgctcaagtctccgatat

SEQ ID NO: 23564 - DNA, 22 bp, Artificial Sequence
  chemically synthesized
aagtctccgatataaaaatggc

SEQ ID NO: 23565 - DNA, 22 bp, Artificial Sequence
  chemically synthesized
cgatataaaaatggcttactat

SEQ ID NO: 23566 - DNA, 22 bp, Artificial Sequence
  chemically synthesized
actatttgcatataacctaaac

SEQ ID NO: 23567 - DNA, 22 bp, Artificial Sequence
  chemically synthesized
ctatttgcatataacctaaaca

SEQ ID NO: 23568 - DNA, 22 bp, Artificial Sequence
  chemically synthesized
tttgcatataacctaaacacat

SEQ ID NO: 23569 - DNA, 22 bp, Artificial Sequence
  chemically synthesized
gcatataacctaaacacatcct

SEQ ID NO: 23570 - DNA, 22 bp, Artificial Sequence
  chemically synthesized
catataacctaaacacatcctc

SEQ ID NO: 23571 - DNA, 22 bp, Artificial Sequence
  chemically synthesized
aacacatcctcctttgtacttt

SEQ ID NO: 23572 - DNA, 22 bp, Artificial Sequence
  chemically synthesized
ctttgtactttaaatcatctct

SEQ ID NO: 23573 - DNA, 22 bp, Artificial Sequence
  chemically synthesized
tgtactttaaatcatctctagg

SEQ ID NO: 23574 - DNA, 22 bp, Artificial Sequence
  chemically synthesized
gtactttaaatcatctctaggt

SEQ ID NO: 23575 - DNA, 22 bp, Artificial Sequence
  chemically synthesized
tactttaaatcatctctaggtt

SEQ ID NO: 23576 - DNA, 22 bp, Artificial Sequence
  chemically synthesized
taaatcatctctaggtttctct

SEQ ID NO: 23577 - DNA, 22 bp, Artificial Sequence
  chemically synthesized
aaatcatctctaggtttctctt

SEQ ID NO: 23578 - DNA, 22 bp, Artificial Sequence
  chemically synthesized
aatcatctctaggtttctctta

SEQ ID NO: 23579 - DNA, 22 bp, Artificial Sequence
  chemically synthesized
taggtttctcttaatagctaat

SEQ ID NO: 23580 - DNA, 22 bp, Artificial Sequence
  chemically synthesized
ggtttctcttaatagctaatac

SEQ ID NO: 23581 - DNA, 22 bp, Artificial Sequence
  chemically synthesized
ctcttaatagctaatacaatgt

SEQ ID NO: 23582 - DNA, 22 bp, Artificial Sequence
  chemically synthesized
tcttaatagctaatacaatgta

SEQ ID NO: 23583 - DNA, 22 bp, Artificial Sequence
  chemically synthesized
ttaatagctaatacaatgtaaa

SEQ ID NO: 23584 - DNA, 22 bp, Artificial Sequence
  chemically synthesized
aatagctaatacaatgtaaatg

SEQ ID NO: 23585 - DNA, 22 bp, Artificial Sequence
  chemically synthesized
atagctaatacaatgtaaatgc

SEQ ID NO: 23586 - DNA, 22 bp, Artificial Sequence
  chemically synthesized
atacaatgtaaatgctatgtaa

SEQ ID NO: 23587 - DNA, 22 bp, Artificial Sequence
  chemically synthesized
tgtaaatagttgttatgctgta

SEQ ID NO: 23588 - DNA, 22 bp, Artificial Sequence
  chemically synthesized
ttatgctgtattgtttagggaa

SEQ ID NO: 23589 - DNA, 22 bp, Artificial Sequence
  chemically synthesized
tgctgtattgtttagggaataa

SEQ ID NO: 23590 - DNA, 22 bp, Artificial Sequence
  chemically synthesized
tattgtttagggaataatgaaa

SEQ ID NO: 23591 - DNA, 22 bp, Artificial Sequence
  chemically synthesized
tttagggaataatgaaagataa

SEQ ID NO: 23592 - DNA, 22 bp, Artificial Sequence
  chemically synthesized
agggaataatgaaagataaaag

SEQ ID NO: 23593 - DNA, 22 bp, Artificial Sequence
  chemically synthesized
gggaataatgaaagataaaaga

SEQ ID NO: 23594 - DNA, 22 bp, Artificial Sequence
  chemically synthesized
tacatgttcagtagagatgcaa

SEQ ID NO: 23595 - DNA, 22 bp, Artificial Sequence
  chemically synthesized
agtagagatgcaaccatccatt

SEQ ID NO: 23596 - DNA, 22 bp, Artificial Sequence
  chemically synthesized
ttttcttgaatatttttgatct

SEQ ID NO: 23597 - DNA, 22 bp, Artificial Sequence
  chemically synthesized
tttcttgaatatttttgatctg

SEQ ID NO: 23598 - DNA, 22 bp, Artificial Sequence
  chemically synthesized
ttcttgaatatttttgatctgc

SEQ ID NO: 23599 - DNA, 22 bp, Artificial Sequence
  chemically synthesized
tcttgaatatttttgatctgca

SEQ ID NO: 23600 - DNA, 22 bp, Artificial Sequence
  chemically synthesized
cttgaatatttttgatctgcag

SEQ ID NO: 23601 - DNA, 22 bp, Artificial Sequence
  chemically synthesized
ttgaatatttttgatctgcagt

SEQ ID NO: 23602 - DNA, 22 bp, Artificial Sequence
  chemically synthesized
gaatatttttgatctgcagtta

SEQ ID NO: 23603 - DNA, 22 bp, Artificial Sequence
  chemically synthesized
aatatttttgatctgcagttaa

SEQ ID NO: 23604 - DNA, 22 bp, Artificial Sequence
  chemically synthesized
ttgatctgcagttaattgaatc

SEQ ID NO: 23605 - DNA, 22 bp, Artificial Sequence
  chemically synthesized
tgatctgcagttaattgaatct

SEQ ID NO: 23606 - DNA, 22 bp, Artificial Sequence
  chemically synthesized
gatctgcagttaattgaatctg

SEQ ID NO: 23607 - DNA, 22 bp, Artificial Sequence
  chemically synthesized
atctgcagttaattgaatctgt

SEQ ID NO: 23608 - DNA, 22 bp, Artificial Sequence
  chemically synthesized
cagttaattgaatctgtggctg

SEQ ID NO: 23609 - DNA, 22 bp, Artificial Sequence
  chemically synthesized
attgaatctgtggctgtggaac

SEQ ID NO: 23610 - DNA, 22 bp, Artificial Sequence
  chemically synthesized
aatctgtggctgtggaactcac

SEQ ID NO: 23611 - DNA, 22 bp, Artificial Sequence
  chemically synthesized
tggctgtggaactcacaaggag

SEQ ID NO: 23612 - DNA, 22 bp, Artificial Sequence
  chemically synthesized
tggaactcacaaggagagctga

SEQ ID NO: 23613 - DNA, 22 bp, Artificial Sequence
  chemically synthesized
acaaggagagctgactgtacag

SEQ ID NO: 23614 - DNA, 22 bp, Artificial Sequence
  chemically synthesized
actgtacagtgtggttgagtga

SEQ ID NO: 23615 - DNA, 22 bp, Artificial Sequence
  chemically synthesized
tacagtgtggttgagtgaaaaa

SEQ ID NO: 23616 - DNA, 22 bp, Artificial Sequence
  chemically synthesized
agtgaaaaaacagactttagaa

SEQ ID NO: 23617 - DNA, 22 bp, Artificial Sequence
  chemically synthesized
tagaatcagatcagacagaaat

SEQ ID NO: 23618 - DNA, 22 bp, Artificial Sequence
  chemically synthesized
agaatcagatcagacagaaata

SEQ ID NO: 23619 - DNA, 22 bp, Artificial Sequence
  chemically synthesized
gaatcagatcagacagaaatag

SEQ ID NO: 23620 - DNA, 22 bp, Artificial Sequence
  chemically synthesized
gaatcaagtatctgcctcctct

SEQ ID NO: 23621 - DNA, 22 bp, Artificial Sequence
  chemically synthesized
aatcaagtatctgcctcctcta

SEQ ID NO: 23622 - DNA, 22 bp, Artificial Sequence
  chemically synthesized
cctcctctagacctgtgacctt

SEQ ID NO: 23623 - DNA, 22 bp, Artificial Sequence
  chemically synthesized
ctctagacctgtgaccttggac

SEQ ID NO: 23624 - DNA, 22 bp, Artificial Sequence
  chemically synthesized
tagacctgtgaccttggacaag

SEQ ID NO: 23625 - DNA, 22 bp, Artificial Sequence
  chemically synthesized
gacctgtgaccttggacaagtc

SEQ ID NO: 23626 - DNA, 22 bp, Artificial Sequence
  chemically synthesized
tgaccttggacaagtcacacaa

SEQ ID NO: 23627 - DNA, 22 bp, Artificial Sequence
  chemically synthesized
ggacaagtcacacaagctctga

SEQ ID NO: 23628 - DNA, 22 bp, Artificial Sequence
  chemically synthesized
gacaagtcacacaagctctgaa

SEQ ID NO: 23629 - DNA, 22 bp, Artificial Sequence
  chemically synthesized
tgaaccttaactttgtcaaatg

SEQ ID NO: 23630 - DNA, 22 bp, Artificial Sequence
  chemically synthesized
aaccttaactttgtcaaatgta

SEQ ID NO: 23631 - DNA, 22 bp, Artificial Sequence
  chemically synthesized
aactttgtcaaatgtaaattag

SEQ ID NO: 23632 - DNA, 22 bp, Artificial Sequence
  chemically synthesized
actttgtcaaatgtaaattagg

SEQ ID NO: 23633 - DNA, 22 bp, Artificial Sequence
  chemically synthesized
tgtcaaatgtaaattaggttta

SEQ ID NO: 23634 - DNA, 22 bp, Artificial Sequence
  chemically synthesized
gtcaaatgtaaattaggtttaa

SEQ ID NO: 23635 - DNA, 22 bp, Artificial Sequence
  chemically synthesized
tcaaatgtaaattaggtttaac

SEQ ID NO: 23636 - DNA, 22 bp, Artificial Sequence
  chemically synthesized
ggtttaacagtagtataataag

SEQ ID NO: 23637 - DNA, 22 bp, Artificial Sequence
  chemically synthesized
aacagtagtataataagaatat

SEQ ID NO: 23638 - DNA, 22 bp, Artificial Sequence
  chemically synthesized
acagtagtataataagaatatc

SEQ ID NO: 23639 - DNA, 22 bp, Artificial Sequence
  chemically synthesized
tctcacaggtgttggcaggatc

SEQ ID NO: 23640 - DNA, 22 bp, Artificial Sequence
  chemically synthesized
acaggtgttggcaggatcagtg

SEQ ID NO: 23641 - DNA, 22 bp, Artificial Sequence
  chemically synthesized
gcaggatcagtgagacaatatg

SEQ ID NO: 23642 - DNA, 22 bp, Artificial Sequence
  chemically synthesized
gttatctctttttctccctact

SEQ ID NO: 23643 - DNA, 22 bp, Artificial Sequence
  chemically synthesized
tctctttttctccctactcctt

SEQ ID NO: 23644 - DNA, 22 bp, Artificial Sequence
  chemically synthesized
tttttctccctactcctttcat

SEQ ID NO: 23645 - DNA, 22 bp, Artificial Sequence
  chemically synthesized
tttctccctactcctttcatgt

SEQ ID NO: 23646 - DNA, 22 bp, Artificial Sequence
  chemically synthesized
ttctccctactcctttcatgtt

SEQ ID NO: 23647 - DNA, 22 bp, Artificial Sequence
  chemically synthesized
tctccctactcctttcatgttg

SEQ ID NO: 23648 - DNA, 22 bp, Artificial Sequence
  chemically synthesized
ctccctactcctttcatgttgg

SEQ ID NO: 23649 - DNA, 22 bp, Artificial Sequence
  chemically synthesized
tccctactcctttcatgttggc

SEQ ID NO: 23650 - DNA, 22 bp, Artificial Sequence
  chemically synthesized
cctactcctttcatgttggccc

SEQ ID NO: 23651 - DNA, 22 bp, Artificial Sequence
  chemically synthesized
ctcctttcatgttggccctact

SEQ ID NO: 23652 - DNA, 22 bp, Artificial Sequence
  chemically synthesized
ctttcatgttggccctactttc

SEQ ID NO: 23653 - DNA, 22 bp, Artificial Sequence
  chemically synthesized
tcatgttggccctactttcttc

SEQ ID NO: 23654 - DNA, 22 bp, Artificial Sequence
  chemically synthesized
catgttggccctactttcttct

SEQ ID NO: 23655 - DNA, 22 bp, Artificial Sequence
  chemically synthesized
atgttggccctactttcttctg

SEQ ID NO: 23656 - DNA, 22 bp, Artificial Sequence
  chemically synthesized
gccctactttcttctgttttaa

SEQ ID NO: 23657 - DNA, 22 bp, Artificial Sequence
  chemically synthesized
ctttcttctgttttaaatttct

SEQ ID NO: 23658 - DNA, 22 bp, Artificial Sequence
  chemically synthesized
tcttctgttttaaatttctcaa

SEQ ID NO: 23659 - DNA, 22 bp, Artificial Sequence
  chemically synthesized
cttctgttttaaatttctcaat

SEQ ID NO: 23660 - DNA, 22 bp, Artificial Sequence
  chemically synthesized
ttctgttttaaatttctcaatt

SEQ ID NO: 23661 - DNA, 22 bp, Artificial Sequence
  chemically synthesized
ctgttttaaatttctcaattct

SEQ ID NO: 23662 - DNA, 22 bp, Artificial Sequence
  chemically synthesized
tgttttaaatttctcaattctc

SEQ ID NO: 23663 - DNA, 22 bp, Artificial Sequence
  chemically synthesized
ttttaaatttctcaattctctt

SEQ ID NO: 23664 - DNA, 22 bp, Artificial Sequence
  chemically synthesized
taaatttctcaattctctttag

SEQ ID NO: 23665 - DNA, 22 bp, Artificial Sequence
  chemically synthesized
aaatttctcaattctctttagc

SEQ ID NO: 23666 - DNA, 22 bp, Artificial Sequence
  chemically synthesized
aatttctcaattctctttagct

SEQ ID NO: 23667 - DNA, 22 bp, Artificial Sequence
  chemically synthesized
ctcaattctctttagctcttta

SEQ ID NO: 23668 - DNA, 22 bp, Artificial Sequence
  chemically synthesized
tcaattctctttagctctttaa

SEQ ID NO: 23669 - DNA, 22 bp, Artificial Sequence
  chemically synthesized
aattctctttagctctttaata

SEQ ID NO: 23670 - DNA, 22 bp, Artificial Sequence
  chemically synthesized
tctttagctctttaataacttc

SEQ ID NO: 23671 - DNA, 22 bp, Artificial Sequence
  chemically synthesized
tttagctctttaataacttctg

SEQ ID NO: 23672 - DNA, 22 bp, Artificial Sequence
  chemically synthesized
tagctctttaataacttctgtg

SEQ ID NO: 23673 - DNA, 22 bp, Artificial Sequence
  chemically synthesized
agctctttaataacttctgtgt

SEQ ID NO: 23674 - DNA, 22 bp, Artificial Sequence
  chemically synthesized
gctctttaataacttctgtgta

SEQ ID NO: 23675 - DNA, 22 bp, Artificial Sequence
  chemically synthesized
tttaataacttctgtgtagctc

SEQ ID NO: 23676 - DNA, 22 bp, Artificial Sequence
  chemically synthesized
taataacttctgtgtagctctt

SEQ ID NO: 23677 - DNA, 22 bp, Artificial Sequence
  chemically synthesized
aataacttctgtgtagctcttt

SEQ ID NO: 23678 - DNA, 22 bp, Artificial Sequence
  chemically synthesized
ataacttctgtgtagctctttt

SEQ ID NO: 23679 - DNA, 22 bp, Artificial Sequence
  chemically synthesized
ctgtgtagctcttttccttcct

SEQ ID NO: 23680 - DNA, 22 bp, Artificial Sequence
  chemically synthesized
tgtgtagctcttttccttcctt

SEQ ID NO: 23681 - DNA, 22 bp, Artificial Sequence
  chemically synthesized
tgtagctcttttccttccttaa

SEQ ID NO: 23682 - DNA, 22 bp, Artificial Sequence
  chemically synthesized
ttttccttccttaatcacattt

SEQ ID NO: 23683 - DNA, 22 bp, Artificial Sequence
  chemically synthesized
ttccttccttaatcacatttat

SEQ ID NO: 23684 - DNA, 22 bp, Artificial Sequence
  chemically synthesized
tccttccttaatcacatttata

SEQ ID NO: 23685 - DNA, 22 bp, Artificial Sequence
  chemically synthesized
ccttccttaatcacatttatat

SEQ ID NO: 23686 - DNA, 22 bp, Artificial Sequence
  chemically synthesized
cttccttaatcacatttatata

SEQ ID NO: 23687 - DNA, 22 bp, Artificial Sequence
  chemically synthesized
ccttaatcacatttatataatg

SEQ ID NO: 23688 - DNA, 22 bp, Artificial Sequence
  chemically synthesized
cttaatcacatttatataatga

SEQ ID NO: 23689 - DNA, 22 bp, Artificial Sequence
  chemically synthesized
aatcacatttatataatgaaat

SEQ ID NO: 23690 - DNA, 22 bp, Artificial Sequence
  chemically synthesized
atcacatttatataatgaaatg

SEQ ID NO: 23691 - DNA, 22 bp, Artificial Sequence
  chemically synthesized
atataatgaaatgactattgtc

SEQ ID NO: 23692 - DNA, 22 bp, Artificial Sequence
  chemically synthesized
tataatgaaatgactattgtca

SEQ ID NO: 23693 - DNA, 22 bp, Artificial Sequence
  chemically synthesized
ttgtcacaatcaggaatgacct

SEQ ID NO: 23694 - DNA, 22 bp, Artificial Sequence
  chemically synthesized
tcacaatcaggaatgacctaaa

SEQ ID NO: 23695 - DNA, 22 bp, Artificial Sequence
  chemically synthesized
aagaataattttgagtttatgt

SEQ ID NO: 23696 - DNA, 22 bp, Artificial Sequence
  chemically synthesized
tgagtttatgtatttactggct

SEQ ID NO: 23697 - DNA, 22 bp, Artificial Sequence
  chemically synthesized
gagtttatgtatttactggctg

SEQ ID NO: 23698 - DNA, 22 bp, Artificial Sequence
  chemically synthesized
agtttatgtatttactggctgc

SEQ ID NO: 23699 - DNA, 22 bp, Artificial Sequence
  chemically synthesized
atgtatttactggctgctctaa

SEQ ID NO: 23700 - DNA, 22 bp, Artificial Sequence
  chemically synthesized
tgtatttactggctgctctaaa

SEQ ID NO: 23701 - DNA, 22 bp, Artificial Sequence
  chemically synthesized
actggctgctctaaataatttc

SEQ ID NO: 23702 - DNA, 22 bp, Artificial Sequence
  chemically synthesized
ctggctgctctaaataatttct

SEQ ID NO: 23703 - DNA, 22 bp, Artificial Sequence
  chemically synthesized
gctgctctaaataatttctaat

SEQ ID NO: 23704 - DNA, 22 bp, Artificial Sequence
  chemically synthesized
ctctaaataatttctaattgtt

SEQ ID NO: 23705 - DNA, 22 bp, Artificial Sequence
  chemically synthesized
taaataatttctaattgttgat

SEQ ID NO: 23706 - DNA, 22 bp, Artificial Sequence
  chemically synthesized
aataatttctaattgttgatct

SEQ ID NO: 23707 - DNA, 22 bp, Artificial Sequence
  chemically synthesized
ctaattgttgatctctcccttt

SEQ ID NO: 23708 - DNA, 22 bp, Artificial Sequence
  chemically synthesized
taattgttgatctctccctttt

SEQ ID NO: 23709 - DNA, 22 bp, Artificial Sequence
  chemically synthesized
attgttgatctctcccttttta

SEQ ID NO: 23710 - DNA, 22 bp, Artificial Sequence
  chemically synthesized
ttgatctctccctttttaggaa

SEQ ID NO: 23711 - DNA, 22 bp, Artificial Sequence
  chemically synthesized
atctctccctttttaggaaact

SEQ ID NO: 23712 - DNA, 22 bp, Artificial Sequence
  chemically synthesized
tccctttttaggaaactctttt

SEQ ID NO: 23713 - DNA, 22 bp, Artificial Sequence
  chemically synthesized
cctttttaggaaactcttttta

SEQ ID NO: 23714 - DNA, 22 bp, Artificial Sequence
  chemically synthesized
tttaggaaactctttttataat

SEQ ID NO: 23715 - DNA, 22 bp, Artificial Sequence
  chemically synthesized
ttaggaaactctttttataata

SEQ ID NO: 23716 - DNA, 22 bp, Artificial Sequence
  chemically synthesized
taggaaactctttttataataa

SEQ ID NO: 23717 - DNA, 22 bp, Artificial Sequence
  chemically synthesized
aggaaactctttttataataat

SEQ ID NO: 23718 - DNA, 22 bp, Artificial Sequence
  chemically synthesized
ggaaactctttttataataatc

SEQ ID NO: 23719 - DNA, 22 bp, Artificial Sequence
  chemically synthesized
tttttataataatcactctatt

SEQ ID NO: 23720 - DNA, 22 bp, Artificial Sequence
  chemically synthesized
tttataataatcactctattct

SEQ ID NO: 23721 - DNA, 22 bp, Artificial Sequence
  chemically synthesized
ttataataatcactctattctg

SEQ ID NO: 23722 - DNA, 22 bp, Artificial Sequence
  chemically synthesized
tataataatcactctattctgg

SEQ ID NO: 23723 - DNA, 22 bp, Artificial Sequence
  chemically synthesized
ataataatcactctattctggt

SEQ ID NO: 23724 - DNA, 22 bp, Artificial Sequence
  chemically synthesized
taataatcactctattctggtt

SEQ ID NO: 23725 - DNA, 22 bp, Artificial Sequence
  chemically synthesized
tattctggttccccgctttgct

SEQ ID NO: 23726 - DNA, 22 bp, Artificial Sequence
  chemically synthesized
ttctggttccccgctttgctct

SEQ ID NO: 23727 - DNA, 22 bp, Artificial Sequence
  chemically synthesized
tggttccccgctttgctctaac

SEQ ID NO: 23728 - DNA, 22 bp, Artificial Sequence
  chemically synthesized
gttccccgctttgctctaactc

SEQ ID NO: 23729 - DNA, 22 bp, Artificial Sequence
  chemically synthesized
cccgctttgctctaactcctgt

SEQ ID NO: 23730 - DNA, 22 bp, Artificial Sequence
  chemically synthesized
tgctctaactcctgttatccat

SEQ ID NO: 23731 - DNA, 22 bp, Artificial Sequence
  chemically synthesized
gctctaactcctgttatccatc

SEQ ID NO: 23732 - DNA, 22 bp, Artificial Sequence
  chemically synthesized
ctctaactcctgttatccatcc

SEQ ID NO: 23733 - DNA, 22 bp, Artificial Sequence
  chemically synthesized
taactcctgttatccatccagc

SEQ ID NO: 23734 - DNA, 22 bp, Artificial Sequence
  chemically synthesized
actcctgttatccatccagcac

SEQ ID NO: 23735 - DNA, 22 bp, Artificial Sequence
  chemically synthesized
ctgttatccatccagcacttga

SEQ ID NO: 23736 - DNA, 22 bp, Artificial Sequence
  chemically synthesized
ttatccatccagcacttgaatt

SEQ ID NO: 23737 - DNA, 22 bp, Artificial Sequence
  chemically synthesized
tccatccagcacttgaattgat

SEQ ID NO: 23738 - DNA, 22 bp, Artificial Sequence
  chemically synthesized
gaattgattaactcctgttcct

SEQ ID NO: 23739 - DNA, 22 bp, Artificial Sequence
  chemically synthesized
aattgattaactcctgttcctc

SEQ ID NO: 23740 - DNA, 22 bp, Artificial Sequence
  chemically synthesized
attaactcctgttcctctccat

SEQ ID NO: 23741 - DNA, 22 bp, Artificial Sequence
  chemically synthesized
actcctgttcctctccatggcc

SEQ ID NO: 23742 - DNA, 22 bp, Artificial Sequence
  chemically synthesized
ctgttcctctccatggccctta

SEQ ID NO: 23743 - DNA, 22 bp, Artificial Sequence
  chemically synthesized
ttcctctccatggcccttaaat

SEQ ID NO: 23744 - DNA, 22 bp, Artificial Sequence
  chemically synthesized
ctctccatggcccttaaatgtc

SEQ ID NO: 23745 - DNA, 22 bp, Artificial Sequence
  chemically synthesized
tccatggcccttaaatgtccag

SEQ ID NO: 23746 - DNA, 22 bp, Artificial Sequence
  chemically synthesized
catggcccttaaatgtccaggg

SEQ ID NO: 23747 - DNA, 22 bp, Artificial Sequence
  chemically synthesized
aaatgtccagggttctcccagg

SEQ ID NO: 23748 - DNA, 22 bp, Artificial Sequence
  chemically synthesized
aatgtccagggttctcccaggc

SEQ ID NO: 23749 - DNA, 22 bp, Artificial Sequence
  chemically synthesized
tcccaggctccagcctcagctt

SEQ ID NO: 23750 - DNA, 22 bp, Artificial Sequence
  chemically synthesized
ccaggctccagcctcagctttt

SEQ ID NO: 23751 - DNA, 22 bp, Artificial Sequence
  chemically synthesized
cagcctcagctttttccttttt

SEQ ID NO: 23752 - DNA, 22 bp, Artificial Sequence
  chemically synthesized
agctttttcctttttcacctta

SEQ ID NO: 23753 - DNA, 22 bp, Artificial Sequence
  chemically synthesized
tttcctttttcaccttatatat

SEQ ID NO: 23754 - DNA, 22 bp, Artificial Sequence
  chemically synthesized
ttcctttttcaccttatatata

SEQ ID NO: 23755 - DNA, 22 bp, Artificial Sequence
  chemically synthesized
tcctttttcaccttatatatac

SEQ ID NO: 23756 - DNA, 22 bp, Artificial Sequence
  chemically synthesized
cctttttcaccttatatatact

SEQ ID NO: 23757 - DNA, 22 bp, Artificial Sequence
  chemically synthesized
ctttttcaccttatatatactt

SEQ ID NO: 23758 - DNA, 22 bp, Artificial Sequence
  chemically synthesized
tttcaccttatatatacttgct

SEQ ID NO: 23759 - DNA, 22 bp, Artificial Sequence
  chemically synthesized
ttcaccttatatatacttgcta

SEQ ID NO: 23760 - DNA, 22 bp, Artificial Sequence
  chemically synthesized
tcaccttatatatacttgctag

SEQ ID NO: 23761 - DNA, 22 bp, Artificial Sequence
  chemically synthesized
caccttatatatacttgctagg

SEQ ID NO: 23762 - DNA, 22 bp, Artificial Sequence
  chemically synthesized
accttatatatacttgctaggg

SEQ ID NO: 23763 - DNA, 22 bp, Artificial Sequence
  chemically synthesized
atatatacttgctagggctggg

SEQ ID NO: 23764 - DNA, 22 bp, Artificial Sequence
  chemically synthesized
tatatacttgctagggctggga

SEQ ID NO: 23765 - DNA, 22 bp, Artificial Sequence
  chemically synthesized
gctagggctgggacaagagtga

SEQ ID NO: 23766 - DNA, 22 bp, Artificial Sequence
  chemically synthesized
ctagggctgggacaagagtgaa

SEQ ID NO: 23767 - DNA, 22 bp, Artificial Sequence
  chemically synthesized
gggctgggacaagagtgaacca

SEQ ID NO: 23768 - DNA, 22 bp, Artificial Sequence
  chemically synthesized
ggacaagagtgaaccaaacaag

SEQ ID NO: 23769 - DNA, 22 bp, Artificial Sequence
  chemically synthesized
aagaggtcctcacttctcgggg

SEQ ID NO: 23770 - DNA, 22 bp, Artificial Sequence
  chemically synthesized
agaggtcctcacttctcggggc

SEQ ID NO: 23771 - DNA, 22 bp, Artificial Sequence
  chemically synthesized
acttctcggggcatacaagtat

SEQ ID NO: 23772 - DNA, 22 bp, Artificial Sequence
  chemically synthesized
ctcggggcatacaagtatattt

SEQ ID NO: 23773 - DNA, 22 bp, Artificial Sequence
  chemically synthesized
tcggggcatacaagtatattta

SEQ ID NO: 23774 - DNA, 22 bp, Artificial Sequence
  chemically synthesized
ggggcatacaagtatatttatg

SEQ ID NO: 23775 - DNA, 22 bp, Artificial Sequence
  chemically synthesized
atgccctacaggccttgcttac

SEQ ID NO: 23776 - DNA, 22 bp, Artificial Sequence
  chemically synthesized
tgccctacaggccttgcttacc

SEQ ID NO: 23777 - DNA, 22 bp, Artificial Sequence
  chemically synthesized
caggccttgcttaccacagtct

SEQ ID NO: 23778 - DNA, 22 bp, Artificial Sequence
  chemically synthesized
gcttaccacagtctagtccggc

SEQ ID NO: 23779 - DNA, 22 bp, Artificial Sequence
  chemically synthesized
cttaccacagtctagtccggcc

SEQ ID NO: 23780 - DNA, 22 bp, Artificial Sequence
  chemically synthesized
accacagtctagtccggccctg

SEQ ID NO: 23781 - DNA, 22 bp, Artificial Sequence
  chemically synthesized
ccacagtctagtccggccctga

SEQ ID NO: 23782 - DNA, 22 bp, Artificial Sequence
  chemically synthesized
gtccggccctgaccctgtcaac

SEQ ID NO: 23783 - DNA, 22 bp, Artificial Sequence
  chemically synthesized
accctgtcaacaaaatttactg

SEQ ID NO: 23784 - DNA, 22 bp, Artificial Sequence
  chemically synthesized
tcaacaaaatttactgagcata

SEQ ID NO: 23785 - DNA, 22 bp, Artificial Sequence
  chemically synthesized
actgagcatacaaccactactg

SEQ ID NO: 23786 - DNA, 22 bp, Artificial Sequence
  chemically synthesized
ctgagcatacaaccactactgc

SEQ ID NO: 23787 - DNA, 22 bp, Artificial Sequence
  chemically synthesized
agcatacaaccactactgccag

SEQ ID NO: 23788 - DNA, 22 bp, Artificial Sequence
  chemically synthesized
ctgccaggcactgtactaggta

SEQ ID NO: 23789 - DNA, 22 bp, Artificial Sequence
  chemically synthesized
ccaggcactgtactaggtatca

SEQ ID NO: 23790 - DNA, 22 bp, Artificial Sequence
  chemically synthesized
tactaggtatcacaatatccat

SEQ ID NO: 23791 - DNA, 22 bp, Artificial Sequence
  chemically synthesized
ggtatcacaatatccatgctca

SEQ ID NO: 23792 - DNA, 22 bp, Artificial Sequence
  chemically synthesized
actctccagatgcccacacacg

SEQ ID NO: 23793 - DNA, 22 bp, Artificial Sequence
  chemically synthesized
tccagatgcccacacacgtggc

SEQ ID NO: 23794 - DNA, 22 bp, Artificial Sequence
  chemically synthesized
cagatgcccacacacgtggctg

SEQ ID NO: 23795 - DNA, 22 bp, Artificial Sequence
  chemically synthesized
taactactgtttacagaacaat

SEQ ID NO: 23796 - DNA, 22 bp, Artificial Sequence
  chemically synthesized
ctgtttacagaacaatgagttc

SEQ ID NO: 23797 - DNA, 22 bp, Artificial Sequence
  chemically synthesized
tttacagaacaatgagttccaa

SEQ ID NO: 23798 - DNA, 22 bp, Artificial Sequence
  chemically synthesized
acagaacaatgagttccaaata

SEQ ID NO: 23799 - DNA, 22 bp, Artificial Sequence
  chemically synthesized
cagaacaatgagttccaaatac

SEQ ID NO: 23800 - DNA, 22 bp, Artificial Sequence
  chemically synthesized
caaatactcacctatagtcaga

SEQ ID NO: 23801 - DNA, 22 bp, Artificial Sequence
  chemically synthesized
acctatagtcagatacgtctcc

SEQ ID NO: 23802 - DNA, 22 bp, Artificial Sequence
  chemically synthesized
tagtcagatacgtctcctgaat

SEQ ID NO: 23803 - DNA, 22 bp, Artificial Sequence
  chemically synthesized
ctgaatttcagattatctttcc

SEQ ID NO: 23804 - DNA, 22 bp, Artificial Sequence
  chemically synthesized
aatttcagattatctttccaac

SEQ ID NO: 23805 - DNA, 22 bp, Artificial Sequence
  chemically synthesized
cagattatctttccaactccct

SEQ ID NO: 23806 - DNA, 22 bp, Artificial Sequence
  chemically synthesized
agattatctttccaactcccta

SEQ ID NO: 23807 - DNA, 22 bp, Artificial Sequence
  chemically synthesized
tctttccaactccctaactgta

SEQ ID NO: 23808 - DNA, 22 bp, Artificial Sequence
  chemically synthesized
tccaactccctaactgtatatc

SEQ ID NO: 23809 - DNA, 22 bp, Artificial Sequence
  chemically synthesized
ccaactccctaactgtatatca

SEQ ID NO: 23810 - DNA, 22 bp, Artificial Sequence
  chemically synthesized
caactccctaactgtatatcat

SEQ ID NO: 23811 - DNA, 22 bp, Artificial Sequence
  chemically synthesized
cctaactgtatatcataatgta

SEQ ID NO: 23812 - DNA, 22 bp, Artificial Sequence
  chemically synthesized
actgtatatcataatgtagcca

SEQ ID NO: 23813 - DNA, 22 bp, Artificial Sequence
  chemically synthesized
tatatcataatgtagccagtaa

SEQ ID NO: 23814 - DNA, 22 bp, Artificial Sequence
  chemically synthesized
atgtatatgtaatgcttctgct

SEQ ID NO: 23815 - DNA, 22 bp, Artificial Sequence
  chemically synthesized
ctgctgtgttggacactgtgct

SEQ ID NO: 23816 - DNA, 22 bp, Artificial Sequence
  chemically synthesized
tgctgtgttggacactgtgctc

SEQ ID NO: 23817 - DNA, 22 bp, Artificial Sequence
  chemically synthesized
ctgtgttggacactgtgctcag

SEQ ID NO: 23818 - DNA, 22 bp, Artificial Sequence
  chemically synthesized
tgttggacactgtgctcagtaa

SEQ ID NO: 23819 - DNA, 22 bp, Artificial Sequence
  chemically synthesized
gacactgtgctcagtaactttg

SEQ ID NO: 23820 - DNA, 22 bp, Artificial Sequence
  chemically synthesized
tgctcagtaactttgcatccat

SEQ ID NO: 23821 - DNA, 22 bp, Artificial Sequence
  chemically synthesized
agtaactttgcatccattatct

SEQ ID NO: 23822 - DNA, 22 bp, Artificial Sequence
  chemically synthesized
tgcatccattatctcacttcat

SEQ ID NO: 23823 - DNA, 22 bp, Artificial Sequence
  chemically synthesized
gcatccattatctcacttcatc

SEQ ID NO: 23824 - DNA, 22 bp, Artificial Sequence
  chemically synthesized
catccattatctcacttcatcc

SEQ ID NO: 23825 - DNA, 22 bp, Artificial Sequence
  chemically synthesized
tctcacttcatcctcacaaaag

SEQ ID NO: 23826 - DNA, 22 bp, Artificial Sequence
  chemically synthesized
acttcatcctcacaaaagtccc

SEQ ID NO: 23827 - DNA, 22 bp, Artificial Sequence
  chemically synthesized
catcctcacaaaagtcccacga

SEQ ID NO: 23828 - DNA, 22 bp, Artificial Sequence
  chemically synthesized
atcctcacaaaagtcccacgag

SEQ ID NO: 23829 - DNA, 22 bp, Artificial Sequence
  chemically synthesized
acaaaagtcccacgagataggc

SEQ ID NO: 23830 - DNA, 22 bp, Artificial Sequence
  chemically synthesized
tcatcttatttttatgaatgag

SEQ ID NO: 23831 - DNA, 22 bp, Artificial Sequence
  chemically synthesized
atttttatgaatgaggaagata

SEQ ID NO: 23832 - DNA, 22 bp, Artificial Sequence
  chemically synthesized
tttttatgaatgaggaagatag

SEQ ID NO: 23833 - DNA, 22 bp, Artificial Sequence
  chemically synthesized
ttatgaatgaggaagatagatt

SEQ ID NO: 23834 - DNA, 22 bp, Artificial Sequence
  chemically synthesized
tatgaatgaggaagatagattc

SEQ ID NO: 23835 - DNA, 22 bp, Artificial Sequence
  chemically synthesized
atgaatgaggaagatagattca

SEQ ID NO: 23836 - DNA, 22 bp, Artificial Sequence
  chemically synthesized
tgaatgaggaagatagattcat

SEQ ID NO: 23837 - DNA, 22 bp, Artificial Sequence
  chemically synthesized
atagaggctaagggctttgccc

SEQ ID NO: 23838 - DNA, 22 bp, Artificial Sequence
  chemically synthesized
agggctttgcccaaggtaacat

SEQ ID NO: 23839 - DNA, 22 bp, Artificial Sequence
  chemically synthesized
tgcccaaggtaacatactaaaa

SEQ ID NO: 23840 - DNA, 22 bp, Artificial Sequence
  chemically synthesized
gcccaaggtaacatactaaaac

SEQ ID NO: 23841 - DNA, 22 bp, Artificial Sequence
  chemically synthesized
cccaaggtaacatactaaaaca

SEQ ID NO: 23842 - DNA, 22 bp, Artificial Sequence
  chemically synthesized
aaacattcaggattcagactct

SEQ ID NO: 23843 - DNA, 22 bp, Artificial Sequence
  chemically synthesized
aggattcagactctggcagtca

SEQ ID NO: 23844 - DNA, 22 bp, Artificial Sequence
  chemically synthesized
agactctggcagtcagactaaa

SEQ ID NO: 23845 - DNA, 22 bp, Artificial Sequence
  chemically synthesized
tggcagtcagactaaagagcca

SEQ ID NO: 23846 - DNA, 22 bp, Artificial Sequence
  chemically synthesized
gcagtcagactaaagagccagt

SEQ ID NO: 23847 - DNA, 22 bp, Artificial Sequence
  chemically synthesized
aagagccagttctcttagacat

SEQ ID NO: 23848 - DNA, 22 bp, Artificial Sequence
  chemically synthesized
tcttagacattattctgtggtc

SEQ ID NO: 23849 - DNA, 22 bp, Artificial Sequence
  chemically synthesized
ttagacattattctgtggtcca

SEQ ID NO: 23850 - DNA, 22 bp, Artificial Sequence
  chemically synthesized
agacattattctgtggtccata

SEQ ID NO: 23851 - DNA, 22 bp, Artificial Sequence
  chemically synthesized
gacattattctgtggtccataa

SEQ ID NO: 23852 - DNA, 22 bp, Artificial Sequence
  chemically synthesized
ttctgtggtccataatcacatc

SEQ ID NO: 23853 - DNA, 22 bp, Artificial Sequence
  chemically synthesized
tgtggtccataatcacatcaaa

SEQ ID NO: 23854 - DNA, 22 bp, Artificial Sequence
  chemically synthesized
tggtccataatcacatcaaaca

SEQ ID NO: 23855 - DNA, 22 bp, Artificial Sequence
  chemically synthesized
tagccatttccccttccatacc

SEQ ID NO: 23856 - DNA, 22 bp, Artificial Sequence
  chemically synthesized
gccatttccccttccataccca

SEQ ID NO: 23857 - DNA, 22 bp, Artificial Sequence
  chemically synthesized
ccccttccatacccagatggtt

SEQ ID NO: 23858 - DNA, 22 bp, Artificial Sequence
  chemically synthesized
cccttccatacccagatggtta

SEQ ID NO: 23859 - DNA, 22 bp, Artificial Sequence
  chemically synthesized
ccatacccagatggttaagtca

SEQ ID NO: 23860 - DNA, 22 bp, Artificial Sequence
  chemically synthesized
catacccagatggttaagtcat

SEQ ID NO: 23861 - DNA, 22 bp, Artificial Sequence
  chemically synthesized
agtcataccacttctacttcct

SEQ ID NO: 23862 - DNA, 22 bp, Artificial Sequence
  chemically synthesized
ctacttccttaatatcatttga

SEQ ID NO: 23863 - DNA, 22 bp, Artificial Sequence
  chemically synthesized
tacttccttaatatcatttgaa

SEQ ID NO: 23864 - DNA, 22 bp, Artificial Sequence
  chemically synthesized
cttccttaatatcatttgaact

SEQ ID NO: 23865 - DNA, 22 bp, Artificial Sequence
  chemically synthesized
ccttaatatcatttgaactccc

SEQ ID NO: 23866 - DNA, 22 bp, Artificial Sequence
  chemically synthesized
cttaatatcatttgaactcccc

SEQ ID NO: 23867 - DNA, 22 bp, Artificial Sequence
  chemically synthesized
aatatcatttgaactcccctct

SEQ ID NO: 23868 - DNA, 22 bp, Artificial Sequence
  chemically synthesized
atatcatttgaactcccctctt

SEQ ID NO: 23869 - DNA, 22 bp, Artificial Sequence
  chemically synthesized
gaactcccctctttttttgtac

SEQ ID NO: 23870 - DNA, 22 bp, Artificial Sequence
  chemically synthesized
aactcccctctttttttgtact

SEQ ID NO: 23871 - DNA, 22 bp, Artificial Sequence
  chemically synthesized
ccctctttttttgtactgctac

SEQ ID NO: 23872 - DNA, 22 bp, Artificial Sequence
  chemically synthesized
tttttttgtactgctactgttc

SEQ ID NO: 23873 - DNA, 22 bp, Artificial Sequence
  chemically synthesized
tttttgtactgctactgttcag

SEQ ID NO: 23874 - DNA, 22 bp, Artificial Sequence
  chemically synthesized
ttttgtactgctactgttcagg

SEQ ID NO: 23875 - DNA, 22 bp, Artificial Sequence
  chemically synthesized
tttgtactgctactgttcaggt

SEQ ID NO: 23876 - DNA, 22 bp, Artificial Sequence
  chemically synthesized
ttgtactgctactgttcaggtt

SEQ ID NO: 23877 - DNA, 22 bp, Artificial Sequence
  chemically synthesized
tgtactgctactgttcaggttc

SEQ ID NO: 23878 - DNA, 22 bp, Artificial Sequence
  chemically synthesized
gtactgctactgttcaggttct

SEQ ID NO: 23879 - DNA, 22 bp, Artificial Sequence
  chemically synthesized
tactgctactgttcaggttcta

SEQ ID NO: 23880 - DNA, 22 bp, Artificial Sequence
  chemically synthesized
ctactgttcaggttctagcctt

SEQ ID NO: 23881 - DNA, 22 bp, Artificial Sequence
  chemically synthesized
ctgttcaggttctagcctttat

SEQ ID NO: 23882 - DNA, 22 bp, Artificial Sequence
  chemically synthesized
ttcaggttctagcctttatgtc

SEQ ID NO: 23883 - DNA, 22 bp, Artificial Sequence
  chemically synthesized
aggttctagcctttatgtctcc

SEQ ID NO: 23884 - DNA, 22 bp, Artificial Sequence
  chemically synthesized
tagcctttatgtctcccgcaga

SEQ ID NO: 23885 - DNA, 22 bp, Artificial Sequence
  chemically synthesized
gcctttatgtctcccgcagata

SEQ ID NO: 23886 - DNA, 22 bp, Artificial Sequence
  chemically synthesized
tatgtctcccgcagataattgc

SEQ ID NO: 23887 - DNA, 22 bp, Artificial Sequence
  chemically synthesized
atgtctcccgcagataattgca

SEQ ID NO: 23888 - DNA, 22 bp, Artificial Sequence
  chemically synthesized
tgtctcccgcagataattgcaa

SEQ ID NO: 23889 - DNA, 22 bp, Artificial Sequence
  chemically synthesized
ccgcagataattgcaatagtct

SEQ ID NO: 23890 - DNA, 22 bp, Artificial Sequence
  chemically synthesized
caatagtctcaggactgctctc

SEQ ID NO: 23891 - DNA, 22 bp, Artificial Sequence
  chemically synthesized
aggactgctctctcctagtctt

SEQ ID NO: 23892 - DNA, 22 bp, Artificial Sequence
  chemically synthesized
ctctctcctagtcttggtacgg

SEQ ID NO: 23893 - DNA, 22 bp, Artificial Sequence
  chemically synthesized
tctcctagtcttggtacggccc

SEQ ID NO: 23894 - DNA, 22 bp, Artificial Sequence
  chemically synthesized
tcctagtcttggtacggccccc

SEQ ID NO: 23895 - DNA, 22 bp, Artificial Sequence
  chemically synthesized
ctagtcttggtacggccccctc

SEQ ID NO: 23896 - DNA, 22 bp, Artificial Sequence
  chemically synthesized
gtcttggtacggccccctcccc

SEQ ID NO: 23897 - DNA, 22 bp, Artificial Sequence
  chemically synthesized
ggtacggccccctcccccacta

SEQ ID NO: 23898 - DNA, 22 bp, Artificial Sequence
  chemically synthesized
gtacggccccctcccccactat

SEQ ID NO: 23899 - DNA, 22 bp, Artificial Sequence
  chemically synthesized
ccccactatcatttcattagcg

SEQ ID NO: 23900 - DNA, 22 bp, Artificial Sequence
  chemically synthesized
tcatttcattagcgtgttgcca

SEQ ID NO: 23901 - DNA, 22 bp, Artificial Sequence
  chemically synthesized
cattagcgtgttgccagactgg

SEQ ID NO: 23902 - DNA, 22 bp, Artificial Sequence
  chemically synthesized
attagcgtgttgccagactggg

SEQ ID NO: 23903 - DNA, 22 bp, Artificial Sequence
  chemically synthesized
gcgtgttgccagactgggcatc

SEQ ID NO: 23904 - DNA, 22 bp, Artificial Sequence
  chemically synthesized
ccagactgggcatcctaaatca

SEQ ID NO: 23905 - DNA, 22 bp, Artificial Sequence
  chemically synthesized
ggcatcctaaatcagccatcag

SEQ ID NO: 23906 - DNA, 22 bp, Artificial Sequence
  chemically synthesized
aatcagccatcagtggtactcc

SEQ ID NO: 23907 - DNA, 22 bp, Artificial Sequence
  chemically synthesized
cttatgtttatacttcgatacc

SEQ ID NO: 23908 - DNA, 22 bp, Artificial Sequence
  chemically synthesized
atgtttatacttcgatacctcc

SEQ ID NO: 23909 - DNA, 22 bp, Artificial Sequence
  chemically synthesized
tgtttatacttcgatacctcca

SEQ ID NO: 23910 - DNA, 22 bp, Artificial Sequence
  chemically synthesized
atacttcgatacctccatattg

SEQ ID NO: 23911 - DNA, 22 bp, Artificial Sequence
  chemically synthesized
tacttcgatacctccatattgc

SEQ ID NO: 23912 - DNA, 22 bp, Artificial Sequence
  chemically synthesized
cgatacctccatattgcatttt

SEQ ID NO: 23913 - DNA, 22 bp, Artificial Sequence
  chemically synthesized
gatacctccatattgcatttta

SEQ ID NO: 23914 - DNA, 22 bp, Artificial Sequence
  chemically synthesized
catattgcattttattgtccaa

SEQ ID NO: 23915 - DNA, 22 bp, Artificial Sequence
  chemically synthesized
cattttattgtccaatctcctt

SEQ ID NO: 23916 - DNA, 22 bp, Artificial Sequence
  chemically synthesized
tattgtccaatctccttaggtt

SEQ ID NO: 23917 - DNA, 22 bp, Artificial Sequence
  chemically synthesized
attgtccaatctccttaggtta

SEQ ID NO: 23918 - DNA, 22 bp, Artificial Sequence
  chemically synthesized
ttgtccaatctccttaggttaa

SEQ ID NO: 23919 - DNA, 22 bp, Artificial Sequence
  chemically synthesized
tccaatctccttaggttaatga

SEQ ID NO: 23920 - DNA, 22 bp, Artificial Sequence
  chemically synthesized
cttaggttaatgacttcattat

SEQ ID NO: 23921 - DNA, 22 bp, Artificial Sequence
  chemically synthesized
aggttaatgacttcattatctg

SEQ ID NO: 23922 - DNA, 22 bp, Artificial Sequence
  chemically synthesized
ggttaatgacttcattatctga

SEQ ID NO: 23923 - DNA, 22 bp, Artificial Sequence
  chemically synthesized
atgacttcattatctgatgacc

SEQ ID NO: 23924 - DNA, 22 bp, Artificial Sequence
  chemically synthesized
cattatctgatgaccagctctg

SEQ ID NO: 23925 - DNA, 22 bp, Artificial Sequence
  chemically synthesized
attatctgatgaccagctctgc

SEQ ID NO: 23926 - DNA, 22 bp, Artificial Sequence
  chemically synthesized
tctgatgaccagctctgcctag

SEQ ID NO: 23927 - DNA, 22 bp, Artificial Sequence
  chemically synthesized
atgaccagctctgcctagttta

SEQ ID NO: 23928 - DNA, 22 bp, Artificial Sequence
  chemically synthesized
tgcctagtttacctgtctcact

SEQ ID NO: 23929 - DNA, 22 bp, Artificial Sequence
  chemically synthesized
cctagtttacctgtctcacttg

SEQ ID NO: 23930 - DNA, 22 bp, Artificial Sequence
  chemically synthesized
gtttacctgtctcacttgtcat

SEQ ID NO: 23931 - DNA, 22 bp, Artificial Sequence
  chemically synthesized
acctgtctcacttgtcatagtc

SEQ ID NO: 23932 - DNA, 22 bp, Artificial Sequence
  chemically synthesized
cctgtctcacttgtcatagtcc

SEQ ID NO: 23933 - DNA, 22 bp, Artificial Sequence
  chemically synthesized
tctcacttgtcatagtccatat

SEQ ID NO: 23934 - DNA, 22 bp, Artificial Sequence
  chemically synthesized
acttgtcatagtccatatggaa

SEQ ID NO: 23935 - DNA, 22 bp, Artificial Sequence
  chemically synthesized
gtcatagtccatatggaaccat

SEQ ID NO: 23936 - DNA, 22 bp, Artificial Sequence
  chemically synthesized
tcatagtccatatggaaccata

SEQ ID NO: 23937 - DNA, 22 bp, Artificial Sequence
  chemically synthesized
ctgaaatacctcacgttcttgc

SEQ ID NO: 23938 - DNA, 22 bp, Artificial Sequence
  chemically synthesized
aaatacctcacgttcttgcaaa

SEQ ID NO: 23939 - DNA, 22 bp, Artificial Sequence
  chemically synthesized
acgttcttgcaaatctgagtct

SEQ ID NO: 23940 - DNA, 22 bp, Artificial Sequence
  chemically synthesized
ttgcaaatctgagtctttgcac

SEQ ID NO: 23941 - DNA, 22 bp, Artificial Sequence
  chemically synthesized
gcaaatctgagtctttgcacga

SEQ ID NO: 23942 - DNA, 22 bp, Artificial Sequence
  chemically synthesized
caaatctgagtctttgcacgag

SEQ ID NO: 23943 - DNA, 22 bp, Artificial Sequence
  chemically synthesized
agtctttgcacgagtgatcctc

SEQ ID NO: 23944 - DNA, 22 bp, Artificial Sequence
  chemically synthesized
tgcacgagtgatcctctttgca

SEQ ID NO: 23945 - DNA, 22 bp, Artificial Sequence
  chemically synthesized
gcacgagtgatcctctttgcat

SEQ ID NO: 23946 - DNA, 22 bp, Artificial Sequence
  chemically synthesized
cacgagtgatcctctttgcata

SEQ ID NO: 23947 - DNA, 22 bp, Artificial Sequence
  chemically synthesized
tttgcataaaatgcccttatat

SEQ ID NO: 23948 - DNA, 22 bp, Artificial Sequence
  chemically synthesized
tgcataaaatgcccttatatca

SEQ ID NO: 23949 - DNA, 22 bp, Artificial Sequence
  chemically synthesized
gcataaaatgcccttatatcag

SEQ ID NO: 23950 - DNA, 22 bp, Artificial Sequence
  chemically synthesized
cataaaatgcccttatatcaga

SEQ ID NO: 23951 - DNA, 22 bp, Artificial Sequence
  chemically synthesized
atatcagacatttaaagagaga

SEQ ID NO: 23952 - DNA, 22 bp, Artificial Sequence
  chemically synthesized
tatcagacatttaaagagagag

SEQ ID NO: 23953 - DNA, 22 bp, Artificial Sequence
  chemically synthesized
aaagagagagaacgcctactca

SEQ ID NO: 23954 - DNA, 22 bp, Artificial Sequence
  chemically synthesized
aagagagagaacgcctactcat

SEQ ID NO: 23955 - DNA, 22 bp, Artificial Sequence
  chemically synthesized
ctcatcttttaagacccagatg

SEQ ID NO: 23956 - DNA, 22 bp, Artificial Sequence
  chemically synthesized
atcttttaagacccagatgaaa

SEQ ID NO: 23957 - DNA, 22 bp, Artificial Sequence
  chemically synthesized
ttaagacccagatgaaaatatt

SEQ ID NO: 23958 - DNA, 22 bp, Artificial Sequence
  chemically synthesized
taagacccagatgaaaatattc

SEQ ID NO: 23959 - DNA, 22 bp, Artificial Sequence
  chemically synthesized
aagacccagatgaaaatattct

SEQ ID NO: 23960 - DNA, 22 bp, Artificial Sequence
  chemically synthesized
agacccagatgaaaatattctc

SEQ ID NO: 23961 - DNA, 22 bp, Artificial Sequence
  chemically synthesized
tctctctatcaattgtttcccc

SEQ ID NO: 23962 - DNA, 22 bp, Artificial Sequence
  chemically synthesized
tctctatcaattgtttccccat

SEQ ID NO: 23963 - DNA, 22 bp, Artificial Sequence
  chemically synthesized
tctatcaattgtttccccattt

SEQ ID NO: 23964 - DNA, 22 bp, Artificial Sequence
  chemically synthesized
tatcaattgtttccccatttaa

SEQ ID NO: 23965 - DNA, 22 bp, Artificial Sequence
  chemically synthesized
tcaattgtttccccatttaatg

SEQ ID NO: 23966 - DNA, 22 bp, Artificial Sequence
  chemically synthesized
tttccccatttaatgtgttcct

SEQ ID NO: 23967 - DNA, 22 bp, Artificial Sequence
  chemically synthesized
ccccatttaatgtgttcctttc

SEQ ID NO: 23968 - DNA, 22 bp, Artificial Sequence
  chemically synthesized
cccatttaatgtgttcctttct

SEQ ID NO: 23969 - DNA, 22 bp, Artificial Sequence
  chemically synthesized
aatgtgttcctttctctatgat

SEQ ID NO: 23970 - DNA, 22 bp, Artificial Sequence
  chemically synthesized
atgtgttcctttctctatgatc

SEQ ID NO: 23971 - DNA, 22 bp, Artificial Sequence
  chemically synthesized
ctttctctatgatcccttagta

SEQ ID NO: 23972 - DNA, 22 bp, Artificial Sequence
  chemically synthesized
tctctatgatcccttagtacct

SEQ ID NO: 23973 - DNA, 22 bp, Artificial Sequence
  chemically synthesized
ctctatgatcccttagtaccta

SEQ ID NO: 23974 - DNA, 22 bp, Artificial Sequence
  chemically synthesized
tctatgatcccttagtacctag

SEQ ID NO: 23975 - DNA, 22 bp, Artificial Sequence
  chemically synthesized
tatgatcccttagtacctagtg

SEQ ID NO: 23976 - DNA, 22 bp, Artificial Sequence
  chemically synthesized
tgatcccttagtacctagtgca

SEQ ID NO: 23977 - DNA, 22 bp, Artificial Sequence
  chemically synthesized
agtacctagtgcacattttatc

SEQ ID NO: 23978 - DNA, 22 bp, Artificial Sequence
  chemically synthesized
gtacctagtgcacattttatca

SEQ ID NO: 23979 - DNA, 22 bp, Artificial Sequence
  chemically synthesized
gtgcacattttatcacattata

SEQ ID NO: 23980 - DNA, 22 bp, Artificial Sequence
  chemically synthesized
tatcacattatattgaaacctc

SEQ ID NO: 23981 - DNA, 22 bp, Artificial Sequence
  chemically synthesized
atcacattatattgaaacctct

SEQ ID NO: 23982 - DNA, 22 bp, Artificial Sequence
  chemically synthesized
tcacattatattgaaacctctc

SEQ ID NO: 23983 - DNA, 22 bp, Artificial Sequence
  chemically synthesized
tattgaaacctctcacctggcc

SEQ ID NO: 23984 - DNA, 22 bp, Artificial Sequence
  chemically synthesized
aaacctctcacctggcctcatg

SEQ ID NO: 23985 - DNA, 22 bp, Artificial Sequence
  chemically synthesized
tcacctggcctcatgctgcttt

SEQ ID NO: 23986 - DNA, 22 bp, Artificial Sequence
  chemically synthesized
acctggcctcatgctgctttag

SEQ ID NO: 23987 - DNA, 22 bp, Artificial Sequence
  chemically synthesized
gcctcatgctgctttagatcaa

SEQ ID NO: 23988 - DNA, 22 bp, Artificial Sequence
  chemically synthesized
atgctgctttagatcaaagagg

SEQ ID NO: 23989 - DNA, 22 bp, Artificial Sequence
  chemically synthesized
ctttagatcaaagagggagtct

SEQ ID NO: 23990 - DNA, 22 bp, Artificial Sequence
  chemically synthesized
tagatcaaagagggagtctggt

SEQ ID NO: 23991 - DNA, 22 bp, Artificial Sequence
  chemically synthesized
agatcaaagagggagtctggtt

SEQ ID NO: 23992 - DNA, 22 bp, Artificial Sequence
  chemically synthesized
gatcaaagagggagtctggttt

SEQ ID NO: 23993 - DNA, 22 bp, Artificial Sequence
  chemically synthesized
gtttatccccatacccctagta

SEQ ID NO: 23994 - DNA, 22 bp, Artificial Sequence
  chemically synthesized
atccccatacccctagtaccct

SEQ ID NO: 23995 - DNA, 22 bp, Artificial Sequence
  chemically synthesized
tccccatacccctagtaccctg

SEQ ID NO: 23996 - DNA, 22 bp, Artificial Sequence
  chemically synthesized
gtaccctgacacagtacctggc

SEQ ID NO: 23997 - DNA, 22 bp, Artificial Sequence
  chemically synthesized
acacagtacctggcaccatagt

SEQ ID NO: 23998 - DNA, 22 bp, Artificial Sequence
  chemically synthesized
gcaccatagttgtaactcagta

SEQ ID NO: 23999 - DNA, 22 bp, Artificial Sequence
  chemically synthesized
taactcagtaatgtctgaatga

SEQ ID NO: 24000 - DNA, 22 bp, Artificial Sequence
  chemically synthesized
agtaatgtctgaatgaaggaca

SEQ ID NO: 24001 - DNA, 22 bp, Artificial Sequence
  chemically synthesized
aatgaaggacatctttgatgca

SEQ ID NO: 24002 - DNA, 22 bp, Artificial Sequence
  chemically synthesized
tgatgcatacactttacaaaac

SEQ ID NO: 24003 - DNA, 22 bp, Artificial Sequence
  chemically synthesized
gatgcatacactttacaaaact

SEQ ID NO: 24004 - DNA, 22 bp, Artificial Sequence
  chemically synthesized
atgcatacactttacaaaacta

SEQ ID NO: 24005 - DNA, 22 bp, Artificial Sequence
  chemically synthesized
tacaaaactaaactggttttac

SEQ ID NO: 24006 - DNA, 22 bp, Artificial Sequence
  chemically synthesized
acaaaactaaactggttttaca

SEQ ID NO: 24007 - DNA, 22 bp, Artificial Sequence
  chemically synthesized
caaaactaaactggttttacag

SEQ ID NO: 24008 - DNA, 22 bp, Artificial Sequence
  chemically synthesized
aactggttttacagaactgttt

SEQ ID NO: 24009 - DNA, 22 bp, Artificial Sequence
  chemically synthesized
gttttacagaactgttttaatt

SEQ ID NO: 24010 - DNA, 22 bp, Artificial Sequence
  chemically synthesized
tacagaactgttttaatttcaa

SEQ ID NO: 24011 - DNA, 22 bp, Artificial Sequence
  chemically synthesized
acagaactgttttaatttcaaa

SEQ ID NO: 24012 - DNA, 22 bp, Artificial Sequence
  chemically synthesized
cagaactgttttaatttcaaaa

SEQ ID NO: 24013 - DNA, 22 bp, Artificial Sequence
  chemically synthesized
ttttaatttcaaaattccaaac

SEQ ID NO: 24014 - DNA, 22 bp, Artificial Sequence
  chemically synthesized
taatttcaaaattccaaactgt

SEQ ID NO: 24015 - DNA, 22 bp, Artificial Sequence
  chemically synthesized
aatttcaaaattccaaactgtt

SEQ ID NO: 24016 - DNA, 22 bp, Artificial Sequence
  chemically synthesized
atttcaaaattccaaactgttg

SEQ ID NO: 24017 - DNA, 22 bp, Artificial Sequence
  chemically synthesized
caaaattccaaactgttgcaat

SEQ ID NO: 24018 - DNA, 22 bp, Artificial Sequence
  chemically synthesized
aaaattccaaactgttgcaata

SEQ ID NO: 24019 - DNA, 22 bp, Artificial Sequence
  chemically synthesized
caaactgttgcaataataccta

SEQ ID NO: 24020 - DNA, 22 bp, Artificial Sequence
  chemically synthesized
ttgcaataatacctaaaggcag

SEQ ID NO: 24021 - DNA, 22 bp, Artificial Sequence
  chemically synthesized
caataatacctaaaggcagcag

SEQ ID NO: 24022 - DNA, 22 bp, Artificial Sequence
  chemically synthesized
aaggcagcagccatgaaaatgc

SEQ ID NO: 24023 - DNA, 22 bp, Artificial Sequence
  chemically synthesized
agcaaatcactcaccgaaactc

SEQ ID NO: 24024 - DNA, 22 bp, Artificial Sequence
  chemically synthesized
accgaaactccttttagaagcc

SEQ ID NO: 24025 - DNA, 22 bp, Artificial Sequence
  chemically synthesized
cttttagaagccaatgagagtt

SEQ ID NO: 24026 - DNA, 22 bp, Artificial Sequence
  chemically synthesized
ttagaagccaatgagagtttaa

SEQ ID NO: 24027 - DNA, 22 bp, Artificial Sequence
  chemically synthesized
tagaagccaatgagagtttaat

SEQ ID NO: 24028 - DNA, 22 bp, Artificial Sequence
  chemically synthesized
agaagccaatgagagtttaata

SEQ ID NO: 24029 - DNA, 22 bp, Artificial Sequence
  chemically synthesized
gaagccaatgagagtttaatag

SEQ ID NO: 24030 - DNA, 22 bp, Artificial Sequence
  chemically synthesized
aatagcagaagagagtgctgca

SEQ ID NO: 24031 - DNA, 22 bp, Artificial Sequence
  chemically synthesized
atagcagaagagagtgctgcat

SEQ ID NO: 24032 - DNA, 22 bp, Artificial Sequence
  chemically synthesized
cattaatactgtctatccttag

SEQ ID NO: 24033 - DNA, 22 bp, Artificial Sequence
  chemically synthesized
atactgtctatccttagaaaaa

SEQ ID NO: 24034 - DNA, 22 bp, Artificial Sequence
  chemically synthesized
tctatccttagaaaaattcccc

SEQ ID NO: 24035 - DNA, 22 bp, Artificial Sequence
  chemically synthesized
tccttagaaaaattcccctggc

SEQ ID NO: 24036 - DNA, 22 bp, Artificial Sequence
  chemically synthesized
agaaaaattcccctggcccctt

SEQ ID NO: 24037 - DNA, 22 bp, Artificial Sequence
  chemically synthesized
gaaaaattcccctggccccttc

SEQ ID NO: 24038 - DNA, 22 bp, Artificial Sequence
  chemically synthesized
ccctggccccttcctcaagggc

SEQ ID NO: 24039 - DNA, 22 bp, Artificial Sequence
  chemically synthesized
gccccttcctcaagggcttatt

SEQ ID NO: 24040 - DNA, 22 bp, Artificial Sequence
  chemically synthesized
cctcaagggcttattatctctg

SEQ ID NO: 24041 - DNA, 22 bp, Artificial Sequence
  chemically synthesized
ctcaagggcttattatctctgg

SEQ ID NO: 24042 - DNA, 22 bp, Artificial Sequence
  chemically synthesized
aagggcttattatctctggcta

SEQ ID NO: 24043 - DNA, 22 bp, Artificial Sequence
  chemically synthesized
attatctctggctacaatggct

SEQ ID NO: 24044 - DNA, 22 bp, Artificial Sequence
  chemically synthesized
ttatctctggctacaatggctg

SEQ ID NO: 24045 - DNA, 22 bp, Artificial Sequence
  chemically synthesized
tctctggctacaatggctgcag

SEQ ID NO: 24046 - DNA, 22 bp, Artificial Sequence
  chemically synthesized
tggctacaatggctgcagaatc

SEQ ID NO: 24047 - DNA, 22 bp, Artificial Sequence
  chemically synthesized
gctacaatggctgcagaatcac

SEQ ID NO: 24048 - DNA, 22 bp, Artificial Sequence
  chemically synthesized
caatggctgcagaatcacattg

SEQ ID NO: 24049 - DNA, 22 bp, Artificial Sequence
  chemically synthesized
cagaatcacattgcctttctcc

SEQ ID NO: 24050 - DNA, 22 bp, Artificial Sequence
  chemically synthesized
cctttctccttagtattatctg

SEQ ID NO: 24051 - DNA, 22 bp, Artificial Sequence
  chemically synthesized
tctccttagtattatctgggga

SEQ ID NO: 24052 - DNA, 22 bp, Artificial Sequence
  chemically synthesized
ctccttagtattatctggggat

SEQ ID NO: 24053 - DNA, 22 bp, Artificial Sequence
  chemically synthesized
tccttagtattatctggggatc

SEQ ID NO: 24054 - DNA, 22 bp, Artificial Sequence
  chemically synthesized
cttagtattatctggggatcgt

SEQ ID NO: 24055 - DNA, 22 bp, Artificial Sequence
  chemically synthesized
agtattatctggggatcgtata

SEQ ID NO: 24056 - DNA, 22 bp, Artificial Sequence
  chemically synthesized
gtattatctggggatcgtatac

SEQ ID NO: 24057 - DNA, 22 bp, Artificial Sequence
  chemically synthesized
tctggggatcgtatacttaact

SEQ ID NO: 24058 - DNA, 22 bp, Artificial Sequence
  chemically synthesized
gggatcgtatacttaacttccc

SEQ ID NO: 24059 - DNA, 22 bp, Artificial Sequence
  chemically synthesized
aacttcccttcaggtttatcgc

SEQ ID NO: 24060 - DNA, 22 bp, Artificial Sequence
  chemically synthesized
acttcccttcaggtttatcgct

SEQ ID NO: 24061 - DNA, 22 bp, Artificial Sequence
  chemically synthesized
cccttcaggtttatcgctagtc

SEQ ID NO: 24062 - DNA, 22 bp, Artificial Sequence
  chemically synthesized
ccttcaggtttatcgctagtca

SEQ ID NO: 24063 - DNA, 22 bp, Artificial Sequence
  chemically synthesized
caggtttatcgctagtcattat

SEQ ID NO: 24064 - DNA, 22 bp, Artificial Sequence
  chemically synthesized
aggtttatcgctagtcattatt

SEQ ID NO: 24065 - DNA, 22 bp, Artificial Sequence
  chemically synthesized
atcgctagtcattatttcccag

SEQ ID NO: 24066 - DNA, 22 bp, Artificial Sequence
  chemically synthesized
tcgctagtcattatttcccagg

SEQ ID NO: 24067 - DNA, 22 bp, Artificial Sequence
  chemically synthesized
gtcattatttcccaggctccaa

SEQ ID NO: 24068 - DNA, 22 bp, Artificial Sequence
  chemically synthesized
tttcccaggctccaaaagcctg

SEQ ID NO: 24069 - DNA, 22 bp, Artificial Sequence
  chemically synthesized
cccaggctccaaaagcctggtt

SEQ ID NO: 24070 - DNA, 22 bp, Artificial Sequence
  chemically synthesized
ccaggctccaaaagcctggttc

SEQ ID NO: 24071 - DNA, 22 bp, Artificial Sequence
  chemically synthesized
caaaagcctggttcatccttat

SEQ ID NO: 24072 - DNA, 22 bp, Artificial Sequence
  chemically synthesized
gttcatccttattcttatctat

SEQ ID NO: 24073 - DNA, 22 bp, Artificial Sequence
  chemically synthesized
atccttattcttatctatcctt

SEQ ID NO: 24074 - DNA, 22 bp, Artificial Sequence
  chemically synthesized
attcttatctatcctttcccca

SEQ ID NO: 24075 - DNA, 22 bp, Artificial Sequence
  chemically synthesized
ttcttatctatcctttccccag

SEQ ID NO: 24076 - DNA, 22 bp, Artificial Sequence
  chemically synthesized
ttatctatcctttccccagcat

SEQ ID NO: 24077 - DNA, 22 bp, Artificial Sequence
  chemically synthesized
atctatcctttccccagcatct

SEQ ID NO: 24078 - DNA, 22 bp, Artificial Sequence
  chemically synthesized
tctatcctttccccagcatctg

SEQ ID NO: 24079 - DNA, 22 bp, Artificial Sequence
  chemically synthesized
tcctttccccagcatctgaagt

SEQ ID NO: 24080 - DNA, 22 bp, Artificial Sequence
  chemically synthesized
tccccagcatctgaagtcttca

SEQ ID NO: 24081 - DNA, 22 bp, Artificial Sequence
  chemically synthesized
ccccagcatctgaagtcttcaa

SEQ ID NO: 24082 - DNA, 22 bp, Artificial Sequence
  chemically synthesized
cccagcatctgaagtcttcaag

SEQ ID NO: 24083 - DNA, 22 bp, Artificial Sequence
  chemically synthesized
aagtcttcaagggggcagaagc

SEQ ID NO: 24084 - DNA, 22 bp, Artificial Sequence
  chemically synthesized
caagggggcagaagccctctta

SEQ ID NO: 24085 - DNA, 22 bp, Artificial Sequence
  chemically synthesized
aagggggcagaagccctcttac

SEQ ID NO: 24086 - DNA, 22 bp, Artificial Sequence
  chemically synthesized
ttacaaccttcatcatctcacc

SEQ ID NO: 24087 - DNA, 22 bp, Artificial Sequence
  chemically synthesized
acaaccttcatcatctcaccac

SEQ ID NO: 24088 - DNA, 22 bp, Artificial Sequence
  chemically synthesized
caaccttcatcatctcaccact

SEQ ID NO: 24089 - DNA, 22 bp, Artificial Sequence
  chemically synthesized
catcatctcaccacttatatag

SEQ ID NO: 24090 - DNA, 22 bp, Artificial Sequence
  chemically synthesized
atcatctcaccacttatataga

SEQ ID NO: 24091 - DNA, 22 bp, Artificial Sequence
  chemically synthesized
accacttatatagaagaaaggg

SEQ ID NO: 24092 - DNA, 22 bp, Artificial Sequence
  chemically synthesized
atatagaagaaagggtttggat

SEQ ID NO: 24093 - DNA, 22 bp, Artificial Sequence
  chemically synthesized
tatagaagaaagggtttggatg

SEQ ID NO: 24094 - DNA, 22 bp, Artificial Sequence
  chemically synthesized
ggatgctttgtcctcccagatg

SEQ ID NO: 24095 - DNA, 22 bp, Artificial Sequence
  chemically synthesized
gatgctttgtcctcccagatgt

SEQ ID NO: 24096 - DNA, 22 bp, Artificial Sequence
  chemically synthesized
tgtcctcccagatgtcacacta

SEQ ID NO: 24097 - DNA, 22 bp, Artificial Sequence
  chemically synthesized
gtcctcccagatgtcacactaa

SEQ ID NO: 24098 - DNA, 22 bp, Artificial Sequence
  chemically synthesized
tcctcccagatgtcacactaat

SEQ ID NO: 24099 - DNA, 22 bp, Artificial Sequence
  chemically synthesized
ccagatgtcacactaatgagat

SEQ ID NO: 24100 - DNA, 22 bp, Artificial Sequence
  chemically synthesized
atgagatatatctaatggcctt

SEQ ID NO: 24101 - DNA, 22 bp, Artificial Sequence
  chemically synthesized
atggccttgctttatgtcctgc

SEQ ID NO: 24102 - DNA, 22 bp, Artificial Sequence
  chemically synthesized
gctttatgtcctgctttgtgag

SEQ ID NO: 24103 - DNA, 22 bp, Artificial Sequence
  chemically synthesized
ctttatgtcctgctttgtgagt

SEQ ID NO: 24104 - DNA, 22 bp, Artificial Sequence
  chemically synthesized
tatgtcctgctttgtgagtttt

SEQ ID NO: 24105 - DNA, 22 bp, Artificial Sequence
  chemically synthesized
atgtcctgctttgtgagttttc

SEQ ID NO: 24106 - DNA, 22 bp, Artificial Sequence
  chemically synthesized
tgtcctgctttgtgagttttcc

SEQ ID NO: 24107 - DNA, 22 bp, Artificial Sequence
  chemically synthesized
ctttgtgagttttccaacaaat

SEQ ID NO: 24108 - DNA, 22 bp, Artificial Sequence
  chemically synthesized
tgtgagttttccaacaaatttt

SEQ ID NO: 24109 - DNA, 22 bp, Artificial Sequence
  chemically synthesized
gtgagttttccaacaaattttc

SEQ ID NO: 24110 - DNA, 22 bp, Artificial Sequence
  chemically synthesized
tgagttttccaacaaattttct

SEQ ID NO: 24111 - DNA, 22 bp, Artificial Sequence
  chemically synthesized
tccaacaaattttctttatccc

SEQ ID NO: 24112 - DNA, 22 bp, Artificial Sequence
  chemically synthesized
ccaacaaattttctttatccct

SEQ ID NO: 24113 - DNA, 22 bp, Artificial Sequence
  chemically synthesized
caacaaattttctttatccctt

SEQ ID NO: 24114 - DNA, 22 bp, Artificial Sequence
  chemically synthesized
tctttatcccttgactttactc

SEQ ID NO: 24115 - DNA, 22 bp, Artificial Sequence
  chemically synthesized
ctttatcccttgactttactca

SEQ ID NO: 24116 - DNA, 22 bp, Artificial Sequence
  chemically synthesized
tttatcccttgactttactcac

SEQ ID NO: 24117 - DNA, 22 bp, Artificial Sequence
  chemically synthesized
tatcccttgactttactcactt

SEQ ID NO: 24118 - DNA, 22 bp, Artificial Sequence
  chemically synthesized
atcccttgactttactcacttt

SEQ ID NO: 24119 - DNA, 22 bp, Artificial Sequence
  chemically synthesized
tcccttgactttactcactttg

SEQ ID NO: 24120 - DNA, 22 bp, Artificial Sequence
  chemically synthesized
gactttactcactttgctagtt

SEQ ID NO: 24121 - DNA, 22 bp, Artificial Sequence
  chemically synthesized
actttactcactttgctagttt

SEQ ID NO: 24122 - DNA, 22 bp, Artificial Sequence
  chemically synthesized
tactcactttgctagtttaacc

SEQ ID NO: 24123 - DNA, 22 bp, Artificial Sequence
  chemically synthesized
actcactttgctagtttaacct

SEQ ID NO: 24124 - DNA, 22 bp, Artificial Sequence
  chemically synthesized
ctcactttgctagtttaacctc

SEQ ID NO: 24125 - DNA, 22 bp, Artificial Sequence
  chemically synthesized
actttgctagtttaacctctgt

SEQ ID NO: 24126 - DNA, 22 bp, Artificial Sequence
  chemically synthesized
tgctagtttaacctctgtattt

SEQ ID NO: 24127 - DNA, 22 bp, Artificial Sequence
  chemically synthesized
gctagtttaacctctgtatttt

SEQ ID NO: 24128 - DNA, 22 bp, Artificial Sequence
  chemically synthesized
ctagtttaacctctgtattttt

SEQ ID NO: 24129 - DNA, 22 bp, Artificial Sequence
  chemically synthesized
gtttaacctctgtatttttttt

SEQ ID NO: 24130 - DNA, 22 bp, Artificial Sequence
  chemically synthesized
aacctctgtatttttttttatc

SEQ ID NO: 24131 - DNA, 22 bp, Artificial Sequence
  chemically synthesized
acctctgtatttttttttatcg

SEQ ID NO: 24132 - DNA, 22 bp, Artificial Sequence
  chemically synthesized
tgtatttttttttatcgttatt

SEQ ID NO: 24133 - DNA, 22 bp, Artificial Sequence
  chemically synthesized
tatttttttttatcgttatttc

SEQ ID NO: 24134 - DNA, 22 bp, Artificial Sequence
  chemically synthesized
ttttttatcgttatttcagcat

SEQ ID NO: 24135 - DNA, 22 bp, Artificial Sequence
  chemically synthesized
tttttatcgttatttcagcatt

SEQ ID NO: 24136 - DNA, 22 bp, Artificial Sequence
  chemically synthesized
ttttatcgttatttcagcattt

SEQ ID NO: 24137 - DNA, 22 bp, Artificial Sequence
  chemically synthesized
tttatcgttatttcagcatttc

SEQ ID NO: 24138 - DNA, 22 bp, Artificial Sequence
  chemically synthesized
ttatcgttatttcagcatttca

SEQ ID NO: 24139 - DNA, 22 bp, Artificial Sequence
  chemically synthesized
tatcgttatttcagcatttcag

SEQ ID NO: 24140 - DNA, 22 bp, Artificial Sequence
  chemically synthesized
atcgttatttcagcatttcagt

SEQ ID NO: 24141 - DNA, 22 bp, Artificial Sequence
  chemically synthesized
tcgttatttcagcatttcagtc

SEQ ID NO: 24142 - DNA, 22 bp, Artificial Sequence
  chemically synthesized
tttcagcatttcagtctgattt

SEQ ID NO: 24143 - DNA, 22 bp, Artificial Sequence
  chemically synthesized
cagcatttcagtctgatttcac

SEQ ID NO: 24144 - DNA, 22 bp, Artificial Sequence
  chemically synthesized
agcatttcagtctgatttcaca

SEQ ID NO: 24145 - DNA, 22 bp, Artificial Sequence
  chemically synthesized
cagtctgatttcacagctgaca

SEQ ID NO: 24146 - DNA, 22 bp, Artificial Sequence
  chemically synthesized
agtctgatttcacagctgacat

SEQ ID NO: 24147 - DNA, 22 bp, Artificial Sequence
  chemically synthesized
atttcacagctgacatcatgtc

SEQ ID NO: 24148 - DNA, 22 bp, Artificial Sequence
  chemically synthesized
cacagctgacatcatgtctgga

SEQ ID NO: 24149 - DNA, 22 bp, Artificial Sequence
  chemically synthesized
acagctgacatcatgtctggag

SEQ ID NO: 24150 - DNA, 22 bp, Artificial Sequence
  chemically synthesized
acatcatgtctggagtgggaac

SEQ ID NO: 24151 - DNA, 22 bp, Artificial Sequence
  chemically synthesized
gagtgggaaccacagggccagt

SEQ ID NO: 24152 - DNA, 22 bp, Artificial Sequence
  chemically synthesized
tctgggggtgcttagggttggc

SEQ ID NO: 24153 - DNA, 22 bp, Artificial Sequence
  chemically synthesized
ctgggggtgcttagggttggca

SEQ ID NO: 24154 - DNA, 22 bp, Artificial Sequence
  chemically synthesized
tgggggtgcttagggttggcac

SEQ ID NO: 24155 - DNA, 22 bp, Artificial Sequence
  chemically synthesized
ggggtgcttagggttggcaccc

SEQ ID NO: 24156 - DNA, 22 bp, Artificial Sequence
  chemically synthesized
agggttggcacccctgatcctg

SEQ ID NO: 24157 - DNA, 22 bp, Artificial Sequence
  chemically synthesized
gggttggcacccctgatcctgg

SEQ ID NO: 24158 - DNA, 22 bp, Artificial Sequence
  chemically synthesized
gcacccctgatcctggtactgt

SEQ ID NO: 24159 - DNA, 22 bp, Artificial Sequence
  chemically synthesized
atcctggtactgtcagctacta

SEQ ID NO: 24160 - DNA, 22 bp, Artificial Sequence
  chemically synthesized
gtactgtcagctactagatttg

SEQ ID NO: 24161 - DNA, 22 bp, Artificial Sequence
  chemically synthesized
tcagctactagatttgattcta

SEQ ID NO: 24162 - DNA, 22 bp, Artificial Sequence
  chemically synthesized
ctagatttgattctagaaagtt

SEQ ID NO: 24163 - DNA, 22 bp, Artificial Sequence
  chemically synthesized
gatttgattctagaaagttgac

SEQ ID NO: 24164 - DNA, 22 bp, Artificial Sequence
  chemically synthesized
gattctagaaagttgacaagta

SEQ ID NO: 24165 - DNA, 22 bp, Artificial Sequence
  chemically synthesized
attctagaaagttgacaagtaa

SEQ ID NO: 24166 - DNA, 22 bp, Artificial Sequence
  chemically synthesized
tagaaagttgacaagtaagtgt

SEQ ID NO: 24167 - DNA, 22 bp, Artificial Sequence
  chemically synthesized
gaaagttgacaagtaagtgtga

SEQ ID NO: 24168 - DNA, 22 bp, Artificial Sequence
  chemically synthesized
acaagtaagtgtgataaatgct

SEQ ID NO: 24169 - DNA, 22 bp, Artificial Sequence
  chemically synthesized
cctgtgagaacatgctgtttgt

SEQ ID NO: 24170 - DNA, 22 bp, Artificial Sequence
  chemically synthesized
ctgtgagaacatgctgtttgtc

SEQ ID NO: 24171 - DNA, 22 bp, Artificial Sequence
  chemically synthesized
tgagaacatgctgtttgtccaa

SEQ ID NO: 24172 - DNA, 22 bp, Artificial Sequence
  chemically synthesized
tttgtccaaatgggataatttc

SEQ ID NO: 24173 - DNA, 22 bp, Artificial Sequence
  chemically synthesized
gtccaaatgggataatttcttc

SEQ ID NO: 24174 - DNA, 22 bp, Artificial Sequence
  chemically synthesized
tccaaatgggataatttcttcc

SEQ ID NO: 24175 - DNA, 22 bp, Artificial Sequence
  chemically synthesized
cttccctgtatgccttcctctg

SEQ ID NO: 24176 - DNA, 22 bp, Artificial Sequence
  chemically synthesized
ttccctgtatgccttcctctgg

SEQ ID NO: 24177 - DNA, 22 bp, Artificial Sequence
  chemically synthesized
ccctgtatgccttcctctggga

SEQ ID NO: 24178 - DNA, 22 bp, Artificial Sequence
  chemically synthesized
cctgtatgccttcctctgggaa

SEQ ID NO: 24179 - DNA, 22 bp, Artificial Sequence
  chemically synthesized
tatgccttcctctgggaaatac

SEQ ID NO: 24180 - DNA, 22 bp, Artificial Sequence
  chemically synthesized
cctctgggaaatacataaagtc

SEQ ID NO: 24181 - DNA, 22 bp, Artificial Sequence
  chemically synthesized
ctctgggaaatacataaagtca

SEQ ID NO: 24182 - DNA, 22 bp, Artificial Sequence
  chemically synthesized
tgggaaatacataaagtcactg

SEQ ID NO: 24183 - DNA, 22 bp, Artificial Sequence
  chemically synthesized
ggaaatacataaagtcactgta

SEQ ID NO: 24184 - DNA, 22 bp, Artificial Sequence
  chemically synthesized
tagttgtgaaaaaacaaagtga

SEQ ID NO: 24185 - DNA, 22 bp, Artificial Sequence
  chemically synthesized
tgaaaaaacaaagtgatatatg

SEQ ID NO: 24186 - DNA, 22 bp, Artificial Sequence
  chemically synthesized
cattagctaacttcctactctt

SEQ ID NO: 24187 - DNA, 22 bp, Artificial Sequence
  chemically synthesized
gctaacttcctactctttatgt

SEQ ID NO: 24188 - DNA, 22 bp, Artificial Sequence
  chemically synthesized
acttcctactctttatgtcaat

SEQ ID NO: 24189 - DNA, 22 bp, Artificial Sequence
  chemically synthesized
cctactctttatgtcaattctt

SEQ ID NO: 24190 - DNA, 22 bp, Artificial Sequence
  chemically synthesized
ctactctttatgtcaattctta

SEQ ID NO: 24191 - DNA, 22 bp, Artificial Sequence
  chemically synthesized
ctctttatgtcaattcttaagc

SEQ ID NO: 24192 - DNA, 22 bp, Artificial Sequence
  chemically synthesized
tttatgtcaattcttaagcttg

SEQ ID NO: 24193 - DNA, 22 bp, Artificial Sequence
  chemically synthesized
tatgtcaattcttaagcttgct

SEQ ID NO: 24194 - DNA, 22 bp, Artificial Sequence
  chemically synthesized
atgtcaattcttaagcttgctt

SEQ ID NO: 24195 - DNA, 22 bp, Artificial Sequence
  chemically synthesized
tgtcaattcttaagcttgcttt

SEQ ID NO: 24196 - DNA, 22 bp, Artificial Sequence
  chemically synthesized
ttaagcttgcttttctccccta

SEQ ID NO: 24197 - DNA, 22 bp, Artificial Sequence
  chemically synthesized
aagcttgcttttctcccctagg

SEQ ID NO: 24198 - DNA, 22 bp, Artificial Sequence
  chemically synthesized
agcttgcttttctcccctaggg

SEQ ID NO: 24199 - DNA, 22 bp, Artificial Sequence
  chemically synthesized
gcttttctcccctagggaactc

SEQ ID NO: 24200 - DNA, 22 bp, Artificial Sequence
  chemically synthesized
cttttctcccctagggaactca

SEQ ID NO: 24201 - DNA, 22 bp, Artificial Sequence
  chemically synthesized
ttctcccctagggaactcaact

SEQ ID NO: 24202 - DNA, 22 bp, Artificial Sequence
  chemically synthesized
tctcccctagggaactcaactg

SEQ ID NO: 24203 - DNA, 22 bp, Artificial Sequence
  chemically synthesized
ctcccctagggaactcaactga

SEQ ID NO: 24204 - DNA, 22 bp, Artificial Sequence
  chemically synthesized
tcccctagggaactcaactgag

SEQ ID NO: 24205 - DNA, 22 bp, Artificial Sequence
  chemically synthesized
ccctagggaactcaactgagta

SEQ ID NO: 24206 - DNA, 22 bp, Artificial Sequence
  chemically synthesized
gggaactcaactgagtattgtg

SEQ ID NO: 24207 - DNA, 22 bp, Artificial Sequence
  chemically synthesized
aactgagtattgtgtttcccca

SEQ ID NO: 24208 - DNA, 22 bp, Artificial Sequence
  chemically synthesized
agtattgtgtttccccaaatat

SEQ ID NO: 24209 - DNA, 22 bp, Artificial Sequence
  chemically synthesized
tgtttccccaaatatcaactcc

SEQ ID NO: 24210 - DNA, 22 bp, Artificial Sequence
  chemically synthesized
ccccaaatatcaactccaagat

SEQ ID NO: 24211 - DNA, 22 bp, Artificial Sequence
  chemically synthesized
cccaaatatcaactccaagatg

SEQ ID NO: 24212 - DNA, 22 bp, Artificial Sequence
  chemically synthesized
caagatgtttgacatagagaca

SEQ ID NO: 24213 - DNA, 22 bp, Artificial Sequence
  chemically synthesized
gacatagagacaaaatgatttt

SEQ ID NO: 24214 - DNA, 22 bp, Artificial Sequence
  chemically synthesized
acatagagacaaaatgattttt

SEQ ID NO: 24215 - DNA, 22 bp, Artificial Sequence
  chemically synthesized
tttcctaatccatgaaaagctt

SEQ ID NO: 24216 - DNA, 22 bp, Artificial Sequence
  chemically synthesized
ttcctaatccatgaaaagcttt

SEQ ID NO: 24217 - DNA, 22 bp, Artificial Sequence
  chemically synthesized
tcctaatccatgaaaagctttg

SEQ ID NO: 24218 - DNA, 22 bp, Artificial Sequence
  chemically synthesized
cctaatccatgaaaagctttgg

SEQ ID NO: 24219 - DNA, 22 bp, Artificial Sequence
  chemically synthesized
ctaatccatgaaaagctttggt

SEQ ID NO: 24220 - DNA, 22 bp, Artificial Sequence
  chemically synthesized
atccatgaaaagctttggtgat

SEQ ID NO: 24221 - DNA, 22 bp, Artificial Sequence
  chemically synthesized
tggtgataactaacagcttgct

SEQ ID NO: 24222 - DNA, 22 bp, Artificial Sequence
  chemically synthesized
ggtgataactaacagcttgcta

SEQ ID NO: 24223 - DNA, 22 bp, Artificial Sequence
  chemically synthesized
gtgataactaacagcttgctaa

SEQ ID NO: 24224 - DNA, 22 bp, Artificial Sequence
  chemically synthesized
acagcttgctaatgaaaggtta

SEQ ID NO: 24225 - DNA, 22 bp, Artificial Sequence
  chemically synthesized
gctaatgaaaggttaatcttta

SEQ ID NO: 24226 - DNA, 22 bp, Artificial Sequence
  chemically synthesized
ctaatgaaaggttaatctttat

SEQ ID NO: 24227 - DNA, 22 bp, Artificial Sequence
  chemically synthesized
atgaaaggttaatctttatgtt

SEQ ID NO: 24228 - DNA, 22 bp, Artificial Sequence
  chemically synthesized
atctttatgttttaactaaaac

SEQ ID NO: 24229 - DNA, 22 bp, Artificial Sequence
  chemically synthesized
tatgttttaactaaaactttaa

SEQ ID NO: 24230 - DNA, 22 bp, Artificial Sequence
  chemically synthesized
atgttttaactaaaactttaaa

SEQ ID NO: 24231 - DNA, 22 bp, Artificial Sequence
  chemically synthesized
tgttttaactaaaactttaaat

SEQ ID NO: 24232 - DNA, 22 bp, Artificial Sequence
  chemically synthesized
taactaaaactttaaattgaag

SEQ ID NO: 24233 - DNA, 22 bp, Artificial Sequence
  chemically synthesized
aactaaaactttaaattgaaga

SEQ ID NO: 24234 - DNA, 22 bp, Artificial Sequence
  chemically synthesized
actaaaactttaaattgaagat

SEQ ID NO: 24235 - DNA, 22 bp, Artificial Sequence
  chemically synthesized
aaactttaaattgaagatatat

SEQ ID NO: 24236 - DNA, 22 bp, Artificial Sequence
  chemically synthesized
taaattgaagatatataattta

SEQ ID NO: 24237 - DNA, 22 bp, Artificial Sequence
  chemically synthesized
aaattgaagatatataatttaa

SEQ ID NO: 24238 - DNA, 22 bp, Artificial Sequence
  chemically synthesized
aattgaagatatataatttaaa

SEQ ID NO: 24239 - DNA, 22 bp, Artificial Sequence
  chemically synthesized
aagatatataatttaaaaaatt

SEQ ID NO: 24240 - DNA, 22 bp, Artificial Sequence
  chemically synthesized
aaaaaattagagacacacctca

SEQ ID NO: 24241 - DNA, 22 bp, Artificial Sequence
  chemically synthesized
aaaaattagagacacacctcat

SEQ ID NO: 24242 - DNA, 22 bp, Artificial Sequence
  chemically synthesized
gagacacacctcattacatact

SEQ ID NO: 24243 - DNA, 22 bp, Artificial Sequence
  chemically synthesized
attacatacttctgaaaccttg

SEQ ID NO: 24244 - DNA, 22 bp, Artificial Sequence
  chemically synthesized
catacttctgaaaccttgaaat

SEQ ID NO: 24245 - DNA, 22 bp, Artificial Sequence
  chemically synthesized
ctgaaaccttgaaatgtcatat

SEQ ID NO: 24246 - DNA, 22 bp, Artificial Sequence
  chemically synthesized
tgaaaccttgaaatgtcatata

SEQ ID NO: 24247 - DNA, 22 bp, Artificial Sequence
  chemically synthesized
aaaccttgaaatgtcatatatc

SEQ ID NO: 24248 - DNA, 22 bp, Artificial Sequence
  chemically synthesized
gaaatgtcatatatcttaaaat

SEQ ID NO: 24249 - DNA, 22 bp, Artificial Sequence
  chemically synthesized
aaatgtcatatatcttaaaatc

SEQ ID NO: 24250 - DNA, 22 bp, Artificial Sequence
  chemically synthesized
aaaatcagactttttgtgtaaa

SEQ ID NO: 24251 - DNA, 22 bp, Artificial Sequence
  chemically synthesized
aaatcagactttttgtgtaaat

SEQ ID NO: 24252 - DNA, 22 bp, Artificial Sequence
  chemically synthesized
tttgtgtaaataaggccattgt

SEQ ID NO: 24253 - DNA, 22 bp, Artificial Sequence
  chemically synthesized
ttgtgtaaataaggccattgtt

SEQ ID NO: 24254 - DNA, 22 bp, Artificial Sequence
  chemically synthesized
tgtgtaaataaggccattgttt

SEQ ID NO: 24255 - DNA, 22 bp, Artificial Sequence
  chemically synthesized
gtgtaaataaggccattgtttg

SEQ ID NO: 24256 - DNA, 22 bp, Artificial Sequence
  chemically synthesized
tgtaaataaggccattgtttgt

SEQ ID NO: 24257 - DNA, 22 bp, Artificial Sequence
  chemically synthesized
tttgtgcttttgtttcccattt

SEQ ID NO: 24258 - DNA, 22 bp, Artificial Sequence
  chemically synthesized
gtgcttttgtttcccattttga

SEQ ID NO: 24259 - DNA, 22 bp, Artificial Sequence
  chemically synthesized
tgcttttgtttcccattttgat

SEQ ID NO: 24260 - DNA, 22 bp, Artificial Sequence
  chemically synthesized
ttgtttcccattttgatttcaa

SEQ ID NO: 24261 - DNA, 22 bp, Artificial Sequence
  chemically synthesized
tgtttcccattttgatttcaaa

SEQ ID NO: 24262 - DNA, 22 bp, Artificial Sequence
  chemically synthesized
gtttcccattttgatttcaaag

SEQ ID NO: 24263 - DNA, 22 bp, Artificial Sequence
  chemically synthesized
tttcccattttgatttcaaagt

SEQ ID NO: 24264 - DNA, 22 bp, Artificial Sequence
  chemically synthesized
cccattttgatttcaaagtggt

SEQ ID NO: 24265 - DNA, 22 bp, Artificial Sequence
  chemically synthesized
ccattttgatttcaaagtggta

SEQ ID NO: 24266 - DNA, 22 bp, Artificial Sequence
  chemically synthesized
tgatttcaaagtggtaagtcca

SEQ ID NO: 24267 - DNA, 22 bp, Artificial Sequence
  chemically synthesized
gatttcaaagtggtaagtccaa

SEQ ID NO: 24268 - DNA, 22 bp, Artificial Sequence
  chemically synthesized
atttcaaagtggtaagtccaaa

SEQ ID NO: 24269 - DNA, 22 bp, Artificial Sequence
  chemically synthesized
caaagtggtaagtccaaacaaa

SEQ ID NO: 24270 - DNA, 22 bp, Artificial Sequence
  chemically synthesized
aaagtggtaagtccaaacaaaa

SEQ ID NO: 24271 - DNA, 22 bp, Artificial Sequence
  chemically synthesized
ttttttttcactatattctgct

SEQ ID NO: 24272 - DNA, 22 bp, Artificial Sequence
  chemically synthesized
tttttcactatattctgctatt

SEQ ID NO: 24273 - DNA, 22 bp, Artificial Sequence
  chemically synthesized
ttttcactatattctgctattt

SEQ ID NO: 24274 - DNA, 22 bp, Artificial Sequence
  chemically synthesized
tttcactatattctgctatttc

SEQ ID NO: 24275 - DNA, 22 bp, Artificial Sequence
  chemically synthesized
ttcactatattctgctatttct

SEQ ID NO: 24276 - DNA, 22 bp, Artificial Sequence
  chemically synthesized
tcactatattctgctatttctt

SEQ ID NO: 24277 - DNA, 22 bp, Artificial Sequence
  chemically synthesized
cactatattctgctatttcttt

SEQ ID NO: 24278 - DNA, 22 bp, Artificial Sequence
  chemically synthesized
actatattctgctatttctttg

SEQ ID NO: 24279 - DNA, 22 bp, Artificial Sequence
  chemically synthesized
tattctgctatttctttgtttt

SEQ ID NO: 24280 - DNA, 22 bp, Artificial Sequence
  chemically synthesized
tgctatttctttgttttcccac

SEQ ID NO: 24281 - DNA, 22 bp, Artificial Sequence
  chemically synthesized
ctatttctttgttttcccactt

SEQ ID NO: 24282 - DNA, 22 bp, Artificial Sequence
  chemically synthesized
tttctttgttttcccactttta

SEQ ID NO: 24283 - DNA, 22 bp, Artificial Sequence
  chemically synthesized
ctttgttttcccacttttaatt

SEQ ID NO: 24284 - DNA, 22 bp, Artificial Sequence
  chemically synthesized
tttgttttcccacttttaattt

SEQ ID NO: 24285 - DNA, 22 bp, Artificial Sequence
  chemically synthesized
tgttttcccacttttaattttt

SEQ ID NO: 24286 - DNA, 22 bp, Artificial Sequence
  chemically synthesized
gttttcccacttttaatttttt

SEQ ID NO: 24287 - DNA, 22 bp, Artificial Sequence
  chemically synthesized
ttttcccacttttaattttttt

SEQ ID NO: 24288 - DNA, 22 bp, Artificial Sequence
  chemically synthesized
tcccacttttaatttttttaaa

SEQ ID NO: 24289 - DNA, 22 bp, Artificial Sequence
  chemically synthesized
cccacttttaatttttttaaac

SEQ ID NO: 24290 - DNA, 22 bp, Artificial Sequence
  chemically synthesized
ccacttttaatttttttaaacc

SEQ ID NO: 24291 - DNA, 22 bp, Artificial Sequence
  chemically synthesized
ttaatttttttaaaccaaggag

SEQ ID NO: 24292 - DNA, 22 bp, Artificial Sequence
  chemically synthesized
taatttttttaaaccaaggaga

SEQ ID NO: 24293 - DNA, 22 bp, Artificial Sequence
  chemically synthesized
aatttttttaaaccaaggagat

SEQ ID NO: 24294 - DNA, 22 bp, Artificial Sequence
  chemically synthesized
atttttttaaaccaaggagatg

SEQ ID NO: 24295 - DNA, 22 bp, Artificial Sequence
  chemically synthesized
ttttaaaccaaggagatgaatg

SEQ ID NO: 24296 - DNA, 22 bp, Artificial Sequence
  chemically synthesized
tttaaaccaaggagatgaatgt

SEQ ID NO: 24297 - DNA, 22 bp, Artificial Sequence
  chemically synthesized
ttaaaccaaggagatgaatgtt

SEQ ID NO: 24298 - DNA, 22 bp, Artificial Sequence
  chemically synthesized
taaaccaaggagatgaatgttt

SEQ ID NO: 24299 - DNA, 22 bp, Artificial Sequence
  chemically synthesized
aaaccaaggagatgaatgtttt

SEQ ID NO: 24300 - DNA, 22 bp, Artificial Sequence
  chemically synthesized
aaccaaggagatgaatgttttc

SEQ ID NO: 24301 - DNA, 22 bp, Artificial Sequence
  chemically synthesized
tctaacaggaattacatgacca

SEQ ID NO: 24302 - DNA, 22 bp, Artificial Sequence
  chemically synthesized
ctaacaggaattacatgaccaa

SEQ ID NO: 24303 - DNA, 22 bp, Artificial Sequence
  chemically synthesized
taacaggaattacatgaccaaa

SEQ ID NO: 24304 - DNA, 22 bp, Artificial Sequence
  chemically synthesized
acaggaattacatgaccaaatc

SEQ ID NO: 24305 - DNA, 22 bp, Artificial Sequence
  chemically synthesized
catgaccaaatcatgaactgaa

SEQ ID NO: 24306 - DNA, 22 bp, Artificial Sequence
  chemically synthesized
aacagtgtttattaaacataaa

SEQ ID NO: 24307 - DNA, 22 bp, Artificial Sequence
  chemically synthesized
attaaacataaatgcatcataa

SEQ ID NO: 24308 - DNA, 22 bp, Artificial Sequence
  chemically synthesized
ttaaacataaatgcatcataag

SEQ ID NO: 24309 - DNA, 22 bp, Artificial Sequence
  chemically synthesized
aacataaatgcatcataagcat

SEQ ID NO: 24310 - DNA, 22 bp, Artificial Sequence
  chemically synthesized
tcgatctatttagttttaaaaa

SEQ ID NO: 24311 - DNA, 22 bp, Artificial Sequence
  chemically synthesized
tttagttttaaaaatgaagaag

SEQ ID NO: 24312 - DNA, 22 bp, Artificial Sequence
  chemically synthesized
agttttaaaaatgaagaagaag

SEQ ID NO: 24313 - DNA, 22 bp, Artificial Sequence
  chemically synthesized
gttttaaaaatgaagaagaaga

SEQ ID NO: 24314 - DNA, 22 bp, Artificial Sequence
  chemically synthesized
taaaaatgaagaagaagaaaac

SEQ ID NO: 24315 - DNA, 22 bp, Artificial Sequence
  chemically synthesized
aaaaatgaagaagaagaaaacc

SEQ ID NO: 24316 - DNA, 22 bp, Artificial Sequence
  chemically synthesized
aaaatgaagaagaagaaaacct

SEQ ID NO: 24317 - DNA, 22 bp, Artificial Sequence
  chemically synthesized
gctaacaaagaaccagtactta

SEQ ID NO: 24318 - DNA, 22 bp, Artificial Sequence
  chemically synthesized
acaaagaaccagtacttaccaa

SEQ ID NO: 24319 - DNA, 22 bp, Artificial Sequence
  chemically synthesized
accaacctgcgtgctggctgtt

SEQ ID NO: 24320 - DNA, 22 bp, Artificial Sequence
  chemically synthesized
ccaacctgcgtgctggctgtta

SEQ ID NO: 24321 - DNA, 22 bp, Artificial Sequence
  chemically synthesized
cgtgctggctgttagactcttc

SEQ ID NO: 24322 - DNA, 22 bp, Artificial Sequence
  chemically synthesized
gctgttagactcttcaatattg

SEQ ID NO: 24323 - DNA, 22 bp, Artificial Sequence
  chemically synthesized
ttagactcttcaatattgctgt

SEQ ID NO: 24324 - DNA, 22 bp, Artificial Sequence
  chemically synthesized
gactcttcaatattgctgtcaa

SEQ ID NO: 24325 - DNA, 22 bp, Artificial Sequence
  chemically synthesized
ttcaatattgctgtcaaatcat

SEQ ID NO: 24326 - DNA, 22 bp, Artificial Sequence
  chemically synthesized
caatattgctgtcaaatcatgt

SEQ ID NO: 24327 - DNA, 22 bp, Artificial Sequence
  chemically synthesized
aatattgctgtcaaatcatgta

SEQ ID NO: 24328 - DNA, 22 bp, Artificial Sequence
  chemically synthesized
ctgtcaaatcatgtaatcaaaa

SEQ ID NO: 24329 - DNA, 22 bp, Artificial Sequence
  chemically synthesized
tcaaatcatgtaatcaaaattt

SEQ ID NO: 24330 - DNA, 22 bp, Artificial Sequence
  chemically synthesized
agtgaagaagacagcatcagat

SEQ ID NO: 24331 - DNA, 22 bp, Artificial Sequence
  chemically synthesized
gtgaagaagacagcatcagata

SEQ ID NO: 24332 - DNA, 22 bp, Artificial Sequence
  chemically synthesized
ctatatctaaaaggcaagcata

SEQ ID NO: 24333 - DNA, 22 bp, Artificial Sequence
  chemically synthesized
tatatctaaaaggcaagcatac

SEQ ID NO: 24334 - DNA, 22 bp, Artificial Sequence
  chemically synthesized
tatctaaaaggcaagcatactc

SEQ ID NO: 24335 - DNA, 22 bp, Artificial Sequence
  chemically synthesized
aaaggcaagcatactcaatgta

SEQ ID NO: 24336 - DNA, 22 bp, Artificial Sequence
  chemically synthesized
aatgtattttaaaaaaggaaac

SEQ ID NO: 24337 - DNA, 22 bp, Artificial Sequence
  chemically synthesized
taaaaaaggaaacaaacctgta

SEQ ID NO: 24338 - DNA, 22 bp, Artificial Sequence
  chemically synthesized
aaaaaaggaaacaaacctgtac

SEQ ID NO: 24339 - DNA, 22 bp, Artificial Sequence
  chemically synthesized
aaaaaggaaacaaacctgtaca

SEQ ID NO: 24340 - DNA, 22 bp, Artificial Sequence
  chemically synthesized
tacattcagcactgagtagata

SEQ ID NO: 24341 - DNA, 22 bp, Artificial Sequence
  chemically synthesized
agcactgagtagatatcctaaa

SEQ ID NO: 24342 - DNA, 22 bp, Artificial Sequence
  chemically synthesized
agtagatatcctaaaaggcaga

SEQ ID NO: 24343 - DNA, 22 bp, Artificial Sequence
  chemically synthesized
aaaggcagatggtgatgaggcc

SEQ ID NO: 24344 - DNA, 22 bp, Artificial Sequence
  chemically synthesized
gtgattctgccatgatcatgtt

SEQ ID NO: 24345 - DNA, 22 bp, Artificial Sequence
  chemically synthesized
tgccatgatcatgttcacgcgc

SEQ ID NO: 24346 - DNA, 22 bp, Artificial Sequence
  chemically synthesized
ccatgatcatgttcacgcgctg

SEQ ID NO: 24347 - DNA, 22 bp, Artificial Sequence
  chemically synthesized
acgcgctgcataacctttgcta

SEQ ID NO: 24348 - DNA, 22 bp, Artificial Sequence
  chemically synthesized
cataacctttgctagcagattg

SEQ ID NO: 24349 - DNA, 22 bp, Artificial Sequence
  chemically synthesized
tgctagcagattgtgaaagtgg

SEQ ID NO: 24350 - DNA, 22 bp, Artificial Sequence
  chemically synthesized
gctagcagattgtgaaagtggt

SEQ ID NO: 24351 - DNA, 20 bp, Artificial Sequence
  chemically synthesized
tttagacaaacgtggttttt

SEQ ID NO: 24352 - DNA, 20 bp, Artificial Sequence
  chemically synthesized
aaacgtggtttttgagtcca

SEQ ID NO: 24353 - DNA, 20 bp, Artificial Sequence
  chemically synthesized
tggtttttgagtccaaagat

SEQ ID NO: 24354 - DNA, 20 bp, Artificial Sequence
  chemically synthesized
ggtttttgagtccaaagatc

SEQ ID NO: 24355 - DNA, 20 bp, Artificial Sequence
  chemically synthesized
gtttttgagtccaaagatca

SEQ ID NO: 24356 - DNA, 20 bp, Artificial Sequence
  chemically synthesized
ttgagtccaaagatcagggc

SEQ ID NO: 24357 - DNA, 20 bp, Artificial Sequence
  chemically synthesized
tgagtccaaagatcagggct

SEQ ID NO: 24358 - DNA, 20 bp, Artificial Sequence
  chemically synthesized
ggctgggttgacctgaatac

SEQ ID NO: 24359 - DNA, 20 bp, Artificial Sequence
  chemically synthesized
gttgacctgaatactggata

SEQ ID NO: 24360 - DNA, 20 bp, Artificial Sequence
  chemically synthesized
ttgacctgaatactggatac

SEQ ID NO: 24361 - DNA, 20 bp, Artificial Sequence
  chemically synthesized
tgacctgaatactggataca

SEQ ID NO: 24362 - DNA, 20 bp, Artificial Sequence
  chemically synthesized
tggatacagggcatataaaa

SEQ ID NO: 24363 - DNA, 20 bp, Artificial Sequence
  chemically synthesized
ggatacagggcatataaaac

SEQ ID NO: 24364 - DNA, 20 bp, Artificial Sequence
  chemically synthesized
gatacagggcatataaaaca

SEQ ID NO: 24365 - DNA, 20 bp, Artificial Sequence
  chemically synthesized
atacagggcatataaaacag

SEQ ID NO: 24366 - DNA, 20 bp, Artificial Sequence
  chemically synthesized
agggcatataaaacaggggc

SEQ ID NO: 24367 - DNA, 20 bp, Artificial Sequence
  chemically synthesized
gggcatataaaacaggggca

SEQ ID NO: 24368 - DNA, 20 bp, Artificial Sequence
  chemically synthesized
tataaaacaggggcaaggca

SEQ ID NO: 24369 - DNA, 20 bp, Artificial Sequence
  chemically synthesized
aggggcaaggcacagactca

SEQ ID NO: 24370 - DNA, 20 bp, Artificial Sequence
  chemically synthesized
ggcaaggcacagactcatag

SEQ ID NO: 24371 - DNA, 20 bp, Artificial Sequence
  chemically synthesized
caaggcacagactcatagca

SEQ ID NO: 24372 - DNA, 20 bp, Artificial Sequence
  chemically synthesized
atagcagagcaatcaccacc

SEQ ID NO: 24373 - DNA, 20 bp, Artificial Sequence
  chemically synthesized
agagcaatcaccaccaagcc

SEQ ID NO: 24374 - DNA, 20 bp, Artificial Sequence
  chemically synthesized
accaagcctggaataactgc

SEQ ID NO: 24375 - DNA, 20 bp, Artificial Sequence
  chemically synthesized
ccaagcctggaataactgca

SEQ ID NO: 24376 - DNA, 20 bp, Artificial Sequence
  chemically synthesized
caagcctggaataactgcaa

SEQ ID NO: 24377 - DNA, 20 bp, Artificial Sequence
  chemically synthesized
ggctctgctgacatcttcct

SEQ ID NO: 24378 - DNA, 20 bp, Artificial Sequence
  chemically synthesized
gctctgctgacatcttcctg

SEQ ID NO: 24379 - DNA, 20 bp, Artificial Sequence
  chemically synthesized
tgacatcttcctgaggtgcc

SEQ ID NO: 24380 - DNA, 20 bp, Artificial Sequence
  chemically synthesized
gacatcttcctgaggtgcca

SEQ ID NO: 24381 - DNA, 20 bp, Artificial Sequence
  chemically synthesized
tcctgaggtgccaaggaaat

SEQ ID NO: 24382 - DNA, 20 bp, Artificial Sequence
  chemically synthesized
cctgaggtgccaaggaaatg

SEQ ID NO: 24383 - DNA, 20 bp, Artificial Sequence
  chemically synthesized
aggtgccaaggaaatgagga

SEQ ID NO: 24384 - DNA, 20 bp, Artificial Sequence
  chemically synthesized
gtgccaaggaaatgaggatg

SEQ ID NO: 24385 - DNA, 20 bp, Artificial Sequence
  chemically synthesized
tgccaaggaaatgaggatgg

SEQ ID NO: 24386 - DNA, 20 bp, Artificial Sequence
  chemically synthesized
caaggaaatgaggatggagg

SEQ ID NO: 24387 - DNA, 20 bp, Artificial Sequence
  chemically synthesized
aaggaaatgaggatggagga

SEQ ID NO: 24388 - DNA, 20 bp, Artificial Sequence
  chemically synthesized
atgaatgttctccatgactt

SEQ ID NO: 24389 - DNA, 20 bp, Artificial Sequence
  chemically synthesized
tgaatgttctccatgacttt

SEQ ID NO: 24390 - DNA, 20 bp, Artificial Sequence
  chemically synthesized
ttctccatgactttgggatc

SEQ ID NO: 24391 - DNA, 20 bp, Artificial Sequence
  chemically synthesized
tccagtcaacacattacctc

SEQ ID NO: 24392 - DNA, 20 bp, Artificial Sequence
  chemically synthesized
ccagtcaacacattacctcc

SEQ ID NO: 24393 - DNA, 20 bp, Artificial Sequence
  chemically synthesized
ttacctccaggtgaattacc

SEQ ID NO: 24394 - DNA, 20 bp, Artificial Sequence
  chemically synthesized
aggtgaattaccaagactcc

SEQ ID NO: 24395 - DNA, 20 bp, Artificial Sequence
  chemically synthesized
ggtgaattaccaagactccc

SEQ ID NO: 24396 - DNA, 20 bp, Artificial Sequence
  chemically synthesized
attaccaagactcccaggac

SEQ ID NO: 24397 - DNA, 20 bp, Artificial Sequence
  chemically synthesized
ctcccaggactggttcatct

SEQ ID NO: 24398 - DNA, 20 bp, Artificial Sequence
  chemically synthesized
catcttggtgtccgtgatcg

SEQ ID NO: 24399 - DNA, 20 bp, Artificial Sequence
  chemically synthesized
gtgtccgtgatcgcagacct

SEQ ID NO: 24400 - DNA, 20 bp, Artificial Sequence
  chemically synthesized
tgtccgtgatcgcagacctc

SEQ ID NO: 24401 - DNA, 20 bp, Artificial Sequence
  chemically synthesized
tctacgtcctcttccccatc

SEQ ID NO: 24402 - DNA, 20 bp, Artificial Sequence
  chemically synthesized
tccccatctggttccatctt

SEQ ID NO: 24403 - DNA, 20 bp, Artificial Sequence
  chemically synthesized
ccccatctggttccatcttc

SEQ ID NO: 24404 - DNA, 20 bp, Artificial Sequence
  chemically synthesized
catctggttccatcttcagg

SEQ ID NO: 24405 - DNA, 20 bp, Artificial Sequence
  chemically synthesized
gttccatcttcaggaagctg

SEQ ID NO: 24406 - DNA, 20 bp, Artificial Sequence
  chemically synthesized
ttccatcttcaggaagctgt

SEQ ID NO: 24407 - DNA, 20 bp, Artificial Sequence
  chemically synthesized
ctgtgggcattaaactcctt

SEQ ID NO: 24408 - DNA, 20 bp, Artificial Sequence
  chemically synthesized
tgtgggcattaaactccttt

SEQ ID NO: 24409 - DNA, 20 bp, Artificial Sequence
  chemically synthesized
gggcattaaactcctttggg

SEQ ID NO: 24410 - DNA, 20 bp, Artificial Sequence
  chemically synthesized
ctcctttgggtagctgtgat

SEQ ID NO: 24411 - DNA, 20 bp, Artificial Sequence
  chemically synthesized
cctttgggtagctgtgattg

SEQ ID NO: 24412 - DNA, 20 bp, Artificial Sequence
  chemically synthesized
gggtagctgtgattggagac

SEQ ID NO: 24413 - DNA, 20 bp, Artificial Sequence
  chemically synthesized
actggctcaacctcgtcttt

SEQ ID NO: 24414 - DNA, 20 bp, Artificial Sequence
  chemically synthesized
ggctcaacctcgtctttaag

SEQ ID NO: 24415 - DNA, 20 bp, Artificial Sequence
  chemically synthesized
caacctcgtctttaagtggt

SEQ ID NO: 24416 - DNA, 20 bp, Artificial Sequence
  chemically synthesized
tttaagtggtaagaaccata

SEQ ID NO: 24417 - DNA, 20 bp, Artificial Sequence
  chemically synthesized
taagtggtaagaaccatata

SEQ ID NO: 24418 - DNA, 20 bp, Artificial Sequence
  chemically synthesized
agtggtaagaaccatataga

SEQ ID NO: 24419 - DNA, 20 bp, Artificial Sequence
  chemically synthesized
gtggtaagaaccatatagag

SEQ ID NO: 24420 - DNA, 20 bp, Artificial Sequence
  chemically synthesized
ggtaagaaccatatagagag

SEQ ID NO: 24421 - DNA, 20 bp, Artificial Sequence
  chemically synthesized
gaaccatatagagaggagat

SEQ ID NO: 24422 - DNA, 20 bp, Artificial Sequence
  chemically synthesized
catatagagaggagatcagc

SEQ ID NO: 24423 - DNA, 20 bp, Artificial Sequence
  chemically synthesized
agagaggagatcagcaagaa

SEQ ID NO: 24424 - DNA, 20 bp, Artificial Sequence
  chemically synthesized
agaggagatcagcaagaaaa

SEQ ID NO: 24425 - DNA, 20 bp, Artificial Sequence
  chemically synthesized
gaggagatcagcaagaaaag

SEQ ID NO: 24426 - DNA, 20 bp, Artificial Sequence
  chemically synthesized
agatcagcaagaaaagaggc

SEQ ID NO: 24427 - DNA, 20 bp, Artificial Sequence
  chemically synthesized
ctctcgcaatgtctgtccat

SEQ ID NO: 24428 - DNA, 20 bp, Artificial Sequence
  chemically synthesized
tcgcaatgtctgtccatcag

SEQ ID NO: 24429 - DNA, 20 bp, Artificial Sequence
  chemically synthesized
ccatcagaagttgctttccc

SEQ ID NO: 24430 - DNA, 20 bp, Artificial Sequence
  chemically synthesized
catcagaagttgctttcccc

SEQ ID NO: 24431 - DNA, 20 bp, Artificial Sequence
  chemically synthesized
gttgctttccccaggctatt

SEQ ID NO: 24432 - DNA, 20 bp, Artificial Sequence
  chemically synthesized
ttgctttccccaggctattc

SEQ ID NO: 24433 - DNA, 20 bp, Artificial Sequence
  chemically synthesized
ctttccccaggctattcagg

SEQ ID NO: 24434 - DNA, 20 bp, Artificial Sequence
  chemically synthesized
ccaggctattcaggaagcca

SEQ ID NO: 24435 - DNA, 20 bp, Artificial Sequence
  chemically synthesized
caggctattcaggaagccac

SEQ ID NO: 24436 - DNA, 20 bp, Artificial Sequence
  chemically synthesized
ccaacccctctctctgactt

SEQ ID NO: 24437 - DNA, 20 bp, Artificial Sequence
  chemically synthesized
gactttggatcatctacata

SEQ ID NO: 24438 - DNA, 20 bp, Artificial Sequence
  chemically synthesized
actttggatcatctacataa

SEQ ID NO: 24439 - DNA, 20 bp, Artificial Sequence
  chemically synthesized
ctttggatcatctacataaa

SEQ ID NO: 24440 - DNA, 20 bp, Artificial Sequence
  chemically synthesized
tttggatcatctacataaag

SEQ ID NO: 24441 - DNA, 20 bp, Artificial Sequence
  chemically synthesized
ttggatcatctacataaagg

SEQ ID NO: 24442 - DNA, 20 bp, Artificial Sequence
  chemically synthesized
gatcatctacataaaggggg

SEQ ID NO: 24443 - DNA, 20 bp, Artificial Sequence
  chemically synthesized
atctacataaagggggaaga

SEQ ID NO: 24444 - DNA, 20 bp, Artificial Sequence
  chemically synthesized
gaagacagaaaaaatcctac

SEQ ID NO: 24445 - DNA, 20 bp, Artificial Sequence
  chemically synthesized
acagaaaaaatcctaccagt

SEQ ID NO: 24446 - DNA, 20 bp, Artificial Sequence
  chemically synthesized
ctaccagtgagttgaaaata

SEQ ID NO: 24447 - DNA, 20 bp, Artificial Sequence
  chemically synthesized
taccagtgagttgaaaatac

SEQ ID NO: 24448 - DNA, 20 bp, Artificial Sequence
  chemically synthesized
agtgagttgaaaatacagga

SEQ ID NO: 24449 - DNA, 20 bp, Artificial Sequence
  chemically synthesized
acaggaaagcctatttcata

SEQ ID NO: 24450 - DNA, 20 bp, Artificial Sequence
  chemically synthesized
caggaaagcctatttcatat

SEQ ID NO: 24451 - DNA, 20 bp, Artificial Sequence
  chemically synthesized
agcctatttcatatgggtta

SEQ ID NO: 24452 - DNA, 20 bp, Artificial Sequence
  chemically synthesized
gcctatttcatatgggttaa

SEQ ID NO: 24453 - DNA, 20 bp, Artificial Sequence
  chemically synthesized
cctatttcatatgggttaaa

SEQ ID NO: 24454 - DNA, 20 bp, Artificial Sequence
  chemically synthesized
atttcatatgggttaaaggg

SEQ ID NO: 24455 - DNA, 20 bp, Artificial Sequence
  chemically synthesized
tttcatatgggttaaagggt

SEQ ID NO: 24456 - DNA, 20 bp, Artificial Sequence
  chemically synthesized
atatgggttaaagggtagga

SEQ ID NO: 24457 - DNA, 20 bp, Artificial Sequence
  chemically synthesized
ggacagttgaatttcgtgaa

SEQ ID NO: 24458 - DNA, 20 bp, Artificial Sequence
  chemically synthesized
ttgaatttcgtgaaaagtct

SEQ ID NO: 24459 - DNA, 20 bp, Artificial Sequence
  chemically synthesized
cgtgaaaagtctgagttata

SEQ ID NO: 24460 - DNA, 20 bp, Artificial Sequence
  chemically synthesized
gtgaaaagtctgagttatat

SEQ ID NO: 24461 - DNA, 20 bp, Artificial Sequence
  chemically synthesized
gtctgagttatataggcttt

SEQ ID NO: 24462 - DNA, 20 bp, Artificial Sequence
  chemically synthesized
agttatataggctttgagca

SEQ ID NO: 24463 - DNA, 20 bp, Artificial Sequence
  chemically synthesized
ttatataggctttgagcaaa

SEQ ID NO: 24464 - DNA, 20 bp, Artificial Sequence
  chemically synthesized
ctttgagcaaagagttttat

SEQ ID NO: 24465 - DNA, 20 bp, Artificial Sequence
  chemically synthesized
caaagagttttattagtatg

SEQ ID NO: 24466 - DNA, 20 bp, Artificial Sequence
  chemically synthesized
agagttttattagtatgaag

SEQ ID NO: 24467 - DNA, 20 bp, Artificial Sequence
  chemically synthesized
gttttattagtatgaagcag

SEQ ID NO: 24468 - DNA, 20 bp, Artificial Sequence
  chemically synthesized
tttattagtatgaagcagaa

SEQ ID NO: 24469 - DNA, 20 bp, Artificial Sequence
  chemically synthesized
ttattagtatgaagcagaag

SEQ ID NO: 24470 - DNA, 20 bp, Artificial Sequence
  chemically synthesized
gaagcagaagaggtaacata

SEQ ID NO: 24471 - DNA, 20 bp, Artificial Sequence
  chemically synthesized
cagaagaggtaacataaaga

SEQ ID NO: 24472 - DNA, 20 bp, Artificial Sequence
  chemically synthesized
gtaacataaagaaagatgta

SEQ ID NO: 24473 - DNA, 20 bp, Artificial Sequence
  chemically synthesized
taacataaagaaagatgtat

SEQ ID NO: 24474 - DNA, 20 bp, Artificial Sequence
  chemically synthesized
aacataaagaaagatgtatg

SEQ ID NO: 24475 - DNA, 20 bp, Artificial Sequence
  chemically synthesized
taaagaaagatgtatggggc

SEQ ID NO: 24476 - DNA, 20 bp, Artificial Sequence
  chemically synthesized
aaagaaagatgtatggggcc

SEQ ID NO: 24477 - DNA, 20 bp, Artificial Sequence
  chemically synthesized
aagatgtatggggccaggca

SEQ ID NO: 24478 - DNA, 20 bp, Artificial Sequence
  chemically synthesized
atgtatggggccaggcatgg

SEQ ID NO: 24479 - DNA, 20 bp, Artificial Sequence
  chemically synthesized
gtggctcacacctgtaatcc

SEQ ID NO: 24480 - DNA, 20 bp, Artificial Sequence
  chemically synthesized
cacctgtaatcccagcactt

SEQ ID NO: 24481 - DNA, 20 bp, Artificial Sequence
  chemically synthesized
acctgtaatcccagcacttt

SEQ ID NO: 24482 - DNA, 20 bp, Artificial Sequence
  chemically synthesized
ctgtaatcccagcactttgg

SEQ ID NO: 24483 - DNA, 20 bp, Artificial Sequence
  chemically synthesized
tgtaatcccagcactttggg

SEQ ID NO: 24484 - DNA, 20 bp, Artificial Sequence
  chemically synthesized
tcccagcactttgggaggcc

SEQ ID NO: 24485 - DNA, 20 bp, Artificial Sequence
  chemically synthesized
cccagcactttgggaggccg

SEQ ID NO: 24486 - DNA, 20 bp, Artificial Sequence
  chemically synthesized
agcactttgggaggccgagg

SEQ ID NO: 24487 - DNA, 20 bp, Artificial Sequence
  chemically synthesized
gcactttgggaggccgaggt

SEQ ID NO: 24488 - DNA, 20 bp, Artificial Sequence
  chemically synthesized
cgaggtgggcgaatcactcc

SEQ ID NO: 24489 - DNA, 20 bp, Artificial Sequence
  chemically synthesized
gaggtgggcgaatcactcct

SEQ ID NO: 24490 - DNA, 20 bp, Artificial Sequence
  chemically synthesized
gaatcactcctgggtgaact

SEQ ID NO: 24491 - DNA, 20 bp, Artificial Sequence
  chemically synthesized
aatcactcctgggtgaactc

SEQ ID NO: 24492 - DNA, 20 bp, Artificial Sequence
  chemically synthesized
tcactcctgggtgaactcag

SEQ ID NO: 24493 - DNA, 20 bp, Artificial Sequence
  chemically synthesized
ctgggtgaactcaggagttc

SEQ ID NO: 24494 - DNA, 20 bp, Artificial Sequence
  chemically synthesized
tgaactcaggagttcaagac

SEQ ID NO: 24495 - DNA, 20 bp, Artificial Sequence
  chemically synthesized
tcaggagttcaagaccagcc

SEQ ID NO: 24496 - DNA, 20 bp, Artificial Sequence
  chemically synthesized
caggagttcaagaccagcct

SEQ ID NO: 24497 - DNA, 20 bp, Artificial Sequence
  chemically synthesized
caagaccagcctgggcaaca

SEQ ID NO: 24498 - DNA, 20 bp, Artificial Sequence
  chemically synthesized
tacaaaaacattacgaaaat

SEQ ID NO: 24499 - DNA, 20 bp, Artificial Sequence
  chemically synthesized
aaaacattacgaaaattagc

SEQ ID NO: 24500 - DNA, 20 bp, Artificial Sequence
  chemically synthesized
aaacattacgaaaattagct

SEQ ID NO: 24501 - DNA, 20 bp, Artificial Sequence
  chemically synthesized
cgaaaattagctgggcgtgt

SEQ ID NO: 24502 - DNA, 20 bp, Artificial Sequence
  chemically synthesized
agctgggcgtgttggtgctg

SEQ ID NO: 24503 - DNA, 20 bp, Artificial Sequence
  chemically synthesized
gcgtgttggtgctgtagtcc

SEQ ID NO: 24504 - DNA, 20 bp, Artificial Sequence
  chemically synthesized
gtgctgtagtcccagctact

SEQ ID NO: 24505 - DNA, 20 bp, Artificial Sequence
  chemically synthesized
tgctgtagtcccagctactc

SEQ ID NO: 24506 - DNA, 20 bp, Artificial Sequence
  chemically synthesized
ctgtagtcccagctactcag

SEQ ID NO: 24507 - DNA, 20 bp, Artificial Sequence
  chemically synthesized
tgtagtcccagctactcagg

SEQ ID NO: 24508 - DNA, 20 bp, Artificial Sequence
  chemically synthesized
tcccagctactcaggaggct

SEQ ID NO: 24509 - DNA, 20 bp, Artificial Sequence
  chemically synthesized
cccagctactcaggaggctg

SEQ ID NO: 24510 - DNA, 20 bp, Artificial Sequence
  chemically synthesized
gctactcaggaggctgaggt

SEQ ID NO: 24511 - DNA, 20 bp, Artificial Sequence
  chemically synthesized
tactcaggaggctgaggtga

SEQ ID NO: 24512 - DNA, 20 bp, Artificial Sequence
  chemically synthesized
actcaggaggctgaggtgag

SEQ ID NO: 24513 - DNA, 20 bp, Artificial Sequence
  chemically synthesized
caggaggctgaggtgagagg

SEQ ID NO: 24514 - DNA, 20 bp, Artificial Sequence
  chemically synthesized
ggaggctgaggtgagaggcg

SEQ ID NO: 24515 - DNA, 20 bp, Artificial Sequence
  chemically synthesized
gaggctgaggtgagaggcgg

SEQ ID NO: 24516 - DNA, 20 bp, Artificial Sequence
  chemically synthesized
ggctgaggtgagaggcggag

SEQ ID NO: 24517 - DNA, 20 bp, Artificial Sequence
  chemically synthesized
gctgaggtgagaggcggagg

SEQ ID NO: 24518 - DNA, 20 bp, Artificial Sequence
  chemically synthesized
gtgagaggcggaggaggttg

SEQ ID NO: 24519 - DNA, 20 bp, Artificial Sequence
  chemically synthesized
gaggcggaggaggttgcagt

SEQ ID NO: 24520 - DNA, 20 bp, Artificial Sequence
  chemically synthesized
ggaggaggttgcagtgagtc

SEQ ID NO: 24521 - DNA, 20 bp, Artificial Sequence
  chemically synthesized
aagatcatgccactgcactc

SEQ ID NO: 24522 - DNA, 20 bp, Artificial Sequence
  chemically synthesized
catgccactgcactccagcc

SEQ ID NO: 24523 - DNA, 20 bp, Artificial Sequence
  chemically synthesized
atgccactgcactccagcct

SEQ ID NO: 24524 - DNA, 20 bp, Artificial Sequence
  chemically synthesized
ctgcactccagcctgggcaa

SEQ ID NO: 24525 - DNA, 20 bp, Artificial Sequence
  chemically synthesized
gcactccagcctgggcaaca

SEQ ID NO: 24526 - DNA, 20 bp, Artificial Sequence
  chemically synthesized
tccagcctgggcaacagagt

SEQ ID NO: 24527 - DNA, 20 bp, Artificial Sequence
  chemically synthesized
cctgtctcaaaaaaaaaaaa

SEQ ID NO: 24528 - DNA, 20 bp, Artificial Sequence
  chemically synthesized
tctcaaaaaaaaaaaaaaga

SEQ ID NO: 24529 - DNA, 20 bp, Artificial Sequence
  chemically synthesized
tgatgtatgctgtatgaaaa

SEQ ID NO: 24530 - DNA, 20 bp, Artificial Sequence
  chemically synthesized
gatgtatgctgtatgaaaaa

SEQ ID NO: 24531 - DNA, 20 bp, Artificial Sequence
  chemically synthesized
gtatgaaaaaaggaaacaca

SEQ ID NO: 24532 - DNA, 20 bp, Artificial Sequence
  chemically synthesized
gaaacacacagatgattcaa

SEQ ID NO: 24533 - DNA, 20 bp, Artificial Sequence
  chemically synthesized
tgattcaacagcctgttttg

SEQ ID NO: 24534 - DNA, 20 bp, Artificial Sequence
  chemically synthesized
gattcaacagcctgttttgt

SEQ ID NO: 24535 - DNA, 20 bp, Artificial Sequence
  chemically synthesized
attcaacagcctgttttgtg

SEQ ID NO: 24536 - DNA, 20 bp, Artificial Sequence
  chemically synthesized
ctgttttgtggggtaatgaa

SEQ ID NO: 24537 - DNA, 20 bp, Artificial Sequence
  chemically synthesized
ggggtaatgaaaagtcaccc

SEQ ID NO: 24538 - DNA, 20 bp, Artificial Sequence
  chemically synthesized
gggtaatgaaaagtcaccct

SEQ ID NO: 24539 - DNA, 20 bp, Artificial Sequence
  chemically synthesized
tgaaaagtcaccctgggaac

SEQ ID NO: 24540 - DNA, 20 bp, Artificial Sequence
  chemically synthesized
gaaaagtcaccctgggaact

SEQ ID NO: 24541 - DNA, 20 bp, Artificial Sequence
  chemically synthesized
tcaccctgggaactgggctc

SEQ ID NO: 24542 - DNA, 20 bp, Artificial Sequence
  chemically synthesized
acccaccaactacatgtcct

SEQ ID NO: 24543 - DNA, 20 bp, Artificial Sequence
  chemically synthesized
accaactacatgtccttggc

SEQ ID NO: 24544 - DNA, 20 bp, Artificial Sequence
  chemically synthesized
gcaagtcatatcaattatct

SEQ ID NO: 24545 - DNA, 20 bp, Artificial Sequence
  chemically synthesized
tctgttttataatctacaaa

SEQ ID NO: 24546 - DNA, 20 bp, Artificial Sequence
  chemically synthesized
ctgttttataatctacaaat

SEQ ID NO: 24547 - DNA, 20 bp, Artificial Sequence
  chemically synthesized
atctacaaataggttatctc

SEQ ID NO: 24548 - DNA, 20 bp, Artificial Sequence
  chemically synthesized
tacaaataggttatctctgg

SEQ ID NO: 24549 - DNA, 20 bp, Artificial Sequence
  chemically synthesized
tctggcagcttaataataat

SEQ ID NO: 24550 - DNA, 20 bp, Artificial Sequence
  chemically synthesized
ctggcagcttaataataatc

SEQ ID NO: 24551 - DNA, 20 bp, Artificial Sequence
  chemically synthesized
tggcagcttaataataatca

SEQ ID NO: 24552 - DNA, 20 bp, Artificial Sequence
  chemically synthesized
cagggttaacatttattaaa

SEQ ID NO: 24553 - DNA, 20 bp, Artificial Sequence
  chemically synthesized
atttattaaacagtgtgtgc

SEQ ID NO: 24554 - DNA, 20 bp, Artificial Sequence
  chemically synthesized
tgtgctatgtgcttttctgt

SEQ ID NO: 24555 - DNA, 20 bp, Artificial Sequence
  chemically synthesized
gtgctatgtgcttttctgtg

SEQ ID NO: 24556 - DNA, 20 bp, Artificial Sequence
  chemically synthesized
ctatgtgcttttctgtgagg

SEQ ID NO: 24557 - DNA, 20 bp, Artificial Sequence
  chemically synthesized
gaggtagttactgctattta

SEQ ID NO: 24558 - DNA, 20 bp, Artificial Sequence
  chemically synthesized
gttactgctatttacagaaa

SEQ ID NO: 24559 - DNA, 20 bp, Artificial Sequence
  chemically synthesized
actgctatttacagaaacag

SEQ ID NO: 24560 - DNA, 20 bp, Artificial Sequence
  chemically synthesized
atttacagaaacagtagatg

SEQ ID NO: 24561 - DNA, 20 bp, Artificial Sequence
  chemically synthesized
ttacagaaacagtagatgca

SEQ ID NO: 24562 - DNA, 20 bp, Artificial Sequence
  chemically synthesized
aaacagtagatgcagagacc

SEQ ID NO: 24563 - DNA, 20 bp, Artificial Sequence
  chemically synthesized
aacagtagatgcagagacca

SEQ ID NO: 24564 - DNA, 20 bp, Artificial Sequence
  chemically synthesized
gatgcagagaccaaggtgct

SEQ ID NO: 24565 - DNA, 20 bp, Artificial Sequence
  chemically synthesized
aaggtgctgagttaaatgat

SEQ ID NO: 24566 - DNA, 20 bp, Artificial Sequence
  chemically synthesized
aggtgctgagttaaatgatt

SEQ ID NO: 24567 - DNA, 20 bp, Artificial Sequence
  chemically synthesized
agttaaatgattaggccaac

SEQ ID NO: 24568 - DNA, 20 bp, Artificial Sequence
  chemically synthesized
gttaaatgattaggccaaca

SEQ ID NO: 24569 - DNA, 20 bp, Artificial Sequence
  chemically synthesized
aatgattaggccaacaaggt

SEQ ID NO: 24570 - DNA, 20 bp, Artificial Sequence
  chemically synthesized
caacaaggttagtacatgcc

SEQ ID NO: 24571 - DNA, 20 bp, Artificial Sequence
  chemically synthesized
aaggttagtacatgccgagc

SEQ ID NO: 24572 - DNA, 20 bp, Artificial Sequence
  chemically synthesized
aggttagtacatgccgagcc

SEQ ID NO: 24573 - DNA, 20 bp, Artificial Sequence
  chemically synthesized
tagtacatgccgagccagga

SEQ ID NO: 24574 - DNA, 20 bp, Artificial Sequence
  chemically synthesized
tacatgccgagccaggatgg

SEQ ID NO: 24575 - DNA, 20 bp, Artificial Sequence
  chemically synthesized
gccgagccaggatggaagcc

SEQ ID NO: 24576 - DNA, 20 bp, Artificial Sequence
  chemically synthesized
ccgagccaggatggaagccc

SEQ ID NO: 24577 - DNA, 20 bp, Artificial Sequence
  chemically synthesized
agccaggatggaagcccagg

SEQ ID NO: 24578 - DNA, 20 bp, Artificial Sequence
  chemically synthesized
gccaggatggaagcccaggt

SEQ ID NO: 24579 - DNA, 20 bp, Artificial Sequence
  chemically synthesized
aggatggaagcccaggtagg

SEQ ID NO: 24580 - DNA, 20 bp, Artificial Sequence
  chemically synthesized
ggatggaagcccaggtaggc

SEQ ID NO: 24581 - DNA, 20 bp, Artificial Sequence
  chemically synthesized
ggaagcccaggtaggcaggc

SEQ ID NO: 24582 - DNA, 20 bp, Artificial Sequence
  chemically synthesized
ggtaggcaggctggcttccg

SEQ ID NO: 24583 - DNA, 20 bp, Artificial Sequence
  chemically synthesized
cttatgaactatgttacgtc

SEQ ID NO: 24584 - DNA, 20 bp, Artificial Sequence
  chemically synthesized
gtgctgataaactgactctc

SEQ ID NO: 24585 - DNA, 20 bp, Artificial Sequence
  chemically synthesized
tgctgataaactgactctct

SEQ ID NO: 24586 - DNA, 20 bp, Artificial Sequence
  chemically synthesized
gctgataaactgactctctg

SEQ ID NO: 24587 - DNA, 20 bp, Artificial Sequence
  chemically synthesized
tgataaactgactctctggg

SEQ ID NO: 24588 - DNA, 20 bp, Artificial Sequence
  chemically synthesized
taaactgactctctggggag

SEQ ID NO: 24589 - DNA, 20 bp, Artificial Sequence
  chemically synthesized
aaactgactctctggggagc

SEQ ID NO: 24590 - DNA, 20 bp, Artificial Sequence
  chemically synthesized
aactgactctctggggagca

SEQ ID NO: 24591 - DNA, 20 bp, Artificial Sequence
  chemically synthesized
actgactctctggggagcag

SEQ ID NO: 24592 - DNA, 20 bp, Artificial Sequence
  chemically synthesized
actctctggggagcagggga

SEQ ID NO: 24593 - DNA, 20 bp, Artificial Sequence
  chemically synthesized
ggggagcaggggaaagccct

SEQ ID NO: 24594 - DNA, 20 bp, Artificial Sequence
  chemically synthesized
gcaggggaaagccctgagtt

SEQ ID NO: 24595 - DNA, 20 bp, Artificial Sequence
  chemically synthesized
tcacgtaaacattcccattc

SEQ ID NO: 24596 - DNA, 20 bp, Artificial Sequence
  chemically synthesized
tttcttttgtttgtttgttt

SEQ ID NO: 24597 - DNA, 20 bp, Artificial Sequence
  chemically synthesized
ttttgtttgtttgtttgaga

SEQ ID NO: 24598 - DNA, 20 bp, Artificial Sequence
  chemically synthesized
ttgtttgtttgtttgagatg

SEQ ID NO: 24599 - DNA, 20 bp, Artificial Sequence
  chemically synthesized
tggagtctcgcactgttgcc

SEQ ID NO: 24600 - DNA, 20 bp, Artificial Sequence
  chemically synthesized
gtctcgcactgttgcctggc

SEQ ID NO: 24601 - DNA, 20 bp, Artificial Sequence
  chemically synthesized
ctcgcactgttgcctggctg

SEQ ID NO: 24602 - DNA, 20 bp, Artificial Sequence
  chemically synthesized
gttgcctggctggagtgcaa

SEQ ID NO: 24603 - DNA, 20 bp, Artificial Sequence
  chemically synthesized
ggagtgcaatggtgcaatct

SEQ ID NO: 24604 - DNA, 20 bp, Artificial Sequence
  chemically synthesized
cactgcaacctctgcctctc

SEQ ID NO: 24605 - DNA, 20 bp, Artificial Sequence
  chemically synthesized
aacctctgcctctccggttc

SEQ ID NO: 24606 - DNA, 20 bp, Artificial Sequence
  chemically synthesized
ttcaagtgattctcctgcct

SEQ ID NO: 24607 - DNA, 20 bp, Artificial Sequence
  chemically synthesized
ttctcctgcctcagcctccc

SEQ ID NO: 24608 - DNA, 20 bp, Artificial Sequence
  chemically synthesized
tcctgcctcagcctcccaag

SEQ ID NO: 24609 - DNA, 20 bp, Artificial Sequence
  chemically synthesized
gcctcagcctcccaagtagc

SEQ ID NO: 24610 - DNA, 20 bp, Artificial Sequence
  chemically synthesized
cctcagcctcccaagtagct

SEQ ID NO: 24611 - DNA, 20 bp, Artificial Sequence
  chemically synthesized
ctcccaagtagctgggatta

SEQ ID NO: 24612 - DNA, 20 bp, Artificial Sequence
  chemically synthesized
tcccaagtagctgggattac

SEQ ID NO: 24613 - DNA, 20 bp, Artificial Sequence
  chemically synthesized
caggtgcccgccaccatgcc

SEQ ID NO: 24614 - DNA, 20 bp, Artificial Sequence
  chemically synthesized
gctaattttttttgtatttt

SEQ ID NO: 24615 - DNA, 20 bp, Artificial Sequence
  chemically synthesized
aattttttttgtatttttag

SEQ ID NO: 24616 - DNA, 20 bp, Artificial Sequence
  chemically synthesized
ttttttttgtatttttagta

SEQ ID NO: 24617 - DNA, 20 bp, Artificial Sequence
  chemically synthesized
ttgtatttttagtagagaca

SEQ ID NO: 24618 - DNA, 20 bp, Artificial Sequence
  chemically synthesized
catggtttcactatgttgac

SEQ ID NO: 24619 - DNA, 20 bp, Artificial Sequence
  chemically synthesized
atggtttcactatgttgact

SEQ ID NO: 24620 - DNA, 20 bp, Artificial Sequence
  chemically synthesized
tttcactatgttgactaggc

SEQ ID NO: 24621 - DNA, 20 bp, Artificial Sequence
  chemically synthesized
acctcatgatctgcctgcct

SEQ ID NO: 24622 - DNA, 20 bp, Artificial Sequence
  chemically synthesized
ctgcctgccttggcctccct

SEQ ID NO: 24623 - DNA, 20 bp, Artificial Sequence
  chemically synthesized
gccttggcctccctaagtgc

SEQ ID NO: 24624 - DNA, 20 bp, Artificial Sequence
  chemically synthesized
ccttggcctccctaagtgct

SEQ ID NO: 24625 - DNA, 20 bp, Artificial Sequence
  chemically synthesized
ctccctaagtgctaggatta

SEQ ID NO: 24626 - DNA, 20 bp, Artificial Sequence
  chemically synthesized
tccctaagtgctaggattac

SEQ ID NO: 24627 - DNA, 20 bp, Artificial Sequence
  chemically synthesized
agtgctaggattacaggcgt

SEQ ID NO: 24628 - DNA, 20 bp, Artificial Sequence
  chemically synthesized
caggcgtgagccactacacc

SEQ ID NO: 24629 - DNA, 20 bp, Artificial Sequence
  chemically synthesized
gcatgattctaaaaaataaa

SEQ ID NO: 24630 - DNA, 20 bp, Artificial Sequence
  chemically synthesized
ttctaaaaaataaaaagatg

SEQ ID NO: 24631 - DNA, 20 bp, Artificial Sequence
  chemically synthesized
caaacatctgatctccattg

SEQ ID NO: 24632 - DNA, 20 bp, Artificial Sequence
  chemically synthesized
gaagaaccatgcaatctctc

SEQ ID NO: 24633 - DNA, 20 bp, Artificial Sequence
  chemically synthesized
aagaaccatgcaatctctct

SEQ ID NO: 24634 - DNA, 20 bp, Artificial Sequence
  chemically synthesized
atgcaatctctctgggttga

SEQ ID NO: 24635 - DNA, 20 bp, Artificial Sequence
  chemically synthesized
gcaatctctctgggttgata

SEQ ID NO: 24636 - DNA, 20 bp, Artificial Sequence
  chemically synthesized
caatctctctgggttgatag

SEQ ID NO: 24637 - DNA, 20 bp, Artificial Sequence
  chemically synthesized
ctctctgggttgatagaggc

SEQ ID NO: 24638 - DNA, 20 bp, Artificial Sequence
  chemically synthesized
ctctgggttgatagaggcca

SEQ ID NO: 24639 - DNA, 20 bp, Artificial Sequence
  chemically synthesized
gggttgatagaggccagagt

SEQ ID NO: 24640 - DNA, 20 bp, Artificial Sequence
  chemically synthesized
ttgatagaggccagagttag

SEQ ID NO: 24641 - DNA, 20 bp, Artificial Sequence
  chemically synthesized
ttagtggctctccctgattt

SEQ ID NO: 24642 - DNA, 20 bp, Artificial Sequence
  chemically synthesized
tggctctccctgatttcggt

SEQ ID NO: 24643 - DNA, 20 bp, Artificial Sequence
  chemically synthesized
aaatcactattccaccatca

SEQ ID NO: 24644 - DNA, 20 bp, Artificial Sequence
  chemically synthesized
aatcactattccaccatcac

SEQ ID NO: 24645 - DNA, 20 bp, Artificial Sequence
  chemically synthesized
attccaccatcacgggataa

SEQ ID NO: 24646 - DNA, 20 bp, Artificial Sequence
  chemically synthesized
ttccaccatcacgggataaa

SEQ ID NO: 24647 - DNA, 20 bp, Artificial Sequence
  chemically synthesized
gggataaaaggcatcctgac

SEQ ID NO: 24648 - DNA, 20 bp, Artificial Sequence
  chemically synthesized
ataaaaggcatcctgactgg

SEQ ID NO: 24649 - DNA, 20 bp, Artificial Sequence
  chemically synthesized
gcggttgacacctatttcca

SEQ ID NO: 24650 - DNA, 20 bp, Artificial Sequence
  chemically synthesized
gacacctatttccacagtga

SEQ ID NO: 24651 - DNA, 20 bp, Artificial Sequence
  chemically synthesized
tccacagtgaaagatatatc

SEQ ID NO: 24652 - DNA, 20 bp, Artificial Sequence
  chemically synthesized
agatatatctagtactttta

SEQ ID NO: 24653 - DNA, 20 bp, Artificial Sequence
  chemically synthesized
gatatatctagtacttttaa

SEQ ID NO: 24654 - DNA, 20 bp, Artificial Sequence
  chemically synthesized
atatatctagtacttttaaa

SEQ ID NO: 24655 - DNA, 20 bp, Artificial Sequence
  chemically synthesized
tatatctagtacttttaaag

SEQ ID NO: 24656 - DNA, 20 bp, Artificial Sequence
  chemically synthesized
atctagtacttttaaagggg

SEQ ID NO: 24657 - DNA, 20 bp, Artificial Sequence
  chemically synthesized
tagtacttttaaaggggaag

SEQ ID NO: 24658 - DNA, 20 bp, Artificial Sequence
  chemically synthesized
aaaggggaagtggtttgtct

SEQ ID NO: 24659 - DNA, 20 bp, Artificial Sequence
  chemically synthesized
gtctgagatactctgtttca

SEQ ID NO: 24660 - DNA, 20 bp, Artificial Sequence
  chemically synthesized
tgagatactctgtttcaaag

SEQ ID NO: 24661 - DNA, 20 bp, Artificial Sequence
  chemically synthesized
agatactctgtttcaaagta

SEQ ID NO: 24662 - DNA, 20 bp, Artificial Sequence
  chemically synthesized
atactctgtttcaaagtaga

SEQ ID NO: 24663 - DNA, 20 bp, Artificial Sequence
  chemically synthesized
tactctgtttcaaagtagag

SEQ ID NO: 24664 - DNA, 20 bp, Artificial Sequence
  chemically synthesized
gtttcaaagtagagaggata

SEQ ID NO: 24665 - DNA, 20 bp, Artificial Sequence
  chemically synthesized
aagtagagaggatacagaac

SEQ ID NO: 24666 - DNA, 20 bp, Artificial Sequence
  chemically synthesized
ggatacagaacaagcatctg

SEQ ID NO: 24667 - DNA, 20 bp, Artificial Sequence
  chemically synthesized
tgaagctatatacatcctta

SEQ ID NO: 24668 - DNA, 20 bp, Artificial Sequence
  chemically synthesized
aagctatatacatccttaca

SEQ ID NO: 24669 - DNA, 20 bp, Artificial Sequence
  chemically synthesized
gctatatacatccttacaga

SEQ ID NO: 24670 - DNA, 20 bp, Artificial Sequence
  chemically synthesized
cttacagagagcaattctga

SEQ ID NO: 24671 - DNA, 20 bp, Artificial Sequence
  chemically synthesized
gagcaattctgatggaaatg

SEQ ID NO: 24672 - DNA, 20 bp, Artificial Sequence
  chemically synthesized
agcaattctgatggaaatgc

SEQ ID NO: 24673 - DNA, 20 bp, Artificial Sequence
  chemically synthesized
aaatgcaggccatgtttccc

SEQ ID NO: 24674 - DNA, 20 bp, Artificial Sequence
  chemically synthesized
aatgcaggccatgtttccct

SEQ ID NO: 24675 - DNA, 20 bp, Artificial Sequence
  chemically synthesized
atgcaggccatgtttccctg

SEQ ID NO: 24676 - DNA, 20 bp, Artificial Sequence
  chemically synthesized
tgcaggccatgtttccctgg

SEQ ID NO: 24677 - DNA, 20 bp, Artificial Sequence
  chemically synthesized
gcaggccatgtttccctggg

SEQ ID NO: 24678 - DNA, 20 bp, Artificial Sequence
  chemically synthesized
caggccatgtttccctgggg

SEQ ID NO: 24679 - DNA, 20 bp, Artificial Sequence
  chemically synthesized
aggccatgtttccctggggg

SEQ ID NO: 24680 - DNA, 20 bp, Artificial Sequence
  chemically synthesized
tccctggggggggctcgtcc

SEQ ID NO: 24681 - DNA, 20 bp, Artificial Sequence
  chemically synthesized
ccctggggggggctcgtcct

SEQ ID NO: 24682 - DNA, 20 bp, Artificial Sequence
  chemically synthesized
cctggggggggctcgtccta

SEQ ID NO: 24683 - DNA, 20 bp, Artificial Sequence
  chemically synthesized
ctggggggggctcgtcctag

SEQ ID NO: 24684 - DNA, 20 bp, Artificial Sequence
  chemically synthesized
ggggggctcgtcctaggggc

SEQ ID NO: 24685 - DNA, 20 bp, Artificial Sequence
  chemically synthesized
ggggctcgtcctaggggctg

SEQ ID NO: 24686 - DNA, 20 bp, Artificial Sequence
  chemically synthesized
tggagtgcattctctgatgt

SEQ ID NO: 24687 - DNA, 20 bp, Artificial Sequence
  chemically synthesized
gagtgcattctctgatgtca

SEQ ID NO: 24688 - DNA, 20 bp, Artificial Sequence
  chemically synthesized
agtgcattctctgatgtcag

SEQ ID NO: 24689 - DNA, 20 bp, Artificial Sequence
  chemically synthesized
tctgatgtcagaggaaatgc

SEQ ID NO: 24690 - DNA, 20 bp, Artificial Sequence
  chemically synthesized
gaggaaatgcaagattccct

SEQ ID NO: 24691 - DNA, 20 bp, Artificial Sequence
  chemically synthesized
aggaaatgcaagattccctg

SEQ ID NO: 24692 - DNA, 20 bp, Artificial Sequence
  chemically synthesized
tgcaagattccctgaggcct

SEQ ID NO: 24693 - DNA, 20 bp, Artificial Sequence
  chemically synthesized
gcaagattccctgaggcctg

SEQ ID NO: 24694 - DNA, 20 bp, Artificial Sequence
  chemically synthesized
caagattccctgaggcctga

SEQ ID NO: 24695 - DNA, 20 bp, Artificial Sequence
  chemically synthesized
ctgaggcctgagggaaccca

SEQ ID NO: 24696 - DNA, 20 bp, Artificial Sequence
  chemically synthesized
agggaacccatggtatatgc

SEQ ID NO: 24697 - DNA, 20 bp, Artificial Sequence
  chemically synthesized
cccatggtatatgcaagtcc

SEQ ID NO: 24698 - DNA, 20 bp, Artificial Sequence
  chemically synthesized
caagtccaagtttcaaactg

SEQ ID NO: 24699 - DNA, 20 bp, Artificial Sequence
  chemically synthesized
tagttccatatgcattcttc

SEQ ID NO: 24700 - DNA, 20 bp, Artificial Sequence
  chemically synthesized
agttccatatgcattcttcc

SEQ ID NO: 24701 - DNA, 20 bp, Artificial Sequence
  chemically synthesized
ttccaggacaaatacttctt

SEQ ID NO: 24702 - DNA, 20 bp, Artificial Sequence
  chemically synthesized
tccaggacaaatacttcttg

SEQ ID NO: 24703 - DNA, 20 bp, Artificial Sequence
  chemically synthesized
ttcttgaggttaaaaaaaaa

SEQ ID NO: 24704 - DNA, 20 bp, Artificial Sequence
  chemically synthesized
gttaaaaaaaaaaagtcaca

SEQ ID NO: 24705 - DNA, 20 bp, Artificial Sequence
  chemically synthesized
gtcacatagctgccatttta

SEQ ID NO: 24706 - DNA, 20 bp, Artificial Sequence
  chemically synthesized
agctgccattttatggattt

SEQ ID NO: 24707 - DNA, 20 bp, Artificial Sequence
  chemically synthesized
gctgccattttatggatttc

SEQ ID NO: 24708 - DNA, 20 bp, Artificial Sequence
  chemically synthesized
attttttttttttttttttt

SEQ ID NO: 24709 - DNA, 20 bp, Artificial Sequence
  chemically synthesized
ttttttttttttttttgaga

SEQ ID NO: 24710 - DNA, 20 bp, Artificial Sequence
  chemically synthesized
ttttttttttttttgagatg

SEQ ID NO: 24711 - DNA, 20 bp, Artificial Sequence
  chemically synthesized
tggagtcttgctctgtcacc

SEQ ID NO: 24712 - DNA, 20 bp, Artificial Sequence
  chemically synthesized
ttgctctgtcacccagcctg

SEQ ID NO: 24713 - DNA, 20 bp, Artificial Sequence
  chemically synthesized
ctgtcacccagcctgtagtg

SEQ ID NO: 24714 - DNA, 20 bp, Artificial Sequence
  chemically synthesized
tcacccagcctgtagtgcag

SEQ ID NO: 24715 - DNA, 20 bp, Artificial Sequence
  chemically synthesized
gtagtgcagtggcataatct

SEQ ID NO: 24716 - DNA, 20 bp, Artificial Sequence
  chemically synthesized
agtggcataatctcggctca

SEQ ID NO: 24717 - DNA, 20 bp, Artificial Sequence
  chemically synthesized
tcacggcaacctccgcctcc

SEQ ID NO: 24718 - DNA, 20 bp, Artificial Sequence
  chemically synthesized
cacggcaacctccgcctccc

SEQ ID NO: 24719 - DNA, 20 bp, Artificial Sequence
  chemically synthesized
aacctccgcctcccaggttc

SEQ ID NO: 24720 - DNA, 20 bp, Artificial Sequence
  chemically synthesized
ttcaagcgattctcttgcct

SEQ ID NO: 24721 - DNA, 20 bp, Artificial Sequence
  chemically synthesized
ttctcttgccttagcctccc

SEQ ID NO: 24722 - DNA, 20 bp, Artificial Sequence
  chemically synthesized
tcttgccttagcctcccgag

SEQ ID NO: 24723 - DNA, 20 bp, Artificial Sequence
  chemically synthesized
gccttagcctcccgagtagc

SEQ ID NO: 24724 - DNA, 20 bp, Artificial Sequence
  chemically synthesized
ccttagcctcccgagtagct

SEQ ID NO: 24725 - DNA, 20 bp, Artificial Sequence
  chemically synthesized
ctcccgagtagctgggatta

SEQ ID NO: 24726 - DNA, 20 bp, Artificial Sequence
  chemically synthesized
cagtcacgcaccaccacatc

SEQ ID NO: 24727 - DNA, 20 bp, Artificial Sequence
  chemically synthesized
ggctaattctttatattttt

SEQ ID NO: 24728 - DNA, 20 bp, Artificial Sequence
  chemically synthesized
taattctttatattttttgg

SEQ ID NO: 24729 - DNA, 20 bp, Artificial Sequence
  chemically synthesized
tttatattttttggtagaaa

SEQ ID NO: 24730 - DNA, 20 bp, Artificial Sequence
  chemically synthesized
gaaacggtgtttcaccatgt

SEQ ID NO: 24731 - DNA, 20 bp, Artificial Sequence
  chemically synthesized
cggtgtttcaccatgttggc

SEQ ID NO: 24732 - DNA, 20 bp, Artificial Sequence
  chemically synthesized
ggtgtttcaccatgttggcc

SEQ ID NO: 24733 - DNA, 20 bp, Artificial Sequence
  chemically synthesized
tttcaccatgttggccaggc

SEQ ID NO: 24734 - DNA, 20 bp, Artificial Sequence
  chemically synthesized
ctcatgtgatctgcctgcct

SEQ ID NO: 24735 - DNA, 20 bp, Artificial Sequence
  chemically synthesized
ctgcctgccttggcctccca

SEQ ID NO: 24736 - DNA, 20 bp, Artificial Sequence
  chemically synthesized
ccttggcctcccaaagtgct

SEQ ID NO: 24737 - DNA, 20 bp, Artificial Sequence
  chemically synthesized
ctcccaaagtgctgagatta

SEQ ID NO: 24738 - DNA, 20 bp, Artificial Sequence
  chemically synthesized
tcccaaagtgctgagattac

SEQ ID NO: 24739 - DNA, 20 bp, Artificial Sequence
  chemically synthesized
agtgctgagattacaggtgt

SEQ ID NO: 24740 - DNA, 20 bp, Artificial Sequence
  chemically synthesized
tgtgagccaccgcgcctgcc

SEQ ID NO: 24741 - DNA, 20 bp, Artificial Sequence
  chemically synthesized
tgagccaccgcgcctgcctg

SEQ ID NO: 24742 - DNA, 20 bp, Artificial Sequence
  chemically synthesized
caccgcgcctgcctggagtt

SEQ ID NO: 24743 - DNA, 20 bp, Artificial Sequence
  chemically synthesized
ctgcctggagttcagaatct

SEQ ID NO: 24744 - DNA, 20 bp, Artificial Sequence
  chemically synthesized
tgcctggagttcagaatctt

SEQ ID NO: 24745 - DNA, 20 bp, Artificial Sequence
  chemically synthesized
cttcattatttgtgtttaaa

SEQ ID NO: 24746 - DNA, 20 bp, Artificial Sequence
  chemically synthesized
ttgtgtttaaatagatcata

SEQ ID NO: 24747 - DNA, 20 bp, Artificial Sequence
  chemically synthesized
gtttaaatagatcatacagt

SEQ ID NO: 24748 - DNA, 20 bp, Artificial Sequence
  chemically synthesized
tttaaatagatcatacagtc

SEQ ID NO: 24749 - DNA, 20 bp, Artificial Sequence
  chemically synthesized
atagatcatacagtcaggca

SEQ ID NO: 24750 - DNA, 20 bp, Artificial Sequence
  chemically synthesized
gatcatacagtcaggcacgg

SEQ ID NO: 24751 - DNA, 20 bp, Artificial Sequence
  chemically synthesized
gtggctcatgcctgtaatcc

SEQ ID NO: 24752 - DNA, 20 bp, Artificial Sequence
  chemically synthesized
tgcctgtaatcccagcactt

SEQ ID NO: 24753 - DNA, 20 bp, Artificial Sequence
  chemically synthesized
gcctgtaatcccagcacttt

SEQ ID NO: 24754 - DNA, 20 bp, Artificial Sequence
  chemically synthesized
ctgtaatcccagcactttgg

SEQ ID NO: 24755 - DNA, 20 bp, Artificial Sequence
  chemically synthesized
tgtaatcccagcactttggg

SEQ ID NO: 24756 - DNA, 20 bp, Artificial Sequence
  chemically synthesized
tcccagcactttgggaggct

SEQ ID NO: 24757 - DNA, 20 bp, Artificial Sequence
  chemically synthesized
cccagcactttgggaggctg

SEQ ID NO: 24758 - DNA, 20 bp, Artificial Sequence
  chemically synthesized
agcactttgggaggctgagg

SEQ ID NO: 24759 - DNA, 20 bp, Artificial Sequence
  chemically synthesized
gcactttgggaggctgaggt

SEQ ID NO: 24760 - DNA, 20 bp, Artificial Sequence
  chemically synthesized
actttgggaggctgaggtgg

SEQ ID NO: 24761 - DNA, 20 bp, Artificial Sequence
  chemically synthesized
ctttgggaggctgaggtggg

SEQ ID NO: 24762 - DNA, 20 bp, Artificial Sequence
  chemically synthesized
ctgaggtgggaggattgcct

SEQ ID NO: 24763 - DNA, 20 bp, Artificial Sequence
  chemically synthesized
gtgggaggattgcctgagtt

SEQ ID NO: 24764 - DNA, 20 bp, Artificial Sequence
  chemically synthesized
tgggaggattgcctgagttc

SEQ ID NO: 24765 - DNA, 20 bp, Artificial Sequence
  chemically synthesized
ggaggattgcctgagttcag

SEQ ID NO: 24766 - DNA, 20 bp, Artificial Sequence
  chemically synthesized
gattgcctgagttcaggaga

SEQ ID NO: 24767 - DNA, 20 bp, Artificial Sequence
  chemically synthesized
ttgcctgagttcaggagatg

SEQ ID NO: 24768 - DNA, 20 bp, Artificial Sequence
  chemically synthesized
tgagttcaggagatggagac

SEQ ID NO: 24769 - DNA, 20 bp, Artificial Sequence
  chemically synthesized
tcaggagatggagaccagcc

SEQ ID NO: 24770 - DNA, 20 bp, Artificial Sequence
  chemically synthesized
caggagatggagaccagcct

SEQ ID NO: 24771 - DNA, 20 bp, Artificial Sequence
  chemically synthesized
ggagaccagcctgggcaaca

SEQ ID NO: 24772 - DNA, 20 bp, Artificial Sequence
  chemically synthesized
tctactaaaaatacaaaaac

SEQ ID NO: 24773 - DNA, 20 bp, Artificial Sequence
  chemically synthesized
ctaaaaatacaaaaactagc

SEQ ID NO: 24774 - DNA, 20 bp, Artificial Sequence
  chemically synthesized
atacaaaaactagctggatg

SEQ ID NO: 24775 - DNA, 20 bp, Artificial Sequence
  chemically synthesized
caaaaactagctggatgtgg

SEQ ID NO: 24776 - DNA, 20 bp, Artificial Sequence
  chemically synthesized
gatgtggtggcacacacctg

SEQ ID NO: 24777 - DNA, 20 bp, Artificial Sequence
  chemically synthesized
gtggcacacacctgtagtcc

SEQ ID NO: 24778 - DNA, 20 bp, Artificial Sequence
  chemically synthesized
cacctgtagtcccagctatt

SEQ ID NO: 24779 - DNA, 20 bp, Artificial Sequence
  chemically synthesized
acctgtagtcccagctattc

SEQ ID NO: 24780 - DNA, 20 bp, Artificial Sequence
  chemically synthesized
ctgtagtcccagctattcag

SEQ ID NO: 24781 - DNA, 20 bp, Artificial Sequence
  chemically synthesized
tgtagtcccagctattcagg

SEQ ID NO: 24782 - DNA, 20 bp, Artificial Sequence
  chemically synthesized
tcccagctattcaggaggct

SEQ ID NO: 24783 - DNA, 20 bp, Artificial Sequence
  chemically synthesized
cccagctattcaggaggctg

SEQ ID NO: 24784 - DNA, 20 bp, Artificial Sequence
  chemically synthesized
agctattcaggaggctgagg

SEQ ID NO: 24785 - DNA, 20 bp, Artificial Sequence
  chemically synthesized
gctattcaggaggctgaggt

SEQ ID NO: 24786 - DNA, 20 bp, Artificial Sequence
  chemically synthesized
tattcaggaggctgaggtgg

SEQ ID NO: 24787 - DNA, 20 bp, Artificial Sequence
  chemically synthesized
attcaggaggctgaggtggg

SEQ ID NO: 24788 - DNA, 20 bp, Artificial Sequence
  chemically synthesized
aggctgaggtgggaggatcc

SEQ ID NO: 24789 - DNA, 20 bp, Artificial Sequence
  chemically synthesized
ggctgaggtgggaggatccc

SEQ ID NO: 24790 - DNA, 20 bp, Artificial Sequence
  chemically synthesized
ctgaggtgggaggatcccag

SEQ ID NO: 24791 - DNA, 20 bp, Artificial Sequence
  chemically synthesized
tgaggtgggaggatcccagg

SEQ ID NO: 24792 - DNA, 20 bp, Artificial Sequence
  chemically synthesized
ggtgggaggatcccaggagg

SEQ ID NO: 24793 - DNA, 20 bp, Artificial Sequence
  chemically synthesized
tgggaggatcccaggaggta

SEQ ID NO: 24794 - DNA, 20 bp, Artificial Sequence
  chemically synthesized
gggaggatcccaggaggtag

SEQ ID NO: 24795 - DNA, 20 bp, Artificial Sequence
  chemically synthesized
caggaggtagaggtcacaat

SEQ ID NO: 24796 - DNA, 20 bp, Artificial Sequence
  chemically synthesized
ggtagaggtcacaatgagcc

SEQ ID NO: 24797 - DNA, 20 bp, Artificial Sequence
  chemically synthesized
gagattgcgccactgcactc

SEQ ID NO: 24798 - DNA, 20 bp, Artificial Sequence
  chemically synthesized
agattgcgccactgcactcc

SEQ ID NO: 24799 - DNA, 20 bp, Artificial Sequence
  chemically synthesized
tgcgccactgcactccaggc

SEQ ID NO: 24800 - DNA, 20 bp, Artificial Sequence
  chemically synthesized
gcgccactgcactccaggct

SEQ ID NO: 24801 - DNA, 20 bp, Artificial Sequence
  chemically synthesized
gcactccaggctgggttact

SEQ ID NO: 24802 - DNA, 20 bp, Artificial Sequence
  chemically synthesized
tccaggctgggttactgagc

SEQ ID NO: 24803 - DNA, 20 bp, Artificial Sequence
  chemically synthesized
atcctgtctcaaaaaaaaaa

SEQ ID NO: 24804 - DNA, 20 bp, Artificial Sequence
  chemically synthesized
aaaaagataatacattcaaa

SEQ ID NO: 24805 - DNA, 20 bp, Artificial Sequence
  chemically synthesized
tcaaacagttcaaaatgcaa

SEQ ID NO: 24806 - DNA, 20 bp, Artificial Sequence
  chemically synthesized
aatgcaaaagttacatacat

SEQ ID NO: 24807 - DNA, 20 bp, Artificial Sequence
  chemically synthesized
atgcaaaagttacatacata

SEQ ID NO: 24808 - DNA, 20 bp, Artificial Sequence
  chemically synthesized
caaaagttacatacataagg

SEQ ID NO: 24809 - DNA, 20 bp, Artificial Sequence
  chemically synthesized
ctccctctcacacttctccc

SEQ ID NO: 24810 - DNA, 20 bp, Artificial Sequence
  chemically synthesized
cacacttctccccagccacc

SEQ ID NO: 24811 - DNA, 20 bp, Artificial Sequence
  chemically synthesized
agccacccagttctcccttc

SEQ ID NO: 24812 - DNA, 20 bp, Artificial Sequence
  chemically synthesized
ccacccagttctcccttcta

SEQ ID NO: 24813 - DNA, 20 bp, Artificial Sequence
  chemically synthesized
cacccagttctcccttctag

SEQ ID NO: 24814 - DNA, 20 bp, Artificial Sequence
  chemically synthesized
gcaacatgtgaaatccttct

SEQ ID NO: 24815 - DNA, 20 bp, Artificial Sequence
  chemically synthesized
caacatgtgaaatccttctc

SEQ ID NO: 24816 - DNA, 20 bp, Artificial Sequence
  chemically synthesized
ctcaggctacactcttcttg

SEQ ID NO: 24817 - DNA, 20 bp, Artificial Sequence
  chemically synthesized
tcaggctacactcttcttga

SEQ ID NO: 24818 - DNA, 20 bp, Artificial Sequence
  chemically synthesized
ctacactcttcttgaaggtg

SEQ ID NO: 24819 - DNA, 20 bp, Artificial Sequence
  chemically synthesized
tacactcttcttgaaggtgt

SEQ ID NO: 24820 - DNA, 20 bp, Artificial Sequence
  chemically synthesized
cttcttgaaggtgtaggctt

SEQ ID NO: 24821 - DNA, 20 bp, Artificial Sequence
  chemically synthesized
ttcttgaaggtgtaggcttt

SEQ ID NO: 24822 - DNA, 20 bp, Artificial Sequence
  chemically synthesized
aaggtgtaggctttgggcaa

SEQ ID NO: 24823 - DNA, 20 bp, Artificial Sequence
  chemically synthesized
tttgggcaaaagcattcatt

SEQ ID NO: 24824 - DNA, 20 bp, Artificial Sequence
  chemically synthesized
aagcattcattcagtaaccc

SEQ ID NO: 24825 - DNA, 20 bp, Artificial Sequence
  chemically synthesized
aaacttgttctgtttttcca

SEQ ID NO: 24826 - DNA, 20 bp, Artificial Sequence
  chemically synthesized
aacttgttctgtttttccat

SEQ ID NO: 24827 - DNA, 20 bp, Artificial Sequence
  chemically synthesized
tttttccataggattctctt

SEQ ID NO: 24828 - DNA, 20 bp, Artificial Sequence
  chemically synthesized
tccataggattctctttgga

SEQ ID NO: 24829 - DNA, 20 bp, Artificial Sequence
  chemically synthesized
tctttggacagcgtccatac

SEQ ID NO: 24830 - DNA, 20 bp, Artificial Sequence
  chemically synthesized
ttggacagcgtccatactgg

SEQ ID NO: 24831 - DNA, 20 bp, Artificial Sequence
  chemically synthesized
tggacagcgtccatactggt

SEQ ID NO: 24832 - DNA, 20 bp, Artificial Sequence
  chemically synthesized
gcgtccatactggtgggttt

SEQ ID NO: 24833 - DNA, 20 bp, Artificial Sequence
  chemically synthesized
gttttggatactgactacta

SEQ ID NO: 24834 - DNA, 20 bp, Artificial Sequence
  chemically synthesized
acacttccgtgcccctgata

SEQ ID NO: 24835 - DNA, 20 bp, Artificial Sequence
  chemically synthesized
cttccgtgcccctgataaag

SEQ ID NO: 24836 - DNA, 20 bp, Artificial Sequence
  chemically synthesized
agcagttccctgtaacctgt

SEQ ID NO: 24837 - DNA, 20 bp, Artificial Sequence
  chemically synthesized
ttccctgtaacctgtgagac

SEQ ID NO: 24838 - DNA, 20 bp, Artificial Sequence
  chemically synthesized
tgtaacctgtgagactggac

SEQ ID NO: 24839 - DNA, 20 bp, Artificial Sequence
  chemically synthesized
gtaacctgtgagactggacc

SEQ ID NO: 24840 - DNA, 20 bp, Artificial Sequence
  chemically synthesized
cctgtgagactggaccaggt

SEQ ID NO: 24841 - DNA, 20 bp, Artificial Sequence
  chemically synthesized
actggaccaggtaagcgtcc

SEQ ID NO: 24842 - DNA, 20 bp, Artificial Sequence
  chemically synthesized
ggtaagcgtcccagcccctg

SEQ ID NO: 24843 - DNA, 20 bp, Artificial Sequence
  chemically synthesized
agcgtcccagcccctgcaga

SEQ ID NO: 24844 - DNA, 20 bp, Artificial Sequence
  chemically synthesized
gtcccagcccctgcagacag

SEQ ID NO: 24845 - DNA, 20 bp, Artificial Sequence
  chemically synthesized
agcccctgcagacagaagct

SEQ ID NO: 24846 - DNA, 20 bp, Artificial Sequence
  chemically synthesized
ccctgcagacagaagctgag

SEQ ID NO: 24847 - DNA, 20 bp, Artificial Sequence
  chemically synthesized
tggacctcgtttacctgtta

SEQ ID NO: 24848 - DNA, 20 bp, Artificial Sequence
  chemically synthesized
ttatggatgaaactgacctt

SEQ ID NO: 24849 - DNA, 20 bp, Artificial Sequence
  chemically synthesized
tatggatgaaactgaccttg

SEQ ID NO: 24850 - DNA, 20 bp, Artificial Sequence
  chemically synthesized
atggatgaaactgaccttga

SEQ ID NO: 24851 - DNA, 20 bp, Artificial Sequence
  chemically synthesized
tggatgaaactgaccttgag

SEQ ID NO: 24852 - DNA, 20 bp, Artificial Sequence
  chemically synthesized
aactgaccttgaggggacat

SEQ ID NO: 24853 - DNA, 20 bp, Artificial Sequence
  chemically synthesized
actgaccttgaggggacatg

SEQ ID NO: 24854 - DNA, 20 bp, Artificial Sequence
  chemically synthesized
tgaccttgaggggacatgag

SEQ ID NO: 24855 - DNA, 20 bp, Artificial Sequence
  chemically synthesized
accttgaggggacatgagga

SEQ ID NO: 24856 - DNA, 20 bp, Artificial Sequence
  chemically synthesized
cttttgtcatgctcttcaat

SEQ ID NO: 24857 - DNA, 20 bp, Artificial Sequence
  chemically synthesized
ttctgcaatactttcctgaa

SEQ ID NO: 24858 - DNA, 20 bp, Artificial Sequence
  chemically synthesized
caatactttcctgaatagca

SEQ ID NO: 24859 - DNA, 20 bp, Artificial Sequence
  chemically synthesized
tactttcctgaatagcacag

SEQ ID NO: 24860 - DNA, 20 bp, Artificial Sequence
  chemically synthesized
cctgaatagcacagtagtat

SEQ ID NO: 24861 - DNA, 20 bp, Artificial Sequence
  chemically synthesized
tattggaaatctgcctatta

SEQ ID NO: 24862 - DNA, 20 bp, Artificial Sequence
  chemically synthesized
aatctgcctattacagaacc

SEQ ID NO: 24863 - DNA, 20 bp, Artificial Sequence
  chemically synthesized
tgcctattacagaacctgga

SEQ ID NO: 24864 - DNA, 20 bp, Artificial Sequence
  chemically synthesized
cctattacagaacctggatg

SEQ ID NO: 24865 - DNA, 20 bp, Artificial Sequence
  chemically synthesized
tacagaacctggatggagtc

SEQ ID NO: 24866 - DNA, 20 bp, Artificial Sequence
  chemically synthesized
cagaacctggatggagtcca

SEQ ID NO: 24867 - DNA, 20 bp, Artificial Sequence
  chemically synthesized
gaacctggatggagtccaga

SEQ ID NO: 24868 - DNA, 20 bp, Artificial Sequence
  chemically synthesized
aacctggatggagtccagag

SEQ ID NO: 24869 - DNA, 20 bp, Artificial Sequence
  chemically synthesized
ggatggagtccagagaggca

SEQ ID NO: 24870 - DNA, 20 bp, Artificial Sequence
  chemically synthesized
gatggagtccagagaggcac

SEQ ID NO: 24871 - DNA, 20 bp, Artificial Sequence
  chemically synthesized
cagagaggcacgggcatcca

SEQ ID NO: 24872 - DNA, 20 bp, Artificial Sequence
  chemically synthesized
agagaggcacgggcatccat

SEQ ID NO: 24873 - DNA, 20 bp, Artificial Sequence
  chemically synthesized
ggcacgggcatccatgggca

SEQ ID NO: 24874 - DNA, 20 bp, Artificial Sequence
  chemically synthesized
gcacgggcatccatgggcaa

SEQ ID NO: 24875 - DNA, 20 bp, Artificial Sequence
  chemically synthesized
cacgggcatccatgggcaaa

SEQ ID NO: 24876 - DNA, 20 bp, Artificial Sequence
  chemically synthesized
tccatgggcaaagggctcgt

SEQ ID NO: 24877 - DNA, 20 bp, Artificial Sequence
  chemically synthesized
catgggcaaagggctcgtga

SEQ ID NO: 24878 - DNA, 20 bp, Artificial Sequence
  chemically synthesized
tcgtgagagtcaccgccctg

SEQ ID NO: 24879 - DNA, 20 bp, Artificial Sequence
  chemically synthesized
tgcagggcggtgactctcac

SEQ ID NO: 24880 - DNA, 20 bp, Artificial Sequence
  chemically synthesized
tctcacgagccctttgccca

SEQ ID NO: 24881 - DNA, 20 bp, Artificial Sequence
  chemically synthesized
catggatgcccgtgcctctc

SEQ ID NO: 24882 - DNA, 20 bp, Artificial Sequence
  chemically synthesized
gtgcctctctggactccatc

SEQ ID NO: 24883 - DNA, 20 bp, Artificial Sequence
  chemically synthesized
tgcctctctggactccatcc

SEQ ID NO: 24884 - DNA, 20 bp, Artificial Sequence
  chemically synthesized
actccatccaggttctgtaa

SEQ ID NO: 24885 - DNA, 20 bp, Artificial Sequence
  chemically synthesized
ctccatccaggttctgtaat

SEQ ID NO: 24886 - DNA, 20 bp, Artificial Sequence
  chemically synthesized
catccaggttctgtaatagg

SEQ ID NO: 24887 - DNA, 20 bp, Artificial Sequence
  chemically synthesized
tccaatactactgtgctatt

SEQ ID NO: 24888 - DNA, 20 bp, Artificial Sequence
  chemically synthesized
ccaatactactgtgctattc

SEQ ID NO: 24889 - DNA, 20 bp, Artificial Sequence
  chemically synthesized
tactactgtgctattcagga

SEQ ID NO: 24890 - DNA, 20 bp, Artificial Sequence
  chemically synthesized
tgctattcaggaaagtattg

SEQ ID NO: 24891 - DNA, 20 bp, Artificial Sequence
  chemically synthesized
tattcaggaaagtattgcag

SEQ ID NO: 24892 - DNA, 20 bp, Artificial Sequence
  chemically synthesized
gaattaatttgtgccaattg

SEQ ID NO: 24893 - DNA, 20 bp, Artificial Sequence
  chemically synthesized
attaatttgtgccaattgaa

SEQ ID NO: 24894 - DNA, 20 bp, Artificial Sequence
  chemically synthesized
ccaattgaagagcatgacaa

SEQ ID NO: 24895 - DNA, 20 bp, Artificial Sequence
  chemically synthesized
aagagcatgacaaaagtaca

SEQ ID NO: 24896 - DNA, 20 bp, Artificial Sequence
  chemically synthesized
agagcatgacaaaagtacaa

SEQ ID NO: 24897 - DNA, 20 bp, Artificial Sequence
  chemically synthesized
atgacaaaagtacaaaggaa

SEQ ID NO: 24898 - DNA, 20 bp, Artificial Sequence
  chemically synthesized
ggctctcctcatgtcccctc

SEQ ID NO: 24899 - DNA, 20 bp, Artificial Sequence
  chemically synthesized
gctctcctcatgtcccctca

SEQ ID NO: 24900 - DNA, 20 bp, Artificial Sequence
  chemically synthesized
tcctcatgtcccctcaaggt

SEQ ID NO: 24901 - DNA, 20 bp, Artificial Sequence
  chemically synthesized
aaggtcagtttcatccataa

SEQ ID NO: 24902 - DNA, 20 bp, Artificial Sequence
  chemically synthesized
aggtcagtttcatccataac

SEQ ID NO: 24903 - DNA, 20 bp, Artificial Sequence
  chemically synthesized
ttcatccataacaggtaaac

SEQ ID NO: 24904 - DNA, 20 bp, Artificial Sequence
  chemically synthesized
tcatccataacaggtaaacg

SEQ ID NO: 24905 - DNA, 20 bp, Artificial Sequence
  chemically synthesized
acaggtaaacgaggtccact

SEQ ID NO: 24906 - DNA, 20 bp, Artificial Sequence
  chemically synthesized
gtccactcagcttctgtctg

SEQ ID NO: 24907 - DNA, 20 bp, Artificial Sequence
  chemically synthesized
tccactcagcttctgtctgc

SEQ ID NO: 24908 - DNA, 20 bp, Artificial Sequence
  chemically synthesized
ccactcagcttctgtctgca

SEQ ID NO: 24909 - DNA, 20 bp, Artificial Sequence
  chemically synthesized
cactcagcttctgtctgcag

SEQ ID NO: 24910 - DNA, 20 bp, Artificial Sequence
  chemically synthesized
cagcttctgtctgcaggggc

SEQ ID NO: 24911 - DNA, 20 bp, Artificial Sequence
  chemically synthesized
agcttctgtctgcaggggct

SEQ ID NO: 24912 - DNA, 20 bp, Artificial Sequence
  chemically synthesized
caggggctgggacgcttacc

SEQ ID NO: 24913 - DNA, 20 bp, Artificial Sequence
  chemically synthesized
gctgggacgcttacctggtc

SEQ ID NO: 24914 - DNA, 20 bp, Artificial Sequence
  chemically synthesized
gcttacctggtccagtctca

SEQ ID NO: 24915 - DNA, 20 bp, Artificial Sequence
  chemically synthesized
cttacctggtccagtctcac

SEQ ID NO: 24916 - DNA, 20 bp, Artificial Sequence
  chemically synthesized
tggtccagtctcacaggtta

SEQ ID NO: 24917 - DNA, 20 bp, Artificial Sequence
  chemically synthesized
ggtccagtctcacaggttac

SEQ ID NO: 24918 - DNA, 20 bp, Artificial Sequence
  chemically synthesized
gtccagtctcacaggttaca

SEQ ID NO: 24919 - DNA, 20 bp, Artificial Sequence
  chemically synthesized
gttacagggaactgctttat

SEQ ID NO: 24920 - DNA, 20 bp, Artificial Sequence
  chemically synthesized
ttacagggaactgctttatc

SEQ ID NO: 24921 - DNA, 20 bp, Artificial Sequence
  chemically synthesized
tacagggaactgctttatca

SEQ ID NO: 24922 - DNA, 20 bp, Artificial Sequence
  chemically synthesized
acagggaactgctttatcag

SEQ ID NO: 24923 - DNA, 20 bp, Artificial Sequence
  chemically synthesized
gaactgctttatcaggggca

SEQ ID NO: 24924 - DNA, 20 bp, Artificial Sequence
  chemically synthesized
ctgctttatcaggggcacgg

SEQ ID NO: 24925 - DNA, 20 bp, Artificial Sequence
  chemically synthesized
ggggcacggaagtgttgctg

SEQ ID NO: 24926 - DNA, 20 bp, Artificial Sequence
  chemically synthesized
gcacggaagtgttgctgtag

SEQ ID NO: 24927 - DNA, 20 bp, Artificial Sequence
  chemically synthesized
ggaagtgttgctgtagtagt

SEQ ID NO: 24928 - DNA, 20 bp, Artificial Sequence
  chemically synthesized
agtcagtatccaaaacccac

SEQ ID NO: 24929 - DNA, 20 bp, Artificial Sequence
  chemically synthesized
gtatccaaaacccaccagta

SEQ ID NO: 24930 - DNA, 20 bp, Artificial Sequence
  chemically synthesized
accagtatggacgctgtcca

SEQ ID NO: 24931 - DNA, 20 bp, Artificial Sequence
  chemically synthesized
cagtatggacgctgtccaaa

SEQ ID NO: 24932 - DNA, 20 bp, Artificial Sequence
  chemically synthesized
gctgtccaaagagaatccta

SEQ ID NO: 24933 - DNA, 20 bp, Artificial Sequence
  chemically synthesized
aagagaatcctatggaaaaa

SEQ ID NO: 24934 - DNA, 20 bp, Artificial Sequence
  chemically synthesized
atcctatggaaaaacagaac

SEQ ID NO: 24935 - DNA, 20 bp, Artificial Sequence
  chemically synthesized
ggaaaaacagaacaagtttc

SEQ ID NO: 24936 - DNA, 20 bp, Artificial Sequence
  chemically synthesized
gaaaaacagaacaagtttct

SEQ ID NO: 24937 - DNA, 20 bp, Artificial Sequence
  chemically synthesized
aaaaacagaacaagtttctg

SEQ ID NO: 24938 - DNA, 20 bp, Artificial Sequence
  chemically synthesized
tgaatgaatgcttttgccca

SEQ ID NO: 24939 - DNA, 20 bp, Artificial Sequence
  chemically synthesized
tgcccaaagcctacaccttc

SEQ ID NO: 24940 - DNA, 20 bp, Artificial Sequence
  chemically synthesized
ccaaagcctacaccttcaag

SEQ ID NO: 24941 - DNA, 20 bp, Artificial Sequence
  chemically synthesized
aaagcctacaccttcaagaa

SEQ ID NO: 24942 - DNA, 20 bp, Artificial Sequence
  chemically synthesized
ctacaccttcaagaagagtg

SEQ ID NO: 24943 - DNA, 20 bp, Artificial Sequence
  chemically synthesized
cttcaagaagagtgtagcct

SEQ ID NO: 24944 - DNA, 20 bp, Artificial Sequence
  chemically synthesized
caagaagagtgtagcctgag

SEQ ID NO: 24945 - DNA, 20 bp, Artificial Sequence
  chemically synthesized
aagaagagtgtagcctgaga

SEQ ID NO: 24946 - DNA, 20 bp, Artificial Sequence
  chemically synthesized
aggatttcacatgttgcctc

SEQ ID NO: 24947 - DNA, 20 bp, Artificial Sequence
  chemically synthesized
atttcacatgttgcctctag

SEQ ID NO: 24948 - DNA, 20 bp, Artificial Sequence
  chemically synthesized
tttcacatgttgcctctaga

SEQ ID NO: 24949 - DNA, 20 bp, Artificial Sequence
  chemically synthesized
ttcacatgttgcctctagaa

SEQ ID NO: 24950 - DNA, 20 bp, Artificial Sequence
  chemically synthesized
cacatgttgcctctagaagg

SEQ ID NO: 24951 - DNA, 20 bp, Artificial Sequence
  chemically synthesized
ttgcctctagaagggagaac

SEQ ID NO: 24952 - DNA, 20 bp, Artificial Sequence
  chemically synthesized
tgcctctagaagggagaact

SEQ ID NO: 24953 - DNA, 20 bp, Artificial Sequence
  chemically synthesized
ctctagaagggagaactggg

SEQ ID NO: 24954 - DNA, 20 bp, Artificial Sequence
  chemically synthesized
agaagggagaactgggtggc

SEQ ID NO: 24955 - DNA, 20 bp, Artificial Sequence
  chemically synthesized
gaagggagaactgggtggct

SEQ ID NO: 24956 - DNA, 20 bp, Artificial Sequence
  chemically synthesized
aagggagaactgggtggctg

SEQ ID NO: 24957 - DNA, 20 bp, Artificial Sequence
  chemically synthesized
gggagaactgggtggctggg

SEQ ID NO: 24958 - DNA, 20 bp, Artificial Sequence
  chemically synthesized
agaactgggtggctggggag

SEQ ID NO: 24959 - DNA, 20 bp, Artificial Sequence
  chemically synthesized
gggtggctggggagaagtgt

SEQ ID NO: 24960 - DNA, 20 bp, Artificial Sequence
  chemically synthesized
gtggctggggagaagtgtga

SEQ ID NO: 24961 - DNA, 20 bp, Artificial Sequence
  chemically synthesized
tggctggggagaagtgtgag

SEQ ID NO: 24962 - DNA, 20 bp, Artificial Sequence
  chemically synthesized
ggctggggagaagtgtgaga

SEQ ID NO: 24963 - DNA, 20 bp, Artificial Sequence
  chemically synthesized
ctggggagaagtgtgagagg

SEQ ID NO: 24964 - DNA, 20 bp, Artificial Sequence
  chemically synthesized
gtattatctttttttttttt

SEQ ID NO: 24965 - DNA, 20 bp, Artificial Sequence
  chemically synthesized
tatcttttttttttttgaga

SEQ ID NO: 24966 - DNA, 20 bp, Artificial Sequence
  chemically synthesized
atcttttttttttttgagac

SEQ ID NO: 24967 - DNA, 20 bp, Artificial Sequence
  chemically synthesized
tttttttttgagacaggatc

SEQ ID NO: 24968 - DNA, 20 bp, Artificial Sequence
  chemically synthesized
ttttgagacaggatctggct

SEQ ID NO: 24969 - DNA, 20 bp, Artificial Sequence
  chemically synthesized
caggatctggctcagtaacc

SEQ ID NO: 24970 - DNA, 20 bp, Artificial Sequence
  chemically synthesized
tctggctcagtaacccagcc

SEQ ID NO: 24971 - DNA, 20 bp, Artificial Sequence
  chemically synthesized
tggctcagtaacccagcctg

SEQ ID NO: 24972 - DNA, 20 bp, Artificial Sequence
  chemically synthesized
cagtaacccagcctggagtg

SEQ ID NO: 24973 - DNA, 20 bp, Artificial Sequence
  chemically synthesized
taacccagcctggagtgcag

SEQ ID NO: 24974 - DNA, 20 bp, Artificial Sequence
  chemically synthesized
ggagtgcagtggcgcaatct

SEQ ID NO: 24975 - DNA, 20 bp, Artificial Sequence
  chemically synthesized
tcattgtgacctctacctcc

SEQ ID NO: 24976 - DNA, 20 bp, Artificial Sequence
  chemically synthesized
cattgtgacctctacctcct

SEQ ID NO: 24977 - DNA, 20 bp, Artificial Sequence
  chemically synthesized
ctcctgggatcctcccacct

SEQ ID NO: 24978 - DNA, 20 bp, Artificial Sequence
  chemically synthesized
tcccacctcagcctcctgaa

SEQ ID NO: 24979 - DNA, 20 bp, Artificial Sequence
  chemically synthesized
acctcagcctcctgaatagc

SEQ ID NO: 24980 - DNA, 20 bp, Artificial Sequence
  chemically synthesized
cctcagcctcctgaatagct

SEQ ID NO: 24981 - DNA, 20 bp, Artificial Sequence
  chemically synthesized
ctcctgaatagctgggacta

SEQ ID NO: 24982 - DNA, 20 bp, Artificial Sequence
  chemically synthesized
tcctgaatagctgggactac

SEQ ID NO: 24983 - DNA, 20 bp, Artificial Sequence
  chemically synthesized
caggtgtgtgccaccacatc

SEQ ID NO: 24984 - DNA, 20 bp, Artificial Sequence
  chemically synthesized
tgtgtgccaccacatccagc

SEQ ID NO: 24985 - DNA, 20 bp, Artificial Sequence
  chemically synthesized
ccagctagtttttgtatttt

SEQ ID NO: 24986 - DNA, 20 bp, Artificial Sequence
  chemically synthesized
gctagtttttgtatttttag

SEQ ID NO: 24987 - DNA, 20 bp, Artificial Sequence
  chemically synthesized
tagtttttgtatttttagta

SEQ ID NO: 24988 - DNA, 20 bp, Artificial Sequence
  chemically synthesized
ttttgtatttttagtagaga

SEQ ID NO: 24989 - DNA, 20 bp, Artificial Sequence
  chemically synthesized
tttgtatttttagtagagac

SEQ ID NO: 24990 - DNA, 20 bp, Artificial Sequence
  chemically synthesized
ttgtatttttagtagagacg

SEQ ID NO: 24991 - DNA, 20 bp, Artificial Sequence
  chemically synthesized
cggggtttcaccatgttgcc

SEQ ID NO: 24992 - DNA, 20 bp, Artificial Sequence
  chemically synthesized
ggggtttcaccatgttgccc

SEQ ID NO: 24993 - DNA, 20 bp, Artificial Sequence
  chemically synthesized
tttcaccatgttgcccaggc

SEQ ID NO: 24994 - DNA, 20 bp, Artificial Sequence
  chemically synthesized
tggtctccatctcctgaact

SEQ ID NO: 24995 - DNA, 20 bp, Artificial Sequence
  chemically synthesized
ggtctccatctcctgaactc

SEQ ID NO: 24996 - DNA, 20 bp, Artificial Sequence
  chemically synthesized
ctcaggcaatcctcccacct

SEQ ID NO: 24997 - DNA, 20 bp, Artificial Sequence
  chemically synthesized
cctcccacctcagcctccca

SEQ ID NO: 24998 - DNA, 20 bp, Artificial Sequence
  chemically synthesized
acctcagcctcccaaagtgc

SEQ ID NO: 24999 - DNA, 20 bp, Artificial Sequence
  chemically synthesized
cctcagcctcccaaagtgct

SEQ ID NO: 25000 - DNA, 20 bp, Artificial Sequence
  chemically synthesized
ctcccaaagtgctgggatta

SEQ ID NO: 25001 - DNA, 20 bp, Artificial Sequence
  chemically synthesized
tcccaaagtgctgggattac

SEQ ID NO: 25002 - DNA, 20 bp, Artificial Sequence
  chemically synthesized
agtgctgggattacaggcat

SEQ ID NO: 25003 - DNA, 20 bp, Artificial Sequence
  chemically synthesized
ctatttaaacacaaataatg

SEQ ID NO: 25004 - DNA, 20 bp, Artificial Sequence
  chemically synthesized
aaacacaaataatgaagccc

SEQ ID NO: 25005 - DNA, 20 bp, Artificial Sequence
  chemically synthesized
aagcccaagattctgaactc

SEQ ID NO: 25006 - DNA, 20 bp, Artificial Sequence
  chemically synthesized
agcccaagattctgaactcc

SEQ ID NO: 25007 - DNA, 20 bp, Artificial Sequence
  chemically synthesized
ccaagattctgaactccagg

SEQ ID NO: 25008 - DNA, 20 bp, Artificial Sequence
  chemically synthesized
caagattctgaactccaggc

SEQ ID NO: 25009 - DNA, 20 bp, Artificial Sequence
  chemically synthesized
ttctgaactccaggcaggcg

SEQ ID NO: 25010 - DNA, 20 bp, Artificial Sequence
  chemically synthesized
tgaactccaggcaggcgcgg

SEQ ID NO: 25011 - DNA, 20 bp, Artificial Sequence
  chemically synthesized
gtggctcacacctgtaatct

SEQ ID NO: 25012 - DNA, 20 bp, Artificial Sequence
  chemically synthesized
cacctgtaatctcagcactt

SEQ ID NO: 25013 - DNA, 20 bp, Artificial Sequence
  chemically synthesized
acctgtaatctcagcacttt

SEQ ID NO: 25014 - DNA, 20 bp, Artificial Sequence
  chemically synthesized
ctgtaatctcagcactttgg

SEQ ID NO: 25015 - DNA, 20 bp, Artificial Sequence
  chemically synthesized
tgtaatctcagcactttggg

SEQ ID NO: 25016 - DNA, 20 bp, Artificial Sequence
  chemically synthesized
tctcagcactttgggaggcc

SEQ ID NO: 25017 - DNA, 20 bp, Artificial Sequence
  chemically synthesized
ctcagcactttgggaggcca

SEQ ID NO: 25018 - DNA, 20 bp, Artificial Sequence
  chemically synthesized
agcactttgggaggccaagg

SEQ ID NO: 25019 - DNA, 20 bp, Artificial Sequence
  chemically synthesized
gcactttgggaggccaaggc

SEQ ID NO: 25020 - DNA, 20 bp, Artificial Sequence
  chemically synthesized
ctttgggaggccaaggcagg

SEQ ID NO: 25021 - DNA, 20 bp, Artificial Sequence
  chemically synthesized
ccaaggcaggcagatcacat

SEQ ID NO: 25022 - DNA, 20 bp, Artificial Sequence
  chemically synthesized
caaggcaggcagatcacatg

SEQ ID NO: 25023 - DNA, 20 bp, Artificial Sequence
  chemically synthesized
gcaggcagatcacatgaggt

SEQ ID NO: 25024 - DNA, 20 bp, Artificial Sequence
  chemically synthesized
caggcagatcacatgaggtc

SEQ ID NO: 25025 - DNA, 20 bp, Artificial Sequence
  chemically synthesized
ggcagatcacatgaggtcag

SEQ ID NO: 25026 - DNA, 20 bp, Artificial Sequence
  chemically synthesized
tcacatgaggtcaggagttt

SEQ ID NO: 25027 - DNA, 20 bp, Artificial Sequence
  chemically synthesized
tgaggtcaggagtttgagac

SEQ ID NO: 25028 - DNA, 20 bp, Artificial Sequence
  chemically synthesized
tcaggagtttgagaccagcc

SEQ ID NO: 25029 - DNA, 20 bp, Artificial Sequence
  chemically synthesized
tgagaccagcctggccaaca

SEQ ID NO: 25030 - DNA, 20 bp, Artificial Sequence
  chemically synthesized
cgtttctaccaaaaaatata

SEQ ID NO: 25031 - DNA, 20 bp, Artificial Sequence
  chemically synthesized
taccaaaaaatataaagaat

SEQ ID NO: 25032 - DNA, 20 bp, Artificial Sequence
  chemically synthesized
aaaaaatataaagaattagc

SEQ ID NO: 25033 - DNA, 20 bp, Artificial Sequence
  chemically synthesized
tataaagaattagccagatg

SEQ ID NO: 25034 - DNA, 20 bp, Artificial Sequence
  chemically synthesized
aaagaattagccagatgtgg

SEQ ID NO: 25035 - DNA, 20 bp, Artificial Sequence
  chemically synthesized
gtggtgcgtgactgtaatcc

SEQ ID NO: 25036 - DNA, 20 bp, Artificial Sequence
  chemically synthesized
tgactgtaatcccagctact

SEQ ID NO: 25037 - DNA, 20 bp, Artificial Sequence
  chemically synthesized
gactgtaatcccagctactc

SEQ ID NO: 25038 - DNA, 20 bp, Artificial Sequence
  chemically synthesized
ctgtaatcccagctactcgg

SEQ ID NO: 25039 - DNA, 20 bp, Artificial Sequence
  chemically synthesized
tgtaatcccagctactcggg

SEQ ID NO: 25040 - DNA, 20 bp, Artificial Sequence
  chemically synthesized
tcccagctactcgggaggct

SEQ ID NO: 25041 - DNA, 20 bp, Artificial Sequence
  chemically synthesized
cccagctactcgggaggcta

SEQ ID NO: 25042 - DNA, 20 bp, Artificial Sequence
  chemically synthesized
gctactcgggaggctaaggc

SEQ ID NO: 25043 - DNA, 20 bp, Artificial Sequence
  chemically synthesized
tactcgggaggctaaggcaa

SEQ ID NO: 25044 - DNA, 20 bp, Artificial Sequence
  chemically synthesized
gcaagagaatcgcttgaacc

SEQ ID NO: 25045 - DNA, 20 bp, Artificial Sequence
  chemically synthesized
caagagaatcgcttgaacct

SEQ ID NO: 25046 - DNA, 20 bp, Artificial Sequence
  chemically synthesized
agagaatcgcttgaacctgg

SEQ ID NO: 25047 - DNA, 20 bp, Artificial Sequence
  chemically synthesized
gagaatcgcttgaacctggg

SEQ ID NO: 25048 - DNA, 20 bp, Artificial Sequence
  chemically synthesized
aatcgcttgaacctgggagg

SEQ ID NO: 25049 - DNA, 20 bp, Artificial Sequence
  chemically synthesized
tcgcttgaacctgggaggcg

SEQ ID NO: 25050 - DNA, 20 bp, Artificial Sequence
  chemically synthesized
cgcttgaacctgggaggcgg

SEQ ID NO: 25051 - DNA, 20 bp, Artificial Sequence
  chemically synthesized
tgggaggcggaggttgccgt

SEQ ID NO: 25052 - DNA, 20 bp, Artificial Sequence
  chemically synthesized
ggcggaggttgccgtgagcc

SEQ ID NO: 25053 - DNA, 20 bp, Artificial Sequence
  chemically synthesized
gagattatgccactgcacta

SEQ ID NO: 25054 - DNA, 20 bp, Artificial Sequence
  chemically synthesized
agattatgccactgcactac

SEQ ID NO: 25055 - DNA, 20 bp, Artificial Sequence
  chemically synthesized
tatgccactgcactacaggc

SEQ ID NO: 25056 - DNA, 20 bp, Artificial Sequence
  chemically synthesized
atgccactgcactacaggct

SEQ ID NO: 25057 - DNA, 20 bp, Artificial Sequence
  chemically synthesized
ctgcactacaggctgggtga

SEQ ID NO: 25058 - DNA, 20 bp, Artificial Sequence
  chemically synthesized
gcactacaggctgggtgaca

SEQ ID NO: 25059 - DNA, 20 bp, Artificial Sequence
  chemically synthesized
tacaggctgggtgacagagc

SEQ ID NO: 25060 - DNA, 20 bp, Artificial Sequence
  chemically synthesized
aaatcctgaaatccataaaa

SEQ ID NO: 25061 - DNA, 20 bp, Artificial Sequence
  chemically synthesized
tcctgaaatccataaaatgg

SEQ ID NO: 25062 - DNA, 20 bp, Artificial Sequence
  chemically synthesized
gactttttttttttaacctc

SEQ ID NO: 25063 - DNA, 20 bp, Artificial Sequence
  chemically synthesized
tttttttttttaacctcaag

SEQ ID NO: 25064 - DNA, 20 bp, Artificial Sequence
  chemically synthesized
acctcaagaagtatttgtcc

SEQ ID NO: 25065 - DNA, 20 bp, Artificial Sequence
  chemically synthesized
tcaagaagtatttgtcctgg

SEQ ID NO: 25066 - DNA, 20 bp, Artificial Sequence
  chemically synthesized
ttgtcctggaagaatgcata

SEQ ID NO: 25067 - DNA, 20 bp, Artificial Sequence
  chemically synthesized
gaagaatgcatatggaacta

SEQ ID NO: 25068 - DNA, 20 bp, Artificial Sequence
  chemically synthesized
tggaactacagtttgaaact

SEQ ID NO: 25069 - DNA, 20 bp, Artificial Sequence
  chemically synthesized
acttggacttgcatatacca

SEQ ID NO: 25070 - DNA, 20 bp, Artificial Sequence
  chemically synthesized
cttggacttgcatataccat

SEQ ID NO: 25071 - DNA, 20 bp, Artificial Sequence
  chemically synthesized
gcatataccatgggttccct

SEQ ID NO: 25072 - DNA, 20 bp, Artificial Sequence
  chemically synthesized
catataccatgggttccctc

SEQ ID NO: 25073 - DNA, 20 bp, Artificial Sequence
  chemically synthesized
ccatgggttccctcaggcct

SEQ ID NO: 25074 - DNA, 20 bp, Artificial Sequence
  chemically synthesized
catgggttccctcaggcctc

SEQ ID NO: 25075 - DNA, 20 bp, Artificial Sequence
  chemically synthesized
atgggttccctcaggcctca

SEQ ID NO: 25076 - DNA, 20 bp, Artificial Sequence
  chemically synthesized
tcttgcatttcctctgacat

SEQ ID NO: 25077 - DNA, 20 bp, Artificial Sequence
  chemically synthesized
ttgcatttcctctgacatca

SEQ ID NO: 25078 - DNA, 20 bp, Artificial Sequence
  chemically synthesized
tgacatcagagaatgcactc

SEQ ID NO: 25079 - DNA, 20 bp, Artificial Sequence
  chemically synthesized
agagaatgcactccagcccc

SEQ ID NO: 25080 - DNA, 20 bp, Artificial Sequence
  chemically synthesized
gagaatgcactccagcccct

SEQ ID NO: 25081 - DNA, 20 bp, Artificial Sequence
  chemically synthesized
tgcactccagcccctaggac

SEQ ID NO: 25082 - DNA, 20 bp, Artificial Sequence
  chemically synthesized
cccctaggacgagccccccc

SEQ ID NO: 25083 - DNA, 20 bp, Artificial Sequence
  chemically synthesized
ccctaggacgagcccccccc

SEQ ID NO: 25084 - DNA, 20 bp, Artificial Sequence
  chemically synthesized
cctaggacgagcccccccca

SEQ ID NO: 25085 - DNA, 20 bp, Artificial Sequence
  chemically synthesized
gagccccccccagggaaaca

SEQ ID NO: 25086 - DNA, 20 bp, Artificial Sequence
  chemically synthesized
aacatggcctgcatttccat

SEQ ID NO: 25087 - DNA, 20 bp, Artificial Sequence
  chemically synthesized
ccatcagaattgctctctgt

SEQ ID NO: 25088 - DNA, 20 bp, Artificial Sequence
  chemically synthesized
catcagaattgctctctgta

SEQ ID NO: 25089 - DNA, 20 bp, Artificial Sequence
  chemically synthesized
gctctctgtaaggatgtata

SEQ ID NO: 25090 - DNA, 20 bp, Artificial Sequence
  chemically synthesized
tgtaaggatgtatatagctt

SEQ ID NO: 25091 - DNA, 20 bp, Artificial Sequence
  chemically synthesized
gtatcctctctactttgaaa

SEQ ID NO: 25092 - DNA, 20 bp, Artificial Sequence
  chemically synthesized
atcctctctactttgaaaca

SEQ ID NO: 25093 - DNA, 20 bp, Artificial Sequence
  chemically synthesized
tactttgaaacagagtatct

SEQ ID NO: 25094 - DNA, 20 bp, Artificial Sequence
  chemically synthesized
acaaaccacttcccctttaa

SEQ ID NO: 25095 - DNA, 20 bp, Artificial Sequence
  chemically synthesized
cacttcccctttaaaagtac

SEQ ID NO: 25096 - DNA, 20 bp, Artificial Sequence
  chemically synthesized
actagatatatctttcactg

SEQ ID NO: 25097 - DNA, 20 bp, Artificial Sequence
  chemically synthesized
tatatctttcactgtggaaa

SEQ ID NO: 25098 - DNA, 20 bp, Artificial Sequence
  chemically synthesized
atatctttcactgtggaaat

SEQ ID NO: 25099 - DNA, 20 bp, Artificial Sequence
  chemically synthesized
tggaaataggtgtcaaccgc

SEQ ID NO: 25100 - DNA, 20 bp, Artificial Sequence
  chemically synthesized
aataggtgtcaaccgccagt

SEQ ID NO: 25101 - DNA, 20 bp, Artificial Sequence
  chemically synthesized
ataggtgtcaaccgccagtc

SEQ ID NO: 25102 - DNA, 20 bp, Artificial Sequence
  chemically synthesized
ggatgccttttatcccgtga

SEQ ID NO: 25103 - DNA, 20 bp, Artificial Sequence
  chemically synthesized
tgccttttatcccgtgatgg

SEQ ID NO: 25104 - DNA, 20 bp, Artificial Sequence
  chemically synthesized
tttatcccgtgatggtggaa

SEQ ID NO: 25105 - DNA, 20 bp, Artificial Sequence
  chemically synthesized
tagtgatttctcaccgaaat

SEQ ID NO: 25106 - DNA, 20 bp, Artificial Sequence
  chemically synthesized
agtgatttctcaccgaaatc

SEQ ID NO: 25107 - DNA, 20 bp, Artificial Sequence
  chemically synthesized
gtgatttctcaccgaaatca

SEQ ID NO: 25108 - DNA, 20 bp, Artificial Sequence
  chemically synthesized
gatttctcaccgaaatcagg

SEQ ID NO: 25109 - DNA, 20 bp, Artificial Sequence
  chemically synthesized
tttctcaccgaaatcaggga

SEQ ID NO: 25110 - DNA, 20 bp, Artificial Sequence
  chemically synthesized
tcagggagagccactaactc

SEQ ID NO: 25111 - DNA, 20 bp, Artificial Sequence
  chemically synthesized
aactctggcctctatcaacc

SEQ ID NO: 25112 - DNA, 20 bp, Artificial Sequence
  chemically synthesized
ctctggcctctatcaaccca

SEQ ID NO: 25113 - DNA, 20 bp, Artificial Sequence
  chemically synthesized
ctggcctctatcaacccaga

SEQ ID NO: 25114 - DNA, 20 bp, Artificial Sequence
  chemically synthesized
atcaacccagagagattgca

SEQ ID NO: 25115 - DNA, 20 bp, Artificial Sequence
  chemically synthesized
gagattgcatggttcttcaa

SEQ ID NO: 25116 - DNA, 20 bp, Artificial Sequence
  chemically synthesized
gattgcatggttcttcaatg

SEQ ID NO: 25117 - DNA, 20 bp, Artificial Sequence
  chemically synthesized
catggttcttcaatggagat

SEQ ID NO: 25118 - DNA, 20 bp, Artificial Sequence
  chemically synthesized
ttcaatggagatcagatgtt

SEQ ID NO: 25119 - DNA, 20 bp, Artificial Sequence
  chemically synthesized
cacttcatctttttattttt

SEQ ID NO: 25120 - DNA, 20 bp, Artificial Sequence
  chemically synthesized
ttttattttttagaatcatg

SEQ ID NO: 25121 - DNA, 20 bp, Artificial Sequence
  chemically synthesized
attttttagaatcatgcggc

SEQ ID NO: 25122 - DNA, 20 bp, Artificial Sequence
  chemically synthesized
ttttttagaatcatgcggct

SEQ ID NO: 25123 - DNA, 20 bp, Artificial Sequence
  chemically synthesized
tagaatcatgcggctgggtg

SEQ ID NO: 25124 - DNA, 20 bp, Artificial Sequence
  chemically synthesized
aatcatgcggctgggtgtag

SEQ ID NO: 25125 - DNA, 20 bp, Artificial Sequence
  chemically synthesized
gtggctcacgcctgtaatcc

SEQ ID NO: 25126 - DNA, 20 bp, Artificial Sequence
  chemically synthesized
acgcctgtaatcctagcact

SEQ ID NO: 25127 - DNA, 20 bp, Artificial Sequence
  chemically synthesized
cgcctgtaatcctagcactt

SEQ ID NO: 25128 - DNA, 20 bp, Artificial Sequence
  chemically synthesized
gcctgtaatcctagcactta

SEQ ID NO: 25129 - DNA, 20 bp, Artificial Sequence
  chemically synthesized
ctgtaatcctagcacttagg

SEQ ID NO: 25130 - DNA, 20 bp, Artificial Sequence
  chemically synthesized
tgtaatcctagcacttaggg

SEQ ID NO: 25131 - DNA, 20 bp, Artificial Sequence
  chemically synthesized
tcctagcacttagggaggcc

SEQ ID NO: 25132 - DNA, 20 bp, Artificial Sequence
  chemically synthesized
cctagcacttagggaggcca

SEQ ID NO: 25133 - DNA, 20 bp, Artificial Sequence
  chemically synthesized
agcacttagggaggccaagg

SEQ ID NO: 25134 - DNA, 20 bp, Artificial Sequence
  chemically synthesized
gcacttagggaggccaaggc

SEQ ID NO: 25135 - DNA, 20 bp, Artificial Sequence
  chemically synthesized
cttagggaggccaaggcagg

SEQ ID NO: 25136 - DNA, 20 bp, Artificial Sequence
  chemically synthesized
ggccaaggcaggcagatcat

SEQ ID NO: 25137 - DNA, 20 bp, Artificial Sequence
  chemically synthesized
gccaaggcaggcagatcatg

SEQ ID NO: 25138 - DNA, 20 bp, Artificial Sequence
  chemically synthesized
aggcaggcagatcatgaggt

SEQ ID NO: 25139 - DNA, 20 bp, Artificial Sequence
  chemically synthesized
ggcaggcagatcatgaggtc

SEQ ID NO: 25140 - DNA, 20 bp, Artificial Sequence
  chemically synthesized
caggcagatcatgaggtcag

SEQ ID NO: 25141 - DNA, 20 bp, Artificial Sequence
  chemically synthesized
gatcatgaggtcaggagttc

SEQ ID NO: 25142 - DNA, 20 bp, Artificial Sequence
  chemically synthesized
tgaggtcaggagttcgagac

SEQ ID NO: 25143 - DNA, 20 bp, Artificial Sequence
  chemically synthesized
tcaggagttcgagaccagcc

SEQ ID NO: 25144 - DNA, 20 bp, Artificial Sequence
  chemically synthesized
cgagaccagcctagtcaaca

SEQ ID NO: 25145 - DNA, 20 bp, Artificial Sequence
  chemically synthesized
actaaaaatacaaaaaaaat

SEQ ID NO: 25146 - DNA, 20 bp, Artificial Sequence
  chemically synthesized
aaaatacaaaaaaaattagc

SEQ ID NO: 25147 - DNA, 20 bp, Artificial Sequence
  chemically synthesized
aaatacaaaaaaaattagct

SEQ ID NO: 25148 - DNA, 20 bp, Artificial Sequence
  chemically synthesized
caaaaaaaattagctgggca

SEQ ID NO: 25149 - DNA, 20 bp, Artificial Sequence
  chemically synthesized
aaaaaattagctgggcatgg

SEQ ID NO: 25150 - DNA, 20 bp, Artificial Sequence
  chemically synthesized
aaattagctgggcatggtgg

SEQ ID NO: 25151 - DNA, 20 bp, Artificial Sequence
  chemically synthesized
aattagctgggcatggtggc

SEQ ID NO: 25152 - DNA, 20 bp, Artificial Sequence
  chemically synthesized
gtggcgggcacctgtaatcc

SEQ ID NO: 25153 - DNA, 20 bp, Artificial Sequence
  chemically synthesized
cacctgtaatcccagctact

SEQ ID NO: 25154 - DNA, 20 bp, Artificial Sequence
  chemically synthesized
acctgtaatcccagctactt

SEQ ID NO: 25155 - DNA, 20 bp, Artificial Sequence
  chemically synthesized
ctgtaatcccagctacttgg

SEQ ID NO: 25156 - DNA, 20 bp, Artificial Sequence
  chemically synthesized
tgtaatcccagctacttggg

SEQ ID NO: 25157 - DNA, 20 bp, Artificial Sequence
  chemically synthesized
tcccagctacttgggaggct

SEQ ID NO: 25158 - DNA, 20 bp, Artificial Sequence
  chemically synthesized
cccagctacttgggaggctg

SEQ ID NO: 25159 - DNA, 20 bp, Artificial Sequence
  chemically synthesized
agctacttgggaggctgagg

SEQ ID NO: 25160 - DNA, 20 bp, Artificial Sequence
  chemically synthesized
gctacttgggaggctgaggc

SEQ ID NO: 25161 - DNA, 20 bp, Artificial Sequence
  chemically synthesized
tacttgggaggctgaggcag

SEQ ID NO: 25162 - DNA, 20 bp, Artificial Sequence
  chemically synthesized
ggcaggagaatcacttgaac

SEQ ID NO: 25163 - DNA, 20 bp, Artificial Sequence
  chemically synthesized
caggagaatcacttgaaccg

SEQ ID NO: 25164 - DNA, 20 bp, Artificial Sequence
  chemically synthesized
ggagaatcacttgaaccgga

SEQ ID NO: 25165 - DNA, 20 bp, Artificial Sequence
  chemically synthesized
gagaatcacttgaaccggag

SEQ ID NO: 25166 - DNA, 20 bp, Artificial Sequence
  chemically synthesized
aatcacttgaaccggagagg

SEQ ID NO: 25167 - DNA, 20 bp, Artificial Sequence
  chemically synthesized
tcacttgaaccggagaggca

SEQ ID NO: 25168 - DNA, 20 bp, Artificial Sequence
  chemically synthesized
cacttgaaccggagaggcag

SEQ ID NO: 25169 - DNA, 20 bp, Artificial Sequence
  chemically synthesized
aaccggagaggcagaggttg

SEQ ID NO: 25170 - DNA, 20 bp, Artificial Sequence
  chemically synthesized
ggagaggcagaggttgcagt

SEQ ID NO: 25171 - DNA, 20 bp, Artificial Sequence
  chemically synthesized
ggcagaggttgcagtgagct

SEQ ID NO: 25172 - DNA, 20 bp, Artificial Sequence
  chemically synthesized
gagattgcaccattgcactc

SEQ ID NO: 25173 - DNA, 20 bp, Artificial Sequence
  chemically synthesized
ttgcaccattgcactccagc

SEQ ID NO: 25174 - DNA, 20 bp, Artificial Sequence
  chemically synthesized
tgcaccattgcactccagcc

SEQ ID NO: 25175 - DNA, 20 bp, Artificial Sequence
  chemically synthesized
attgcactccagccaggcaa

SEQ ID NO: 25176 - DNA, 20 bp, Artificial Sequence
  chemically synthesized
ctccagccaggcaacagtgc

SEQ ID NO: 25177 - DNA, 20 bp, Artificial Sequence
  chemically synthesized
catctcaaacaaacaaacaa

SEQ ID NO: 25178 - DNA, 20 bp, Artificial Sequence
  chemically synthesized
tcaaacaaacaaacaaaaga

SEQ ID NO: 25179 - DNA, 20 bp, Artificial Sequence
  chemically synthesized
acaaacaaacaaaagaaaga

SEQ ID NO: 25180 - DNA, 20 bp, Artificial Sequence
  chemically synthesized
acaaacaaaagaaagaaaga

SEQ ID NO: 25181 - DNA, 20 bp, Artificial Sequence
  chemically synthesized
acaaaagaaagaaagaaaga

SEQ ID NO: 25182 - DNA, 20 bp, Artificial Sequence
  chemically synthesized
aaagaaagaaagaaagaaag

SEQ ID NO: 25183 - DNA, 20 bp, Artificial Sequence
  chemically synthesized
aaagaaagaaagaaagtggc

SEQ ID NO: 25184 - DNA, 20 bp, Artificial Sequence
  chemically synthesized
aagaaagaaagtggccagaa

SEQ ID NO: 25185 - DNA, 20 bp, Artificial Sequence
  chemically synthesized
agaaagaaagtggccagaat

SEQ ID NO: 25186 - DNA, 20 bp, Artificial Sequence
  chemically synthesized
gaatgggaatgtttacgtga

SEQ ID NO: 25187 - DNA, 20 bp, Artificial Sequence
  chemically synthesized
aatgtttacgtgatagaaat

SEQ ID NO: 25188 - DNA, 20 bp, Artificial Sequence
  chemically synthesized
aaattggcaaatgctaaact

SEQ ID NO: 25189 - DNA, 20 bp, Artificial Sequence
  chemically synthesized
aattggcaaatgctaaactc

SEQ ID NO: 25190 - DNA, 20 bp, Artificial Sequence
  chemically synthesized
attggcaaatgctaaactca

SEQ ID NO: 25191 - DNA, 20 bp, Artificial Sequence
  chemically synthesized
cagggctttcccctgctccc

SEQ ID NO: 25192 - DNA, 20 bp, Artificial Sequence
  chemically synthesized
gggctttcccctgctcccca

SEQ ID NO: 25193 - DNA, 20 bp, Artificial Sequence
  chemically synthesized
gctttcccctgctccccaga

SEQ ID NO: 25194 - DNA, 20 bp, Artificial Sequence
  chemically synthesized
tcccctgctccccagagagt

SEQ ID NO: 25195 - DNA, 20 bp, Artificial Sequence
  chemically synthesized
tccccagagagtcagtttat

SEQ ID NO: 25196 - DNA, 20 bp, Artificial Sequence
  chemically synthesized
gagagtcagtttatcagcac

SEQ ID NO: 25197 - DNA, 20 bp, Artificial Sequence
  chemically synthesized
tatcagcactggacgtaaca

SEQ ID NO: 25198 - DNA, 20 bp, Artificial Sequence
  chemically synthesized
ctggacgtaacatagttcat

SEQ ID NO: 25199 - DNA, 20 bp, Artificial Sequence
  chemically synthesized
ggacgtaacatagttcataa

SEQ ID NO: 25200 - DNA, 20 bp, Artificial Sequence
  chemically synthesized
agttcataagagcattgccg

SEQ ID NO: 25201 - DNA, 20 bp, Artificial Sequence
  chemically synthesized
tcataagagcattgccgcgg

SEQ ID NO: 25202 - DNA, 20 bp, Artificial Sequence
  chemically synthesized
aagagcattgccgcggaagc

SEQ ID NO: 25203 - DNA, 20 bp, Artificial Sequence
  chemically synthesized
cggaagccagcctgcctacc

SEQ ID NO: 25204 - DNA, 20 bp, Artificial Sequence
  chemically synthesized
ggaagccagcctgcctacct

SEQ ID NO: 25205 - DNA, 20 bp, Artificial Sequence
  chemically synthesized
gcctacctgggcttccatcc

SEQ ID NO: 25206 - DNA, 20 bp, Artificial Sequence
  chemically synthesized
cctgggcttccatcctggct

SEQ ID NO: 25207 - DNA, 20 bp, Artificial Sequence
  chemically synthesized
tcggcatgtactaaccttgt

SEQ ID NO: 25208 - DNA, 20 bp, Artificial Sequence
  chemically synthesized
gttggcctaatcatttaact

SEQ ID NO: 25209 - DNA, 20 bp, Artificial Sequence
  chemically synthesized
aatcatttaactcagcacct

SEQ ID NO: 25210 - DNA, 20 bp, Artificial Sequence
  chemically synthesized
gcatctactgtttctgtaaa

SEQ ID NO: 25211 - DNA, 20 bp, Artificial Sequence
  chemically synthesized
tctactgtttctgtaaatag

SEQ ID NO: 25212 - DNA, 20 bp, Artificial Sequence
  chemically synthesized
aaatagcagtaactacctca

SEQ ID NO: 25213 - DNA, 20 bp, Artificial Sequence
  chemically synthesized
gcagtaactacctcacagaa

SEQ ID NO: 25214 - DNA, 20 bp, Artificial Sequence
  chemically synthesized
ctacctcacagaaaagcaca

SEQ ID NO: 25215 - DNA, 20 bp, Artificial Sequence
  chemically synthesized
acagaaaagcacatagcaca

SEQ ID NO: 25216 - DNA, 20 bp, Artificial Sequence
  chemically synthesized
aaagcacatagcacatggac

SEQ ID NO: 25217 - DNA, 20 bp, Artificial Sequence
  chemically synthesized
tgttaaccctgattattatt

SEQ ID NO: 25218 - DNA, 20 bp, Artificial Sequence
  chemically synthesized
cctgattattattaagctgc

SEQ ID NO: 25219 - DNA, 20 bp, Artificial Sequence
  chemically synthesized
tgattattattaagctgcca

SEQ ID NO: 25220 - DNA, 20 bp, Artificial Sequence
  chemically synthesized
tgccagagataacctatttg

SEQ ID NO: 25221 - DNA, 20 bp, Artificial Sequence
  chemically synthesized
cctatttgtagattataaaa

SEQ ID NO: 25222 - DNA, 20 bp, Artificial Sequence
  chemically synthesized
tagattataaaacagaaact

SEQ ID NO: 25223 - DNA, 20 bp, Artificial Sequence
  chemically synthesized
gataattgatatgacttgcc

SEQ ID NO: 25224 - DNA, 20 bp, Artificial Sequence
  chemically synthesized
ataattgatatgacttgcca

SEQ ID NO: 25225 - DNA, 20 bp, Artificial Sequence
  chemically synthesized
tatgacttgccaaggacatg

SEQ ID NO: 25226 - DNA, 20 bp, Artificial Sequence
  chemically synthesized
acttgccaaggacatgtagt

SEQ ID NO: 25227 - DNA, 20 bp, Artificial Sequence
  chemically synthesized
tgccaaggacatgtagttgg

SEQ ID NO: 25228 - DNA, 20 bp, Artificial Sequence
  chemically synthesized
gccaaggacatgtagttggt

SEQ ID NO: 25229 - DNA, 20 bp, Artificial Sequence
  chemically synthesized
aaggacatgtagttggtggg

SEQ ID NO: 25230 - DNA, 20 bp, Artificial Sequence
  chemically synthesized
gacatgtagttggtgggtgg

SEQ ID NO: 25231 - DNA, 20 bp, Artificial Sequence
  chemically synthesized
tagttggtgggtggcagaac

SEQ ID NO: 25232 - DNA, 20 bp, Artificial Sequence
  chemically synthesized
agttggtgggtggcagaacg

SEQ ID NO: 25233 - DNA, 20 bp, Artificial Sequence
  chemically synthesized
gttggtgggtggcagaacga

SEQ ID NO: 25234 - DNA, 20 bp, Artificial Sequence
  chemically synthesized
gtgggtggcagaacgagggc

SEQ ID NO: 25235 - DNA, 20 bp, Artificial Sequence
  chemically synthesized
gggtggcagaacgagggctg

SEQ ID NO: 25236 - DNA, 20 bp, Artificial Sequence
  chemically synthesized
gcagaacgagggctggagcc

SEQ ID NO: 25237 - DNA, 20 bp, Artificial Sequence
  chemically synthesized
gagggctggagcccagttcc

SEQ ID NO: 25238 - DNA, 20 bp, Artificial Sequence
  chemically synthesized
agggctggagcccagttccc

SEQ ID NO: 25239 - DNA, 20 bp, Artificial Sequence
  chemically synthesized
gggctggagcccagttccca

SEQ ID NO: 25240 - DNA, 20 bp, Artificial Sequence
  chemically synthesized
cttttcattaccccacaaaa

SEQ ID NO: 25241 - DNA, 20 bp, Artificial Sequence
  chemically synthesized
ttttcattaccccacaaaac

SEQ ID NO: 25242 - DNA, 20 bp, Artificial Sequence
  chemically synthesized
gtgtgtttccttttttcata

SEQ ID NO: 25243 - DNA, 20 bp, Artificial Sequence
  chemically synthesized
tctatctttttttttttttt

SEQ ID NO: 25244 - DNA, 20 bp, Artificial Sequence
  chemically synthesized
tcttttttttttttttgaga

SEQ ID NO: 25245 - DNA, 20 bp, Artificial Sequence
  chemically synthesized
cttttttttttttttgagac

SEQ ID NO: 25246 - DNA, 20 bp, Artificial Sequence
  chemically synthesized
ttttttttttttttgagaca

SEQ ID NO: 25247 - DNA, 20 bp, Artificial Sequence
  chemically synthesized
cagggtcttactctgttgcc

SEQ ID NO: 25248 - DNA, 20 bp, Artificial Sequence
  chemically synthesized
agggtcttactctgttgccc

SEQ ID NO: 25249 - DNA, 20 bp, Artificial Sequence
  chemically synthesized
tcttactctgttgcccaggc

SEQ ID NO: 25250 - DNA, 20 bp, Artificial Sequence
  chemically synthesized
ttactctgttgcccaggctg

SEQ ID NO: 25251 - DNA, 20 bp, Artificial Sequence
  chemically synthesized
ctgttgcccaggctggagtg

SEQ ID NO: 25252 - DNA, 20 bp, Artificial Sequence
  chemically synthesized
ttgcccaggctggagtgcag

SEQ ID NO: 25253 - DNA, 20 bp, Artificial Sequence
  chemically synthesized
acctcctccgcctctcacct

SEQ ID NO: 25254 - DNA, 20 bp, Artificial Sequence
  chemically synthesized
gcctctcacctcagcctcct

SEQ ID NO: 25255 - DNA, 20 bp, Artificial Sequence
  chemically synthesized
tctcacctcagcctcctgag

SEQ ID NO: 25256 - DNA, 20 bp, Artificial Sequence
  chemically synthesized
acctcagcctcctgagtagc

SEQ ID NO: 25257 - DNA, 20 bp, Artificial Sequence
  chemically synthesized
cctcagcctcctgagtagct

SEQ ID NO: 25258 - DNA, 20 bp, Artificial Sequence
  chemically synthesized
ctcctgagtagctgggacta

SEQ ID NO: 25259 - DNA, 20 bp, Artificial Sequence
  chemically synthesized
gactacagcaccaacacgcc

SEQ ID NO: 25260 - DNA, 20 bp, Artificial Sequence
  chemically synthesized
taattttcgtaatgtttttg

SEQ ID NO: 25261 - DNA, 20 bp, Artificial Sequence
  chemically synthesized
attttcgtaatgtttttgta

SEQ ID NO: 25262 - DNA, 20 bp, Artificial Sequence
  chemically synthesized
tcgtaatgtttttgtagaga

SEQ ID NO: 25263 - DNA, 20 bp, Artificial Sequence
  chemically synthesized
gtaatgtttttgtagagatg

SEQ ID NO: 25264 - DNA, 20 bp, Artificial Sequence
  chemically synthesized
tggagtttcgccatgttgcc

SEQ ID NO: 25265 - DNA, 20 bp, Artificial Sequence
  chemically synthesized
ggagtttcgccatgttgccc

SEQ ID NO: 25266 - DNA, 20 bp, Artificial Sequence
  chemically synthesized
tttcgccatgttgcccaggc

SEQ ID NO: 25267 - DNA, 20 bp, Artificial Sequence
  chemically synthesized
caggctggtcttgaactcct

SEQ ID NO: 25268 - DNA, 20 bp, Artificial Sequence
  chemically synthesized
cttgaactcctgagttcacc

SEQ ID NO: 25269 - DNA, 20 bp, Artificial Sequence
  chemically synthesized
ttgaactcctgagttcaccc

SEQ ID NO: 25270 - DNA, 20 bp, Artificial Sequence
  chemically synthesized
gaactcctgagttcacccag

SEQ ID NO: 25271 - DNA, 20 bp, Artificial Sequence
  chemically synthesized
caggagtgattcgcccacct

SEQ ID NO: 25272 - DNA, 20 bp, Artificial Sequence
  chemically synthesized
tcgcccacctcggcctccca

SEQ ID NO: 25273 - DNA, 20 bp, Artificial Sequence
  chemically synthesized
acctcggcctcccaaagtgc

SEQ ID NO: 25274 - DNA, 20 bp, Artificial Sequence
  chemically synthesized
cctcggcctcccaaagtgct

SEQ ID NO: 25275 - DNA, 20 bp, Artificial Sequence
  chemically synthesized
ctcccaaagtgctgggatta

SEQ ID NO: 25276 - DNA, 20 bp, Artificial Sequence
  chemically synthesized
tcccaaagtgctgggattac

SEQ ID NO: 25277 - DNA, 20 bp, Artificial Sequence
  chemically synthesized
agtgctgggattacaggtgt

SEQ ID NO: 25278 - DNA, 20 bp, Artificial Sequence
  chemically synthesized
caggtgtgagccaccatgcc

SEQ ID NO: 25279 - DNA, 20 bp, Artificial Sequence
  chemically synthesized
ctaataaaactctttgctca

SEQ ID NO: 25280 - DNA, 20 bp, Artificial Sequence
  chemically synthesized
tgctcaaagcctatataact

SEQ ID NO: 25281 - DNA, 20 bp, Artificial Sequence
  chemically synthesized
accctttaacccatatgaaa

SEQ ID NO: 25282 - DNA, 20 bp, Artificial Sequence
  chemically synthesized
ccctttaacccatatgaaat

SEQ ID NO: 25283 - DNA, 20 bp, Artificial Sequence
  chemically synthesized
ttcctgtattttcaactcac

SEQ ID NO: 25284 - DNA, 20 bp, Artificial Sequence
  chemically synthesized
ctgtattttcaactcactgg

SEQ ID NO: 25285 - DNA, 20 bp, Artificial Sequence
  chemically synthesized
tgtattttcaactcactggt

SEQ ID NO: 25286 - DNA, 20 bp, Artificial Sequence
  chemically synthesized
ttctgtcttccccctttatg

SEQ ID NO: 25287 - DNA, 20 bp, Artificial Sequence
  chemically synthesized
ccctttatgtagatgatcca

SEQ ID NO: 25288 - DNA, 20 bp, Artificial Sequence
  chemically synthesized
ttatgtagatgatccaaagt

SEQ ID NO: 25289 - DNA, 20 bp, Artificial Sequence
  chemically synthesized
atgtagatgatccaaagtca

SEQ ID NO: 25290 - DNA, 20 bp, Artificial Sequence
  chemically synthesized
gtagatgatccaaagtcaga

SEQ ID NO: 25291 - DNA, 20 bp, Artificial Sequence
  chemically synthesized
agatgatccaaagtcagaga

SEQ ID NO: 25292 - DNA, 20 bp, Artificial Sequence
  chemically synthesized
gatgatccaaagtcagagag

SEQ ID NO: 25293 - DNA, 20 bp, Artificial Sequence
  chemically synthesized
atgatccaaagtcagagaga

SEQ ID NO: 25294 - DNA, 20 bp, Artificial Sequence
  chemically synthesized
tgatccaaagtcagagagag

SEQ ID NO: 25295 - DNA, 20 bp, Artificial Sequence
  chemically synthesized
ccaaagtcagagagaggggt

SEQ ID NO: 25296 - DNA, 20 bp, Artificial Sequence
  chemically synthesized
aagtcagagagaggggttgg

SEQ ID NO: 25297 - DNA, 20 bp, Artificial Sequence
  chemically synthesized
gagagaggggttggaagcat

SEQ ID NO: 25298 - DNA, 20 bp, Artificial Sequence
  chemically synthesized
agaggggttggaagcatgag

SEQ ID NO: 25299 - DNA, 20 bp, Artificial Sequence
  chemically synthesized
ttggaagcatgagtagcccg

SEQ ID NO: 25300 - DNA, 20 bp, Artificial Sequence
  chemically synthesized
gtagcccgtggcttcctgaa

SEQ ID NO: 25301 - DNA, 20 bp, Artificial Sequence
  chemically synthesized
ccgtggcttcctgaatagcc

SEQ ID NO: 25302 - DNA, 20 bp, Artificial Sequence
  chemically synthesized
cgtggcttcctgaatagcct

SEQ ID NO: 25303 - DNA, 20 bp, Artificial Sequence
  chemically synthesized
gtggcttcctgaatagcctg

SEQ ID NO: 25304 - DNA, 20 bp, Artificial Sequence
  chemically synthesized
cttcctgaatagcctgggga

SEQ ID NO: 25305 - DNA, 20 bp, Artificial Sequence
  chemically synthesized
ctggggaaagcaacttctga

SEQ ID NO: 25306 - DNA, 20 bp, Artificial Sequence
  chemically synthesized
ggaaagcaacttctgatgga

SEQ ID NO: 25307 - DNA, 20 bp, Artificial Sequence
  chemically synthesized
ttctgatggacagacattgc

SEQ ID NO: 25308 - DNA, 20 bp, Artificial Sequence
  chemically synthesized
ctgatggacagacattgcga

SEQ ID NO: 25309 - DNA, 20 bp, Artificial Sequence
  chemically synthesized
gacattgcgagagcgaatgc

SEQ ID NO: 25310 - DNA, 20 bp, Artificial Sequence
  chemically synthesized
ttgctgatctcctctctata

SEQ ID NO: 25311 - DNA, 20 bp, Artificial Sequence
  chemically synthesized
tatatggttcttaccactta

SEQ ID NO: 25312 - DNA, 20 bp, Artificial Sequence
  chemically synthesized
ggttcttaccacttaaagac

SEQ ID NO: 25313 - DNA, 20 bp, Artificial Sequence
  chemically synthesized
gttcttaccacttaaagacg

SEQ ID NO: 25314 - DNA, 20 bp, Artificial Sequence
  chemically synthesized
taccacttaaagacgaggtt

SEQ ID NO: 25315 - DNA, 20 bp, Artificial Sequence
  chemically synthesized
acttaaagacgaggttgagc

SEQ ID NO: 25316 - DNA, 20 bp, Artificial Sequence
  chemically synthesized
gttgagccagtctccaatca

SEQ ID NO: 25317 - DNA, 20 bp, Artificial Sequence
  chemically synthesized
tctccaatcacagctaccca

SEQ ID NO: 25318 - DNA, 20 bp, Artificial Sequence
  chemically synthesized
ctccaatcacagctacccaa

SEQ ID NO: 25319 - DNA, 20 bp, Artificial Sequence
  chemically synthesized
ccaatcacagctacccaaag

SEQ ID NO: 25320 - DNA, 20 bp, Artificial Sequence
  chemically synthesized
ccaaaggagtttaatgccca

SEQ ID NO: 25321 - DNA, 20 bp, Artificial Sequence
  chemically synthesized
ttaatgcccacagcttcctg

SEQ ID NO: 25322 - DNA, 20 bp, Artificial Sequence
  chemically synthesized
tgcccacagcttcctgaaga

SEQ ID NO: 25323 - DNA, 20 bp, Artificial Sequence
  chemically synthesized
cagcttcctgaagatggaac

SEQ ID NO: 25324 - DNA, 20 bp, Artificial Sequence
  chemically synthesized
ttcctgaagatggaaccaga

SEQ ID NO: 25325 - DNA, 20 bp, Artificial Sequence
  chemically synthesized
tcctgaagatggaaccagat

SEQ ID NO: 25326 - DNA, 20 bp, Artificial Sequence
  chemically synthesized
cctgaagatggaaccagatg

SEQ ID NO: 25327 - DNA, 20 bp, Artificial Sequence
  chemically synthesized
gaagatggaaccagatgggg

SEQ ID NO: 25328 - DNA, 20 bp, Artificial Sequence
  chemically synthesized
agatggaaccagatggggaa

SEQ ID NO: 25329 - DNA, 20 bp, Artificial Sequence
  chemically synthesized
gatggaaccagatggggaag

SEQ ID NO: 25330 - DNA, 20 bp, Artificial Sequence
  chemically synthesized
accagatggggaagaggacg

SEQ ID NO: 25331 - DNA, 20 bp, Artificial Sequence
  chemically synthesized
agatggggaagaggacgtag

SEQ ID NO: 25332 - DNA, 20 bp, Artificial Sequence
  chemically synthesized
gatggggaagaggacgtaga

SEQ ID NO: 25333 - DNA, 20 bp, Artificial Sequence
  chemically synthesized
aggacgtagaaggcattcct

SEQ ID NO: 25334 - DNA, 20 bp, Artificial Sequence
  chemically synthesized
ggacgtagaaggcattcctg

SEQ ID NO: 25335 - DNA, 20 bp, Artificial Sequence
  chemically synthesized
attcctgaggtctgcgatca

SEQ ID NO: 25336 - DNA, 20 bp, Artificial Sequence
  chemically synthesized
ggtctgcgatcacggacacc

SEQ ID NO: 25337 - DNA, 20 bp, Artificial Sequence
  chemically synthesized
tcacggacaccaagatgaac

SEQ ID NO: 25338 - DNA, 20 bp, Artificial Sequence
  chemically synthesized
acaccaagatgaaccagtcc

SEQ ID NO: 25339 - DNA, 20 bp, Artificial Sequence
  chemically synthesized
caccaagatgaaccagtcct

SEQ ID NO: 25340 - DNA, 20 bp, Artificial Sequence
  chemically synthesized
ccaagatgaaccagtcctgg

SEQ ID NO: 25341 - DNA, 20 bp, Artificial Sequence
  chemically synthesized
tgaaccagtcctgggagtct

SEQ ID NO: 25342 - DNA, 20 bp, Artificial Sequence
  chemically synthesized
gggagtcttggtaattcacc

SEQ ID NO: 25343 - DNA, 20 bp, Artificial Sequence
  chemically synthesized
gagtcttggtaattcacctg

SEQ ID NO: 25344 - DNA, 20 bp, Artificial Sequence
  chemically synthesized
agtcttggtaattcacctgg

SEQ ID NO: 25345 - DNA, 20 bp, Artificial Sequence
  chemically synthesized
cctggaggtaatgtgttgac

SEQ ID NO: 25346 - DNA, 20 bp, Artificial Sequence
  chemically synthesized
aatgtgttgactggatccca

SEQ ID NO: 25347 - DNA, 20 bp, Artificial Sequence
  chemically synthesized
ttgactggatcccaaagtca

SEQ ID NO: 25348 - DNA, 20 bp, Artificial Sequence
  chemically synthesized
gactggatcccaaagtcatg

SEQ ID NO: 25349 - DNA, 20 bp, Artificial Sequence
  chemically synthesized
ttcctccatcctcatttcct

SEQ ID NO: 25350 - DNA, 20 bp, Artificial Sequence
  chemically synthesized
tcctcatttccttggcacct

SEQ ID NO: 25351 - DNA, 20 bp, Artificial Sequence
  chemically synthesized
cctcatttccttggcacctc

SEQ ID NO: 25352 - DNA, 20 bp, Artificial Sequence
  chemically synthesized
catttccttggcacctcagg

SEQ ID NO: 25353 - DNA, 20 bp, Artificial Sequence
  chemically synthesized
ttggcacctcaggaagatgt

SEQ ID NO: 25354 - DNA, 20 bp, Artificial Sequence
  chemically synthesized
gcacctcaggaagatgtcag

SEQ ID NO: 25355 - DNA, 20 bp, Artificial Sequence
  chemically synthesized
acctcaggaagatgtcagca

SEQ ID NO: 25356 - DNA, 20 bp, Artificial Sequence
  chemically synthesized
agatgtcagcagagcccttg

SEQ ID NO: 25357 - DNA, 20 bp, Artificial Sequence
  chemically synthesized
cagagcccttgcagttattc

SEQ ID NO: 25358 - DNA, 20 bp, Artificial Sequence
  chemically synthesized
agagcccttgcagttattcc

SEQ ID NO: 25359 - DNA, 20 bp, Artificial Sequence
  chemically synthesized
ccttgcagttattccaggct

SEQ ID NO: 25360 - DNA, 20 bp, Artificial Sequence
  chemically synthesized
tgcagttattccaggcttgg

SEQ ID NO: 25361 - DNA, 20 bp, Artificial Sequence
  chemically synthesized
ggtggtgattgctctgctat

SEQ ID NO: 25362 - DNA, 20 bp, Artificial Sequence
  chemically synthesized
tgttttatatgccctgtatc

SEQ ID NO: 25363 - DNA, 20 bp, Artificial Sequence
  chemically synthesized
tatgccctgtatccagtatt

SEQ ID NO: 25364 - DNA, 20 bp, Artificial Sequence
  chemically synthesized
atgccctgtatccagtattc

SEQ ID NO: 25365 - DNA, 20 bp, Artificial Sequence
  chemically synthesized
atccagtattcaggtcaacc

SEQ ID NO: 25366 - DNA, 20 bp, Artificial Sequence
  chemically synthesized
gtcaacccagccctgatctt

SEQ ID NO: 25367 - DNA, 20 bp, Artificial Sequence
  chemically synthesized
attttagacaaacgtggttt

SEQ ID NO: 25368 - DNA, 20 bp, Artificial Sequence
  chemically synthesized
tttgagtccaaagatcaggg

SEQ ID NO: 25369 - DNA, 20 bp, Artificial Sequence
  chemically synthesized
aagatcagggctgggttgac

SEQ ID NO: 25370 - DNA, 20 bp, Artificial Sequence
  chemically synthesized
gggctgggttgacctgaata

SEQ ID NO: 25371 - DNA, 20 bp, Artificial Sequence
  chemically synthesized
agagcaatcaccaccaagcc

SEQ ID NO: 25372 - DNA, 20 bp, Artificial Sequence
  chemically synthesized
tcctgaggtgccaaggaaat

SEQ ID NO: 25373 - DNA, 20 bp, Artificial Sequence
  chemically synthesized
aaggaaatgaggatggagga

SEQ ID NO: 25374 - DNA, 20 bp, Artificial Sequence
  chemically synthesized
aaatgaggatggaggaagga

SEQ ID NO: 25375 - DNA, 20 bp, Artificial Sequence
  chemically synthesized
atgaatgttctccatgactt

SEQ ID NO: 25376 - DNA, 20 bp, Artificial Sequence
  chemically synthesized
agtcaacacattacctccag

SEQ ID NO: 25377 - DNA, 20 bp, Artificial Sequence
  chemically synthesized
tgtccgtgatcgcagacctc

SEQ ID NO: 25378 - DNA, 20 bp, Artificial Sequence
  chemically synthesized
gctgtgggcattaaactcct

SEQ ID NO: 25379 - DNA, 20 bp, Artificial Sequence
  chemically synthesized
tccaacccctctctctgact

SEQ ID NO: 25380 - DNA, 20 bp, Artificial Sequence
  chemically synthesized
agacagaaaaaatcctacca

SEQ ID NO: 25381 - DNA, 20 bp, Artificial Sequence
  chemically synthesized
tacaggaaagcctatttcat

SEQ ID NO: 25382 - DNA, 20 bp, Artificial Sequence
  chemically synthesized
agcctatttcatatgggtta

SEQ ID NO: 25383 - DNA, 20 bp, Artificial Sequence
  chemically synthesized
tgggttaaagggtaggacag

SEQ ID NO: 25384 - DNA, 20 bp, Artificial Sequence
  chemically synthesized
agttgaatttcgtgaaaagt

SEQ ID NO: 25385 - DNA, 20 bp, Artificial Sequence
  chemically synthesized
agttatataggctttgagca

SEQ ID NO: 25386 - DNA, 20 bp, Artificial Sequence
  chemically synthesized
actttgggaggccgaggtgg

SEQ ID NO: 25387 - DNA, 20 bp, Artificial Sequence
  chemically synthesized
ccgaggtgggcgaatcactc

SEQ ID NO: 25388 - DNA, 20 bp, Artificial Sequence
  chemically synthesized
aatcactcctgggtgaactc

SEQ ID NO: 25389 - DNA, 20 bp, Artificial Sequence
  chemically synthesized
gagaggcggaggaggttgca

SEQ ID NO: 25390 - DNA, 20 bp, Artificial Sequence
  chemically synthesized
ctgcactccagcctgggcaa

SEQ ID NO: 25391 - DNA, 20 bp, Artificial Sequence
  chemically synthesized
tgattcaacagcctgttttg

SEQ ID NO: 25392 - DNA, 20 bp, Artificial Sequence
  chemically synthesized
tggcaagtcatatcaattat

SEQ ID NO: 25393 - DNA, 20 bp, Artificial Sequence
  chemically synthesized
tctggcagcttaataataat

SEQ ID NO: 25394 - DNA, 20 bp, Artificial Sequence
  chemically synthesized
tagatgcagagaccaaggtg

SEQ ID NO: 25395 - DNA, 20 bp, Artificial Sequence
  chemically synthesized
aaggttagtacatgccgagc

SEQ ID NO: 25396 - DNA, 20 bp, Artificial Sequence
  chemically synthesized
ctggggagcaggggaaagcc

SEQ ID NO: 25397 - DNA, 20 bp, Artificial Sequence
  chemically synthesized
ttttgtttgtttgtttgaga

SEQ ID NO: 25398 - DNA, 20 bp, Artificial Sequence
  chemically synthesized
gtctcgcactgttgcctggc

SEQ ID NO: 25399 - DNA, 20 bp, Artificial Sequence
  chemically synthesized
gcctcagcctcccaagtagc

SEQ ID NO: 25400 - DNA, 20 bp, Artificial Sequence
  chemically synthesized
gccttggcctccctaagtgc

SEQ ID NO: 25401 - DNA, 20 bp, Artificial Sequence
  chemically synthesized
tgaagaaccatgcaatctct

SEQ ID NO: 25402 - DNA, 20 bp, Artificial Sequence
  chemically synthesized
ctctctgggttgatagaggc

SEQ ID NO: 25403 - DNA, 20 bp, Artificial Sequence
  chemically synthesized
aaatcactattccaccatca

SEQ ID NO: 25404 - DNA, 20 bp, Artificial Sequence
  chemically synthesized
atactctgtttcaaagtaga

SEQ ID NO: 25405 - DNA, 20 bp, Artificial Sequence
  chemically synthesized
ggggggctcgtcctaggggc

SEQ ID NO: 25406 - DNA, 20 bp, Artificial Sequence
  chemically synthesized
agtcacatagctgccatttt

SEQ ID NO: 25407 - DNA, 20 bp, Artificial Sequence
  chemically synthesized
agctgccattttatggattt

SEQ ID NO: 25408 - DNA, 20 bp, Artificial Sequence
  chemically synthesized
ttttttttttttttttgaga

SEQ ID NO: 25409 - DNA, 20 bp, Artificial Sequence
  chemically synthesized
gattctcttgccttagcctc

SEQ ID NO: 25410 - DNA, 20 bp, Artificial Sequence
  chemically synthesized
gccttagcctcccgagtagc

SEQ ID NO: 25411 - DNA, 20 bp, Artificial Sequence
  chemically synthesized
tgtgagccaccgcgcctgcc

SEQ ID NO: 25412 - DNA, 20 bp, Artificial Sequence
  chemically synthesized
caccgcgcctgcctggagtt

SEQ ID NO: 25413 - DNA, 20 bp, Artificial Sequence
  chemically synthesized
actttgggaggctgaggtgg

SEQ ID NO: 25414 - DNA, 20 bp, Artificial Sequence
  chemically synthesized
ggctgaggtgggaggattgc

SEQ ID NO: 25415 - DNA, 20 bp, Artificial Sequence
  chemically synthesized
actaaaaatacaaaaactag

SEQ ID NO: 25416 - DNA, 20 bp, Artificial Sequence
  chemically synthesized
tattcaggaggctgaggtgg

SEQ ID NO: 25417 - DNA, 20 bp, Artificial Sequence
  chemically synthesized
ttgcgccactgcactccagg

SEQ ID NO: 25418 - DNA, 20 bp, Artificial Sequence
  chemically synthesized
aaacttgttctgtttttcca

SEQ ID NO: 25419 - DNA, 20 bp, Artificial Sequence
  chemically synthesized
tttggacagcgtccatactg

SEQ ID NO: 25420 - DNA, 20 bp, Artificial Sequence
  chemically synthesized
agcgtccatactggtgggtt

SEQ ID NO: 25421 - DNA, 20 bp, Artificial Sequence
  chemically synthesized
ccagcccctgcagacagaag

SEQ ID NO: 25422 - DNA, 20 bp, Artificial Sequence
  chemically synthesized
gtggacctcgtttacctgtt

SEQ ID NO: 25423 - DNA, 20 bp, Artificial Sequence
  chemically synthesized
ttcacttctgcaatactttc

SEQ ID NO: 25424 - DNA, 20 bp, Artificial Sequence
  chemically synthesized
aaatctgcctattacagaac

SEQ ID NO: 25425 - DNA, 20 bp, Artificial Sequence
  chemically synthesized
tgcctattacagaacctgga

SEQ ID NO: 25426 - DNA, 20 bp, Artificial Sequence
  chemically synthesized
tccatgggcaaagggctcgt

SEQ ID NO: 25427 - DNA, 20 bp, Artificial Sequence
  chemically synthesized
ctctcacgagccctttgccc

SEQ ID NO: 25428 - DNA, 20 bp, Artificial Sequence
  chemically synthesized
ttcaggaaagtattgcagaa

SEQ ID NO: 25429 - DNA, 20 bp, Artificial Sequence
  chemically synthesized
agagcatgacaaaagtacaa

SEQ ID NO: 25430 - DNA, 20 bp, Artificial Sequence
  chemically synthesized
cagtatggacgctgtccaaa

SEQ ID NO: 25431 - DNA, 20 bp, Artificial Sequence
  chemically synthesized
ggaaaaacagaacaagtttc

SEQ ID NO: 25432 - DNA, 20 bp, Artificial Sequence
  chemically synthesized
agaacaagtttctggggtta

SEQ ID NO: 25433 - DNA, 20 bp, Artificial Sequence
  chemically synthesized
caagtttctggggttactga

SEQ ID NO: 25434 - DNA, 20 bp, Artificial Sequence
  chemically synthesized
ccaaagcctacaccttcaag

SEQ ID NO: 25435 - DNA, 20 bp, Artificial Sequence
  chemically synthesized
caagaagagtgtagcctgag

SEQ ID NO: 25436 - DNA, 20 bp, Artificial Sequence
  chemically synthesized
gttgcctctagaagggagaa

SEQ ID NO: 25437 - DNA, 20 bp, Artificial Sequence
  chemically synthesized
acttttgcattttgaactgt

SEQ ID NO: 25438 - DNA, 20 bp, Artificial Sequence
  chemically synthesized
tatcttttttttttttgaga

SEQ ID NO: 25439 - DNA, 20 bp, Artificial Sequence
  chemically synthesized
tctggctcagtaacccagcc

SEQ ID NO: 25440 - DNA, 20 bp, Artificial Sequence
  chemically synthesized
tcattgtgacctctacctcc

SEQ ID NO: 25441 - DNA, 20 bp, Artificial Sequence
  chemically synthesized
gatcctcccacctcagcctc

SEQ ID NO: 25442 - DNA, 20 bp, Artificial Sequence
  chemically synthesized
ttttgtatttttagtagaga

SEQ ID NO: 25443 - DNA, 20 bp, Artificial Sequence
  chemically synthesized
acctcagcctcccaaagtgc

SEQ ID NO: 25444 - DNA, 20 bp, Artificial Sequence
  chemically synthesized
caggcagatcacatgaggtc

SEQ ID NO: 25445 - DNA, 20 bp, Artificial Sequence
  chemically synthesized
cgtttctaccaaaaaatata

SEQ ID NO: 25446 - DNA, 20 bp, Artificial Sequence
  chemically synthesized
tactcgggaggctaaggcaa

SEQ ID NO: 25447 - DNA, 20 bp, Artificial Sequence
  chemically synthesized
ttatgccactgcactacagg

SEQ ID NO: 25448 - DNA, 20 bp, Artificial Sequence
  chemically synthesized
tcaagaagtatttgtcctgg

SEQ ID NO: 25449 - DNA, 20 bp, Artificial Sequence
  chemically synthesized
aacttggacttgcatatacc

SEQ ID NO: 25450 - DNA, 20 bp, Artificial Sequence
  chemically synthesized
atgggttccctcaggcctca

SEQ ID NO: 25451 - DNA, 20 bp, Artificial Sequence
  chemically synthesized
ttgcatttcctctgacatca

SEQ ID NO: 25452 - DNA, 20 bp, Artificial Sequence
  chemically synthesized
aacatggcctgcatttccat

SEQ ID NO: 25453 - DNA, 20 bp, Artificial Sequence
  chemically synthesized
ccatcagaattgctctctgt

SEQ ID NO: 25454 - DNA, 20 bp, Artificial Sequence
  chemically synthesized
gtatcctctctactttgaaa

SEQ ID NO: 25455 - DNA, 20 bp, Artificial Sequence
  chemically synthesized
aataggtgtcaaccgccagt

SEQ ID NO: 25456 - DNA, 20 bp, Artificial Sequence
  chemically synthesized
tgccttttatcccgtgatgg

SEQ ID NO: 25457 - DNA, 20 bp, Artificial Sequence
  chemically synthesized
ttcaatggagatcagatgtt

SEQ ID NO: 25458 - DNA, 20 bp, Artificial Sequence
  chemically synthesized
cacttcatctttttattttt

SEQ ID NO: 25459 - DNA, 20 bp, Artificial Sequence
  chemically synthesized
tattttttagaatcatgcgg

SEQ ID NO: 25460 - DNA, 20 bp, Artificial Sequence
  chemically synthesized
ggcaggcagatcatgaggtc

SEQ ID NO: 25461 - DNA, 20 bp, Artificial Sequence
  chemically synthesized
tacttgggaggctgaggcag

SEQ ID NO: 25462 - DNA, 20 bp, Artificial Sequence
  chemically synthesized
aaagaaagaaagaaagtggc

SEQ ID NO: 25463 - DNA, 20 bp, Artificial Sequence
  chemically synthesized
agaaagaaagtggccagaat

SEQ ID NO: 25464 - DNA, 20 bp, Artificial Sequence
  chemically synthesized
gggctttcccctgctcccca

SEQ ID NO: 25465 - DNA, 20 bp, Artificial Sequence
  chemically synthesized
ttgccaaggacatgtagttg

SEQ ID NO: 25466 - DNA, 20 bp, Artificial Sequence
  chemically synthesized
gagggctggagcccagttcc

SEQ ID NO: 25467 - DNA, 20 bp, Artificial Sequence
  chemically synthesized
ttaccccacaaaacaggctg

SEQ ID NO: 25468 - DNA, 20 bp, Artificial Sequence
  chemically synthesized
tcttttttttttttttgaga

SEQ ID NO: 25469 - DNA, 20 bp, Artificial Sequence
  chemically synthesized
tcttactctgttgcccaggc

SEQ ID NO: 25470 - DNA, 20 bp, Artificial Sequence
  chemically synthesized
ccgcctctcacctcagcctc

SEQ ID NO: 25471 - DNA, 20 bp, Artificial Sequence
  chemically synthesized
tcgtaatgtttttgtagaga

SEQ ID NO: 25472 - DNA, 20 bp, Artificial Sequence
  chemically synthesized
cccaggctggtcttgaactc

SEQ ID NO: 25473 - DNA, 20 bp, Artificial Sequence
  chemically synthesized
ttgaactcctgagttcaccc

SEQ ID NO: 25474 - DNA, 20 bp, Artificial Sequence
  chemically synthesized
acctcggcctcccaaagtgc

SEQ ID NO: 25475 - DNA, 20 bp, Artificial Sequence
  chemically synthesized
ctgtattttcaactcactgg

SEQ ID NO: 25476 - DNA, 20 bp, Artificial Sequence
  chemically synthesized
gatgatccaaagtcagagag

SEQ ID NO: 25477 - DNA, 20 bp, Artificial Sequence
  chemically synthesized
cagagagaggggttggaagc

SEQ ID NO: 25478 - DNA, 20 bp, Artificial Sequence
  chemically synthesized
catgagtagcccgtggcttc

SEQ ID NO: 25479 - DNA, 20 bp, Artificial Sequence
  chemically synthesized
gatggacagacattgcgaga

SEQ ID NO: 25480 - DNA, 20 bp, Artificial Sequence
  chemically synthesized
ctccaatcacagctacccaa

SEQ ID NO: 25481 - DNA, 20 bp, Artificial Sequence
  chemically synthesized
caccaagatgaaccagtcct

SEQ ID NO: 25482 - DNA, 20 bp, Artificial Sequence
  chemically synthesized
acctggaggtaatgtgttga

SEQ ID NO: 25483 - DNA, 20 bp, Artificial Sequence
  chemically synthesized
ttggtggtgattgctctgct

SEQ ID NO: 25484 - DNA, 20 bp, Artificial Sequence
  chemically synthesized
ccatatagagaggagatcag

SEQ ID NO: 25485 - DNA, 20 bp, Artificial Sequence
  chemically synthesized
catctacataaagggggaag

SEQ ID NO: 25486 - DNA, 20 bp, Artificial Sequence
  chemically synthesized
tgaagcagaagaggtaacat

SEQ ID NO: 25487 - DNA, 20 bp, Artificial Sequence
  chemically synthesized
tgaggtagttactgctattt

SEQ ID NO: 25488 - DNA, 20 bp, Artificial Sequence
  chemically synthesized
gtggctctccctgatttcgg

SEQ ID NO: 25489 - DNA, 20 bp, Artificial Sequence
  chemically synthesized
ctaattctttatattttttg

SEQ ID NO: 25490 - DNA, 20 bp, Artificial Sequence
  chemically synthesized
ccaccgcgcctgcctggagt

SEQ ID NO: 25491 - DNA, 20 bp, Artificial Sequence
  chemically synthesized
aaagcattcattcagtaacc

SEQ ID NO: 25492 - DNA, 20 bp, Artificial Sequence
  chemically synthesized
ccagtatggacgctgtccaa

SEQ ID NO: 25493 - DNA, 20 bp, Artificial Sequence
  chemically synthesized
ccgtttctaccaaaaaatat

SEQ ID NO: 25494 - DNA, 20 bp, Artificial Sequence
  chemically synthesized
ctactcgggaggctaaggca

SEQ ID NO: 25495 - DNA, 20 bp, Artificial Sequence
  chemically synthesized
ctcaagaagtatttgtcctg

SEQ ID NO: 25496 - DNA, 20 bp, Artificial Sequence
  chemically synthesized
cttgcatttcctctgacatc

SEQ ID NO: 25497 - DNA, 20 bp, Artificial Sequence
  chemically synthesized
aaacatggcctgcatttcca

SEQ ID NO: 25498 - DNA, 20 bp, Artificial Sequence
  chemically synthesized
acacttcatctttttatttt

SEQ ID NO: 25499 - DNA, 20 bp, Artificial Sequence
  chemically synthesized
ctacttgggaggctgaggca

SEQ ID NO: 25500 - DNA, 20 bp, Artificial Sequence
  chemically synthesized
ccatctcaaacaaacaaaca

SEQ ID NO: 25501 - DNA, 20 bp, Artificial Sequence
  chemically synthesized
ctcaaacaaacaaacaaaag

SEQ ID NO: 25502 - DNA, 20 bp, Artificial Sequence
  chemically synthesized
aacaaacaaacaaaagaaag

SEQ ID NO: 25503 - DNA, 20 bp, Artificial Sequence
  chemically synthesized
aacaaacaaaagaaagaaag

SEQ ID NO: 25504 - DNA, 20 bp, Artificial Sequence
  chemically synthesized
gaaagaaagaaagaaagtgg

SEQ ID NO: 25505 - DNA, 20 bp, Artificial Sequence
  chemically synthesized
agaatgggaatgtttacgtg

SEQ ID NO: 25506 - DNA, 20 bp, Artificial Sequence
  chemically synthesized
taaatagcagtaactacctc

SEQ ID NO: 25507 - DNA, 20 bp, Artificial Sequence
  chemically synthesized
acctatttgtagattataaa

SEQ ID NO: 25508 - DNA, 20 bp, Artificial Sequence
  chemically synthesized
aatactggatacagggcata

SEQ ID NO: 25509 - DNA, 20 bp, Artificial Sequence
  chemically synthesized
tggcgaaactccatctctac

SEQ ID NO: 25510 - DNA, 20 bp, Artificial Sequence
  chemically synthesized
cccgtctctactaaaaatac

SEQ ID NO: 25511 - DNA, 20 bp, Artificial Sequence
  chemically synthesized
ttgctgtagtagtcagtatc

SEQ ID NO: 25512 - DNA, 20 bp, Artificial Sequence
  chemically synthesized
gtccaaagagaatcctatgg

SEQ ID NO: 25513 - DNA, 20 bp, Artificial Sequence
  chemically synthesized
gataacctatttgtagatta

SEQ ID NO: 25514 - DNA, 20 bp, Artificial Sequence
  chemically synthesized
ggtgacttttcattacccca

SEQ ID NO: 25515 - DNA, 20 bp, Artificial Sequence
  chemically synthesized
cctcttctgcttcatactaa

SEQ ID NO: 25516 - DNA, 20 bp, Artificial Sequence
  chemically synthesized
cagccctgatctttggactc

SEQ ID NO: 25517 - DNA, 20 bp, Artificial Sequence
  chemically synthesized
cattaaactcctttgggtag

SEQ ID NO: 25518 - DNA, 20 bp, Artificial Sequence
  chemically synthesized
cgcaatgtctgtccatcaga

SEQ ID NO: 25519 - DNA, 20 bp, Artificial Sequence
  chemically synthesized
ttcaggaagccacgggctac

SEQ ID NO: 25520 - DNA, 20 bp, Artificial Sequence
  chemically synthesized
tcgtgaaaagtctgagttat

SEQ ID NO: 25521 - DNA, 20 bp, Artificial Sequence
  chemically synthesized
agttatataggctttgagca

SEQ ID NO: 25522 - DNA, 20 bp, Artificial Sequence
  chemically synthesized
tatgaaaaaaggaaacacac

SEQ ID NO: 25523 - DNA, 20 bp, Artificial Sequence
  chemically synthesized
aacacacagatgattcaaca

SEQ ID NO: 25524 - DNA, 20 bp, Artificial Sequence
  chemically synthesized
tggcaagtcatatcaattat

SEQ ID NO: 25525 - DNA, 20 bp, Artificial Sequence
  chemically synthesized
gtcatatcaattatctgagt

SEQ ID NO: 25526 - DNA, 20 bp, Artificial Sequence
  chemically synthesized
tctacaaataggttatctct

SEQ ID NO: 25527 - DNA, 20 bp, Artificial Sequence
  chemically synthesized
tgtgtgccagtccatgtgct

SEQ ID NO: 25528 - DNA, 20 bp, Artificial Sequence
  chemically synthesized
agagaccaaggtgctgagtt

SEQ ID NO: 25529 - DNA, 20 bp, Artificial Sequence
  chemically synthesized
atggaagcccaggtaggcag

SEQ ID NO: 25530 - DNA, 20 bp, Artificial Sequence
  chemically synthesized
ctggggagcaggggaaagcc

SEQ ID NO: 25531 - DNA, 20 bp, Artificial Sequence
  chemically synthesized
ccactttctttctttctttc

SEQ ID NO: 25532 - DNA, 20 bp, Artificial Sequence
  chemically synthesized
tttctttctttctttctttt

SEQ ID NO: 25533 - DNA, 20 bp, Artificial Sequence
  chemically synthesized
tttctttctttcttttgttt

SEQ ID NO: 25534 - DNA, 20 bp, Artificial Sequence
  chemically synthesized
aacctctgcctctccggttc

SEQ ID NO: 25535 - DNA, 20 bp, Artificial Sequence
  chemically synthesized
tgcctcagcctcccaagtag

SEQ ID NO: 25536 - DNA, 20 bp, Artificial Sequence
  chemically synthesized
ttttgtatttttagtagaga

SEQ ID NO: 25537 - DNA, 20 bp, Artificial Sequence
  chemically synthesized
tgccttggcctccctaagtg

SEQ ID NO: 25538 - DNA, 20 bp, Artificial Sequence
  chemically synthesized
gtgagccactacacccagcc

SEQ ID NO: 25539 - DNA, 20 bp, Artificial Sequence
  chemically synthesized
aggccagagttagtggctct

SEQ ID NO: 25540 - DNA, 20 bp, Artificial Sequence
  chemically synthesized
tctagtacttttaaagggga

SEQ ID NO: 25541 - DNA, 20 bp, Artificial Sequence
  chemically synthesized
gaagtggtttgtctgagata

SEQ ID NO: 25542 - DNA, 20 bp, Artificial Sequence
  chemically synthesized
aattctgatggaaatgcagg

SEQ ID NO: 25543 - DNA, 20 bp, Artificial Sequence
  chemically synthesized
tctctgatgtcagaggaaat

SEQ ID NO: 25544 - DNA, 20 bp, Artificial Sequence
  chemically synthesized
aacccatggtatatgcaagt

SEQ ID NO: 25545 - DNA, 20 bp, Artificial Sequence
  chemically synthesized
aagtcacatagctgccattt

SEQ ID NO: 25546 - DNA, 20 bp, Artificial Sequence
  chemically synthesized
tagctgccattttatggatt

SEQ ID NO: 25547 - DNA, 20 bp, Artificial Sequence
  chemically synthesized
aacctccgcctcccaggttc

SEQ ID NO: 25548 - DNA, 20 bp, Artificial Sequence
  chemically synthesized
tgccttagcctcccgagtag

SEQ ID NO: 25549 - DNA, 20 bp, Artificial Sequence
  chemically synthesized
tttatattttttggtagaaa

SEQ ID NO: 25550 - DNA, 20 bp, Artificial Sequence
  chemically synthesized
tgccttggcctcccaaagtg

SEQ ID NO: 25551 - DNA, 20 bp, Artificial Sequence
  chemically synthesized
cctgcctggagttcagaatc

SEQ ID NO: 25552 - DNA, 20 bp, Artificial Sequence
  chemically synthesized
agaatcttgggcttcattat

SEQ ID NO: 25553 - DNA, 20 bp, Artificial Sequence
  chemically synthesized
cactttgggaggctgaggtg

SEQ ID NO: 25554 - DNA, 20 bp, Artificial Sequence
  chemically synthesized
gaggtagaggtcacaatgag

SEQ ID NO: 25555 - DNA, 20 bp, Artificial Sequence
  chemically synthesized
gctacactcttcttgaaggt

SEQ ID NO: 25556 - DNA, 20 bp, Artificial Sequence
  chemically synthesized
tcagtaaccccagaaacttg

SEQ ID NO: 25557 - DNA, 20 bp, Artificial Sequence
  chemically synthesized
gaaacttgttctgtttttcc

SEQ ID NO: 25558 - DNA, 20 bp, Artificial Sequence
  chemically synthesized
tttggacagcgtccatactg

SEQ ID NO: 25559 - DNA, 20 bp, Artificial Sequence
  chemically synthesized
gcagacagaagctgagtgga

SEQ ID NO: 25560 - DNA, 20 bp, Artificial Sequence
  chemically synthesized
tccatccaggttctgtaata

SEQ ID NO: 25561 - DNA, 20 bp, Artificial Sequence
  chemically synthesized
tctcctcatgtcccctcaag

SEQ ID NO: 25562 - DNA, 20 bp, Artificial Sequence
  chemically synthesized
taacaggtaaacgaggtcca

SEQ ID NO: 25563 - DNA, 20 bp, Artificial Sequence
  chemically synthesized
gcttctgtctgcaggggctg

SEQ ID NO: 25564 - DNA, 20 bp, Artificial Sequence
  chemically synthesized
cagtctcacaggttacaggg

SEQ ID NO: 25565 - DNA, 20 bp, Artificial Sequence
  chemically synthesized
gaatcctatggaaaaacaga

SEQ ID NO: 25566 - DNA, 20 bp, Artificial Sequence
  chemically synthesized
agtttctggggttactgaat

SEQ ID NO: 25567 - DNA, 20 bp, Artificial Sequence
  chemically synthesized
tcaagaagagtgtagcctga

SEQ ID NO: 25568 - DNA, 20 bp, Artificial Sequence
  chemically synthesized
tatgtaacttttgcattttg

SEQ ID NO: 25569 - DNA, 20 bp, Artificial Sequence
  chemically synthesized
ggtgtgtgccaccacatcca

SEQ ID NO: 25570 - DNA, 20 bp, Artificial Sequence
  chemically synthesized
ttttgtatttttagtagaga

SEQ ID NO: 25571 - DNA, 20 bp, Artificial Sequence
  chemically synthesized
cacctcagcctcccaaagtg

SEQ ID NO: 25572 - DNA, 20 bp, Artificial Sequence
  chemically synthesized
ttaaacacaaataatgaagc

SEQ ID NO: 25573 - DNA, 20 bp, Artificial Sequence
  chemically synthesized
caggcagatcacatgaggtc

SEQ ID NO: 25574 - DNA, 20 bp, Artificial Sequence
  chemically synthesized
gcctggccaacatggtgaaa

SEQ ID NO: 25575 - DNA, 20 bp, Artificial Sequence
  chemically synthesized
tcgggaggctaaggcaagag

SEQ ID NO: 25576 - DNA, 20 bp, Artificial Sequence
  chemically synthesized
gaggcggaggttgccgtgag

SEQ ID NO: 25577 - DNA, 20 bp, Artificial Sequence
  chemically synthesized
tggaagaatgcatatggaac

SEQ ID NO: 25578 - DNA, 20 bp, Artificial Sequence
  chemically synthesized
ttgctctctgtaaggatgta

SEQ ID NO: 25579 - DNA, 20 bp, Artificial Sequence
  chemically synthesized
gtaaggatgtatatagcttc

SEQ ID NO: 25580 - DNA, 20 bp, Artificial Sequence
  chemically synthesized
tttatcccgtgatggtggaa

SEQ ID NO: 25581 - DNA, 20 bp, Artificial Sequence
  chemically synthesized
ctctggcctctatcaaccca

SEQ ID NO: 25582 - DNA, 20 bp, Artificial Sequence
  chemically synthesized
atggttcttcaatggagatc

SEQ ID NO: 25583 - DNA, 20 bp, Artificial Sequence
  chemically synthesized
gaggcagaggttgcagtgag

SEQ ID NO: 25584 - DNA, 20 bp, Artificial Sequence
  chemically synthesized
aaagaaagtggccagaatgg

SEQ ID NO: 25585 - DNA, 20 bp, Artificial Sequence
  chemically synthesized
aaattggcaaatgctaaact

SEQ ID NO: 25586 - DNA, 20 bp, Artificial Sequence
  chemically synthesized
tttcccctgctccccagaga

SEQ ID NO: 25587 - DNA, 20 bp, Artificial Sequence
  chemically synthesized
gcggaagccagcctgcctac

SEQ ID NO: 25588 - DNA, 20 bp, Artificial Sequence
  chemically synthesized
agcaccttggtctctgcatc

SEQ ID NO: 25589 - DNA, 20 bp, Artificial Sequence
  chemically synthesized
atagcacatggactggcaca

SEQ ID NO: 25590 - DNA, 20 bp, Artificial Sequence
  chemically synthesized
cactgtttaataaatgttaa

SEQ ID NO: 25591 - DNA, 20 bp, Artificial Sequence
  chemically synthesized
gctgccagagataacctatt

SEQ ID NO: 25592 - DNA, 20 bp, Artificial Sequence
  chemically synthesized
aacaggctgttgaatcatct

SEQ ID NO: 25593 - DNA, 20 bp, Artificial Sequence
  chemically synthesized
acacgcccagctaattttcg

SEQ ID NO: 25594 - DNA, 20 bp, Artificial Sequence
  chemically synthesized
tcgtaatgtttttgtagaga

SEQ ID NO: 25595 - DNA, 20 bp, Artificial Sequence
  chemically synthesized
gaactcctgagttcacccag

SEQ ID NO: 25596 - DNA, 20 bp, Artificial Sequence
  chemically synthesized
cacctcggcctcccaaagtg

SEQ ID NO: 25597 - DNA, 20 bp, Artificial Sequence
  chemically synthesized
atctttctttatgttacctc

SEQ ID NO: 25598 - DNA, 20 bp, Artificial Sequence
  chemically synthesized
taccctttaacccatatgaa

SEQ ID NO: 25599 - DNA, 20 bp, Artificial Sequence
  chemically synthesized
cctgtattttcaactcactg

SEQ ID NO: 25600 - DNA, 20 bp, Artificial Sequence
  chemically synthesized
ggttggaagcatgagtagcc

SEQ ID NO: 25601 - DNA, 20 bp, Artificial Sequence
  chemically synthesized
ctccaatcacagctacccaa

SEQ ID NO: 25602 - DNA, 20 bp, Artificial Sequence
  chemically synthesized
acccaaaggagtttaatgcc

SEQ ID NO: 25603 - DNA, 20 bp, Artificial Sequence
  chemically synthesized
gcagagcccttgcagttatt

SEQ ID NO: 25604 - DNA, 20 bp, Artificial Sequence
  chemically synthesized
tgcagttattccaggcttgg

SEQ ID NO: 25605 - DNA, 20 bp, Artificial Sequence
  chemically synthesized
gctatgagtctgtgccttgc

SEQ ID NO: 25606 - DNA, 20 bp, Artificial Sequence
  chemically synthesized
ctgatctttggactcaaaaa

SEQ ID NO: 25607 - DNA, 22 bp, Artificial Sequence
  chemically synthesized
tagacaaacgtggtttttgagt

SEQ ID NO: 25608 - DNA, 22 bp, Artificial Sequence
  chemically synthesized
agacaaacgtggtttttgagtc

SEQ ID NO: 25609 - DNA, 22 bp, Artificial Sequence
  chemically synthesized
gacaaacgtggtttttgagtcc

SEQ ID NO: 25610 - DNA, 22 bp, Artificial Sequence
  chemically synthesized
ttgagtccaaagatcagggctg

SEQ ID NO: 25611 - DNA, 22 bp, Artificial Sequence
  chemically synthesized
tgagtccaaagatcagggctgg

SEQ ID NO: 25612 - DNA, 22 bp, Artificial Sequence
  chemically synthesized
gagtccaaagatcagggctggg

SEQ ID NO: 25613 - DNA, 22 bp, Artificial Sequence
  chemically synthesized
agtccaaagatcagggctgggt

SEQ ID NO: 25614 - DNA, 22 bp, Artificial Sequence
  chemically synthesized
ggttgacctgaatactggatac

SEQ ID NO: 25615 - DNA, 22 bp, Artificial Sequence
  chemically synthesized
acctgaatactggatacagggc

SEQ ID NO: 25616 - DNA, 22 bp, Artificial Sequence
  chemically synthesized
aatactggatacagggcatata

SEQ ID NO: 25617 - DNA, 22 bp, Artificial Sequence
  chemically synthesized
gatacagggcatataaaacagg

SEQ ID NO: 25618 - DNA, 22 bp, Artificial Sequence
  chemically synthesized
atagcagagcaatcaccaccaa

SEQ ID NO: 25619 - DNA, 22 bp, Artificial Sequence
  chemically synthesized
gaataactgcaagggctctgct

SEQ ID NO: 25620 - DNA, 22 bp, Artificial Sequence
  chemically synthesized
caagggctctgctgacatcttc

SEQ ID NO: 25621 - DNA, 22 bp, Artificial Sequence
  chemically synthesized
tgctgacatcttcctgaggtgc

SEQ ID NO: 25622 - DNA, 22 bp, Artificial Sequence
  chemically synthesized
ctgacatcttcctgaggtgcca

SEQ ID NO: 25623 - DNA, 22 bp, Artificial Sequence
  chemically synthesized
acatcttcctgaggtgccaagg

SEQ ID NO: 25624 - DNA, 22 bp, Artificial Sequence
  chemically synthesized
cctgaggtgccaaggaaatgag

SEQ ID NO: 25625 - DNA, 22 bp, Artificial Sequence
  chemically synthesized
ctgaggtgccaaggaaatgagg

SEQ ID NO: 25626 - DNA, 22 bp, Artificial Sequence
  chemically synthesized
aggtgccaaggaaatgaggatg

SEQ ID NO: 25627 - DNA, 22 bp, Artificial Sequence
  chemically synthesized
tccatgactttgggatccagtc

SEQ ID NO: 25628 - DNA, 22 bp, Artificial Sequence
  chemically synthesized
catgactttgggatccagtcaa

SEQ ID NO: 25629 - DNA, 22 bp, Artificial Sequence
  chemically synthesized
tgggatccagtcaacacattac

SEQ ID NO: 25630 - DNA, 22 bp, Artificial Sequence
  chemically synthesized
gggatccagtcaacacattacc

SEQ ID NO: 25631 - DNA, 22 bp, Artificial Sequence
  chemically synthesized
ggatccagtcaacacattacct

SEQ ID NO: 25632 - DNA, 22 bp, Artificial Sequence
  chemically synthesized
cctccaggtgaattaccaagac

SEQ ID NO: 25633 - DNA, 22 bp, Artificial Sequence
  chemically synthesized
caggtgaattaccaagactccc

SEQ ID NO: 25634 - DNA, 22 bp, Artificial Sequence
  chemically synthesized
ccaagactcccaggactggttc

SEQ ID NO: 25635 - DNA, 22 bp, Artificial Sequence
  chemically synthesized
ccaggactggttcatcttggtg

SEQ ID NO: 25636 - DNA, 22 bp, Artificial Sequence
  chemically synthesized
gttcatcttggtgtccgtgatc

SEQ ID NO: 25637 - DNA, 22 bp, Artificial Sequence
  chemically synthesized
atcttggtgtccgtgatcgcag

SEQ ID NO: 25638 - DNA, 22 bp, Artificial Sequence
  chemically synthesized
ggtgtccgtgatcgcagacctc

SEQ ID NO: 25639 - DNA, 22 bp, Artificial Sequence
  chemically synthesized
gtgtccgtgatcgcagacctca

SEQ ID NO: 25640 - DNA, 22 bp, Artificial Sequence
  chemically synthesized
aggaatgccttctacgtcctct

SEQ ID NO: 25641 - DNA, 22 bp, Artificial Sequence
  chemically synthesized
ctacgtcctcttccccatctgg

SEQ ID NO: 25642 - DNA, 22 bp, Artificial Sequence
  chemically synthesized
tacgtcctcttccccatctggt

SEQ ID NO: 25643 - DNA, 22 bp, Artificial Sequence
  chemically synthesized
cgtcctcttccccatctggttc

SEQ ID NO: 25644 - DNA, 22 bp, Artificial Sequence
  chemically synthesized
ttccccatctggttccatcttc

SEQ ID NO: 25645 - DNA, 22 bp, Artificial Sequence
  chemically synthesized
ccccatctggttccatcttcag

SEQ ID NO: 25646 - DNA, 22 bp, Artificial Sequence
  chemically synthesized
cccatctggttccatcttcagg

SEQ ID NO: 25647 - DNA, 22 bp, Artificial Sequence
  chemically synthesized
gttccatcttcaggaagctgtg

SEQ ID NO: 25648 - DNA, 22 bp, Artificial Sequence
  chemically synthesized
catcttcaggaagctgtgggca

SEQ ID NO: 25649 - DNA, 22 bp, Artificial Sequence
  chemically synthesized
caggaagctgtgggcattaaac

SEQ ID NO: 25650 - DNA, 22 bp, Artificial Sequence
  chemically synthesized
aggaagctgtgggcattaaact

SEQ ID NO: 25651 - DNA, 22 bp, Artificial Sequence
  chemically synthesized
tgggcattaaactcctttgggt

SEQ ID NO: 25652 - DNA, 22 bp, Artificial Sequence
  chemically synthesized
aactcctttgggtagctgtgat

SEQ ID NO: 25653 - DNA, 22 bp, Artificial Sequence
  chemically synthesized
ctttgggtagctgtgattggag

SEQ ID NO: 25654 - DNA, 22 bp, Artificial Sequence
  chemically synthesized
tgggtagctgtgattggagact

SEQ ID NO: 25655 - DNA, 22 bp, Artificial Sequence
  chemically synthesized
gggtagctgtgattggagactg

SEQ ID NO: 25656 - DNA, 22 bp, Artificial Sequence
  chemically synthesized
ggtagctgtgattggagactgg

SEQ ID NO: 25657 - DNA, 22 bp, Artificial Sequence
  chemically synthesized
tgattggagactggctcaacct

SEQ ID NO: 25658 - DNA, 22 bp, Artificial Sequence
  chemically synthesized
gagactggctcaacctcgtctt

SEQ ID NO: 25659 - DNA, 22 bp, Artificial Sequence
  chemically synthesized
gctcaacctcgtctttaagtgg

SEQ ID NO: 25660 - DNA, 22 bp, Artificial Sequence
  chemically synthesized
aacctcgtctttaagtggtaag

SEQ ID NO: 25661 - DNA, 22 bp, Artificial Sequence
  chemically synthesized
gtctttaagtggtaagaaccat

SEQ ID NO: 25662 - DNA, 22 bp, Artificial Sequence
  chemically synthesized
taagtggtaagaaccatataga

SEQ ID NO: 25663 - DNA, 22 bp, Artificial Sequence
  chemically synthesized
aagtggtaagaaccatatagag

SEQ ID NO: 25664 - DNA, 22 bp, Artificial Sequence
  chemically synthesized
agtggtaagaaccatatagaga

SEQ ID NO: 25665 - DNA, 22 bp, Artificial Sequence
  chemically synthesized
gcattcgctctcgcaatgtctg

SEQ ID NO: 25666 - DNA, 22 bp, Artificial Sequence
  chemically synthesized
gctctcgcaatgtctgtccatc

SEQ ID NO: 25667 - DNA, 22 bp, Artificial Sequence
  chemically synthesized
tcgcaatgtctgtccatcagaa

SEQ ID NO: 25668 - DNA, 22 bp, Artificial Sequence
  chemically synthesized
gcaatgtctgtccatcagaagt

SEQ ID NO: 25669 - DNA, 22 bp, Artificial Sequence
  chemically synthesized
tccatcagaagttgctttcccc

SEQ ID NO: 25670 - DNA, 22 bp, Artificial Sequence
  chemically synthesized
ctttccccaggctattcaggaa

SEQ ID NO: 25671 - DNA, 22 bp, Artificial Sequence
  chemically synthesized
tccccaggctattcaggaagcc

SEQ ID NO: 25672 - DNA, 22 bp, Artificial Sequence
  chemically synthesized
ccccaggctattcaggaagcca

SEQ ID NO: 25673 - DNA, 22 bp, Artificial Sequence
  chemically synthesized
cccaggctattcaggaagccac

SEQ ID NO: 25674 - DNA, 22 bp, Artificial Sequence
  chemically synthesized
ttcaggaagccacgggctactc

SEQ ID NO: 25675 - DNA, 22 bp, Artificial Sequence
  chemically synthesized
aggaagccacgggctactcatg

SEQ ID NO: 25676 - DNA, 22 bp, Artificial Sequence
  chemically synthesized
ctcatgcttccaacccctctct

SEQ ID NO: 25677 - DNA, 22 bp, Artificial Sequence
  chemically synthesized
atgcttccaacccctctctctg

SEQ ID NO: 25678 - DNA, 22 bp, Artificial Sequence
  chemically synthesized
ccaacccctctctctgactttg

SEQ ID NO: 25679 - DNA, 22 bp, Artificial Sequence
  chemically synthesized
caacccctctctctgactttgg

SEQ ID NO: 25680 - DNA, 22 bp, Artificial Sequence
  chemically synthesized
tctctgactttggatcatctac

SEQ ID NO: 25681 - DNA, 22 bp, Artificial Sequence
  chemically synthesized
tctgactttggatcatctacat

SEQ ID NO: 25682 - DNA, 22 bp, Artificial Sequence
  chemically synthesized
tgactttggatcatctacataa

SEQ ID NO: 25683 - DNA, 22 bp, Artificial Sequence
  chemically synthesized
actttggatcatctacataaag

SEQ ID NO: 25684 - DNA, 22 bp, Artificial Sequence
  chemically synthesized
tggatcatctacataaaggggg

SEQ ID NO: 25685 - DNA, 22 bp, Artificial Sequence
  chemically synthesized
ggatcatctacataaaggggga

SEQ ID NO: 25686 - DNA, 22 bp, Artificial Sequence
  chemically synthesized
gatcatctacataaagggggaa

SEQ ID NO: 25687 - DNA, 22 bp, Artificial Sequence
  chemically synthesized
cataaagggggaagacagaaaa

SEQ ID NO: 25688 - DNA, 22 bp, Artificial Sequence
  chemically synthesized
ccagtgagttgaaaatacagga

SEQ ID NO: 25689 - DNA, 22 bp, Artificial Sequence
  chemically synthesized
aaaatacaggaaagcctatttc

SEQ ID NO: 25690 - DNA, 22 bp, Artificial Sequence
  chemically synthesized
tttcatatgggttaaagggtag

SEQ ID NO: 25691 - DNA, 22 bp, Artificial Sequence
  chemically synthesized
catatgggttaaagggtaggac

SEQ ID NO: 25692 - DNA, 22 bp, Artificial Sequence
  chemically synthesized
atatgggttaaagggtaggaca

SEQ ID NO: 25693 - DNA, 22 bp, Artificial Sequence
  chemically synthesized
aagggtaggacagttgaatttc

SEQ ID NO: 25694 - DNA, 22 bp, Artificial Sequence
  chemically synthesized
aatttcgtgaaaagtctgagtt

SEQ ID NO: 25695 - DNA, 22 bp, Artificial Sequence
  chemically synthesized
cgtgaaaagtctgagttatata

SEQ ID NO: 25696 - DNA, 22 bp, Artificial Sequence
  chemically synthesized
gtgaaaagtctgagttatatag

SEQ ID NO: 25697 - DNA, 22 bp, Artificial Sequence
  chemically synthesized
agttatataggctttgagcaaa

SEQ ID NO: 25698 - DNA, 22 bp, Artificial Sequence
  chemically synthesized
tataggctttgagcaaagagtt

SEQ ID NO: 25699 - DNA, 22 bp, Artificial Sequence
  chemically synthesized
tgagcaaagagttttattagta

SEQ ID NO: 25700 - DNA, 22 bp, Artificial Sequence
  chemically synthesized
gagcaaagagttttattagtat

SEQ ID NO: 25701 - DNA, 22 bp, Artificial Sequence
  chemically synthesized
agcaaagagttttattagtatg

SEQ ID NO: 25702 - DNA, 22 bp, Artificial Sequence
  chemically synthesized
tattagtatgaagcagaagagg

SEQ ID NO: 25703 - DNA, 22 bp, Artificial Sequence
  chemically synthesized
attagtatgaagcagaagaggt

SEQ ID NO: 25704 - DNA, 22 bp, Artificial Sequence
  chemically synthesized
ttagtatgaagcagaagaggta

SEQ ID NO: 25705 - DNA, 22 bp, Artificial Sequence
  chemically synthesized
gtatgaagcagaagaggtaaca

SEQ ID NO: 25706 - DNA, 22 bp, Artificial Sequence
  chemically synthesized
acacctgtaatcccagcacttt

SEQ ID NO: 25707 - DNA, 22 bp, Artificial Sequence
  chemically synthesized
taatcccagcactttgggaggc

SEQ ID NO: 25708 - DNA, 22 bp, Artificial Sequence
  chemically synthesized
tgggaggccgaggtgggcgaat

SEQ ID NO: 25709 - DNA, 22 bp, Artificial Sequence
  chemically synthesized
gggaggccgaggtgggcgaatc

SEQ ID NO: 25710 - DNA, 22 bp, Artificial Sequence
  chemically synthesized
ggaggccgaggtgggcgaatca

SEQ ID NO: 25711 - DNA, 22 bp, Artificial Sequence
  chemically synthesized
ctgggtgaactcaggagttcaa

SEQ ID NO: 25712 - DNA, 22 bp, Artificial Sequence
  chemically synthesized
ggtgaactcaggagttcaagac

SEQ ID NO: 25713 - DNA, 22 bp, Artificial Sequence
  chemically synthesized
aggagttcaagaccagcctggg

SEQ ID NO: 25714 - DNA, 22 bp, Artificial Sequence
  chemically synthesized
aagaccagcctgggcaacatgg

SEQ ID NO: 25715 - DNA, 22 bp, Artificial Sequence
  chemically synthesized
ggcaacatggcgaaactccatc

SEQ ID NO: 25716 - DNA, 22 bp, Artificial Sequence
  chemically synthesized
catctctacaaaaacattacga

SEQ ID NO: 25717 - DNA, 22 bp, Artificial Sequence
  chemically synthesized
tacaaaaacattacgaaaatta

SEQ ID NO: 25718 - DNA, 22 bp, Artificial Sequence
  chemically synthesized
caaaaacattacgaaaattagc

SEQ ID NO: 25719 - DNA, 22 bp, Artificial Sequence
  chemically synthesized
cgaaaattagctgggcgtgttg

SEQ ID NO: 25720 - DNA, 22 bp, Artificial Sequence
  chemically synthesized
gctgggcgtgttggtgctgtag

SEQ ID NO: 25721 - DNA, 22 bp, Artificial Sequence
  chemically synthesized
ggcgtgttggtgctgtagtccc

SEQ ID NO: 25722 - DNA, 22 bp, Artificial Sequence
  chemically synthesized
gtgctgtagtcccagctactca

SEQ ID NO: 25723 - DNA, 22 bp, Artificial Sequence
  chemically synthesized
tagtcccagctactcaggaggc

SEQ ID NO: 25724 - DNA, 22 bp, Artificial Sequence
  chemically synthesized
ctcaggaggctgaggtgagagg

SEQ ID NO: 25725 - DNA, 22 bp, Artificial Sequence
  chemically synthesized
aggaggctgaggtgagaggcgg

SEQ ID NO: 25726 - DNA, 22 bp, Artificial Sequence
  chemically synthesized
aggtgagaggcggaggaggttg

SEQ ID NO: 25727 - DNA, 22 bp, Artificial Sequence
  chemically synthesized
cagtgagtcaagatcatgccac

SEQ ID NO: 25728 - DNA, 22 bp, Artificial Sequence
  chemically synthesized
cactccagcctgggcaacagag

SEQ ID NO: 25729 - DNA, 22 bp, Artificial Sequence
  chemically synthesized
cagcctgggcaacagagtaaga

SEQ ID NO: 25730 - DNA, 22 bp, Artificial Sequence
  chemically synthesized
ggcaacagagtaagaccctgtc

SEQ ID NO: 25731 - DNA, 22 bp, Artificial Sequence
  chemically synthesized
tctcaaaaaaaaaaaaaagata

SEQ ID NO: 25732 - DNA, 22 bp, Artificial Sequence
  chemically synthesized
aaaaaaaaaaaaaagatagatg

SEQ ID NO: 25733 - DNA, 22 bp, Artificial Sequence
  chemically synthesized
tatgaaaaaaggaaacacacag

SEQ ID NO: 25734 - DNA, 22 bp, Artificial Sequence
  chemically synthesized
aacagcctgttttgtggggtaa

SEQ ID NO: 25735 - DNA, 22 bp, Artificial Sequence
  chemically synthesized
ttttgtggggtaatgaaaagtc

SEQ ID NO: 25736 - DNA, 22 bp, Artificial Sequence
  chemically synthesized
tgtggggtaatgaaaagtcacc

SEQ ID NO: 25737 - DNA, 22 bp, Artificial Sequence
  chemically synthesized
gtggggtaatgaaaagtcaccc

SEQ ID NO: 25738 - DNA, 22 bp, Artificial Sequence
  chemically synthesized
tggggtaatgaaaagtcaccct

SEQ ID NO: 25739 - DNA, 22 bp, Artificial Sequence
  chemically synthesized
ggaactgggctccagccctcgt

SEQ ID NO: 25740 - DNA, 22 bp, Artificial Sequence
  chemically synthesized
ggctccagccctcgttctgcca

SEQ ID NO: 25741 - DNA, 22 bp, Artificial Sequence
  chemically synthesized
cagccctcgttctgccacccac

SEQ ID NO: 25742 - DNA, 22 bp, Artificial Sequence
  chemically synthesized
gttctgccacccaccaactaca

SEQ ID NO: 25743 - DNA, 22 bp, Artificial Sequence
  chemically synthesized
tgccacccaccaactacatgtc

SEQ ID NO: 25744 - DNA, 22 bp, Artificial Sequence
  chemically synthesized
ccacccaccaactacatgtcct

SEQ ID NO: 25745 - DNA, 22 bp, Artificial Sequence
  chemically synthesized
catgtccttggcaagtcatatc

SEQ ID NO: 25746 - DNA, 22 bp, Artificial Sequence
  chemically synthesized
ggcaagtcatatcaattatctg

SEQ ID NO: 25747 - DNA, 22 bp, Artificial Sequence
  chemically synthesized
gcaagtcatatcaattatctga

SEQ ID NO: 25748 - DNA, 22 bp, Artificial Sequence
  chemically synthesized
tctgagtttctgttttataatc

SEQ ID NO: 25749 - DNA, 22 bp, Artificial Sequence
  chemically synthesized
agtttctgttttataatctaca

SEQ ID NO: 25750 - DNA, 22 bp, Artificial Sequence
  chemically synthesized
ctgttttataatctacaaatag

SEQ ID NO: 25751 - DNA, 22 bp, Artificial Sequence
  chemically synthesized
tgttttataatctacaaatagg

SEQ ID NO: 25752 - DNA, 22 bp, Artificial Sequence
  chemically synthesized
ttttataatctacaaataggtt

SEQ ID NO: 25753 - DNA, 22 bp, Artificial Sequence
  chemically synthesized
tataatctacaaataggttatc

SEQ ID NO: 25754 - DNA, 22 bp, Artificial Sequence
  chemically synthesized
ataatctacaaataggttatct

SEQ ID NO: 25755 - DNA, 22 bp, Artificial Sequence
  chemically synthesized
taatctacaaataggttatctc

SEQ ID NO: 25756 - DNA, 22 bp, Artificial Sequence
  chemically synthesized
caaataggttatctctggcagc

SEQ ID NO: 25757 - DNA, 22 bp, Artificial Sequence
  chemically synthesized
tctctggcagcttaataataat

SEQ ID NO: 25758 - DNA, 22 bp, Artificial Sequence
  chemically synthesized
tggcagcttaataataatcagg

SEQ ID NO: 25759 - DNA, 22 bp, Artificial Sequence
  chemically synthesized
gcagcttaataataatcagggt

SEQ ID NO: 25760 - DNA, 22 bp, Artificial Sequence
  chemically synthesized
aataataatcagggttaacatt

SEQ ID NO: 25761 - DNA, 22 bp, Artificial Sequence
  chemically synthesized
ataataatcagggttaacattt

SEQ ID NO: 25762 - DNA, 22 bp, Artificial Sequence
  chemically synthesized
acatttattaaacagtgtgtgc

SEQ ID NO: 25763 - DNA, 22 bp, Artificial Sequence
  chemically synthesized
attaaacagtgtgtgccagtcc

SEQ ID NO: 25764 - DNA, 22 bp, Artificial Sequence
  chemically synthesized
ttaaacagtgtgtgccagtcca

SEQ ID NO: 25765 - DNA, 22 bp, Artificial Sequence
  chemically synthesized
aacagtgtgtgccagtccatgt

SEQ ID NO: 25766 - DNA, 22 bp, Artificial Sequence
  chemically synthesized
tgtgcttttctgtgaggtagtt

SEQ ID NO: 25767 - DNA, 22 bp, Artificial Sequence
  chemically synthesized
ttctgtgaggtagttactgcta

SEQ ID NO: 25768 - DNA, 22 bp, Artificial Sequence
  chemically synthesized
tctgtgaggtagttactgctat

SEQ ID NO: 25769 - DNA, 22 bp, Artificial Sequence
  chemically synthesized
ctgtgaggtagttactgctatt

SEQ ID NO: 25770 - DNA, 22 bp, Artificial Sequence
  chemically synthesized
tgtgaggtagttactgctattt

SEQ ID NO: 25771 - DNA, 22 bp, Artificial Sequence
  chemically synthesized
tgaggtagttactgctatttac

SEQ ID NO: 25772 - DNA, 22 bp, Artificial Sequence
  chemically synthesized
ctgctatttacagaaacagtag

SEQ ID NO: 25773 - DNA, 22 bp, Artificial Sequence
  chemically synthesized
ctatttacagaaacagtagatg

SEQ ID NO: 25774 - DNA, 22 bp, Artificial Sequence
  chemically synthesized
tttacagaaacagtagatgcag

SEQ ID NO: 25775 - DNA, 22 bp, Artificial Sequence
  chemically synthesized
acagaaacagtagatgcagaga

SEQ ID NO: 25776 - DNA, 22 bp, Artificial Sequence
  chemically synthesized
cagaaacagtagatgcagagac

SEQ ID NO: 25777 - DNA, 22 bp, Artificial Sequence
  chemically synthesized
agttaaatgattaggccaacaa

SEQ ID NO: 25778 - DNA, 22 bp, Artificial Sequence
  chemically synthesized
aatgattaggccaacaaggtta

SEQ ID NO: 25779 - DNA, 22 bp, Artificial Sequence
  chemically synthesized
ggccaacaaggttagtacatgc

SEQ ID NO: 25780 - DNA, 22 bp, Artificial Sequence
  chemically synthesized
gtacatgccgagccaggatgga

SEQ ID NO: 25781 - DNA, 22 bp, Artificial Sequence
  chemically synthesized
gcttccgcggcaatgctcttat

SEQ ID NO: 25782 - DNA, 22 bp, Artificial Sequence
  chemically synthesized
ccgcggcaatgctcttatgaac

SEQ ID NO: 25783 - DNA, 22 bp, Artificial Sequence
  chemically synthesized
cgcggcaatgctcttatgaact

SEQ ID NO: 25784 - DNA, 22 bp, Artificial Sequence
  chemically synthesized
ttatgaactatgttacgtccag

SEQ ID NO: 25785 - DNA, 22 bp, Artificial Sequence
  chemically synthesized
atgaactatgttacgtccagtg

SEQ ID NO: 25786 - DNA, 22 bp, Artificial Sequence
  chemically synthesized
tgaactatgttacgtccagtgc

SEQ ID NO: 25787 - DNA, 22 bp, Artificial Sequence
  chemically synthesized
tgttacgtccagtgctgataaa

SEQ ID NO: 25788 - DNA, 22 bp, Artificial Sequence
  chemically synthesized
cgtccagtgctgataaactgac

SEQ ID NO: 25789 - DNA, 22 bp, Artificial Sequence
  chemically synthesized
ataaactgactctctggggagc

SEQ ID NO: 25790 - DNA, 22 bp, Artificial Sequence
  chemically synthesized
actctctggggagcaggggaaa

SEQ ID NO: 25791 - DNA, 22 bp, Artificial Sequence
  chemically synthesized
tctggggagcaggggaaagccc

SEQ ID NO: 25792 - DNA, 22 bp, Artificial Sequence
  chemically synthesized
tggggagcaggggaaagccctg

SEQ ID NO: 25793 - DNA, 22 bp, Artificial Sequence
  chemically synthesized
gggagcaggggaaagccctgag

SEQ ID NO: 25794 - DNA, 22 bp, Artificial Sequence
  chemically synthesized
agtttagcatttgccaatttct

SEQ ID NO: 25795 - DNA, 22 bp, Artificial Sequence
  chemically synthesized
agcatttgccaatttctatcac

SEQ ID NO: 25796 - DNA, 22 bp, Artificial Sequence
  chemically synthesized
gcatttgccaatttctatcacg

SEQ ID NO: 25797 - DNA, 22 bp, Artificial Sequence
  chemically synthesized
gccaatttctatcacgtaaaca

SEQ ID NO: 25798 - DNA, 22 bp, Artificial Sequence
  chemically synthesized
ccaatttctatcacgtaaacat

SEQ ID NO: 25799 - DNA, 22 bp, Artificial Sequence
  chemically synthesized
ctatcacgtaaacattcccatt

SEQ ID NO: 25800 - DNA, 22 bp, Artificial Sequence
  chemically synthesized
tatcacgtaaacattcccattc

SEQ ID NO: 25801 - DNA, 22 bp, Artificial Sequence
  chemically synthesized
tcacgtaaacattcccattctg

SEQ ID NO: 25802 - DNA, 22 bp, Artificial Sequence
  chemically synthesized
ccattctggccactttctttct

SEQ ID NO: 25803 - DNA, 22 bp, Artificial Sequence
  chemically synthesized
tggccactttctttctttcttt

SEQ ID NO: 25804 - DNA, 22 bp, Artificial Sequence
  chemically synthesized
gccactttctttctttctttct

SEQ ID NO: 25805 - DNA, 22 bp, Artificial Sequence
  chemically synthesized
tctttctttctttcttttgttt

SEQ ID NO: 25806 - DNA, 22 bp, Artificial Sequence
  chemically synthesized
ctttctttctttcttttgtttg

SEQ ID NO: 25807 - DNA, 22 bp, Artificial Sequence
  chemically synthesized
tttctttctttcttttgtttgt

SEQ ID NO: 25808 - DNA, 22 bp, Artificial Sequence
  chemically synthesized
tctttctttcttttgtttgttt

SEQ ID NO: 25809 - DNA, 22 bp, Artificial Sequence
  chemically synthesized
ctttctttcttttgtttgtttg

SEQ ID NO: 25810 - DNA, 22 bp, Artificial Sequence
  chemically synthesized
tttctttcttttgtttgtttgt

SEQ ID NO: 25811 - DNA, 22 bp, Artificial Sequence
  chemically synthesized
tctttcttttgtttgtttgttt

SEQ ID NO: 25812 - DNA, 22 bp, Artificial Sequence
  chemically synthesized
ctttcttttgtttgtttgtttg

SEQ ID NO: 25813 - DNA, 22 bp, Artificial Sequence
  chemically synthesized
tttcttttgtttgtttgtttga

SEQ ID NO: 25814 - DNA, 22 bp, Artificial Sequence
  chemically synthesized
tcttttgtttgtttgtttgaga

SEQ ID NO: 25815 - DNA, 22 bp, Artificial Sequence
  chemically synthesized
cttttgtttgtttgtttgagat

SEQ ID NO: 25816 - DNA, 22 bp, Artificial Sequence
  chemically synthesized
ttttgtttgtttgtttgagatg

SEQ ID NO: 25817 - DNA, 22 bp, Artificial Sequence
  chemically synthesized
ttgtttgtttgtttgagatgga

SEQ ID NO: 25818 - DNA, 22 bp, Artificial Sequence
  chemically synthesized
tgtttgtttgtttgagatggag

SEQ ID NO: 25819 - DNA, 22 bp, Artificial Sequence
  chemically synthesized
gtttgtttgtttgagatggagt

SEQ ID NO: 25820 - DNA, 22 bp, Artificial Sequence
  chemically synthesized
tttgtttgtttgagatggagtc

SEQ ID NO: 25821 - DNA, 22 bp, Artificial Sequence
  chemically synthesized
gtttgtttgagatggagtctcg

SEQ ID NO: 25822 - DNA, 22 bp, Artificial Sequence
  chemically synthesized
tttgtttgagatggagtctcgc

SEQ ID NO: 25823 - DNA, 22 bp, Artificial Sequence
  chemically synthesized
gtttgagatggagtctcgcact

SEQ ID NO: 25824 - DNA, 22 bp, Artificial Sequence
  chemically synthesized
tttgagatggagtctcgcactg

SEQ ID NO: 25825 - DNA, 22 bp, Artificial Sequence
  chemically synthesized
gagatggagtctcgcactgttg

SEQ ID NO: 25826 - DNA, 22 bp, Artificial Sequence
  chemically synthesized
agatggagtctcgcactgttgc

SEQ ID NO: 25827 - DNA, 22 bp, Artificial Sequence
  chemically synthesized
gcactgttgcctggctggagtg

SEQ ID NO: 25828 - DNA, 22 bp, Artificial Sequence
  chemically synthesized
ttgcctggctggagtgcaatgg

SEQ ID NO: 25829 - DNA, 22 bp, Artificial Sequence
  chemically synthesized
cctggctggagtgcaatggtgc

SEQ ID NO: 25830 - DNA, 22 bp, Artificial Sequence
  chemically synthesized
gctggagtgcaatggtgcaatc

SEQ ID NO: 25831 - DNA, 22 bp, Artificial Sequence
  chemically synthesized
gagtgcaatggtgcaatctcag

SEQ ID NO: 25832 - DNA, 22 bp, Artificial Sequence
  chemically synthesized
agctcactgcaacctctgcctc

SEQ ID NO: 25833 - DNA, 22 bp, Artificial Sequence
  chemically synthesized
actgcaacctctgcctctccgg

SEQ ID NO: 25834 - DNA, 22 bp, Artificial Sequence
  chemically synthesized
caacctctgcctctccggttca

SEQ ID NO: 25835 - DNA, 22 bp, Artificial Sequence
  chemically synthesized
tgcctctccggttcaagtgatt

SEQ ID NO: 25836 - DNA, 22 bp, Artificial Sequence
  chemically synthesized
cctctccggttcaagtgattct

SEQ ID NO: 25837 - DNA, 22 bp, Artificial Sequence
  chemically synthesized
tccggttcaagtgattctcctg

SEQ ID NO: 25838 - DNA, 22 bp, Artificial Sequence
  chemically synthesized
cggttcaagtgattctcctgcc

SEQ ID NO: 25839 - DNA, 22 bp, Artificial Sequence
  chemically synthesized
aagtgattctcctgcctcagcc

SEQ ID NO: 25840 - DNA, 22 bp, Artificial Sequence
  chemically synthesized
tcctgcctcagcctcccaagta

SEQ ID NO: 25841 - DNA, 22 bp, Artificial Sequence
  chemically synthesized
ctgcctcagcctcccaagtagc

SEQ ID NO: 25842 - DNA, 22 bp, Artificial Sequence
  chemically synthesized
cctcagcctcccaagtagctgg

SEQ ID NO: 25843 - DNA, 22 bp, Artificial Sequence
  chemically synthesized
agcctcccaagtagctgggatt

SEQ ID NO: 25844 - DNA, 22 bp, Artificial Sequence
  chemically synthesized
ccaagtagctgggattacaggt

SEQ ID NO: 25845 - DNA, 22 bp, Artificial Sequence
  chemically synthesized
ggattacaggtgcccgccacca

SEQ ID NO: 25846 - DNA, 22 bp, Artificial Sequence
  chemically synthesized
caggtgcccgccaccatgccca

SEQ ID NO: 25847 - DNA, 22 bp, Artificial Sequence
  chemically synthesized
attttttttgtatttttagtag

SEQ ID NO: 25848 - DNA, 22 bp, Artificial Sequence
  chemically synthesized
tttttgtatttttagtagagac

SEQ ID NO: 25849 - DNA, 22 bp, Artificial Sequence
  chemically synthesized
ttttgtatttttagtagagaca

SEQ ID NO: 25850 - DNA, 22 bp, Artificial Sequence
  chemically synthesized
tttgtatttttagtagagacat

SEQ ID NO: 25851 - DNA, 22 bp, Artificial Sequence
  chemically synthesized
ttgtatttttagtagagacatg

SEQ ID NO: 25852 - DNA, 22 bp, Artificial Sequence
  chemically synthesized
tgtatttttagtagagacatgg

SEQ ID NO: 25853 - DNA, 22 bp, Artificial Sequence
  chemically synthesized
gtatttttagtagagacatggt

SEQ ID NO: 25854 - DNA, 22 bp, Artificial Sequence
  chemically synthesized
tatttttagtagagacatggtt

SEQ ID NO: 25855 - DNA, 22 bp, Artificial Sequence
  chemically synthesized
ttagtagagacatggtttcact

SEQ ID NO: 25856 - DNA, 22 bp, Artificial Sequence
  chemically synthesized
tagtagagacatggtttcacta

SEQ ID NO: 25857 - DNA, 22 bp, Artificial Sequence
  chemically synthesized
agtagagacatggtttcactat

SEQ ID NO: 25858 - DNA, 22 bp, Artificial Sequence
  chemically synthesized
gtagagacatggtttcactatg

SEQ ID NO: 25859 - DNA, 22 bp, Artificial Sequence
  chemically synthesized
cactatgttgactaggctggtc

SEQ ID NO: 25860 - DNA, 22 bp, Artificial Sequence
  chemically synthesized
actatgttgactaggctggtct

SEQ ID NO: 25861 - DNA, 22 bp, Artificial Sequence
  chemically synthesized
tgttgactaggctggtctcgaa

SEQ ID NO: 25862 - DNA, 22 bp, Artificial Sequence
  chemically synthesized
actaggctggtctcgaactcct

SEQ ID NO: 25863 - DNA, 22 bp, Artificial Sequence
  chemically synthesized
ggctggtctcgaactcctgacc

SEQ ID NO: 25864 - DNA, 22 bp, Artificial Sequence
  chemically synthesized
gtctcgaactcctgacctcatg

SEQ ID NO: 25865 - DNA, 22 bp, Artificial Sequence
  chemically synthesized
gaactcctgacctcatgatctg

SEQ ID NO: 25866 - DNA, 22 bp, Artificial Sequence
  chemically synthesized
ctgacctcatgatctgcctgcc

SEQ ID NO: 25867 - DNA, 22 bp, Artificial Sequence
  chemically synthesized
acctcatgatctgcctgccttg

SEQ ID NO: 25868 - DNA, 22 bp, Artificial Sequence
  chemically synthesized
atgatctgcctgccttggcctc

SEQ ID NO: 25869 - DNA, 22 bp, Artificial Sequence
  chemically synthesized
cctgccttggcctccctaagtg

SEQ ID NO: 25870 - DNA, 22 bp, Artificial Sequence
  chemically synthesized
ccttggcctccctaagtgctag

SEQ ID NO: 25871 - DNA, 22 bp, Artificial Sequence
  chemically synthesized
ggcctccctaagtgctaggatt

SEQ ID NO: 25872 - DNA, 22 bp, Artificial Sequence
  chemically synthesized
gcctccctaagtgctaggatta

SEQ ID NO: 25873 - DNA, 22 bp, Artificial Sequence
  chemically synthesized
cctaagtgctaggattacaggc

SEQ ID NO: 25874 - DNA, 22 bp, Artificial Sequence
  chemically synthesized
agtgctaggattacaggcgtga

SEQ ID NO: 25875 - DNA, 22 bp, Artificial Sequence
  chemically synthesized
ggattacaggcgtgagccacta

SEQ ID NO: 25876 - DNA, 22 bp, Artificial Sequence
  chemically synthesized
caggcgtgagccactacaccca

SEQ ID NO: 25877 - DNA, 22 bp, Artificial Sequence
  chemically synthesized
cacccagccgcatgattctaaa

SEQ ID NO: 25878 - DNA, 22 bp, Artificial Sequence
  chemically synthesized
taaaaaataaaaagatgaagtg

SEQ ID NO: 25879 - DNA, 22 bp, Artificial Sequence
  chemically synthesized
aaaaataaaaagatgaagtgtt

SEQ ID NO: 25880 - DNA, 22 bp, Artificial Sequence
  chemically synthesized
ttccaaacatctgatctccatt

SEQ ID NO: 25881 - DNA, 22 bp, Artificial Sequence
  chemically synthesized
caaacatctgatctccattgaa

SEQ ID NO: 25882 - DNA, 22 bp, Artificial Sequence
  chemically synthesized
atctccattgaagaaccatgca

SEQ ID NO: 25883 - DNA, 22 bp, Artificial Sequence
  chemically synthesized
cattgaagaaccatgcaatctc

SEQ ID NO: 25884 - DNA, 22 bp, Artificial Sequence
  chemically synthesized
aagaaccatgcaatctctctgg

SEQ ID NO: 25885 - DNA, 22 bp, Artificial Sequence
  chemically synthesized
tctgggttgatagaggccagag

SEQ ID NO: 25886 - DNA, 22 bp, Artificial Sequence
  chemically synthesized
tgggttgatagaggccagagtt

SEQ ID NO: 25887 - DNA, 22 bp, Artificial Sequence
  chemically synthesized
ggttgatagaggccagagttag

SEQ ID NO: 25888 - DNA, 22 bp, Artificial Sequence
  chemically synthesized
atagaggccagagttagtggct

SEQ ID NO: 25889 - DNA, 22 bp, Artificial Sequence
  chemically synthesized
gtggctctccctgatttcggtg

SEQ ID NO: 25890 - DNA, 22 bp, Artificial Sequence
  chemically synthesized
tccctgatttcggtgagaaatc

SEQ ID NO: 25891 - DNA, 22 bp, Artificial Sequence
  chemically synthesized
cctgatttcggtgagaaatcac

SEQ ID NO: 25892 - DNA, 22 bp, Artificial Sequence
  chemically synthesized
atttcggtgagaaatcactatt

SEQ ID NO: 25893 - DNA, 22 bp, Artificial Sequence
  chemically synthesized
cggtgagaaatcactattccac

SEQ ID NO: 25894 - DNA, 22 bp, Artificial Sequence
  chemically synthesized
ggtgagaaatcactattccacc

SEQ ID NO: 25895 - DNA, 22 bp, Artificial Sequence
  chemically synthesized
ttccaccatcacgggataaaag

SEQ ID NO: 25896 - DNA, 22 bp, Artificial Sequence
  chemically synthesized
caccatcacgggataaaaggca

SEQ ID NO: 25897 - DNA, 22 bp, Artificial Sequence
  chemically synthesized
actggcggttgacacctatttc

SEQ ID NO: 25898 - DNA, 22 bp, Artificial Sequence
  chemically synthesized
gcggttgacacctatttccaca

SEQ ID NO: 25899 - DNA, 22 bp, Artificial Sequence
  chemically synthesized
acacctatttccacagtgaaag

SEQ ID NO: 25900 - DNA, 22 bp, Artificial Sequence
  chemically synthesized
tttccacagtgaaagatatatc

SEQ ID NO: 25901 - DNA, 22 bp, Artificial Sequence
  chemically synthesized
ccacagtgaaagatatatctag

SEQ ID NO: 25902 - DNA, 22 bp, Artificial Sequence
  chemically synthesized
cacagtgaaagatatatctagt

SEQ ID NO: 25903 - DNA, 22 bp, Artificial Sequence
  chemically synthesized
gtacttttaaaggggaagtggt

SEQ ID NO: 25904 - DNA, 22 bp, Artificial Sequence
  chemically synthesized
ttaaaggggaagtggtttgtct

SEQ ID NO: 25905 - DNA, 22 bp, Artificial Sequence
  chemically synthesized
taaaggggaagtggtttgtctg

SEQ ID NO: 25906 - DNA, 22 bp, Artificial Sequence
  chemically synthesized
aaaggggaagtggtttgtctga

SEQ ID NO: 25907 - DNA, 22 bp, Artificial Sequence
  chemically synthesized
aaggggaagtggtttgtctgag

SEQ ID NO: 25908 - DNA, 22 bp, Artificial Sequence
  chemically synthesized
gtctgagatactctgtttcaaa

SEQ ID NO: 25909 - DNA, 22 bp, Artificial Sequence
  chemically synthesized
tctgagatactctgtttcaaag

SEQ ID NO: 25910 - DNA, 22 bp, Artificial Sequence
  chemically synthesized
agatactctgtttcaaagtaga

SEQ ID NO: 25911 - DNA, 22 bp, Artificial Sequence
  chemically synthesized
tgtttcaaagtagagaggatac

SEQ ID NO: 25912 - DNA, 22 bp, Artificial Sequence
  chemically synthesized
tttcaaagtagagaggatacag

SEQ ID NO: 25913 - DNA, 22 bp, Artificial Sequence
  chemically synthesized
caaagtagagaggatacagaac

SEQ ID NO: 25914 - DNA, 22 bp, Artificial Sequence
  chemically synthesized
aaagtagagaggatacagaaca

SEQ ID NO: 25915 - DNA, 22 bp, Artificial Sequence
  chemically synthesized
aagctatatacatccttacaga

SEQ ID NO: 25916 - DNA, 22 bp, Artificial Sequence
  chemically synthesized
tatacatccttacagagagcaa

SEQ ID NO: 25917 - DNA, 22 bp, Artificial Sequence
  chemically synthesized
acagagagcaattctgatggaa

SEQ ID NO: 25918 - DNA, 22 bp, Artificial Sequence
  chemically synthesized
cagagagcaattctgatggaaa

SEQ ID NO: 25919 - DNA, 22 bp, Artificial Sequence
  chemically synthesized
tgatggaaatgcaggccatgtt

SEQ ID NO: 25920 - DNA, 22 bp, Artificial Sequence
  chemically synthesized
atggaaatgcaggccatgtttc

SEQ ID NO: 25921 - DNA, 22 bp, Artificial Sequence
  chemically synthesized
ccctggggggggctcgtcctag

SEQ ID NO: 25922 - DNA, 22 bp, Artificial Sequence
  chemically synthesized
cctggggggggctcgtcctagg

SEQ ID NO: 25923 - DNA, 22 bp, Artificial Sequence
  chemically synthesized
gggggggctcgtcctaggggct

SEQ ID NO: 25924 - DNA, 22 bp, Artificial Sequence
  chemically synthesized
gtcctaggggctggagtgcatt

SEQ ID NO: 25925 - DNA, 22 bp, Artificial Sequence
  chemically synthesized
ggggctggagtgcattctctga

SEQ ID NO: 25926 - DNA, 22 bp, Artificial Sequence
  chemically synthesized
gagtgcattctctgatgtcaga

SEQ ID NO: 25927 - DNA, 22 bp, Artificial Sequence
  chemically synthesized
tctgatgtcagaggaaatgcaa

SEQ ID NO: 25928 - DNA, 22 bp, Artificial Sequence
  chemically synthesized
tgatgtcagaggaaatgcaaga

SEQ ID NO: 25929 - DNA, 22 bp, Artificial Sequence
  chemically synthesized
atgtcagaggaaatgcaagatt

SEQ ID NO: 25930 - DNA, 22 bp, Artificial Sequence
  chemically synthesized
cctgaggcctgagggaacccat

SEQ ID NO: 25931 - DNA, 22 bp, Artificial Sequence
  chemically synthesized
aggcctgagggaacccatggta

SEQ ID NO: 25932 - DNA, 22 bp, Artificial Sequence
  chemically synthesized
agggaacccatggtatatgcaa

SEQ ID NO: 25933 - DNA, 22 bp, Artificial Sequence
  chemically synthesized
caaactgtagttccatatgcat

SEQ ID NO: 25934 - DNA, 22 bp, Artificial Sequence
  chemically synthesized
aaactgtagttccatatgcatt

SEQ ID NO: 25935 - DNA, 22 bp, Artificial Sequence
  chemically synthesized
tagttccatatgcattcttcca

SEQ ID NO: 25936 - DNA, 22 bp, Artificial Sequence
  chemically synthesized
catatgcattcttccaggacaa

SEQ ID NO: 25937 - DNA, 22 bp, Artificial Sequence
  chemically synthesized
ttccaggacaaatacttcttga

SEQ ID NO: 25938 - DNA, 22 bp, Artificial Sequence
  chemically synthesized
ccaggacaaatacttcttgagg

SEQ ID NO: 25939 - DNA, 22 bp, Artificial Sequence
  chemically synthesized
caggacaaatacttcttgaggt

SEQ ID NO: 25940 - DNA, 22 bp, Artificial Sequence
  chemically synthesized
cttgaggttaaaaaaaaaaagt

SEQ ID NO: 25941 - DNA, 22 bp, Artificial Sequence
  chemically synthesized
ttgaggttaaaaaaaaaaagtc

SEQ ID NO: 25942 - DNA, 22 bp, Artificial Sequence
  chemically synthesized
gaggttaaaaaaaaaaagtcac

SEQ ID NO: 25943 - DNA, 22 bp, Artificial Sequence
  chemically synthesized
aggttaaaaaaaaaaagtcaca

SEQ ID NO: 25944 - DNA, 22 bp, Artificial Sequence
  chemically synthesized
aaaaaaaaaagtcacatagctg

SEQ ID NO: 25945 - DNA, 22 bp, Artificial Sequence
  chemically synthesized
ccattttatggatttcaggatt

SEQ ID NO: 25946 - DNA, 22 bp, Artificial Sequence
  chemically synthesized
tatggatttcaggatttttttt

SEQ ID NO: 25947 - DNA, 22 bp, Artificial Sequence
  chemically synthesized
atggatttcaggattttttttt

SEQ ID NO: 25948 - DNA, 22 bp, Artificial Sequence
  chemically synthesized
tggatttcaggatttttttttt

SEQ ID NO: 25949 - DNA, 22 bp, Artificial Sequence
  chemically synthesized
caggattttttttttttttttt

SEQ ID NO: 25950 - DNA, 22 bp, Artificial Sequence
  chemically synthesized
aggatttttttttttttttttt

SEQ ID NO: 25951 - DNA, 22 bp, Artificial Sequence
  chemically synthesized
ttttttttttttttttgagatg

SEQ ID NO: 25952 - DNA, 22 bp, Artificial Sequence
  chemically synthesized
tttttttttttttttgagatgg

SEQ ID NO: 25953 - DNA, 22 bp, Artificial Sequence
  chemically synthesized
ttttttttttttttgagatgga

SEQ ID NO: 25954 - DNA, 22 bp, Artificial Sequence
  chemically synthesized
tttttttttttttgagatggag

SEQ ID NO: 25955 - DNA, 22 bp, Artificial Sequence
  chemically synthesized
ttttttttttttgagatggagt

SEQ ID NO: 25956 - DNA, 22 bp, Artificial Sequence
  chemically synthesized
tttttttttttgagatggagtc

SEQ ID NO: 25957 - DNA, 22 bp, Artificial Sequence
  chemically synthesized
ttttttttttgagatggagtct

SEQ ID NO: 25958 - DNA, 22 bp, Artificial Sequence
  chemically synthesized
tttttttttgagatggagtctt

SEQ ID NO: 25959 - DNA, 22 bp, Artificial Sequence
  chemically synthesized
ttttttttgagatggagtcttg

SEQ ID NO: 25960 - DNA, 22 bp, Artificial Sequence
  chemically synthesized
tttttttgagatggagtcttgc

SEQ ID NO: 25961 - DNA, 22 bp, Artificial Sequence
  chemically synthesized
ttttttgagatggagtcttgct

SEQ ID NO: 25962 - DNA, 22 bp, Artificial Sequence
  chemically synthesized
tttttgagatggagtcttgctc

SEQ ID NO: 25963 - DNA, 22 bp, Artificial Sequence
  chemically synthesized
ttttgagatggagtcttgctct

SEQ ID NO: 25964 - DNA, 22 bp, Artificial Sequence
  chemically synthesized
tttgagatggagtcttgctctg

SEQ ID NO: 25965 - DNA, 22 bp, Artificial Sequence
  chemically synthesized
ttgagatggagtcttgctctgt

SEQ ID NO: 25966 - DNA, 22 bp, Artificial Sequence
  chemically synthesized
tgagatggagtcttgctctgtc

SEQ ID NO: 25967 - DNA, 22 bp, Artificial Sequence
  chemically synthesized
gagatggagtcttgctctgtca

SEQ ID NO: 25968 - DNA, 22 bp, Artificial Sequence
  chemically synthesized
agatggagtcttgctctgtcac

SEQ ID NO: 25969 - DNA, 22 bp, Artificial Sequence
  chemically synthesized
gctctgtcacccagcctgtagt

SEQ ID NO: 25970 - DNA, 22 bp, Artificial Sequence
  chemically synthesized
ctctgtcacccagcctgtagtg

SEQ ID NO: 25971 - DNA, 22 bp, Artificial Sequence
  chemically synthesized
tgtcacccagcctgtagtgcag

SEQ ID NO: 25972 - DNA, 22 bp, Artificial Sequence
  chemically synthesized
tcacccagcctgtagtgcagtg

SEQ ID NO: 25973 - DNA, 22 bp, Artificial Sequence
  chemically synthesized
tagtgcagtggcataatctcgg

SEQ ID NO: 25974 - DNA, 22 bp, Artificial Sequence
  chemically synthesized
ggctcacggcaacctccgcctc

SEQ ID NO: 25975 - DNA, 22 bp, Artificial Sequence
  chemically synthesized
acggcaacctccgcctcccagg

SEQ ID NO: 25976 - DNA, 22 bp, Artificial Sequence
  chemically synthesized
cgcctcccaggttcaagcgatt

SEQ ID NO: 25977 - DNA, 22 bp, Artificial Sequence
  chemically synthesized
ccaggttcaagcgattctcttg

SEQ ID NO: 25978 - DNA, 22 bp, Artificial Sequence
  chemically synthesized
aagcgattctcttgccttagcc

SEQ ID NO: 25979 - DNA, 22 bp, Artificial Sequence
  chemically synthesized
tcttgccttagcctcccgagta

SEQ ID NO: 25980 - DNA, 22 bp, Artificial Sequence
  chemically synthesized
ttgccttagcctcccgagtagc

SEQ ID NO: 25981 - DNA, 22 bp, Artificial Sequence
  chemically synthesized
gccttagcctcccgagtagctg

SEQ ID NO: 25982 - DNA, 22 bp, Artificial Sequence
  chemically synthesized
ccttagcctcccgagtagctgg

SEQ ID NO: 25983 - DNA, 22 bp, Artificial Sequence
  chemically synthesized
agcctcccgagtagctgggatt

SEQ ID NO: 25984 - DNA, 22 bp, Artificial Sequence
  chemically synthesized
gcctcccgagtagctgggatta

SEQ ID NO: 25985 - DNA, 22 bp, Artificial Sequence
  chemically synthesized
ccgagtagctgggattacagtc

SEQ ID NO: 25986 - DNA, 22 bp, Artificial Sequence
  chemically synthesized
ggattacagtcacgcaccacca

SEQ ID NO: 25987 - DNA, 22 bp, Artificial Sequence
  chemically synthesized
cagtcacgcaccaccacatctg

SEQ ID NO: 25988 - DNA, 22 bp, Artificial Sequence
  chemically synthesized
gctaattctttatattttttgg

SEQ ID NO: 25989 - DNA, 22 bp, Artificial Sequence
  chemically synthesized
attctttatattttttggtaga

SEQ ID NO: 25990 - DNA, 22 bp, Artificial Sequence
  chemically synthesized
tttatattttttggtagaaacg

SEQ ID NO: 25991 - DNA, 22 bp, Artificial Sequence
  chemically synthesized
tatattttttggtagaaacggt

SEQ ID NO: 25992 - DNA, 22 bp, Artificial Sequence
  chemically synthesized
atattttttggtagaaacggtg

SEQ ID NO: 25993 - DNA, 22 bp, Artificial Sequence
  chemically synthesized
tattttttggtagaaacggtgt

SEQ ID NO: 25994 - DNA, 22 bp, Artificial Sequence
  chemically synthesized
tttggtagaaacggtgtttcac

SEQ ID NO: 25995 - DNA, 22 bp, Artificial Sequence
  chemically synthesized
ttggtagaaacggtgtttcacc

SEQ ID NO: 25996 - DNA, 22 bp, Artificial Sequence
  chemically synthesized
tggtagaaacggtgtttcacca

SEQ ID NO: 25997 - DNA, 22 bp, Artificial Sequence
  chemically synthesized
ggtagaaacggtgtttcaccat

SEQ ID NO: 25998 - DNA, 22 bp, Artificial Sequence
  chemically synthesized
gtagaaacggtgtttcaccatg

SEQ ID NO: 25999 - DNA, 22 bp, Artificial Sequence
  chemically synthesized
caccatgttggccaggctggtc

SEQ ID NO: 26000 - DNA, 22 bp, Artificial Sequence
  chemically synthesized
accatgttggccaggctggtct

SEQ ID NO: 26001 - DNA, 22 bp, Artificial Sequence
  chemically synthesized
gccaggctggtctcaaactcct

SEQ ID NO: 26002 - DNA, 22 bp, Artificial Sequence
  chemically synthesized
gtctcaaactcctgacctcatg

SEQ ID NO: 26003 - DNA, 22 bp, Artificial Sequence
  chemically synthesized
aaactcctgacctcatgtgatc

SEQ ID NO: 26004 - DNA, 22 bp, Artificial Sequence
  chemically synthesized
ctgacctcatgtgatctgcctg

SEQ ID NO: 26005 - DNA, 22 bp, Artificial Sequence
  chemically synthesized
acctcatgtgatctgcctgcct

SEQ ID NO: 26006 - DNA, 22 bp, Artificial Sequence
  chemically synthesized
atgtgatctgcctgccttggcc

SEQ ID NO: 26007 - DNA, 22 bp, Artificial Sequence
  chemically synthesized
cctgccttggcctcccaaagtg

SEQ ID NO: 26008 - DNA, 22 bp, Artificial Sequence
  chemically synthesized
ccttggcctcccaaagtgctga

SEQ ID NO: 26009 - DNA, 22 bp, Artificial Sequence
  chemically synthesized
ggcctcccaaagtgctgagatt

SEQ ID NO: 26010 - DNA, 22 bp, Artificial Sequence
  chemically synthesized
gcctcccaaagtgctgagatta

SEQ ID NO: 26011 - DNA, 22 bp, Artificial Sequence
  chemically synthesized
ccaaagtgctgagattacaggt

SEQ ID NO: 26012 - DNA, 22 bp, Artificial Sequence
  chemically synthesized
agattacaggtgtgagccaccg

SEQ ID NO: 26013 - DNA, 22 bp, Artificial Sequence
  chemically synthesized
caggtgtgagccaccgcgcctg

SEQ ID NO: 26014 - DNA, 22 bp, Artificial Sequence
  chemically synthesized
cctggagttcagaatcttgggc

SEQ ID NO: 26015 - DNA, 22 bp, Artificial Sequence
  chemically synthesized
gagttcagaatcttgggcttca

SEQ ID NO: 26016 - DNA, 22 bp, Artificial Sequence
  chemically synthesized
agaatcttgggcttcattattt

SEQ ID NO: 26017 - DNA, 22 bp, Artificial Sequence
  chemically synthesized
gggcttcattatttgtgtttaa

SEQ ID NO: 26018 - DNA, 22 bp, Artificial Sequence
  chemically synthesized
ggcttcattatttgtgtttaaa

SEQ ID NO: 26019 - DNA, 22 bp, Artificial Sequence
  chemically synthesized
cattatttgtgtttaaatagat

SEQ ID NO: 26020 - DNA, 22 bp, Artificial Sequence
  chemically synthesized
attatttgtgtttaaatagatc

SEQ ID NO: 26021 - DNA, 22 bp, Artificial Sequence
  chemically synthesized
tttgtgtttaaatagatcatac

SEQ ID NO: 26022 - DNA, 22 bp, Artificial Sequence
  chemically synthesized
gtgtttaaatagatcatacagt

SEQ ID NO: 26023 - DNA, 22 bp, Artificial Sequence
  chemically synthesized
tgtttaaatagatcatacagtc

SEQ ID NO: 26024 - DNA, 22 bp, Artificial Sequence
  chemically synthesized
aaatagatcatacagtcaggca

SEQ ID NO: 26025 - DNA, 22 bp, Artificial Sequence
  chemically synthesized
aatagatcatacagtcaggcac

SEQ ID NO: 26026 - DNA, 22 bp, Artificial Sequence
  chemically synthesized
atgcctgtaatcccagcacttt

SEQ ID NO: 26027 - DNA, 22 bp, Artificial Sequence
  chemically synthesized
taatcccagcactttgggaggc

SEQ ID NO: 26028 - DNA, 22 bp, Artificial Sequence
  chemically synthesized
tgggaggctgaggtgggaggat

SEQ ID NO: 26029 - DNA, 22 bp, Artificial Sequence
  chemically synthesized
gggaggctgaggtgggaggatt

SEQ ID NO: 26030 - DNA, 22 bp, Artificial Sequence
  chemically synthesized
ggaggctgaggtgggaggattg

SEQ ID NO: 26031 - DNA, 22 bp, Artificial Sequence
  chemically synthesized
aggtgggaggattgcctgagtt

SEQ ID NO: 26032 - DNA, 22 bp, Artificial Sequence
  chemically synthesized
cctgagttcaggagatggagac

SEQ ID NO: 26033 - DNA, 22 bp, Artificial Sequence
  chemically synthesized
agttcaggagatggagaccagc

SEQ ID NO: 26034 - DNA, 22 bp, Artificial Sequence
  chemically synthesized
aggagatggagaccagcctggg

SEQ ID NO: 26035 - DNA, 22 bp, Artificial Sequence
  chemically synthesized
ggcaacatggtgaaaccccgtc

SEQ ID NO: 26036 - DNA, 22 bp, Artificial Sequence
  chemically synthesized
tactaaaaatacaaaaactagc

SEQ ID NO: 26037 - DNA, 22 bp, Artificial Sequence
  chemically synthesized
ctaaaaatacaaaaactagctg

SEQ ID NO: 26038 - DNA, 22 bp, Artificial Sequence
  chemically synthesized
aaaatacaaaaactagctggat

SEQ ID NO: 26039 - DNA, 22 bp, Artificial Sequence
  chemically synthesized
gctggatgtggtggcacacacc

SEQ ID NO: 26040 - DNA, 22 bp, Artificial Sequence
  chemically synthesized
gatgtggtggcacacacctgta

SEQ ID NO: 26041 - DNA, 22 bp, Artificial Sequence
  chemically synthesized
tagtcccagctattcaggaggc

SEQ ID NO: 26042 - DNA, 22 bp, Artificial Sequence
  chemically synthesized
ttcaggaggctgaggtgggagg

SEQ ID NO: 26043 - DNA, 22 bp, Artificial Sequence
  chemically synthesized
aggaggctgaggtgggaggatc

SEQ ID NO: 26044 - DNA, 22 bp, Artificial Sequence
  chemically synthesized
aggtgggaggatcccaggaggt

SEQ ID NO: 26045 - DNA, 22 bp, Artificial Sequence
  chemically synthesized
cgccactgcactccaggctggg

SEQ ID NO: 26046 - DNA, 22 bp, Artificial Sequence
  chemically synthesized
cactccaggctgggttactgag

SEQ ID NO: 26047 - DNA, 22 bp, Artificial Sequence
  chemically synthesized
caggctgggttactgagccaga

SEQ ID NO: 26048 - DNA, 22 bp, Artificial Sequence
  chemically synthesized
ggttactgagccagatcctgtc

SEQ ID NO: 26049 - DNA, 22 bp, Artificial Sequence
  chemically synthesized
ctgagccagatcctgtctcaaa

SEQ ID NO: 26050 - DNA, 22 bp, Artificial Sequence
  chemically synthesized
agccagatcctgtctcaaaaaa

SEQ ID NO: 26051 - DNA, 22 bp, Artificial Sequence
  chemically synthesized
tctcaaaaaaaaaaaagataat

SEQ ID NO: 26052 - DNA, 22 bp, Artificial Sequence
  chemically synthesized
aaaaaaaaaaaagataatacat

SEQ ID NO: 26053 - DNA, 22 bp, Artificial Sequence
  chemically synthesized
aaacagttcaaaatgcaaaagt

SEQ ID NO: 26054 - DNA, 22 bp, Artificial Sequence
  chemically synthesized
aaaatgcaaaagttacatacat

SEQ ID NO: 26055 - DNA, 22 bp, Artificial Sequence
  chemically synthesized
catacataaggaagtgtcatga

SEQ ID NO: 26056 - DNA, 22 bp, Artificial Sequence
  chemically synthesized
cctctcacacttctccccagcc

SEQ ID NO: 26057 - DNA, 22 bp, Artificial Sequence
  chemically synthesized
tcacacttctccccagccaccc

SEQ ID NO: 26058 - DNA, 22 bp, Artificial Sequence
  chemically synthesized
acacttctccccagccacccag

SEQ ID NO: 26059 - DNA, 22 bp, Artificial Sequence
  chemically synthesized
ctccccagccacccagttctcc

SEQ ID NO: 26060 - DNA, 22 bp, Artificial Sequence
  chemically synthesized
tccccagccacccagttctccc

SEQ ID NO: 26061 - DNA, 22 bp, Artificial Sequence
  chemically synthesized
cccagccacccagttctccctt

SEQ ID NO: 26062 - DNA, 22 bp, Artificial Sequence
  chemically synthesized
tcccttctagaggcaacatgtg

SEQ ID NO: 26063 - DNA, 22 bp, Artificial Sequence
  chemically synthesized
ccttctagaggcaacatgtgaa

SEQ ID NO: 26064 - DNA, 22 bp, Artificial Sequence
  chemically synthesized
ctagaggcaacatgtgaaatcc

SEQ ID NO: 26065 - DNA, 22 bp, Artificial Sequence
  chemically synthesized
tagaggcaacatgtgaaatcct

SEQ ID NO: 26066 - DNA, 22 bp, Artificial Sequence
  chemically synthesized
gaggcaacatgtgaaatccttc

SEQ ID NO: 26067 - DNA, 22 bp, Artificial Sequence
  chemically synthesized
ctcaggctacactcttcttgaa

SEQ ID NO: 26068 - DNA, 22 bp, Artificial Sequence
  chemically synthesized
tcaggctacactcttcttgaag

SEQ ID NO: 26069 - DNA, 22 bp, Artificial Sequence
  chemically synthesized
aggctacactcttcttgaaggt

SEQ ID NO: 26070 - DNA, 22 bp, Artificial Sequence
  chemically synthesized
cactcttcttgaaggtgtaggc

SEQ ID NO: 26071 - DNA, 22 bp, Artificial Sequence
  chemically synthesized
ttcttgaaggtgtaggctttgg

SEQ ID NO: 26072 - DNA, 22 bp, Artificial Sequence
  chemically synthesized
cttgaaggtgtaggctttgggc

SEQ ID NO: 26073 - DNA, 22 bp, Artificial Sequence
  chemically synthesized
ttgaaggtgtaggctttgggca

SEQ ID NO: 26074 - DNA, 22 bp, Artificial Sequence
  chemically synthesized
gaaggtgtaggctttgggcaaa

SEQ ID NO: 26075 - DNA, 22 bp, Artificial Sequence
  chemically synthesized
aaggtgtaggctttgggcaaaa

SEQ ID NO: 26076 - DNA, 22 bp, Artificial Sequence
  chemically synthesized
tgggcaaaagcattcattcagt

SEQ ID NO: 26077 - DNA, 22 bp, Artificial Sequence
  chemically synthesized
gggcaaaagcattcattcagta

SEQ ID NO: 26078 - DNA, 22 bp, Artificial Sequence
  chemically synthesized
ggcaaaagcattcattcagtaa

SEQ ID NO: 26079 - DNA, 22 bp, Artificial Sequence
  chemically synthesized
attcagtaaccccagaaacttg

SEQ ID NO: 26080 - DNA, 22 bp, Artificial Sequence
  chemically synthesized
agtaaccccagaaacttgttct

SEQ ID NO: 26081 - DNA, 22 bp, Artificial Sequence
  chemically synthesized
gttctgtttttccataggattc

SEQ ID NO: 26082 - DNA, 22 bp, Artificial Sequence
  chemically synthesized
ttctgtttttccataggattct

SEQ ID NO: 26083 - DNA, 22 bp, Artificial Sequence
  chemically synthesized
tgtttttccataggattctctt

SEQ ID NO: 26084 - DNA, 22 bp, Artificial Sequence
  chemically synthesized
tttttccataggattctctttg

SEQ ID NO: 26085 - DNA, 22 bp, Artificial Sequence
  chemically synthesized
ttccataggattctctttggac

SEQ ID NO: 26086 - DNA, 22 bp, Artificial Sequence
  chemically synthesized
tccataggattctctttggaca

SEQ ID NO: 26087 - DNA, 22 bp, Artificial Sequence
  chemically synthesized
ccataggattctctttggacag

SEQ ID NO: 26088 - DNA, 22 bp, Artificial Sequence
  chemically synthesized
cataggattctctttggacagc

SEQ ID NO: 26089 - DNA, 22 bp, Artificial Sequence
  chemically synthesized
tctttggacagcgtccatactg

SEQ ID NO: 26090 - DNA, 22 bp, Artificial Sequence
  chemically synthesized
tttggacagcgtccatactggt

SEQ ID NO: 26091 - DNA, 22 bp, Artificial Sequence
  chemically synthesized
tggacagcgtccatactggtgg

SEQ ID NO: 26092 - DNA, 22 bp, Artificial Sequence
  chemically synthesized
ggacagcgtccatactggtggg

SEQ ID NO: 26093 - DNA, 22 bp, Artificial Sequence
  chemically synthesized
gacagcgtccatactggtgggt

SEQ ID NO: 26094 - DNA, 22 bp, Artificial Sequence
  chemically synthesized
gtgggttttggatactgactac

SEQ ID NO: 26095 - DNA, 22 bp, Artificial Sequence
  chemically synthesized
tggatactgactactacagcaa

SEQ ID NO: 26096 - DNA, 22 bp, Artificial Sequence
  chemically synthesized
ggatactgactactacagcaac

SEQ ID NO: 26097 - DNA, 22 bp, Artificial Sequence
  chemically synthesized
gatactgactactacagcaaca

SEQ ID NO: 26098 - DNA, 22 bp, Artificial Sequence
  chemically synthesized
actactacagcaacacttccgt

SEQ ID NO: 26099 - DNA, 22 bp, Artificial Sequence
  chemically synthesized
ctacagcaacacttccgtgccc

SEQ ID NO: 26100 - DNA, 22 bp, Artificial Sequence
  chemically synthesized
cagcaacacttccgtgcccctg

SEQ ID NO: 26101 - DNA, 22 bp, Artificial Sequence
  chemically synthesized
ccgtgcccctgataaagcagtt

SEQ ID NO: 26102 - DNA, 22 bp, Artificial Sequence
  chemically synthesized
cgtgcccctgataaagcagttc

SEQ ID NO: 26103 - DNA, 22 bp, Artificial Sequence
  chemically synthesized
ataaagcagttccctgtaacct

SEQ ID NO: 26104 - DNA, 22 bp, Artificial Sequence
  chemically synthesized
cctgtaacctgtgagactggac

SEQ ID NO: 26105 - DNA, 22 bp, Artificial Sequence
  chemically synthesized
taacctgtgagactggaccagg

SEQ ID NO: 26106 - DNA, 22 bp, Artificial Sequence
  chemically synthesized
tgagactggaccaggtaagcgt

SEQ ID NO: 26107 - DNA, 22 bp, Artificial Sequence
  chemically synthesized
gaccaggtaagcgtcccagccc

SEQ ID NO: 26108 - DNA, 22 bp, Artificial Sequence
  chemically synthesized
cagacagaagctgagtggacct

SEQ ID NO: 26109 - DNA, 22 bp, Artificial Sequence
  chemically synthesized
agtggacctcgtttacctgtta

SEQ ID NO: 26110 - DNA, 22 bp, Artificial Sequence
  chemically synthesized
gtttacctgttatggatgaaac

SEQ ID NO: 26111 - DNA, 22 bp, Artificial Sequence
  chemically synthesized
acctgttatggatgaaactgac

SEQ ID NO: 26112 - DNA, 22 bp, Artificial Sequence
  chemically synthesized
cctgttatggatgaaactgacc

SEQ ID NO: 26113 - DNA, 22 bp, Artificial Sequence
  chemically synthesized
ttatggatgaaactgaccttga

SEQ ID NO: 26114 - DNA, 22 bp, Artificial Sequence
  chemically synthesized
tggatgaaactgaccttgaggg

SEQ ID NO: 26115 - DNA, 22 bp, Artificial Sequence
  chemically synthesized
accttgaggggacatgaggaga

SEQ ID NO: 26116 - DNA, 22 bp, Artificial Sequence
  chemically synthesized
gaggggacatgaggagagccat

SEQ ID NO: 26117 - DNA, 22 bp, Artificial Sequence
  chemically synthesized
aggggacatgaggagagccatt

SEQ ID NO: 26118 - DNA, 22 bp, Artificial Sequence
  chemically synthesized
ctttgtacttttgtcatgctct

SEQ ID NO: 26119 - DNA, 22 bp, Artificial Sequence
  chemically synthesized
tgtacttttgtcatgctcttca

SEQ ID NO: 26120 - DNA, 22 bp, Artificial Sequence
  chemically synthesized
gtacttttgtcatgctcttcaa

SEQ ID NO: 26121 - DNA, 22 bp, Artificial Sequence
  chemically synthesized
tacttttgtcatgctcttcaat

SEQ ID NO: 26122 - DNA, 22 bp, Artificial Sequence
  chemically synthesized
ttgtcatgctcttcaattggca

SEQ ID NO: 26123 - DNA, 22 bp, Artificial Sequence
  chemically synthesized
tgtcatgctcttcaattggcac

SEQ ID NO: 26124 - DNA, 22 bp, Artificial Sequence
  chemically synthesized
gtcatgctcttcaattggcaca

SEQ ID NO: 26125 - DNA, 22 bp, Artificial Sequence
  chemically synthesized
tcatgctcttcaattggcacaa

SEQ ID NO: 26126 - DNA, 22 bp, Artificial Sequence
  chemically synthesized
ttcaattggcacaaattaattc

SEQ ID NO: 26127 - DNA, 22 bp, Artificial Sequence
  chemically synthesized
caattggcacaaattaattcac

SEQ ID NO: 26128 - DNA, 22 bp, Artificial Sequence
  chemically synthesized
aattggcacaaattaattcact

SEQ ID NO: 26129 - DNA, 22 bp, Artificial Sequence
  chemically synthesized
gcacaaattaattcacttctgc

SEQ ID NO: 26130 - DNA, 22 bp, Artificial Sequence
  chemically synthesized
attcacttctgcaatactttcc

SEQ ID NO: 26131 - DNA, 22 bp, Artificial Sequence
  chemically synthesized
acttctgcaatactttcctgaa

SEQ ID NO: 26132 - DNA, 22 bp, Artificial Sequence
  chemically synthesized
ctgcaatactttcctgaatagc

SEQ ID NO: 26133 - DNA, 22 bp, Artificial Sequence
  chemically synthesized
tgcaatactttcctgaatagca

SEQ ID NO: 26134 - DNA, 22 bp, Artificial Sequence
  chemically synthesized
caatactttcctgaatagcaca

SEQ ID NO: 26135 - DNA, 22 bp, Artificial Sequence
  chemically synthesized
tcctgaatagcacagtagtatt

SEQ ID NO: 26136 - DNA, 22 bp, Artificial Sequence
  chemically synthesized
cctgaatagcacagtagtattg

SEQ ID NO: 26137 - DNA, 22 bp, Artificial Sequence
  chemically synthesized
ctgaatagcacagtagtattgg

SEQ ID NO: 26138 - DNA, 22 bp, Artificial Sequence
  chemically synthesized
aatagcacagtagtattggaaa

SEQ ID NO: 26139 - DNA, 22 bp, Artificial Sequence
  chemically synthesized
gaaatctgcctattacagaacc

SEQ ID NO: 26140 - DNA, 22 bp, Artificial Sequence
  chemically synthesized
cctattacagaacctggatgga

SEQ ID NO: 26141 - DNA, 22 bp, Artificial Sequence
  chemically synthesized
ttacagaacctggatggagtcc

SEQ ID NO: 26142 - DNA, 22 bp, Artificial Sequence
  chemically synthesized
cagaacctggatggagtccaga

SEQ ID NO: 26143 - DNA, 22 bp, Artificial Sequence
  chemically synthesized
gatggagtccagagaggcacgg

SEQ ID NO: 26144 - DNA, 22 bp, Artificial Sequence
  chemically synthesized
gtgagagtcaccgccctgcagc

SEQ ID NO: 26145 - DNA, 22 bp, Artificial Sequence
  chemically synthesized
cagggcggtgactctcacgagc

SEQ ID NO: 26146 - DNA, 22 bp, Artificial Sequence
  chemically synthesized
tcacgagccctttgcccatgga

SEQ ID NO: 26147 - DNA, 22 bp, Artificial Sequence
  chemically synthesized
acgagccctttgcccatggatg

SEQ ID NO: 26148 - DNA, 22 bp, Artificial Sequence
  chemically synthesized
tgcccatggatgcccgtgcctc

SEQ ID NO: 26149 - DNA, 22 bp, Artificial Sequence
  chemically synthesized
gcccatggatgcccgtgcctct

SEQ ID NO: 26150 - DNA, 22 bp, Artificial Sequence
  chemically synthesized
cccatggatgcccgtgcctctc

SEQ ID NO: 26151 - DNA, 22 bp, Artificial Sequence
  chemically synthesized
tctggactccatccaggttctg

SEQ ID NO: 26152 - DNA, 22 bp, Artificial Sequence
  chemically synthesized
tggactccatccaggttctgta

SEQ ID NO: 26153 - DNA, 22 bp, Artificial Sequence
  chemically synthesized
gactccatccaggttctgtaat

SEQ ID NO: 26154 - DNA, 22 bp, Artificial Sequence
  chemically synthesized
catccaggttctgtaataggca

SEQ ID NO: 26155 - DNA, 22 bp, Artificial Sequence
  chemically synthesized
tgtaataggcagatttccaata

SEQ ID NO: 26156 - DNA, 22 bp, Artificial Sequence
  chemically synthesized
taataggcagatttccaatact

SEQ ID NO: 26157 - DNA, 22 bp, Artificial Sequence
  chemically synthesized
ccaatactactgtgctattcag

SEQ ID NO: 26158 - DNA, 22 bp, Artificial Sequence
  chemically synthesized
caatactactgtgctattcagg

SEQ ID NO: 26159 - DNA, 22 bp, Artificial Sequence
  chemically synthesized
ctgtgctattcaggaaagtatt

SEQ ID NO: 26160 - DNA, 22 bp, Artificial Sequence
  chemically synthesized
tgctattcaggaaagtattgca

SEQ ID NO: 26161 - DNA, 22 bp, Artificial Sequence
  chemically synthesized
ttcaggaaagtattgcagaagt

SEQ ID NO: 26162 - DNA, 22 bp, Artificial Sequence
  chemically synthesized
aggaaagtattgcagaagtgaa

SEQ ID NO: 26163 - DNA, 22 bp, Artificial Sequence
  chemically synthesized
cagaagtgaattaatttgtgcc

SEQ ID NO: 26164 - DNA, 22 bp, Artificial Sequence
  chemically synthesized
atttgtgccaattgaagagcat

SEQ ID NO: 26165 - DNA, 22 bp, Artificial Sequence
  chemically synthesized
gtgccaattgaagagcatgaca

SEQ ID NO: 26166 - DNA, 22 bp, Artificial Sequence
  chemically synthesized
tgccaattgaagagcatgacaa

SEQ ID NO: 26167 - DNA, 22 bp, Artificial Sequence
  chemically synthesized
aagagcatgacaaaagtacaaa

SEQ ID NO: 26168 - DNA, 22 bp, Artificial Sequence
  chemically synthesized
tcctcatgtcccctcaaggtca

SEQ ID NO: 26169 - DNA, 22 bp, Artificial Sequence
  chemically synthesized
ctcatgtcccctcaaggtcagt

SEQ ID NO: 26170 - DNA, 22 bp, Artificial Sequence
  chemically synthesized
atgtcccctcaaggtcagtttc

SEQ ID NO: 26171 - DNA, 22 bp, Artificial Sequence
  chemically synthesized
aaggtcagtttcatccataaca

SEQ ID NO: 26172 - DNA, 22 bp, Artificial Sequence
  chemically synthesized
catccataacaggtaaacgagg

SEQ ID NO: 26173 - DNA, 22 bp, Artificial Sequence
  chemically synthesized
atccataacaggtaaacgaggt

SEQ ID NO: 26174 - DNA, 22 bp, Artificial Sequence
  chemically synthesized
agcttctgtctgcaggggctgg

SEQ ID NO: 26175 - DNA, 22 bp, Artificial Sequence
  chemically synthesized
ctgtctgcaggggctgggacgc

SEQ ID NO: 26176 - DNA, 22 bp, Artificial Sequence
  chemically synthesized
tgtctgcaggggctgggacgct

SEQ ID NO: 26177 - DNA, 22 bp, Artificial Sequence
  chemically synthesized
tctgcaggggctgggacgctta

SEQ ID NO: 26178 - DNA, 22 bp, Artificial Sequence
  chemically synthesized
caggggctgggacgcttacctg

SEQ ID NO: 26179 - DNA, 22 bp, Artificial Sequence
  chemically synthesized
ggacgcttacctggtccagtct

SEQ ID NO: 26180 - DNA, 22 bp, Artificial Sequence
  chemically synthesized
acctggtccagtctcacaggtt

SEQ ID NO: 26181 - DNA, 22 bp, Artificial Sequence
  chemically synthesized
cctggtccagtctcacaggtta

SEQ ID NO: 26182 - DNA, 22 bp, Artificial Sequence
  chemically synthesized
gtccagtctcacaggttacagg

SEQ ID NO: 26183 - DNA, 22 bp, Artificial Sequence
  chemically synthesized
acaggttacagggaactgcttt

SEQ ID NO: 26184 - DNA, 22 bp, Artificial Sequence
  chemically synthesized
cagggaactgctttatcagggg

SEQ ID NO: 26185 - DNA, 22 bp, Artificial Sequence
  chemically synthesized
ctttatcaggggcacggaagtg

SEQ ID NO: 26186 - DNA, 22 bp, Artificial Sequence
  chemically synthesized
tatcaggggcacggaagtgttg

SEQ ID NO: 26187 - DNA, 22 bp, Artificial Sequence
  chemically synthesized
atcaggggcacggaagtgttgc

SEQ ID NO: 26188 - DNA, 22 bp, Artificial Sequence
  chemically synthesized
tcaggggcacggaagtgttgct

SEQ ID NO: 26189 - DNA, 22 bp, Artificial Sequence
  chemically synthesized
ctgtagtagtcagtatccaaaa

SEQ ID NO: 26190 - DNA, 22 bp, Artificial Sequence
  chemically synthesized
tagtagtcagtatccaaaaccc

SEQ ID NO: 26191 - DNA, 22 bp, Artificial Sequence
  chemically synthesized
tccaaagagaatcctatggaaa

SEQ ID NO: 26192 - DNA, 22 bp, Artificial Sequence
  chemically synthesized
tggaaaaacagaacaagtttct

SEQ ID NO: 26193 - DNA, 22 bp, Artificial Sequence
  chemically synthesized
ctggggttactgaatgaatgct

SEQ ID NO: 26194 - DNA, 22 bp, Artificial Sequence
  chemically synthesized
tggggttactgaatgaatgctt

SEQ ID NO: 26195 - DNA, 22 bp, Artificial Sequence
  chemically synthesized
gggttactgaatgaatgctttt

SEQ ID NO: 26196 - DNA, 22 bp, Artificial Sequence
  chemically synthesized
ctgaatgaatgcttttgcccaa

SEQ ID NO: 26197 - DNA, 22 bp, Artificial Sequence
  chemically synthesized
aatgaatgcttttgcccaaagc

SEQ ID NO: 26198 - DNA, 22 bp, Artificial Sequence
  chemically synthesized
ttgcccaaagcctacaccttca

SEQ ID NO: 26199 - DNA, 22 bp, Artificial Sequence
  chemically synthesized
tgcccaaagcctacaccttcaa

SEQ ID NO: 26200 - DNA, 22 bp, Artificial Sequence
  chemically synthesized
gcccaaagcctacaccttcaag

SEQ ID NO: 26201 - DNA, 22 bp, Artificial Sequence
  chemically synthesized
cccaaagcctacaccttcaaga

SEQ ID NO: 26202 - DNA, 22 bp, Artificial Sequence
  chemically synthesized
caccttcaagaagagtgtagcc

SEQ ID NO: 26203 - DNA, 22 bp, Artificial Sequence
  chemically synthesized
caagaagagtgtagcctgagaa

SEQ ID NO: 26204 - DNA, 22 bp, Artificial Sequence
  chemically synthesized
aagaagagtgtagcctgagaag

SEQ ID NO: 26205 - DNA, 22 bp, Artificial Sequence
  chemically synthesized
agaaggatttcacatgttgcct

SEQ ID NO: 26206 - DNA, 22 bp, Artificial Sequence
  chemically synthesized
cacatgttgcctctagaaggga

SEQ ID NO: 26207 - DNA, 22 bp, Artificial Sequence
  chemically synthesized
acatgttgcctctagaagggag

SEQ ID NO: 26208 - DNA, 22 bp, Artificial Sequence
  chemically synthesized
cctctagaagggagaactgggt

SEQ ID NO: 26209 - DNA, 22 bp, Artificial Sequence
  chemically synthesized
tagaagggagaactgggtggct

SEQ ID NO: 26210 - DNA, 22 bp, Artificial Sequence
  chemically synthesized
gaagggagaactgggtggctgg

SEQ ID NO: 26211 - DNA, 22 bp, Artificial Sequence
  chemically synthesized
ggtggctggggagaagtgtgag

SEQ ID NO: 26212 - DNA, 22 bp, Artificial Sequence
  chemically synthesized
gggagaagtgtgagagggagat

SEQ ID NO: 26213 - DNA, 22 bp, Artificial Sequence
  chemically synthesized
catgacacttccttatgtatgt

SEQ ID NO: 26214 - DNA, 22 bp, Artificial Sequence
  chemically synthesized
atgacacttccttatgtatgta

SEQ ID NO: 26215 - DNA, 22 bp, Artificial Sequence
  chemically synthesized
ccttatgtatgtaacttttgca

SEQ ID NO: 26216 - DNA, 22 bp, Artificial Sequence
  chemically synthesized
cttatgtatgtaacttttgcat

SEQ ID NO: 26217 - DNA, 22 bp, Artificial Sequence
  chemically synthesized
atgtatgtaacttttgcatttt

SEQ ID NO: 26218 - DNA, 22 bp, Artificial Sequence
  chemically synthesized
tgtatgtaacttttgcattttg

SEQ ID NO: 26219 - DNA, 22 bp, Artificial Sequence
  chemically synthesized
ttgcattttgaactgtttgaat

SEQ ID NO: 26220 - DNA, 22 bp, Artificial Sequence
  chemically synthesized
tgcattttgaactgtttgaatg

SEQ ID NO: 26221 - DNA, 22 bp, Artificial Sequence
  chemically synthesized
gcattttgaactgtttgaatgt

SEQ ID NO: 26222 - DNA, 22 bp, Artificial Sequence
  chemically synthesized
cattttgaactgtttgaatgta

SEQ ID NO: 26223 - DNA, 22 bp, Artificial Sequence
  chemically synthesized
tgaactgtttgaatgtattatc

SEQ ID NO: 26224 - DNA, 22 bp, Artificial Sequence
  chemically synthesized
gaactgtttgaatgtattatct

SEQ ID NO: 26225 - DNA, 22 bp, Artificial Sequence
  chemically synthesized
aactgtttgaatgtattatctt

SEQ ID NO: 26226 - DNA, 22 bp, Artificial Sequence
  chemically synthesized
tttgaatgtattatcttttttt

SEQ ID NO: 26227 - DNA, 22 bp, Artificial Sequence
  chemically synthesized
gaatgtattatctttttttttt

SEQ ID NO: 26228 - DNA, 22 bp, Artificial Sequence
  chemically synthesized
aatgtattatcttttttttttt

SEQ ID NO: 26229 - DNA, 22 bp, Artificial Sequence
  chemically synthesized
tcttttttttttttgagacagg

SEQ ID NO: 26230 - DNA, 22 bp, Artificial Sequence
  chemically synthesized
ttttttttttgagacaggatct

SEQ ID NO: 26231 - DNA, 22 bp, Artificial Sequence
  chemically synthesized
tttttttttgagacaggatctg

SEQ ID NO: 26232 - DNA, 22 bp, Artificial Sequence
  chemically synthesized
ttttttttgagacaggatctgg

SEQ ID NO: 26233 - DNA, 22 bp, Artificial Sequence
  chemically synthesized
tttttttgagacaggatctggc

SEQ ID NO: 26234 - DNA, 22 bp, Artificial Sequence
  chemically synthesized
ttttttgagacaggatctggct

SEQ ID NO: 26235 - DNA, 22 bp, Artificial Sequence
  chemically synthesized
tttttgagacaggatctggctc

SEQ ID NO: 26236 - DNA, 22 bp, Artificial Sequence
  chemically synthesized
ttttgagacaggatctggctca

SEQ ID NO: 26237 - DNA, 22 bp, Artificial Sequence
  chemically synthesized
tttgagacaggatctggctcag

SEQ ID NO: 26238 - DNA, 22 bp, Artificial Sequence
  chemically synthesized
ttgagacaggatctggctcagt

SEQ ID NO: 26239 - DNA, 22 bp, Artificial Sequence
  chemically synthesized
tgagacaggatctggctcagta

SEQ ID NO: 26240 - DNA, 22 bp, Artificial Sequence
  chemically synthesized
gagacaggatctggctcagtaa

SEQ ID NO: 26241 - DNA, 22 bp, Artificial Sequence
  chemically synthesized
agacaggatctggctcagtaac

SEQ ID NO: 26242 - DNA, 22 bp, Artificial Sequence
  chemically synthesized
gctcagtaacccagcctggagt

SEQ ID NO: 26243 - DNA, 22 bp, Artificial Sequence
  chemically synthesized
agtaacccagcctggagtgcag

SEQ ID NO: 26244 - DNA, 22 bp, Artificial Sequence
  chemically synthesized
gagtgcagtggcgcaatctcgg

SEQ ID NO: 26245 - DNA, 22 bp, Artificial Sequence
  chemically synthesized
ggctcattgtgacctctacctc

SEQ ID NO: 26246 - DNA, 22 bp, Artificial Sequence
  chemically synthesized
attgtgacctctacctcctggg

SEQ ID NO: 26247 - DNA, 22 bp, Artificial Sequence
  chemically synthesized
tgacctctacctcctgggatcc

SEQ ID NO: 26248 - DNA, 22 bp, Artificial Sequence
  chemically synthesized
tacctcctgggatcctcccacc

SEQ ID NO: 26249 - DNA, 22 bp, Artificial Sequence
  chemically synthesized
cctcctgggatcctcccacctc

SEQ ID NO: 26250 - DNA, 22 bp, Artificial Sequence
  chemically synthesized
ctgggatcctcccacctcagcc

SEQ ID NO: 26251 - DNA, 22 bp, Artificial Sequence
  chemically synthesized
ggatcctcccacctcagcctcc

SEQ ID NO: 26252 - DNA, 22 bp, Artificial Sequence
  chemically synthesized
ccacctcagcctcctgaatagc

SEQ ID NO: 26253 - DNA, 22 bp, Artificial Sequence
  chemically synthesized
agcctcctgaatagctgggact

SEQ ID NO: 26254 - DNA, 22 bp, Artificial Sequence
  chemically synthesized
ctgaatagctgggactacaggt

SEQ ID NO: 26255 - DNA, 22 bp, Artificial Sequence
  chemically synthesized
aatagctgggactacaggtgtg

SEQ ID NO: 26256 - DNA, 22 bp, Artificial Sequence
  chemically synthesized
ggactacaggtgtgtgccacca

SEQ ID NO: 26257 - DNA, 22 bp, Artificial Sequence
  chemically synthesized
caggtgtgtgccaccacatcca

SEQ ID NO: 26258 - DNA, 22 bp, Artificial Sequence
  chemically synthesized
gtttttgtatttttagtagaga

SEQ ID NO: 26259 - DNA, 22 bp, Artificial Sequence
  chemically synthesized
ttgtatttttagtagagacggg

SEQ ID NO: 26260 - DNA, 22 bp, Artificial Sequence
  chemically synthesized
tgtatttttagtagagacgggg

SEQ ID NO: 26261 - DNA, 22 bp, Artificial Sequence
  chemically synthesized
gtatttttagtagagacggggt

SEQ ID NO: 26262 - DNA, 22 bp, Artificial Sequence
  chemically synthesized
tatttttagtagagacggggtt

SEQ ID NO: 26263 - DNA, 22 bp, Artificial Sequence
  chemically synthesized
ttagtagagacggggtttcacc

SEQ ID NO: 26264 - DNA, 22 bp, Artificial Sequence
  chemically synthesized
tagtagagacggggtttcacca

SEQ ID NO: 26265 - DNA, 22 bp, Artificial Sequence
  chemically synthesized
agtagagacggggtttcaccat

SEQ ID NO: 26266 - DNA, 22 bp, Artificial Sequence
  chemically synthesized
gtagagacggggtttcaccatg

SEQ ID NO: 26267 - DNA, 22 bp, Artificial Sequence
  chemically synthesized
caccatgttgcccaggctggtc

SEQ ID NO: 26268 - DNA, 22 bp, Artificial Sequence
  chemically synthesized
accatgttgcccaggctggtct

SEQ ID NO: 26269 - DNA, 22 bp, Artificial Sequence
  chemically synthesized
cccaggctggtctccatctcct

SEQ ID NO: 26270 - DNA, 22 bp, Artificial Sequence
  chemically synthesized
gtctccatctcctgaactcagg

SEQ ID NO: 26271 - DNA, 22 bp, Artificial Sequence
  chemically synthesized
catctcctgaactcaggcaatc

SEQ ID NO: 26272 - DNA, 22 bp, Artificial Sequence
  chemically synthesized
ctgaactcaggcaatcctccca

SEQ ID NO: 26273 - DNA, 22 bp, Artificial Sequence
  chemically synthesized
aactcaggcaatcctcccacct

SEQ ID NO: 26274 - DNA, 22 bp, Artificial Sequence
  chemically synthesized
aggcaatcctcccacctcagcc

SEQ ID NO: 26275 - DNA, 22 bp, Artificial Sequence
  chemically synthesized
ccacctcagcctcccaaagtgc

SEQ ID NO: 26276 - DNA, 22 bp, Artificial Sequence
  chemically synthesized
agcctcccaaagtgctgggatt

SEQ ID NO: 26277 - DNA, 22 bp, Artificial Sequence
  chemically synthesized
ccaaagtgctgggattacaggc

SEQ ID NO: 26278 - DNA, 22 bp, Artificial Sequence
  chemically synthesized
ggattacaggcatgagccaccg

SEQ ID NO: 26279 - DNA, 22 bp, Artificial Sequence
  chemically synthesized
caggcatgagccaccgtgcctg

SEQ ID NO: 26280 - DNA, 22 bp, Artificial Sequence
  chemically synthesized
actgtatgatctatttaaacac

SEQ ID NO: 26281 - DNA, 22 bp, Artificial Sequence
  chemically synthesized
tatgatctatttaaacacaaat

SEQ ID NO: 26282 - DNA, 22 bp, Artificial Sequence
  chemically synthesized
tttaaacacaaataatgaagcc

SEQ ID NO: 26283 - DNA, 22 bp, Artificial Sequence
  chemically synthesized
aaacacaaataatgaagcccaa

SEQ ID NO: 26284 - DNA, 22 bp, Artificial Sequence
  chemically synthesized
aacacaaataatgaagcccaag

SEQ ID NO: 26285 - DNA, 22 bp, Artificial Sequence
  chemically synthesized
tgaactccaggcaggcgcggtg

SEQ ID NO: 26286 - DNA, 22 bp, Artificial Sequence
  chemically synthesized
aactccaggcaggcgcggtggc

SEQ ID NO: 26287 - DNA, 22 bp, Artificial Sequence
  chemically synthesized
caggcaggcgcggtggctcaca

SEQ ID NO: 26288 - DNA, 22 bp, Artificial Sequence
  chemically synthesized
acacctgtaatctcagcacttt

SEQ ID NO: 26289 - DNA, 22 bp, Artificial Sequence
  chemically synthesized
taatctcagcactttgggaggc

SEQ ID NO: 26290 - DNA, 22 bp, Artificial Sequence
  chemically synthesized
agcactttgggaggccaaggca

SEQ ID NO: 26291 - DNA, 22 bp, Artificial Sequence
  chemically synthesized
tgggaggccaaggcaggcagat

SEQ ID NO: 26292 - DNA, 22 bp, Artificial Sequence
  chemically synthesized
gggaggccaaggcaggcagatc

SEQ ID NO: 26293 - DNA, 22 bp, Artificial Sequence
  chemically synthesized
ggaggccaaggcaggcagatca

SEQ ID NO: 26294 - DNA, 22 bp, Artificial Sequence
  chemically synthesized
gagaccagcctggccaacatgg

SEQ ID NO: 26295 - DNA, 22 bp, Artificial Sequence
  chemically synthesized
agaccagcctggccaacatggt

SEQ ID NO: 26296 - DNA, 22 bp, Artificial Sequence
  chemically synthesized
gccaacatggtgaaacaccgtt

SEQ ID NO: 26297 - DNA, 22 bp, Artificial Sequence
  chemically synthesized
ctaccaaaaaatataaagaatt

SEQ ID NO: 26298 - DNA, 22 bp, Artificial Sequence
  chemically synthesized
taccaaaaaatataaagaatta

SEQ ID NO: 26299 - DNA, 22 bp, Artificial Sequence
  chemically synthesized
ccaaaaaatataaagaattagc

SEQ ID NO: 26300 - DNA, 22 bp, Artificial Sequence
  chemically synthesized
gccagatgtggtggtgcgtgac

SEQ ID NO: 26301 - DNA, 22 bp, Artificial Sequence
  chemically synthesized
taatcccagctactcgggaggc

SEQ ID NO: 26302 - DNA, 22 bp, Artificial Sequence
  chemically synthesized
ctcgggaggctaaggcaagaga

SEQ ID NO: 26303 - DNA, 22 bp, Artificial Sequence
  chemically synthesized
gggaggctaaggcaagagaatc

SEQ ID NO: 26304 - DNA, 22 bp, Artificial Sequence
  chemically synthesized
aggcaagagaatcgcttgaacc

SEQ ID NO: 26305 - DNA, 22 bp, Artificial Sequence
  chemically synthesized
gaacctgggaggcggaggttgc

SEQ ID NO: 26306 - DNA, 22 bp, Artificial Sequence
  chemically synthesized
aacctgggaggcggaggttgcc

SEQ ID NO: 26307 - DNA, 22 bp, Artificial Sequence
  chemically synthesized
ggaggcggaggttgccgtgagc

SEQ ID NO: 26308 - DNA, 22 bp, Artificial Sequence
  chemically synthesized
ccgtgagccgagattatgccac

SEQ ID NO: 26309 - DNA, 22 bp, Artificial Sequence
  chemically synthesized
tgccactgcactacaggctggg

SEQ ID NO: 26310 - DNA, 22 bp, Artificial Sequence
  chemically synthesized
cactacaggctgggtgacagag

SEQ ID NO: 26311 - DNA, 22 bp, Artificial Sequence
  chemically synthesized
caggctgggtgacagagcaaga

SEQ ID NO: 26312 - DNA, 22 bp, Artificial Sequence
  chemically synthesized
ggtgacagagcaagactccatc

SEQ ID NO: 26313 - DNA, 22 bp, Artificial Sequence
  chemically synthesized
catctcaaaaaaaaaaaaaaaa

SEQ ID NO: 26314 - DNA, 22 bp, Artificial Sequence
  chemically synthesized
aaaaaaaaaaaaaaaaaaatcc

SEQ ID NO: 26315 - DNA, 22 bp, Artificial Sequence
  chemically synthesized
aaatccataaaatggcagctat

SEQ ID NO: 26316 - DNA, 22 bp, Artificial Sequence
  chemically synthesized
tgtgactttttttttttaacct

SEQ ID NO: 26317 - DNA, 22 bp, Artificial Sequence
  chemically synthesized
tttttttttaacctcaagaagt

SEQ ID NO: 26318 - DNA, 22 bp, Artificial Sequence
  chemically synthesized
ttttttttaacctcaagaagta

SEQ ID NO: 26319 - DNA, 22 bp, Artificial Sequence
  chemically synthesized
tttttttaacctcaagaagtat

SEQ ID NO: 26320 - DNA, 22 bp, Artificial Sequence
  chemically synthesized
ttttttaacctcaagaagtatt

SEQ ID NO: 26321 - DNA, 22 bp, Artificial Sequence
  chemically synthesized
tttttaacctcaagaagtattt

SEQ ID NO: 26322 - DNA, 22 bp, Artificial Sequence
  chemically synthesized
ttttaacctcaagaagtatttg

SEQ ID NO: 26323 - DNA, 22 bp, Artificial Sequence
  chemically synthesized
tttaacctcaagaagtatttgt

SEQ ID NO: 26324 - DNA, 22 bp, Artificial Sequence
  chemically synthesized
ttaacctcaagaagtatttgtc

SEQ ID NO: 26325 - DNA, 22 bp, Artificial Sequence
  chemically synthesized
taacctcaagaagtatttgtcc

SEQ ID NO: 26326 - DNA, 22 bp, Artificial Sequence
  chemically synthesized
aacctcaagaagtatttgtcct

SEQ ID NO: 26327 - DNA, 22 bp, Artificial Sequence
  chemically synthesized
acctcaagaagtatttgtcctg

SEQ ID NO: 26328 - DNA, 22 bp, Artificial Sequence
  chemically synthesized
aagaagtatttgtcctggaaga

SEQ ID NO: 26329 - DNA, 22 bp, Artificial Sequence
  chemically synthesized
gtcctggaagaatgcatatgga

SEQ ID NO: 26330 - DNA, 22 bp, Artificial Sequence
  chemically synthesized
tcctggaagaatgcatatggaa

SEQ ID NO: 26331 - DNA, 22 bp, Artificial Sequence
  chemically synthesized
gaagaatgcatatggaactaca

SEQ ID NO: 26332 - DNA, 22 bp, Artificial Sequence
  chemically synthesized
cagtttgaaacttggacttgca

SEQ ID NO: 26333 - DNA, 22 bp, Artificial Sequence
  chemically synthesized
gaaacttggacttgcatatacc

SEQ ID NO: 26334 - DNA, 22 bp, Artificial Sequence
  chemically synthesized
aaacttggacttgcatatacca

SEQ ID NO: 26335 - DNA, 22 bp, Artificial Sequence
  chemically synthesized
ggacttgcatataccatgggtt

SEQ ID NO: 26336 - DNA, 22 bp, Artificial Sequence
  chemically synthesized
gacttgcatataccatgggttc

SEQ ID NO: 26337 - DNA, 22 bp, Artificial Sequence
  chemically synthesized
gcatataccatgggttccctca

SEQ ID NO: 26338 - DNA, 22 bp, Artificial Sequence
  chemically synthesized
catataccatgggttccctcag

SEQ ID NO: 26339 - DNA, 22 bp, Artificial Sequence
  chemically synthesized
cctcaggcctcagggaatcttg

SEQ ID NO: 26340 - DNA, 22 bp, Artificial Sequence
  chemically synthesized
aggcctcagggaatcttgcatt

SEQ ID NO: 26341 - DNA, 22 bp, Artificial Sequence
  chemically synthesized
agggaatcttgcatttcctctg

SEQ ID NO: 26342 - DNA, 22 bp, Artificial Sequence
  chemically synthesized
gcatttcctctgacatcagaga

SEQ ID NO: 26343 - DNA, 22 bp, Artificial Sequence
  chemically synthesized
catttcctctgacatcagagaa

SEQ ID NO: 26344 - DNA, 22 bp, Artificial Sequence
  chemically synthesized
cctctgacatcagagaatgcac

SEQ ID NO: 26345 - DNA, 22 bp, Artificial Sequence
  chemically synthesized
ctctgacatcagagaatgcact

SEQ ID NO: 26346 - DNA, 22 bp, Artificial Sequence
  chemically synthesized
tgacatcagagaatgcactcca

SEQ ID NO: 26347 - DNA, 22 bp, Artificial Sequence
  chemically synthesized
acatcagagaatgcactccagc

SEQ ID NO: 26348 - DNA, 22 bp, Artificial Sequence
  chemically synthesized
cagcccctaggacgagcccccc

SEQ ID NO: 26349 - DNA, 22 bp, Artificial Sequence
  chemically synthesized
ggacgagccccccccagggaaa

SEQ ID NO: 26350 - DNA, 22 bp, Artificial Sequence
  chemically synthesized
catttccatcagaattgctctc

SEQ ID NO: 26351 - DNA, 22 bp, Artificial Sequence
  chemically synthesized
ccatcagaattgctctctgtaa

SEQ ID NO: 26352 - DNA, 22 bp, Artificial Sequence
  chemically synthesized
catcagaattgctctctgtaag

SEQ ID NO: 26353 - DNA, 22 bp, Artificial Sequence
  chemically synthesized
ctctctgtaaggatgtatatag

SEQ ID NO: 26354 - DNA, 22 bp, Artificial Sequence
  chemically synthesized
tctgtaaggatgtatatagctt

SEQ ID NO: 26355 - DNA, 22 bp, Artificial Sequence
  chemically synthesized
tgtaaggatgtatatagcttca

SEQ ID NO: 26356 - DNA, 22 bp, Artificial Sequence
  chemically synthesized
taaggatgtatatagcttcaga

SEQ ID NO: 26357 - DNA, 22 bp, Artificial Sequence
  chemically synthesized
cagatgcttgttctgtatcctc

SEQ ID NO: 26358 - DNA, 22 bp, Artificial Sequence
  chemically synthesized
agatgcttgttctgtatcctct

SEQ ID NO: 26359 - DNA, 22 bp, Artificial Sequence
  chemically synthesized
gttctgtatcctctctactttg

SEQ ID NO: 26360 - DNA, 22 bp, Artificial Sequence
  chemically synthesized
ttctgtatcctctctactttga

SEQ ID NO: 26361 - DNA, 22 bp, Artificial Sequence
  chemically synthesized
tgtatcctctctactttgaaac

SEQ ID NO: 26362 - DNA, 22 bp, Artificial Sequence
  chemically synthesized
tatcctctctactttgaaacag

SEQ ID NO: 26363 - DNA, 22 bp, Artificial Sequence
  chemically synthesized
tctactttgaaacagagtatct

SEQ ID NO: 26364 - DNA, 22 bp, Artificial Sequence
  chemically synthesized
tactttgaaacagagtatctca

SEQ ID NO: 26365 - DNA, 22 bp, Artificial Sequence
  chemically synthesized
ctttgaaacagagtatctcaga

SEQ ID NO: 26366 - DNA, 22 bp, Artificial Sequence
  chemically synthesized
tgaaacagagtatctcagacaa

SEQ ID NO: 26367 - DNA, 22 bp, Artificial Sequence
  chemically synthesized
gaaacagagtatctcagacaaa

SEQ ID NO: 26368 - DNA, 22 bp, Artificial Sequence
  chemically synthesized
aaacagagtatctcagacaaac

SEQ ID NO: 26369 - DNA, 22 bp, Artificial Sequence
  chemically synthesized
agacaaaccacttcccctttaa

SEQ ID NO: 26370 - DNA, 22 bp, Artificial Sequence
  chemically synthesized
cccctttaaaagtactagatat

SEQ ID NO: 26371 - DNA, 22 bp, Artificial Sequence
  chemically synthesized
ccctttaaaagtactagatata

SEQ ID NO: 26372 - DNA, 22 bp, Artificial Sequence
  chemically synthesized
taaaagtactagatatatcttt

SEQ ID NO: 26373 - DNA, 22 bp, Artificial Sequence
  chemically synthesized
aaaagtactagatatatctttc

SEQ ID NO: 26374 - DNA, 22 bp, Artificial Sequence
  chemically synthesized
aaagtactagatatatctttca

SEQ ID NO: 26375 - DNA, 22 bp, Artificial Sequence
  chemically synthesized
gatatatctttcactgtggaaa

SEQ ID NO: 26376 - DNA, 22 bp, Artificial Sequence
  chemically synthesized
tcactgtggaaataggtgtcaa

SEQ ID NO: 26377 - DNA, 22 bp, Artificial Sequence
  chemically synthesized
cactgtggaaataggtgtcaac

SEQ ID NO: 26378 - DNA, 22 bp, Artificial Sequence
  chemically synthesized
actgtggaaataggtgtcaacc

SEQ ID NO: 26379 - DNA, 22 bp, Artificial Sequence
  chemically synthesized
tggaaataggtgtcaaccgcca

SEQ ID NO: 26380 - DNA, 22 bp, Artificial Sequence
  chemically synthesized
ttatcccgtgatggtggaatag

SEQ ID NO: 26381 - DNA, 22 bp, Artificial Sequence
  chemically synthesized
tatcccgtgatggtggaatagt

SEQ ID NO: 26382 - DNA, 22 bp, Artificial Sequence
  chemically synthesized
atcccgtgatggtggaatagtg

SEQ ID NO: 26383 - DNA, 22 bp, Artificial Sequence
  chemically synthesized
tcccgtgatggtggaatagtga

SEQ ID NO: 26384 - DNA, 22 bp, Artificial Sequence
  chemically synthesized
ctcaccgaaatcagggagagcc

SEQ ID NO: 26385 - DNA, 22 bp, Artificial Sequence
  chemically synthesized
tcaccgaaatcagggagagcca

SEQ ID NO: 26386 - DNA, 22 bp, Artificial Sequence
  chemically synthesized
accgaaatcagggagagccact

SEQ ID NO: 26387 - DNA, 22 bp, Artificial Sequence
  chemically synthesized
actctggcctctatcaacccag

SEQ ID NO: 26388 - DNA, 22 bp, Artificial Sequence
  chemically synthesized
tggcctctatcaacccagagag

SEQ ID NO: 26389 - DNA, 22 bp, Artificial Sequence
  chemically synthesized
gcctctatcaacccagagagat

SEQ ID NO: 26390 - DNA, 22 bp, Artificial Sequence
  chemically synthesized
tatcaacccagagagattgcat

SEQ ID NO: 26391 - DNA, 22 bp, Artificial Sequence
  chemically synthesized
tcaacccagagagattgcatgg

SEQ ID NO: 26392 - DNA, 22 bp, Artificial Sequence
  chemically synthesized
catggttcttcaatggagatca

SEQ ID NO: 26393 - DNA, 22 bp, Artificial Sequence
  chemically synthesized
ttcaatggagatcagatgtttg

SEQ ID NO: 26394 - DNA, 22 bp, Artificial Sequence
  chemically synthesized
caatggagatcagatgtttgga

SEQ ID NO: 26395 - DNA, 22 bp, Artificial Sequence
  chemically synthesized
aatggagatcagatgtttggaa

SEQ ID NO: 26396 - DNA, 22 bp, Artificial Sequence
  chemically synthesized
ggaataacacttcatcttttta

SEQ ID NO: 26397 - DNA, 22 bp, Artificial Sequence
  chemically synthesized
gaataacacttcatctttttat

SEQ ID NO: 26398 - DNA, 22 bp, Artificial Sequence
  chemically synthesized
catctttttattttttagaatc

SEQ ID NO: 26399 - DNA, 22 bp, Artificial Sequence
  chemically synthesized
atctttttattttttagaatca

SEQ ID NO: 26400 - DNA, 22 bp, Artificial Sequence
  chemically synthesized
tttattttttagaatcatgcgg

SEQ ID NO: 26401 - DNA, 22 bp, Artificial Sequence
  chemically synthesized
ttattttttagaatcatgcggc

SEQ ID NO: 26402 - DNA, 22 bp, Artificial Sequence
  chemically synthesized
tattttttagaatcatgcggct

SEQ ID NO: 26403 - DNA, 22 bp, Artificial Sequence
  chemically synthesized
attttttagaatcatgcggctg

SEQ ID NO: 26404 - DNA, 22 bp, Artificial Sequence
  chemically synthesized
ttttttagaatcatgcggctgg

SEQ ID NO: 26405 - DNA, 22 bp, Artificial Sequence
  chemically synthesized
tttagaatcatgcggctgggtg

SEQ ID NO: 26406 - DNA, 22 bp, Artificial Sequence
  chemically synthesized
ttagaatcatgcggctgggtgt

SEQ ID NO: 26407 - DNA, 22 bp, Artificial Sequence
  chemically synthesized
tagaatcatgcggctgggtgta

SEQ ID NO: 26408 - DNA, 22 bp, Artificial Sequence
  chemically synthesized
agaatcatgcggctgggtgtag

SEQ ID NO: 26409 - DNA, 22 bp, Artificial Sequence
  chemically synthesized
gaatcatgcggctgggtgtagt

SEQ ID NO: 26410 - DNA, 22 bp, Artificial Sequence
  chemically synthesized
ggtgtagtggctcacgcctgta

SEQ ID NO: 26411 - DNA, 22 bp, Artificial Sequence
  chemically synthesized
acgcctgtaatcctagcactta

SEQ ID NO: 26412 - DNA, 22 bp, Artificial Sequence
  chemically synthesized
taatcctagcacttagggaggc

SEQ ID NO: 26413 - DNA, 22 bp, Artificial Sequence
  chemically synthesized
gcacttagggaggccaaggcag

SEQ ID NO: 26414 - DNA, 22 bp, Artificial Sequence
  chemically synthesized
agggaggccaaggcaggcagat

SEQ ID NO: 26415 - DNA, 22 bp, Artificial Sequence
  chemically synthesized
gggaggccaaggcaggcagatc

SEQ ID NO: 26416 - DNA, 22 bp, Artificial Sequence
  chemically synthesized
gagaccagcctagtcaacatag

SEQ ID NO: 26417 - DNA, 22 bp, Artificial Sequence
  chemically synthesized
gtcaacatagtgaaaccatgtc

SEQ ID NO: 26418 - DNA, 22 bp, Artificial Sequence
  chemically synthesized
tactaaaaatacaaaaaaaatt

SEQ ID NO: 26419 - DNA, 22 bp, Artificial Sequence
  chemically synthesized
ctaaaaatacaaaaaaaattag

SEQ ID NO: 26420 - DNA, 22 bp, Artificial Sequence
  chemically synthesized
aaaatacaaaaaaaattagctg

SEQ ID NO: 26421 - DNA, 22 bp, Artificial Sequence
  chemically synthesized
gctgggcatggtggcgggcacc

SEQ ID NO: 26422 - DNA, 22 bp, Artificial Sequence
  chemically synthesized
ggcatggtggcgggcacctgta

SEQ ID NO: 26423 - DNA, 22 bp, Artificial Sequence
  chemically synthesized
taatcccagctacttgggaggc

SEQ ID NO: 26424 - DNA, 22 bp, Artificial Sequence
  chemically synthesized
cttgggaggctgaggcaggaga

SEQ ID NO: 26425 - DNA, 22 bp, Artificial Sequence
  chemically synthesized
gggaggctgaggcaggagaatc

SEQ ID NO: 26426 - DNA, 22 bp, Artificial Sequence
  chemically synthesized
ggaggctgaggcaggagaatca

SEQ ID NO: 26427 - DNA, 22 bp, Artificial Sequence
  chemically synthesized
aggcaggagaatcacttgaacc

SEQ ID NO: 26428 - DNA, 22 bp, Artificial Sequence
  chemically synthesized
gaaccggagaggcagaggttgc

SEQ ID NO: 26429 - DNA, 22 bp, Artificial Sequence
  chemically synthesized
aaccggagaggcagaggttgca

SEQ ID NO: 26430 - DNA, 22 bp, Artificial Sequence
  chemically synthesized
cagtgagctgagattgcaccat

SEQ ID NO: 26431 - DNA, 22 bp, Artificial Sequence
  chemically synthesized
agattgcaccattgcactccag

SEQ ID NO: 26432 - DNA, 22 bp, Artificial Sequence
  chemically synthesized
caccattgcactccagccaggc

SEQ ID NO: 26433 - DNA, 22 bp, Artificial Sequence
  chemically synthesized
cactccagccaggcaacagtgc

SEQ ID NO: 26434 - DNA, 22 bp, Artificial Sequence
  chemically synthesized
cagccaggcaacagtgcgagac

SEQ ID NO: 26435 - DNA, 22 bp, Artificial Sequence
  chemically synthesized
catctcaaacaaacaaacaaaa

SEQ ID NO: 26436 - DNA, 22 bp, Artificial Sequence
  chemically synthesized
aaacaaacaaacaaaagaaaga

SEQ ID NO: 26437 - DNA, 22 bp, Artificial Sequence
  chemically synthesized
acgtgatagaaattggcaaatg

SEQ ID NO: 26438 - DNA, 22 bp, Artificial Sequence
  chemically synthesized
cgtgatagaaattggcaaatgc

SEQ ID NO: 26439 - DNA, 22 bp, Artificial Sequence
  chemically synthesized
gcaaatgctaaactcagggctt

SEQ ID NO: 26440 - DNA, 22 bp, Artificial Sequence
  chemically synthesized
aactcagggctttcccctgctc

SEQ ID NO: 26441 - DNA, 22 bp, Artificial Sequence
  chemically synthesized
agggctttcccctgctccccag

SEQ ID NO: 26442 - DNA, 22 bp, Artificial Sequence
  chemically synthesized
tcccctgctccccagagagtca

SEQ ID NO: 26443 - DNA, 22 bp, Artificial Sequence
  chemically synthesized
cccctgctccccagagagtcag

SEQ ID NO: 26444 - DNA, 22 bp, Artificial Sequence
  chemically synthesized
ccctgctccccagagagtcagt

SEQ ID NO: 26445 - DNA, 22 bp, Artificial Sequence
  chemically synthesized
ctccccagagagtcagtttatc

SEQ ID NO: 26446 - DNA, 22 bp, Artificial Sequence
  chemically synthesized
cccagagagtcagtttatcagc

SEQ ID NO: 26447 - DNA, 22 bp, Artificial Sequence
  chemically synthesized
atcagcactggacgtaacatag

SEQ ID NO: 26448 - DNA, 22 bp, Artificial Sequence
  chemically synthesized
tcagcactggacgtaacatagt

SEQ ID NO: 26449 - DNA, 22 bp, Artificial Sequence
  chemically synthesized
gacgtaacatagttcataagag

SEQ ID NO: 26450 - DNA, 22 bp, Artificial Sequence
  chemically synthesized
ataagagcattgccgcggaagc

SEQ ID NO: 26451 - DNA, 22 bp, Artificial Sequence
  chemically synthesized
ccgcggaagccagcctgcctac

SEQ ID NO: 26452 - DNA, 22 bp, Artificial Sequence
  chemically synthesized
cctacctgggcttccatcctgg

SEQ ID NO: 26453 - DNA, 22 bp, Artificial Sequence
  chemically synthesized
cctgggcttccatcctggctcg

SEQ ID NO: 26454 - DNA, 22 bp, Artificial Sequence
  chemically synthesized
ggcttccatcctggctcggcat

SEQ ID NO: 26455 - DNA, 22 bp, Artificial Sequence
  chemically synthesized
ccatcctggctcggcatgtact

SEQ ID NO: 26456 - DNA, 22 bp, Artificial Sequence
  chemically synthesized
catcctggctcggcatgtacta

SEQ ID NO: 26457 - DNA, 22 bp, Artificial Sequence
  chemically synthesized
gctcggcatgtactaaccttgt

SEQ ID NO: 26458 - DNA, 22 bp, Artificial Sequence
  chemically synthesized
ggcatgtactaaccttgttggc

SEQ ID NO: 26459 - DNA, 22 bp, Artificial Sequence
  chemically synthesized
accttgttggcctaatcattta

SEQ ID NO: 26460 - DNA, 22 bp, Artificial Sequence
  chemically synthesized
gttggcctaatcatttaactca

SEQ ID NO: 26461 - DNA, 22 bp, Artificial Sequence
  chemically synthesized
ttggcctaatcatttaactcag

SEQ ID NO: 26462 - DNA, 22 bp, Artificial Sequence
  chemically synthesized
gcctaatcatttaactcagcac

SEQ ID NO: 26463 - DNA, 22 bp, Artificial Sequence
  chemically synthesized
atcatttaactcagcaccttgg

SEQ ID NO: 26464 - DNA, 22 bp, Artificial Sequence
  chemically synthesized
aactcagcaccttggtctctgc

SEQ ID NO: 26465 - DNA, 22 bp, Artificial Sequence
  chemically synthesized
actcagcaccttggtctctgca

SEQ ID NO: 26466 - DNA, 22 bp, Artificial Sequence
  chemically synthesized
agcaccttggtctctgcatcta

SEQ ID NO: 26467 - DNA, 22 bp, Artificial Sequence
  chemically synthesized
ggtctctgcatctactgtttct

SEQ ID NO: 26468 - DNA, 22 bp, Artificial Sequence
  chemically synthesized
gtctctgcatctactgtttctg

SEQ ID NO: 26469 - DNA, 22 bp, Artificial Sequence
  chemically synthesized
tgcatctactgtttctgtaaat

SEQ ID NO: 26470 - DNA, 22 bp, Artificial Sequence
  chemically synthesized
catctactgtttctgtaaatag

SEQ ID NO: 26471 - DNA, 22 bp, Artificial Sequence
  chemically synthesized
ctgtttctgtaaatagcagtaa

SEQ ID NO: 26472 - DNA, 22 bp, Artificial Sequence
  chemically synthesized
tttctgtaaatagcagtaacta

SEQ ID NO: 26473 - DNA, 22 bp, Artificial Sequence
  chemically synthesized
ctgtaaatagcagtaactacct

SEQ ID NO: 26474 - DNA, 22 bp, Artificial Sequence
  chemically synthesized
tgtaaatagcagtaactacctc

SEQ ID NO: 26475 - DNA, 22 bp, Artificial Sequence
  chemically synthesized
taaatagcagtaactacctcac

SEQ ID NO: 26476 - DNA, 22 bp, Artificial Sequence
  chemically synthesized
cctcacagaaaagcacatagca

SEQ ID NO: 26477 - DNA, 22 bp, Artificial Sequence
  chemically synthesized
acagaaaagcacatagcacatg

SEQ ID NO: 26478 - DNA, 22 bp, Artificial Sequence
  chemically synthesized
gcacacactgtttaataaatgt

SEQ ID NO: 26479 - DNA, 22 bp, Artificial Sequence
  chemically synthesized
tttaataaatgttaaccctgat

SEQ ID NO: 26480 - DNA, 22 bp, Artificial Sequence
  chemically synthesized
aataaatgttaaccctgattat

SEQ ID NO: 26481 - DNA, 22 bp, Artificial Sequence
  chemically synthesized
ataaatgttaaccctgattatt

SEQ ID NO: 26482 - DNA, 22 bp, Artificial Sequence
  chemically synthesized
accctgattattattaagctgc

SEQ ID NO: 26483 - DNA, 22 bp, Artificial Sequence
  chemically synthesized
attattattaagctgccagaga

SEQ ID NO: 26484 - DNA, 22 bp, Artificial Sequence
  chemically synthesized
ttattaagctgccagagataac

SEQ ID NO: 26485 - DNA, 22 bp, Artificial Sequence
  chemically synthesized
ttaagctgccagagataaccta

SEQ ID NO: 26486 - DNA, 22 bp, Artificial Sequence
  chemically synthesized
agctgccagagataacctattt

SEQ ID NO: 26487 - DNA, 22 bp, Artificial Sequence
  chemically synthesized
ccagagataacctatttgtaga

SEQ ID NO: 26488 - DNA, 22 bp, Artificial Sequence
  chemically synthesized
tttgtagattataaaacagaaa

SEQ ID NO: 26489 - DNA, 22 bp, Artificial Sequence
  chemically synthesized
gtagattataaaacagaaactc

SEQ ID NO: 26490 - DNA, 22 bp, Artificial Sequence
  chemically synthesized
tagattataaaacagaaactca

SEQ ID NO: 26491 - DNA, 22 bp, Artificial Sequence
  chemically synthesized
taaaacagaaactcagataatt

SEQ ID NO: 26492 - DNA, 22 bp, Artificial Sequence
  chemically synthesized
agataattgatatgacttgcca

SEQ ID NO: 26493 - DNA, 22 bp, Artificial Sequence
  chemically synthesized
atatgacttgccaaggacatgt

SEQ ID NO: 26494 - DNA, 22 bp, Artificial Sequence
  chemically synthesized
gccaaggacatgtagttggtgg

SEQ ID NO: 26495 - DNA, 22 bp, Artificial Sequence
  chemically synthesized
ccaaggacatgtagttggtggg

SEQ ID NO: 26496 - DNA, 22 bp, Artificial Sequence
  chemically synthesized
gtgggtggcagaacgagggctg

SEQ ID NO: 26497 - DNA, 22 bp, Artificial Sequence
  chemically synthesized
gagcccagttcccagggtgact

SEQ ID NO: 26498 - DNA, 22 bp, Artificial Sequence
  chemically synthesized
ccagggtgacttttcattaccc

SEQ ID NO: 26499 - DNA, 22 bp, Artificial Sequence
  chemically synthesized
ttcattaccccacaaaacaggc

SEQ ID NO: 26500 - DNA, 22 bp, Artificial Sequence
  chemically synthesized
tcattaccccacaaaacaggct

SEQ ID NO: 26501 - DNA, 22 bp, Artificial Sequence
  chemically synthesized
cattaccccacaaaacaggctg

SEQ ID NO: 26502 - DNA, 22 bp, Artificial Sequence
  chemically synthesized
attaccccacaaaacaggctgt

SEQ ID NO: 26503 - DNA, 22 bp, Artificial Sequence
  chemically synthesized
ccccacaaaacaggctgttgaa

SEQ ID NO: 26504 - DNA, 22 bp, Artificial Sequence
  chemically synthesized
ttgaatcatctgtgtgtttcct

SEQ ID NO: 26505 - DNA, 22 bp, Artificial Sequence
  chemically synthesized
aatcatctgtgtgtttcctttt

SEQ ID NO: 26506 - DNA, 22 bp, Artificial Sequence
  chemically synthesized
tgtgtttccttttttcatacag

SEQ ID NO: 26507 - DNA, 22 bp, Artificial Sequence
  chemically synthesized
ccttttttcatacagcatacat

SEQ ID NO: 26508 - DNA, 22 bp, Artificial Sequence
  chemically synthesized
cttttttcatacagcatacatc

SEQ ID NO: 26509 - DNA, 22 bp, Artificial Sequence
  chemically synthesized
ttttcatacagcatacatcatc

SEQ ID NO: 26510 - DNA, 22 bp, Artificial Sequence
  chemically synthesized
tttcatacagcatacatcatct

SEQ ID NO: 26511 - DNA, 22 bp, Artificial Sequence
  chemically synthesized
ttcatacagcatacatcatcta

SEQ ID NO: 26512 - DNA, 22 bp, Artificial Sequence
  chemically synthesized
tcatacagcatacatcatctat

SEQ ID NO: 26513 - DNA, 22 bp, Artificial Sequence
  chemically synthesized
catacagcatacatcatctatc

SEQ ID NO: 26514 - DNA, 22 bp, Artificial Sequence
  chemically synthesized
atacagcatacatcatctatct

SEQ ID NO: 26515 - DNA, 22 bp, Artificial Sequence
  chemically synthesized
tcttttttttttttttgagaca

SEQ ID NO: 26516 - DNA, 22 bp, Artificial Sequence
  chemically synthesized
ttttttttttttgagacagggt

SEQ ID NO: 26517 - DNA, 22 bp, Artificial Sequence
  chemically synthesized
tttttttttttgagacagggtc

SEQ ID NO: 26518 - DNA, 22 bp, Artificial Sequence
  chemically synthesized
ttttttttttgagacagggtct

SEQ ID NO: 26519 - DNA, 22 bp, Artificial Sequence
  chemically synthesized
tttttttttgagacagggtctt

SEQ ID NO: 26520 - DNA, 22 bp, Artificial Sequence
  chemically synthesized
ttttttttgagacagggtctta

SEQ ID NO: 26521 - DNA, 22 bp, Artificial Sequence
  chemically synthesized
tttttttgagacagggtcttac

SEQ ID NO: 26522 - DNA, 22 bp, Artificial Sequence
  chemically synthesized
ttttttgagacagggtcttact

SEQ ID NO: 26523 - DNA, 22 bp, Artificial Sequence
  chemically synthesized
tttttgagacagggtcttactc

SEQ ID NO: 26524 - DNA, 22 bp, Artificial Sequence
  chemically synthesized
ttttgagacagggtcttactct

SEQ ID NO: 26525 - DNA, 22 bp, Artificial Sequence
  chemically synthesized
tttgagacagggtcttactctg

SEQ ID NO: 26526 - DNA, 22 bp, Artificial Sequence
  chemically synthesized
ttgagacagggtcttactctgt

SEQ ID NO: 26527 - DNA, 22 bp, Artificial Sequence
  chemically synthesized
tgagacagggtcttactctgtt

SEQ ID NO: 26528 - DNA, 22 bp, Artificial Sequence
  chemically synthesized
gagacagggtcttactctgttg

SEQ ID NO: 26529 - DNA, 22 bp, Artificial Sequence
  chemically synthesized
agacagggtcttactctgttgc

SEQ ID NO: 26530 - DNA, 22 bp, Artificial Sequence
  chemically synthesized
actctgttgcccaggctggagt

SEQ ID NO: 26531 - DNA, 22 bp, Artificial Sequence
  chemically synthesized
ctctgttgcccaggctggagtg

SEQ ID NO: 26532 - DNA, 22 bp, Artificial Sequence
  chemically synthesized
tgttgcccaggctggagtgcag

SEQ ID NO: 26533 - DNA, 22 bp, Artificial Sequence
  chemically synthesized
ttgcccaggctggagtgcagtg

SEQ ID NO: 26534 - DNA, 22 bp, Artificial Sequence
  chemically synthesized
cccaggctggagtgcagtggca

SEQ ID NO: 26535 - DNA, 22 bp, Artificial Sequence
  chemically synthesized
gagtgcagtggcatgatcttga

SEQ ID NO: 26536 - DNA, 22 bp, Artificial Sequence
  chemically synthesized
gactcactgcaacctcctccgc

SEQ ID NO: 26537 - DNA, 22 bp, Artificial Sequence
  chemically synthesized
actcactgcaacctcctccgcc

SEQ ID NO: 26538 - DNA, 22 bp, Artificial Sequence
  chemically synthesized
actgcaacctcctccgcctctc

SEQ ID NO: 26539 - DNA, 22 bp, Artificial Sequence
  chemically synthesized
caacctcctccgcctctcacct

SEQ ID NO: 26540 - DNA, 22 bp, Artificial Sequence
  chemically synthesized
ctccgcctctcacctcagcctc

SEQ ID NO: 26541 - DNA, 22 bp, Artificial Sequence
  chemically synthesized
cgcctctcacctcagcctcctg

SEQ ID NO: 26542 - DNA, 22 bp, Artificial Sequence
  chemically synthesized
tcacctcagcctcctgagtagc

SEQ ID NO: 26543 - DNA, 22 bp, Artificial Sequence
  chemically synthesized
acctcagcctcctgagtagctg

SEQ ID NO: 26544 - DNA, 22 bp, Artificial Sequence
  chemically synthesized
agcctcctgagtagctgggact

SEQ ID NO: 26545 - DNA, 22 bp, Artificial Sequence
  chemically synthesized
ctgagtagctgggactacagca

SEQ ID NO: 26546 - DNA, 22 bp, Artificial Sequence
  chemically synthesized
agtagctgggactacagcacca

SEQ ID NO: 26547 - DNA, 22 bp, Artificial Sequence
  chemically synthesized
ggactacagcaccaacacgccc

SEQ ID NO: 26548 - DNA, 22 bp, Artificial Sequence
  chemically synthesized
cagcaccaacacgcccagctaa

SEQ ID NO: 26549 - DNA, 22 bp, Artificial Sequence
  chemically synthesized
attttcgtaatgtttttgtaga

SEQ ID NO: 26550 - DNA, 22 bp, Artificial Sequence
  chemically synthesized
tcgtaatgtttttgtagagatg

SEQ ID NO: 26551 - DNA, 22 bp, Artificial Sequence
  chemically synthesized
cgtaatgtttttgtagagatgg

SEQ ID NO: 26552 - DNA, 22 bp, Artificial Sequence
  chemically synthesized
gtaatgtttttgtagagatgga

SEQ ID NO: 26553 - DNA, 22 bp, Artificial Sequence
  chemically synthesized
ttgtagagatggagtttcgcca

SEQ ID NO: 26554 - DNA, 22 bp, Artificial Sequence
  chemically synthesized
tgtagagatggagtttcgccat

SEQ ID NO: 26555 - DNA, 22 bp, Artificial Sequence
  chemically synthesized
gtagagatggagtttcgccatg

SEQ ID NO: 26556 - DNA, 22 bp, Artificial Sequence
  chemically synthesized
tagagatggagtttcgccatgt

SEQ ID NO: 26557 - DNA, 22 bp, Artificial Sequence
  chemically synthesized
cgccatgttgcccaggctggtc

SEQ ID NO: 26558 - DNA, 22 bp, Artificial Sequence
  chemically synthesized
gccatgttgcccaggctggtct

SEQ ID NO: 26559 - DNA, 22 bp, Artificial Sequence
  chemically synthesized
cccaggctggtcttgaactcct

SEQ ID NO: 26560 - DNA, 22 bp, Artificial Sequence
  chemically synthesized
gtcttgaactcctgagttcacc

SEQ ID NO: 26561 - DNA, 22 bp, Artificial Sequence
  chemically synthesized
gaactcctgagttcacccagga

SEQ ID NO: 26562 - DNA, 22 bp, Artificial Sequence
  chemically synthesized
aactcctgagttcacccaggag

SEQ ID NO: 26563 - DNA, 22 bp, Artificial Sequence
  chemically synthesized
ctgagttcacccaggagtgatt

SEQ ID NO: 26564 - DNA, 22 bp, Artificial Sequence
  chemically synthesized
agttcacccaggagtgattcgc

SEQ ID NO: 26565 - DNA, 22 bp, Artificial Sequence
  chemically synthesized
acccaggagtgattcgcccacc

SEQ ID NO: 26566 - DNA, 22 bp, Artificial Sequence
  chemically synthesized
gcccacctcggcctcccaaagt

SEQ ID NO: 26567 - DNA, 22 bp, Artificial Sequence
  chemically synthesized
ggcctcccaaagtgctgggatt

SEQ ID NO: 26568 - DNA, 22 bp, Artificial Sequence
  chemically synthesized
ccaaagtgctgggattacaggt

SEQ ID NO: 26569 - DNA, 22 bp, Artificial Sequence
  chemically synthesized
ggattacaggtgtgagccacca

SEQ ID NO: 26570 - DNA, 22 bp, Artificial Sequence
  chemically synthesized
caggtgtgagccaccatgcctg

SEQ ID NO: 26571 - DNA, 22 bp, Artificial Sequence
  chemically synthesized
gccccatacatctttctttatg

SEQ ID NO: 26572 - DNA, 22 bp, Artificial Sequence
  chemically synthesized
tctttatgttacctcttctgct

SEQ ID NO: 26573 - DNA, 22 bp, Artificial Sequence
  chemically synthesized
ctttatgttacctcttctgctt

SEQ ID NO: 26574 - DNA, 22 bp, Artificial Sequence
  chemically synthesized
tttatgttacctcttctgcttc

SEQ ID NO: 26575 - DNA, 22 bp, Artificial Sequence
  chemically synthesized
tatgttacctcttctgcttcat

SEQ ID NO: 26576 - DNA, 22 bp, Artificial Sequence
  chemically synthesized
atgttacctcttctgcttcata

SEQ ID NO: 26577 - DNA, 22 bp, Artificial Sequence
  chemically synthesized
tgttacctcttctgcttcatac

SEQ ID NO: 26578 - DNA, 22 bp, Artificial Sequence
  chemically synthesized
cctcttctgcttcatactaata

SEQ ID NO: 26579 - DNA, 22 bp, Artificial Sequence
  chemically synthesized
ttctgcttcatactaataaaac

SEQ ID NO: 26580 - DNA, 22 bp, Artificial Sequence
  chemically synthesized
ctgcttcatactaataaaactc

SEQ ID NO: 26581 - DNA, 22 bp, Artificial Sequence
  chemically synthesized
tgcttcatactaataaaactct

SEQ ID NO: 26582 - DNA, 22 bp, Artificial Sequence
  chemically synthesized
cttcatactaataaaactcttt

SEQ ID NO: 26583 - DNA, 22 bp, Artificial Sequence
  chemically synthesized
catactaataaaactctttgct

SEQ ID NO: 26584 - DNA, 22 bp, Artificial Sequence
  chemically synthesized
atactaataaaactctttgctc

SEQ ID NO: 26585 - DNA, 22 bp, Artificial Sequence
  chemically synthesized
ataaaactctttgctcaaagcc

SEQ ID NO: 26586 - DNA, 22 bp, Artificial Sequence
  chemically synthesized
tttgctcaaagcctatataact

SEQ ID NO: 26587 - DNA, 22 bp, Artificial Sequence
  chemically synthesized
tgctcaaagcctatataactca

SEQ ID NO: 26588 - DNA, 22 bp, Artificial Sequence
  chemically synthesized
gctcaaagcctatataactcag

SEQ ID NO: 26589 - DNA, 22 bp, Artificial Sequence
  chemically synthesized
ctcaaagcctatataactcaga

SEQ ID NO: 26590 - DNA, 22 bp, Artificial Sequence
  chemically synthesized
aaagcctatataactcagactt

SEQ ID NO: 26591 - DNA, 22 bp, Artificial Sequence
  chemically synthesized
tataactcagacttttcacgaa

SEQ ID NO: 26592 - DNA, 22 bp, Artificial Sequence
  chemically synthesized
agacttttcacgaaattcaact

SEQ ID NO: 26593 - DNA, 22 bp, Artificial Sequence
  chemically synthesized
ttcacgaaattcaactgtccta

SEQ ID NO: 26594 - DNA, 22 bp, Artificial Sequence
  chemically synthesized
tcacgaaattcaactgtcctac

SEQ ID NO: 26595 - DNA, 22 bp, Artificial Sequence
  chemically synthesized
cacgaaattcaactgtcctacc

SEQ ID NO: 26596 - DNA, 22 bp, Artificial Sequence
  chemically synthesized
acgaaattcaactgtcctaccc

SEQ ID NO: 26597 - DNA, 22 bp, Artificial Sequence
  chemically synthesized
aactgtcctaccctttaaccca

SEQ ID NO: 26598 - DNA, 22 bp, Artificial Sequence
  chemically synthesized
tcctaccctttaacccatatga

SEQ ID NO: 26599 - DNA, 22 bp, Artificial Sequence
  chemically synthesized
ccctttaacccatatgaaatag

SEQ ID NO: 26600 - DNA, 22 bp, Artificial Sequence
  chemically synthesized
taacccatatgaaataggcttt

SEQ ID NO: 26601 - DNA, 22 bp, Artificial Sequence
  chemically synthesized
aacccatatgaaataggctttc

SEQ ID NO: 26602 - DNA, 22 bp, Artificial Sequence
  chemically synthesized
acccatatgaaataggctttcc

SEQ ID NO: 26603 - DNA, 22 bp, Artificial Sequence
  chemically synthesized
tcctgtattttcaactcactgg

SEQ ID NO: 26604 - DNA, 22 bp, Artificial Sequence
  chemically synthesized
cctgtattttcaactcactggt

SEQ ID NO: 26605 - DNA, 22 bp, Artificial Sequence
  chemically synthesized
ctgtattttcaactcactggta

SEQ ID NO: 26606 - DNA, 22 bp, Artificial Sequence
  chemically synthesized
tattttcaactcactggtagga

SEQ ID NO: 26607 - DNA, 22 bp, Artificial Sequence
  chemically synthesized
tcaactcactggtaggattttt

SEQ ID NO: 26608 - DNA, 22 bp, Artificial Sequence
  chemically synthesized
caactcactggtaggatttttt

SEQ ID NO: 26609 - DNA, 22 bp, Artificial Sequence
  chemically synthesized
aactcactggtaggattttttc

SEQ ID NO: 26610 - DNA, 22 bp, Artificial Sequence
  chemically synthesized
actggtaggattttttctgtct

SEQ ID NO: 26611 - DNA, 22 bp, Artificial Sequence
  chemically synthesized
gtaggattttttctgtcttccc

SEQ ID NO: 26612 - DNA, 22 bp, Artificial Sequence
  chemically synthesized
tttctgtcttccccctttatgt

SEQ ID NO: 26613 - DNA, 22 bp, Artificial Sequence
  chemically synthesized
ttctgtcttccccctttatgta

SEQ ID NO: 26614 - DNA, 22 bp, Artificial Sequence
  chemically synthesized
tctgtcttccccctttatgtag

SEQ ID NO: 26615 - DNA, 22 bp, Artificial Sequence
  chemically synthesized
ctgtcttccccctttatgtaga

SEQ ID NO: 26616 - DNA, 22 bp, Artificial Sequence
  chemically synthesized
tgtcttccccctttatgtagat

SEQ ID NO: 26617 - DNA, 22 bp, Artificial Sequence
  chemically synthesized
tcttccccctttatgtagatga

SEQ ID NO: 26618 - DNA, 22 bp, Artificial Sequence
  chemically synthesized
ccccctttatgtagatgatcca

SEQ ID NO: 26619 - DNA, 22 bp, Artificial Sequence
  chemically synthesized
cccctttatgtagatgatccaa

SEQ ID NO: 26620 - DNA, 22 bp, Artificial Sequence
  chemically synthesized
tatgtagatgatccaaagtcag

SEQ ID NO: 26621 - DNA, 22 bp, Artificial Sequence
  chemically synthesized
atgtagatgatccaaagtcaga

SEQ ID NO: 26622 - DNA, 22 bp, Artificial Sequence
  chemically synthesized
tgtagatgatccaaagtcagag

SEQ ID NO: 26623 - DNA, 22 bp, Artificial Sequence
  chemically synthesized
gaagcatgagtagcccgtggct

SEQ ID NO: 26624 - DNA, 22 bp, Artificial Sequence
  chemically synthesized
cctgaatagcctggggaaagca

SEQ ID NO: 26625 - DNA, 22 bp, Artificial Sequence
  chemically synthesized
ctgaatagcctggggaaagcaa

SEQ ID NO: 26626 - DNA, 22 bp, Artificial Sequence
  chemically synthesized
aatagcctggggaaagcaactt

SEQ ID NO: 26627 - DNA, 22 bp, Artificial Sequence
  chemically synthesized
gggaaagcaacttctgatggac

SEQ ID NO: 26628 - DNA, 22 bp, Artificial Sequence
  chemically synthesized
ctgatggacagacattgcgaga

SEQ ID NO: 26629 - DNA, 22 bp, Artificial Sequence
  chemically synthesized
tgatggacagacattgcgagag

SEQ ID NO: 26630 - DNA, 22 bp, Artificial Sequence
  chemically synthesized
atggacagacattgcgagagcg

SEQ ID NO: 26631 - DNA, 22 bp, Artificial Sequence
  chemically synthesized
cgagagcgaatgccagcctctt

SEQ ID NO: 26632 - DNA, 22 bp, Artificial Sequence
  chemically synthesized
ttttcttgctgatctcctctct

SEQ ID NO: 26633 - DNA, 22 bp, Artificial Sequence
  chemically synthesized
ttcttgctgatctcctctctat

SEQ ID NO: 26634 - DNA, 22 bp, Artificial Sequence
  chemically synthesized
tcttgctgatctcctctctata

SEQ ID NO: 26635 - DNA, 22 bp, Artificial Sequence
  chemically synthesized
cttgctgatctcctctctatat

SEQ ID NO: 26636 - DNA, 22 bp, Artificial Sequence
  chemically synthesized
ttgctgatctcctctctatatg

SEQ ID NO: 26637 - DNA, 22 bp, Artificial Sequence
  chemically synthesized
gctgatctcctctctatatggt

SEQ ID NO: 26638 - DNA, 22 bp, Artificial Sequence
  chemically synthesized
ctgatctcctctctatatggtt

SEQ ID NO: 26639 - DNA, 22 bp, Artificial Sequence
  chemically synthesized
atctcctctctatatggttctt

SEQ ID NO: 26640 - DNA, 22 bp, Artificial Sequence
  chemically synthesized
ctctctatatggttcttaccac

SEQ ID NO: 26641 - DNA, 22 bp, Artificial Sequence
  chemically synthesized
tctatatggttcttaccactta

SEQ ID NO: 26642 - DNA, 22 bp, Artificial Sequence
  chemically synthesized
tatatggttcttaccacttaaa

SEQ ID NO: 26643 - DNA, 22 bp, Artificial Sequence
  chemically synthesized
tatggttcttaccacttaaaga

SEQ ID NO: 26644 - DNA, 22 bp, Artificial Sequence
  chemically synthesized
ttaccacttaaagacgaggttg

SEQ ID NO: 26645 - DNA, 22 bp, Artificial Sequence
  chemically synthesized
accacttaaagacgaggttgag

SEQ ID NO: 26646 - DNA, 22 bp, Artificial Sequence
  chemically synthesized
ccacttaaagacgaggttgagc

SEQ ID NO: 26647 - DNA, 22 bp, Artificial Sequence
  chemically synthesized
aaagacgaggttgagccagtct

SEQ ID NO: 26648 - DNA, 22 bp, Artificial Sequence
  chemically synthesized
aagacgaggttgagccagtctc

SEQ ID NO: 26649 - DNA, 22 bp, Artificial Sequence
  chemically synthesized
agccagtctccaatcacagcta

SEQ ID NO: 26650 - DNA, 22 bp, Artificial Sequence
  chemically synthesized
caatcacagctacccaaaggag

SEQ ID NO: 26651 - DNA, 22 bp, Artificial Sequence
  chemically synthesized
cccaaaggagtttaatgcccac

SEQ ID NO: 26652 - DNA, 22 bp, Artificial Sequence
  chemically synthesized
aatgcccacagcttcctgaaga

SEQ ID NO: 26653 - DNA, 22 bp, Artificial Sequence
  chemically synthesized
atgcccacagcttcctgaagat

SEQ ID NO: 26654 - DNA, 22 bp, Artificial Sequence
  chemically synthesized
cctgaagatggaaccagatggg

SEQ ID NO: 26655 - DNA, 22 bp, Artificial Sequence
  chemically synthesized
ctgaagatggaaccagatgggg

SEQ ID NO: 26656 - DNA, 22 bp, Artificial Sequence
  chemically synthesized
aagatggaaccagatggggaag

SEQ ID NO: 26657 - DNA, 22 bp, Artificial Sequence
  chemically synthesized
ctgaggtctgcgatcacggaca

SEQ ID NO: 26658 - DNA, 22 bp, Artificial Sequence
  chemically synthesized
aggtctgcgatcacggacacca

SEQ ID NO: 26659 - DNA, 22 bp, Artificial Sequence
  chemically synthesized
cgatcacggacaccaagatgaa

SEQ ID NO: 26660 - DNA, 22 bp, Artificial Sequence
  chemically synthesized
ggagtcttggtaattcacctgg

SEQ ID NO: 26661 - DNA, 22 bp, Artificial Sequence
  chemically synthesized
ggtaattcacctggaggtaatg

SEQ ID NO: 26662 - DNA, 22 bp, Artificial Sequence
  chemically synthesized
gtaattcacctggaggtaatgt

SEQ ID NO: 26663 - DNA, 22 bp, Artificial Sequence
  chemically synthesized
acctggaggtaatgtgttgact

SEQ ID NO: 26664 - DNA, 22 bp, Artificial Sequence
  chemically synthesized
gaggtaatgtgttgactggatc

SEQ ID NO: 26665 - DNA, 22 bp, Artificial Sequence
  chemically synthesized
actggatcccaaagtcatggag

SEQ ID NO: 26666 - DNA, 22 bp, Artificial Sequence
  chemically synthesized
gatcccaaagtcatggagaaca

SEQ ID NO: 26667 - DNA, 22 bp, Artificial Sequence
  chemically synthesized
attccttcctccatcctcattt

SEQ ID NO: 26668 - DNA, 22 bp, Artificial Sequence
  chemically synthesized
cttcctccatcctcatttcctt

SEQ ID NO: 26669 - DNA, 22 bp, Artificial Sequence
  chemically synthesized
cctccatcctcatttccttggc

SEQ ID NO: 26670 - DNA, 22 bp, Artificial Sequence
  chemically synthesized
ctccatcctcatttccttggca

SEQ ID NO: 26671 - DNA, 22 bp, Artificial Sequence
  chemically synthesized
catcctcatttccttggcacct

SEQ ID NO: 26672 - DNA, 22 bp, Artificial Sequence
  chemically synthesized
atttccttggcacctcaggaag

SEQ ID NO: 26673 - DNA, 22 bp, Artificial Sequence
  chemically synthesized
ccttggcacctcaggaagatgt

SEQ ID NO: 26674 - DNA, 22 bp, Artificial Sequence
  chemically synthesized
cttggcacctcaggaagatgtc

SEQ ID NO: 26675 - DNA, 22 bp, Artificial Sequence
  chemically synthesized
ggcacctcaggaagatgtcagc

SEQ ID NO: 26676 - DNA, 22 bp, Artificial Sequence
  chemically synthesized
gcacctcaggaagatgtcagca

SEQ ID NO: 26677 - DNA, 22 bp, Artificial Sequence
  chemically synthesized
aggaagatgtcagcagagccct

SEQ ID NO: 26678 - DNA, 22 bp, Artificial Sequence
  chemically synthesized
gcagttattccaggcttggtgg

SEQ ID NO: 26679 - DNA, 22 bp, Artificial Sequence
  chemically synthesized
cagttattccaggcttggtggt

SEQ ID NO: 26680 - DNA, 22 bp, Artificial Sequence
  chemically synthesized
ttccaggcttggtggtgattgc

SEQ ID NO: 26681 - DNA, 22 bp, Artificial Sequence
  chemically synthesized
caggcttggtggtgattgctct

SEQ ID NO: 26682 - DNA, 22 bp, Artificial Sequence
  chemically synthesized
ggtggtgattgctctgctatga

SEQ ID NO: 26683 - DNA, 22 bp, Artificial Sequence
  chemically synthesized
gtggtgattgctctgctatgag

SEQ ID NO: 26684 - DNA, 22 bp, Artificial Sequence
  chemically synthesized
ctctgctatgagtctgtgcctt

SEQ ID NO: 26685 - DNA, 22 bp, Artificial Sequence
  chemically synthesized
tgctatgagtctgtgccttgcc

SEQ ID NO: 26686 - DNA, 22 bp, Artificial Sequence
  chemically synthesized
ctatgagtctgtgccttgcccc

SEQ ID NO: 26687 - DNA, 22 bp, Artificial Sequence
  chemically synthesized
tgagtctgtgccttgcccctgt

SEQ ID NO: 26688 - DNA, 22 bp, Artificial Sequence
  chemically synthesized
tgccttgcccctgttttatatg

SEQ ID NO: 26689 - DNA, 22 bp, Artificial Sequence
  chemically synthesized
gcccctgttttatatgccctgt

SEQ ID NO: 26690 - DNA, 22 bp, Artificial Sequence
  chemically synthesized
cccctgttttatatgccctgta

SEQ ID NO: 26691 - DNA, 22 bp, Artificial Sequence
  chemically synthesized
ttttatatgccctgtatccagt

SEQ ID NO: 26692 - DNA, 22 bp, Artificial Sequence
  chemically synthesized
tatatgccctgtatccagtatt

SEQ ID NO: 26693 - DNA, 22 bp, Artificial Sequence
  chemically synthesized
atatgccctgtatccagtattc

SEQ ID NO: 26694 - DNA, 22 bp, Artificial Sequence
  chemically synthesized
tatgccctgtatccagtattca

SEQ ID NO: 26695 - DNA, 22 bp, Artificial Sequence
  chemically synthesized
tatccagtattcaggtcaaccc

SEQ ID NO: 26696 - DNA, 22 bp, Artificial Sequence
  chemically synthesized
aggtcaacccagccctgatctt

SEQ ID NO: 26697 - DNA, 22 bp, Artificial Sequence
  chemically synthesized
atctttggactcaaaaaccacg

SEQ ID NO: 26698 - DNA, 22 bp, Artificial Sequence
  chemically synthesized
tggactcaaaaaccacgtttgt

SEQ ID NO: 26699 - DNA, 22 bp, Artificial Sequence
  chemically synthesized
ggactcaaaaaccacgtttgtc

SEQ ID NO: 26700 - DNA, 22 bp, Artificial Sequence
  chemically synthesized
gactcaaaaaccacgtttgtct

SEQ ID NO: 26701 - DNA, 22 bp, Artificial Sequence
  chemically synthesized
aaaaaccacgtttgtctaaaat

SEQ ID NO: 26702 - DNA, 20 bp, Artificial Sequence
  chemically synthesized
tgcgtccactgctcttctga

SEQ ID NO: 26703 - DNA, 20 bp, Artificial Sequence
  chemically synthesized
tcttctgacagcatcattta

SEQ ID NO: 26704 - DNA, 20 bp, Artificial Sequence
  chemically synthesized
cttctgacagcatcatttac

SEQ ID NO: 26705 - DNA, 20 bp, Artificial Sequence
  chemically synthesized
aggttcacactgttccacct

SEQ ID NO: 26706 - DNA, 20 bp, Artificial Sequence
  chemically synthesized
ttcatattatgctcaaaata

SEQ ID NO: 26707 - DNA, 20 bp, Artificial Sequence
  chemically synthesized
tgctcaaaatatggacctat

SEQ ID NO: 26708 - DNA, 20 bp, Artificial Sequence
  chemically synthesized
aatatggacctatcagaaaa

SEQ ID NO: 26709 - DNA, 20 bp, Artificial Sequence
  chemically synthesized
ccattcatctgctgttgttt

SEQ ID NO: 26710 - DNA, 20 bp, Artificial Sequence
  chemically synthesized
tttggcctttgtctgaatca

SEQ ID NO: 26711 - DNA, 20 bp, Artificial Sequence
  chemically synthesized
cctttgtctgaatcacagta

SEQ ID NO: 26712 - DNA, 20 bp, Artificial Sequence
  chemically synthesized
tagatgcctccaactgttaa

SEQ ID NO: 26713 - DNA, 20 bp, Artificial Sequence
  chemically synthesized
agatgcctccaactgttaaa

SEQ ID NO: 26714 - DNA, 20 bp, Artificial Sequence
  chemically synthesized
tccaactgttaaaaggaaaa

SEQ ID NO: 26715 - DNA, 20 bp, Artificial Sequence
  chemically synthesized
aaaaagtttctattatcatt

SEQ ID NO: 26716 - DNA, 20 bp, Artificial Sequence
  chemically synthesized
aaaagtttctattatcattc

SEQ ID NO: 26717 - DNA, 20 bp, Artificial Sequence
  chemically synthesized
gtttctattatcattcaggt

SEQ ID NO: 26718 - DNA, 20 bp, Artificial Sequence
  chemically synthesized
tcaggttagcaatttgttta

SEQ ID NO: 26719 - DNA, 20 bp, Artificial Sequence
  chemically synthesized
agcaatttgtttaaagtaat

SEQ ID NO: 26720 - DNA, 20 bp, Artificial Sequence
  chemically synthesized
gcaatttgtttaaagtaata

SEQ ID NO: 26721 - DNA, 20 bp, Artificial Sequence
  chemically synthesized
caatttgtttaaagtaataa

SEQ ID NO: 26722 - DNA, 20 bp, Artificial Sequence
  chemically synthesized
ttgtttaaagtaataaggga

SEQ ID NO: 26723 - DNA, 20 bp, Artificial Sequence
  chemically synthesized
aagtaataagggatggaaat

SEQ ID NO: 26724 - DNA, 20 bp, Artificial Sequence
  chemically synthesized
ataagggatggaaatgagtt

SEQ ID NO: 26725 - DNA, 20 bp, Artificial Sequence
  chemically synthesized
atgagttcagatttttaaat

SEQ ID NO: 26726 - DNA, 20 bp, Artificial Sequence
  chemically synthesized
cagatttttaaattagcatt

SEQ ID NO: 26727 - DNA, 20 bp, Artificial Sequence
  chemically synthesized
agatttttaaattagcattt

SEQ ID NO: 26728 - DNA, 20 bp, Artificial Sequence
  chemically synthesized
attagcatttaggatccact

SEQ ID NO: 26729 - DNA, 20 bp, Artificial Sequence
  chemically synthesized
atttaggatccactaagccc

SEQ ID NO: 26730 - DNA, 20 bp, Artificial Sequence
  chemically synthesized
tttaggatccactaagccca

SEQ ID NO: 26731 - DNA, 20 bp, Artificial Sequence
  chemically synthesized
tatttacctttcaaaaataa

SEQ ID NO: 26732 - DNA, 20 bp, Artificial Sequence
  chemically synthesized
atagtatttgacatattgtt

SEQ ID NO: 26733 - DNA, 20 bp, Artificial Sequence
  chemically synthesized
tagtatttgacatattgtta

SEQ ID NO: 26734 - DNA, 20 bp, Artificial Sequence
  chemically synthesized
agtatttgacatattgttaa

SEQ ID NO: 26735 - DNA, 20 bp, Artificial Sequence
  chemically synthesized
tgttaagggacaccaacgaa

SEQ ID NO: 26736 - DNA, 20 bp, Artificial Sequence
  chemically synthesized
tcaattctgtgcatgtttta

SEQ ID NO: 26737 - DNA, 20 bp, Artificial Sequence
  chemically synthesized
gcatgttttaaagtcccttc

SEQ ID NO: 26738 - DNA, 20 bp, Artificial Sequence
  chemically synthesized
catgttttaaagtcccttct

SEQ ID NO: 26739 - DNA, 20 bp, Artificial Sequence
  chemically synthesized
ccttctaggtgcatgtgaaa

SEQ ID NO: 26740 - DNA, 20 bp, Artificial Sequence
  chemically synthesized
tctaggtgcatgtgaaatag

SEQ ID NO: 26741 - DNA, 20 bp, Artificial Sequence
  chemically synthesized
aggtgcatgtgaaatagcag

SEQ ID NO: 26742 - DNA, 20 bp, Artificial Sequence
  chemically synthesized
ggtgcatgtgaaatagcagc

SEQ ID NO: 26743 - DNA, 20 bp, Artificial Sequence
  chemically synthesized
agcagcaggctgatgccgca

SEQ ID NO: 26744 - DNA, 20 bp, Artificial Sequence
  chemically synthesized
cagcaggctgatgccgcaaa

SEQ ID NO: 26745 - DNA, 20 bp, Artificial Sequence
  chemically synthesized
agcaggctgatgccgcaaag

SEQ ID NO: 26746 - DNA, 20 bp, Artificial Sequence
  chemically synthesized
aagaggtcaaatacctcaaa

SEQ ID NO: 26747 - DNA, 20 bp, Artificial Sequence
  chemically synthesized
ggtcaaatacctcaaaaaga

SEQ ID NO: 26748 - DNA, 20 bp, Artificial Sequence
  chemically synthesized
tcaaatacctcaaaaagaaa

SEQ ID NO: 26749 - DNA, 20 bp, Artificial Sequence
  chemically synthesized
tcaaaaagaaagagtctgaa

SEQ ID NO: 26750 - DNA, 20 bp, Artificial Sequence
  chemically synthesized
aaagagtctgaaaagacaat

SEQ ID NO: 26751 - DNA, 20 bp, Artificial Sequence
  chemically synthesized
agagtctgaaaagacaattg

SEQ ID NO: 26752 - DNA, 20 bp, Artificial Sequence
  chemically synthesized
ttggagtaactacttgccta

SEQ ID NO: 26753 - DNA, 20 bp, Artificial Sequence
  chemically synthesized
taactacttgcctaaagctc

SEQ ID NO: 26754 - DNA, 20 bp, Artificial Sequence
  chemically synthesized
ctaaagctccagtcactttg

SEQ ID NO: 26755 - DNA, 20 bp, Artificial Sequence
  chemically synthesized
ccagtcactttgtagtgtca

SEQ ID NO: 26756 - DNA, 20 bp, Artificial Sequence
  chemically synthesized
tcactttgtagtgtcaaagt

SEQ ID NO: 26757 - DNA, 20 bp, Artificial Sequence
  chemically synthesized
cactttgtagtgtcaaagtt

SEQ ID NO: 26758 - DNA, 20 bp, Artificial Sequence
  chemically synthesized
attgtcatcatacatgccct

SEQ ID NO: 26759 - DNA, 20 bp, Artificial Sequence
  chemically synthesized
gtcatcatacatgccctcag

SEQ ID NO: 26760 - DNA, 20 bp, Artificial Sequence
  chemically synthesized
atcatacatgccctcagcag

SEQ ID NO: 26761 - DNA, 20 bp, Artificial Sequence
  chemically synthesized
ctctcttcctccttctccta

SEQ ID NO: 26762 - DNA, 20 bp, Artificial Sequence
  chemically synthesized
tcttcctccttctcctacag

SEQ ID NO: 26763 - DNA, 20 bp, Artificial Sequence
  chemically synthesized
ctccttctcctacagtggtc

SEQ ID NO: 26764 - DNA, 20 bp, Artificial Sequence
  chemically synthesized
cttctcctacagtggtccag

SEQ ID NO: 26765 - DNA, 20 bp, Artificial Sequence
  chemically synthesized
ttctcctacagtggtccaga

SEQ ID NO: 26766 - DNA, 20 bp, Artificial Sequence
  chemically synthesized
tctcctacagtggtccagaa

SEQ ID NO: 26767 - DNA, 20 bp, Artificial Sequence
  chemically synthesized
ctcctacagtggtccagaag

SEQ ID NO: 26768 - DNA, 20 bp, Artificial Sequence
  chemically synthesized
acagtggtccagaaggggct

SEQ ID NO: 26769 - DNA, 20 bp, Artificial Sequence
  chemically synthesized
cagtggtccagaaggggctc

SEQ ID NO: 26770 - DNA, 20 bp, Artificial Sequence
  chemically synthesized
gctcaggtatgttcaaataa

SEQ ID NO: 26771 - DNA, 20 bp, Artificial Sequence
  chemically synthesized
tgttcaaataacagctgctg

SEQ ID NO: 26772 - DNA, 20 bp, Artificial Sequence
  chemically synthesized
tgctgtggttttcaattatg

SEQ ID NO: 26773 - DNA, 20 bp, Artificial Sequence
  chemically synthesized
caattatgaagaaatctcct

SEQ ID NO: 26774 - DNA, 20 bp, Artificial Sequence
  chemically synthesized
aagaaatctcctaagctaca

SEQ ID NO: 26775 - DNA, 20 bp, Artificial Sequence
  chemically synthesized
acatagtcatttatctttta

SEQ ID NO: 26776 - DNA, 20 bp, Artificial Sequence
  chemically synthesized
catttatcttttaaagcacc

SEQ ID NO: 26777 - DNA, 20 bp, Artificial Sequence
  chemically synthesized
atcttttaaagcaccaagca

SEQ ID NO: 26778 - DNA, 20 bp, Artificial Sequence
  chemically synthesized
caagcaaagtaccttttgat

SEQ ID NO: 26779 - DNA, 20 bp, Artificial Sequence
  chemically synthesized
aagcaaagtaccttttgata

SEQ ID NO: 26780 - DNA, 20 bp, Artificial Sequence
  chemically synthesized
gcaaagtaccttttgataag

SEQ ID NO: 26781 - DNA, 20 bp, Artificial Sequence
  chemically synthesized
tgataaggagaacgtgctta

SEQ ID NO: 26782 - DNA, 20 bp, Artificial Sequence
  chemically synthesized
aacgtgcttatagatgttca

SEQ ID NO: 26783 - DNA, 20 bp, Artificial Sequence
  chemically synthesized
gtgcttatagatgttcatag

SEQ ID NO: 26784 - DNA, 20 bp, Artificial Sequence
  chemically synthesized
agatgttcatagaagatgct

SEQ ID NO: 26785 - DNA, 20 bp, Artificial Sequence
  chemically synthesized
atacgtatttcattctcaca

SEQ ID NO: 26786 - DNA, 20 bp, Artificial Sequence
  chemically synthesized
acatggtatttctctcttcc

SEQ ID NO: 26787 - DNA, 20 bp, Artificial Sequence
  chemically synthesized
ggtatttctctcttcctagt

SEQ ID NO: 26788 - DNA, 20 bp, Artificial Sequence
  chemically synthesized
gtatttctctcttcctagta

SEQ ID NO: 26789 - DNA, 20 bp, Artificial Sequence
  chemically synthesized
tatttctctcttcctagtaa

SEQ ID NO: 26790 - DNA, 20 bp, Artificial Sequence
  chemically synthesized
tttctctcttcctagtaagg

SEQ ID NO: 26791 - DNA, 20 bp, Artificial Sequence
  chemically synthesized
ttctctcttcctagtaaggg

SEQ ID NO: 26792 - DNA, 20 bp, Artificial Sequence
  chemically synthesized
ctctcttcctagtaagggag

SEQ ID NO: 26793 - DNA, 20 bp, Artificial Sequence
  chemically synthesized
atgcccaatttctgcctcca

SEQ ID NO: 26794 - DNA, 20 bp, Artificial Sequence
  chemically synthesized
ccaatttctgcctccaaaga

SEQ ID NO: 26795 - DNA, 20 bp, Artificial Sequence
  chemically synthesized
atttctgcctccaaagaaag

SEQ ID NO: 26796 - DNA, 20 bp, Artificial Sequence
  chemically synthesized
tctgcctccaaagaaagaag

SEQ ID NO: 26797 - DNA, 20 bp, Artificial Sequence
  chemically synthesized
aaagaagaagtaaaaactaa

SEQ ID NO: 26798 - DNA, 20 bp, Artificial Sequence
  chemically synthesized
aagaagaagtaaaaactaaa

SEQ ID NO: 26799 - DNA, 20 bp, Artificial Sequence
  chemically synthesized
aagaagtaaaaactaaaagg

SEQ ID NO: 26800 - DNA, 20 bp, Artificial Sequence
  chemically synthesized
aaaggcagaaatgaaatcca

SEQ ID NO: 26801 - DNA, 20 bp, Artificial Sequence
  chemically synthesized
aaggcagaaatgaaatccac

SEQ ID NO: 26802 - DNA, 20 bp, Artificial Sequence
  chemically synthesized
aaatgaaatccacaggcaaa

SEQ ID NO: 26803 - DNA, 20 bp, Artificial Sequence
  chemically synthesized
aatccacaggcaaacagcct

SEQ ID NO: 26804 - DNA, 20 bp, Artificial Sequence
  chemically synthesized
aacagcctgagaccacatcc

SEQ ID NO: 26805 - DNA, 20 bp, Artificial Sequence
  chemically synthesized
acagcctgagaccacatcct

SEQ ID NO: 26806 - DNA, 20 bp, Artificial Sequence
  chemically synthesized
ctgagaccacatcctgggcc

SEQ ID NO: 26807 - DNA, 20 bp, Artificial Sequence
  chemically synthesized
ccacatcctgggcctggtta

SEQ ID NO: 26808 - DNA, 20 bp, Artificial Sequence
  chemically synthesized
atcctgggcctggttaaaga

SEQ ID NO: 26809 - DNA, 20 bp, Artificial Sequence
  chemically synthesized
ttaaagatagacccctgacc

SEQ ID NO: 26810 - DNA, 20 bp, Artificial Sequence
  chemically synthesized
agatagacccctgacctggc

SEQ ID NO: 26811 - DNA, 20 bp, Artificial Sequence
  chemically synthesized
ctggccagttatgttatcta

SEQ ID NO: 26812 - DNA, 20 bp, Artificial Sequence
  chemically synthesized
gttatgttatctatagattc

SEQ ID NO: 26813 - DNA, 20 bp, Artificial Sequence
  chemically synthesized
tatagattccagacactgta

SEQ ID NO: 26814 - DNA, 20 bp, Artificial Sequence
  chemically synthesized
attccagacactgtatggaa

SEQ ID NO: 26815 - DNA, 20 bp, Artificial Sequence
  chemically synthesized
ccagacactgtatggaaaag

SEQ ID NO: 26816 - DNA, 20 bp, Artificial Sequence
  chemically synthesized
ttctgttccattctgatgac

SEQ ID NO: 26817 - DNA, 20 bp, Artificial Sequence
  chemically synthesized
attctgatgaccagtgcatg

SEQ ID NO: 26818 - DNA, 20 bp, Artificial Sequence
  chemically synthesized
tgaccagtgcatgcagcccc

SEQ ID NO: 26819 - DNA, 20 bp, Artificial Sequence
  chemically synthesized
cccccagtcatgtaccccct

SEQ ID NO: 26820 - DNA, 20 bp, Artificial Sequence
  chemically synthesized
cccagtcatgtaccccctta

SEQ ID NO: 26821 - DNA, 20 bp, Artificial Sequence
  chemically synthesized
atgtacccccttagagttgt

SEQ ID NO: 26822 - DNA, 20 bp, Artificial Sequence
  chemically synthesized
ttagagttgtaagcccttaa

SEQ ID NO: 26823 - DNA, 20 bp, Artificial Sequence
  chemically synthesized
tagagttgtaagcccttaaa

SEQ ID NO: 26824 - DNA, 20 bp, Artificial Sequence
  chemically synthesized
agagttgtaagcccttaaaa

SEQ ID NO: 26825 - DNA, 20 bp, Artificial Sequence
  chemically synthesized
ttgtaagcccttaaaaggga

SEQ ID NO: 26826 - DNA, 20 bp, Artificial Sequence
  chemically synthesized
tgtaagcccttaaaagggac

SEQ ID NO: 26827 - DNA, 20 bp, Artificial Sequence
  chemically synthesized
ggacaggaattgctcactct

SEQ ID NO: 26828 - DNA, 20 bp, Artificial Sequence
  chemically synthesized
acaggaattgctcactctga

SEQ ID NO: 26829 - DNA, 20 bp, Artificial Sequence
  chemically synthesized
aattgctcactctgagagct

SEQ ID NO: 26830 - DNA, 20 bp, Artificial Sequence
  chemically synthesized
cactctgagagcttggttgt

SEQ ID NO: 26831 - DNA, 20 bp, Artificial Sequence
  chemically synthesized
ctctgagagcttggttgttg

SEQ ID NO: 26832 - DNA, 20 bp, Artificial Sequence
  chemically synthesized
agcttggttgttggagatgt

SEQ ID NO: 26833 - DNA, 20 bp, Artificial Sequence
  chemically synthesized
tggagatgtgagtcttgccc

SEQ ID NO: 26834 - DNA, 20 bp, Artificial Sequence
  chemically synthesized
gtgagtcttgcccaagctcc

SEQ ID NO: 26835 - DNA, 20 bp, Artificial Sequence
  chemically synthesized
cccaagctcccagccgaata

SEQ ID NO: 26836 - DNA, 20 bp, Artificial Sequence
  chemically synthesized
aagcccttccttctttaact

SEQ ID NO: 26837 - DNA, 20 bp, Artificial Sequence
  chemically synthesized
ccttctttaactcggtgtct

SEQ ID NO: 26838 - DNA, 20 bp, Artificial Sequence
  chemically synthesized
cttctttaactcggtgtctg

SEQ ID NO: 26839 - DNA, 20 bp, Artificial Sequence
  chemically synthesized
ttctttaactcggtgtctga

SEQ ID NO: 26840 - DNA, 20 bp, Artificial Sequence
  chemically synthesized
tctttaactcggtgtctgag

SEQ ID NO: 26841 - DNA, 20 bp, Artificial Sequence
  chemically synthesized
tgtctgaggggttttgtatg

SEQ ID NO: 26842 - DNA, 20 bp, Artificial Sequence
  chemically synthesized
tgcagcttgtcctgctacac

SEQ ID NO: 26843 - DNA, 20 bp, Artificial Sequence
  chemically synthesized
gctacctctattaaaacaca

SEQ ID NO: 26844 - DNA, 20 bp, Artificial Sequence
  chemically synthesized
aaacacaaagccacaatata

SEQ ID NO: 26845 - DNA, 20 bp, Artificial Sequence
  chemically synthesized
ccacaatatatggatacatt

SEQ ID NO: 26846 - DNA, 20 bp, Artificial Sequence
  chemically synthesized
tttggaaaatatgcacactt

SEQ ID NO: 26847 - DNA, 20 bp, Artificial Sequence
  chemically synthesized
aaatatgcacactttggatc

SEQ ID NO: 26848 - DNA, 20 bp, Artificial Sequence
  chemically synthesized
atgcacactttggatccagc

SEQ ID NO: 26849 - DNA, 20 bp, Artificial Sequence
  chemically synthesized
ggatccagcaagtccacatc

SEQ ID NO: 26850 - DNA, 20 bp, Artificial Sequence
  chemically synthesized
ccacatctagaaaaccatcc

SEQ ID NO: 26851 - DNA, 20 bp, Artificial Sequence
  chemically synthesized
cacatctagaaaaccatcct

SEQ ID NO: 26852 - DNA, 20 bp, Artificial Sequence
  chemically synthesized
acatctagaaaaccatcctg

SEQ ID NO: 26853 - DNA, 20 bp, Artificial Sequence
  chemically synthesized
catctagaaaaccatcctgg

SEQ ID NO: 26854 - DNA, 20 bp, Artificial Sequence
  chemically synthesized
aaccatcctgggggaaaatt

SEQ ID NO: 26855 - DNA, 20 bp, Artificial Sequence
  chemically synthesized
accatcctgggggaaaatta

SEQ ID NO: 26856 - DNA, 20 bp, Artificial Sequence
  chemically synthesized
catcctgggggaaaattaag

SEQ ID NO: 26857 - DNA, 20 bp, Artificial Sequence
  chemically synthesized
tcctgggggaaaattaagga

SEQ ID NO: 26858 - DNA, 20 bp, Artificial Sequence
  chemically synthesized
aaaattaaggagagtatgaa

SEQ ID NO: 26859 - DNA, 20 bp, Artificial Sequence
  chemically synthesized
aaattaaggagagtatgaaa

SEQ ID NO: 26860 - DNA, 20 bp, Artificial Sequence
  chemically synthesized
tatgaaaaggatgtttacta

SEQ ID NO: 26861 - DNA, 20 bp, Artificial Sequence
  chemically synthesized
tgtttactaaagcattatga

SEQ ID NO: 26862 - DNA, 20 bp, Artificial Sequence
  chemically synthesized
gcattatgatggcaaaaaat

SEQ ID NO: 26863 - DNA, 20 bp, Artificial Sequence
  chemically synthesized
agaaacaacttacactgaac

SEQ ID NO: 26864 - DNA, 20 bp, Artificial Sequence
  chemically synthesized
gaactagtcaacttacttaa

SEQ ID NO: 26865 - DNA, 20 bp, Artificial Sequence
  chemically synthesized
tagtcaacttacttaacaga

SEQ ID NO: 26866 - DNA, 20 bp, Artificial Sequence
  chemically synthesized
tcaacttacttaacagacag

SEQ ID NO: 26867 - DNA, 20 bp, Artificial Sequence
  chemically synthesized
caacttacttaacagacaga

SEQ ID NO: 26868 - DNA, 20 bp, Artificial Sequence
  chemically synthesized
taacagacagaaggctcaat

SEQ ID NO: 26869 - DNA, 20 bp, Artificial Sequence
  chemically synthesized
caattagctcatgtgtcaaa

SEQ ID NO: 26870 - DNA, 20 bp, Artificial Sequence
  chemically synthesized
aattagctcatgtgtcaaat

SEQ ID NO: 26871 - DNA, 20 bp, Artificial Sequence
  chemically synthesized
attagctcatgtgtcaaatg

SEQ ID NO: 26872 - DNA, 20 bp, Artificial Sequence
  chemically synthesized
ttagctcatgtgtcaaatgg

SEQ ID NO: 26873 - DNA, 20 bp, Artificial Sequence
  chemically synthesized
aatgggggtaaaataatatt

SEQ ID NO: 26874 - DNA, 20 bp, Artificial Sequence
  chemically synthesized
gggtaaaataatatttagtt

SEQ ID NO: 26875 - DNA, 20 bp, Artificial Sequence
  chemically synthesized
gtaaaataatatttagtttg

SEQ ID NO: 26876 - DNA, 20 bp, Artificial Sequence
  chemically synthesized
taaaataatatttagtttgg

SEQ ID NO: 26877 - DNA, 20 bp, Artificial Sequence
  chemically synthesized
aaaataatatttagtttgga

SEQ ID NO: 26878 - DNA, 20 bp, Artificial Sequence
  chemically synthesized
taatatttagtttggaggga

SEQ ID NO: 26879 - DNA, 20 bp, Artificial Sequence
  chemically synthesized
atttagtttggagggaaaga

SEQ ID NO: 26880 - DNA, 20 bp, Artificial Sequence
  chemically synthesized
tttagtttggagggaaagac

SEQ ID NO: 26881 - DNA, 20 bp, Artificial Sequence
  chemically synthesized
gagggaaagacaggctctaa

SEQ ID NO: 26882 - DNA, 20 bp, Artificial Sequence
  chemically synthesized
gggaaagacaggctctaaaa

SEQ ID NO: 26883 - DNA, 20 bp, Artificial Sequence
  chemically synthesized
ggaaagacaggctctaaaag

SEQ ID NO: 26884 - DNA, 20 bp, Artificial Sequence
  chemically synthesized
tctaaaagaggattaaaaat

SEQ ID NO: 26885 - DNA, 20 bp, Artificial Sequence
  chemically synthesized
agaggattaaaaattagatg

SEQ ID NO: 26886 - DNA, 20 bp, Artificial Sequence
  chemically synthesized
attaaaaattagatgtggcc

SEQ ID NO: 26887 - DNA, 20 bp, Artificial Sequence
  chemically synthesized
ttaaaaattagatgtggcct

SEQ ID NO: 26888 - DNA, 20 bp, Artificial Sequence
  chemically synthesized
aattagatgtggcctaggca

SEQ ID NO: 26889 - DNA, 20 bp, Artificial Sequence
  chemically synthesized
taggcaaagaatttatgacc

SEQ ID NO: 26890 - DNA, 20 bp, Artificial Sequence
  chemically synthesized
aaacacaacaaaaacaaaaa

SEQ ID NO: 26891 - DNA, 20 bp, Artificial Sequence
  chemically synthesized
caaaaacaaaaacagacaaa

SEQ ID NO: 26892 - DNA, 20 bp, Artificial Sequence
  chemically synthesized
aaaaacaaaaacagacaaat

SEQ ID NO: 26893 - DNA, 20 bp, Artificial Sequence
  chemically synthesized
aaaatgcttctgcaccgcaa

SEQ ID NO: 26894 - DNA, 20 bp, Artificial Sequence
  chemically synthesized
accgcaaaagaccgaatcaa

SEQ ID NO: 26895 - DNA, 20 bp, Artificial Sequence
  chemically synthesized
cgcaaaagaccgaatcaaca

SEQ ID NO: 26896 - DNA, 20 bp, Artificial Sequence
  chemically synthesized
gaccgaatcaacagagtaaa

SEQ ID NO: 26897 - DNA, 20 bp, Artificial Sequence
  chemically synthesized
cagagtaaacggataaccta

SEQ ID NO: 26898 - DNA, 20 bp, Artificial Sequence
  chemically synthesized
aaacggataacctacagaat

SEQ ID NO: 26899 - DNA, 20 bp, Artificial Sequence
  chemically synthesized
gcaaactatgaatgcaacaa

SEQ ID NO: 26900 - DNA, 20 bp, Artificial Sequence
  chemically synthesized
caaactatgaatgcaacaaa

SEQ ID NO: 26901 - DNA, 20 bp, Artificial Sequence
  chemically synthesized
tgcaacaaaaggctaatata

SEQ ID NO: 26902 - DNA, 20 bp, Artificial Sequence
  chemically synthesized
ggctaatatacagaatctac

SEQ ID NO: 26903 - DNA, 20 bp, Artificial Sequence
  chemically synthesized
gctaatatacagaatctaca

SEQ ID NO: 26904 - DNA, 20 bp, Artificial Sequence
  chemically synthesized
aacaaaaaaaccaacctcat

SEQ ID NO: 26905 - DNA, 20 bp, Artificial Sequence
  chemically synthesized
aaaaaaccaacctcattaga

SEQ ID NO: 26906 - DNA, 20 bp, Artificial Sequence
  chemically synthesized
tcattagaaagtgactgtga

SEQ ID NO: 26907 - DNA, 20 bp, Artificial Sequence
  chemically synthesized
tgactgtgatggttaatact

SEQ ID NO: 26908 - DNA, 20 bp, Artificial Sequence
  chemically synthesized
atactgagtgtcaacttgat

SEQ ID NO: 26909 - DNA, 20 bp, Artificial Sequence
  chemically synthesized
gtgtcaacttgattggactg

SEQ ID NO: 26910 - DNA, 20 bp, Artificial Sequence
  chemically synthesized
tgtcaacttgattggactga

SEQ ID NO: 26911 - DNA, 20 bp, Artificial Sequence
  chemically synthesized
tgattggactgaaggatgca

SEQ ID NO: 26912 - DNA, 20 bp, Artificial Sequence
  chemically synthesized
aggatgcaaagtaatgatct

SEQ ID NO: 26913 - DNA, 20 bp, Artificial Sequence
  chemically synthesized
ggatgcaaagtaatgatctt

SEQ ID NO: 26914 - DNA, 20 bp, Artificial Sequence
  chemically synthesized
atgatcttgggtgtgtctgt

SEQ ID NO: 26915 - DNA, 20 bp, Artificial Sequence
  chemically synthesized
tgatcttgggtgtgtctgtg

SEQ ID NO: 26916 - DNA, 20 bp, Artificial Sequence
  chemically synthesized
gatcttgggtgtgtctgtga

SEQ ID NO: 26917 - DNA, 20 bp, Artificial Sequence
  chemically synthesized
tgtctgtgagggtgttacca

SEQ ID NO: 26918 - DNA, 20 bp, Artificial Sequence
  chemically synthesized
gtctgtgagggtgttaccaa

SEQ ID NO: 26919 - DNA, 20 bp, Artificial Sequence
  chemically synthesized
ctgtgagggtgttaccaaag

SEQ ID NO: 26920 - DNA, 20 bp, Artificial Sequence
  chemically synthesized
accaaaggagattaatattt

SEQ ID NO: 26921 - DNA, 20 bp, Artificial Sequence
  chemically synthesized
aaggagattaatatttcagt

SEQ ID NO: 26922 - DNA, 20 bp, Artificial Sequence
  chemically synthesized
gagattaatatttcagtcag

SEQ ID NO: 26923 - DNA, 20 bp, Artificial Sequence
  chemically synthesized
agattaatatttcagtcagt

SEQ ID NO: 26924 - DNA, 20 bp, Artificial Sequence
  chemically synthesized
taatatttcagtcagtgggc

SEQ ID NO: 26925 - DNA, 20 bp, Artificial Sequence
  chemically synthesized
aatatttcagtcagtgggct

SEQ ID NO: 26926 - DNA, 20 bp, Artificial Sequence
  chemically synthesized
atatttcagtcagtgggctg

SEQ ID NO: 26927 - DNA, 20 bp, Artificial Sequence
  chemically synthesized
tttcagtcagtgggctgggg

SEQ ID NO: 26928 - DNA, 20 bp, Artificial Sequence
  chemically synthesized
ttcagtcagtgggctgggga

SEQ ID NO: 26929 - DNA, 20 bp, Artificial Sequence
  chemically synthesized
agtcagtgggctggggaagg

SEQ ID NO: 26930 - DNA, 20 bp, Artificial Sequence
  chemically synthesized
aggcagacccacccttaatc

SEQ ID NO: 26931 - DNA, 20 bp, Artificial Sequence
  chemically synthesized
ggcagacccacccttaatct

SEQ ID NO: 26932 - DNA, 20 bp, Artificial Sequence
  chemically synthesized
agacccacccttaatctggg

SEQ ID NO: 26933 - DNA, 20 bp, Artificial Sequence
  chemically synthesized
gacccacccttaatctgggt

SEQ ID NO: 26934 - DNA, 20 bp, Artificial Sequence
  chemically synthesized
ctgggtgggcaccatctaat

SEQ ID NO: 26935 - DNA, 20 bp, Artificial Sequence
  chemically synthesized
ggcaccatctaatcagttgc

SEQ ID NO: 26936 - DNA, 20 bp, Artificial Sequence
  chemically synthesized
catctaatcagttgccagca

SEQ ID NO: 26937 - DNA, 20 bp, Artificial Sequence
  chemically synthesized
taatcagttgccagcacagc

SEQ ID NO: 26938 - DNA, 20 bp, Artificial Sequence
  chemically synthesized
aatcagttgccagcacagcc

SEQ ID NO: 26939 - DNA, 20 bp, Artificial Sequence
  chemically synthesized
gccagcacagccaggatata

SEQ ID NO: 26940 - DNA, 20 bp, Artificial Sequence
  chemically synthesized
agcacagccaggatataaag

SEQ ID NO: 26941 - DNA, 20 bp, Artificial Sequence
  chemically synthesized
gcacagccaggatataaagc

SEQ ID NO: 26942 - DNA, 20 bp, Artificial Sequence
  chemically synthesized
cagccaggatataaagcagg

SEQ ID NO: 26943 - DNA, 20 bp, Artificial Sequence
  chemically synthesized
agcaggcagaaaaatgtgaa

SEQ ID NO: 26944 - DNA, 20 bp, Artificial Sequence
  chemically synthesized
gcaggcagaaaaatgtgaaa

SEQ ID NO: 26945 - DNA, 20 bp, Artificial Sequence
  chemically synthesized
gcagaaaaatgtgaaaaggc

SEQ ID NO: 26946 - DNA, 20 bp, Artificial Sequence
  chemically synthesized
aaaatgtgaaaaggctagat

SEQ ID NO: 26947 - DNA, 20 bp, Artificial Sequence
  chemically synthesized
gtgaaaaggctagattggct

SEQ ID NO: 26948 - DNA, 20 bp, Artificial Sequence
  chemically synthesized
gctagattggcttggcatcc

SEQ ID NO: 26949 - DNA, 20 bp, Artificial Sequence
  chemically synthesized
cctacatttttctcccatgc

SEQ ID NO: 26950 - DNA, 20 bp, Artificial Sequence
  chemically synthesized
atgctggattcttcctgccc

SEQ ID NO: 26951 - DNA, 20 bp, Artificial Sequence
  chemically synthesized
tgccctggaacattgaactc

SEQ ID NO: 26952 - DNA, 20 bp, Artificial Sequence
  chemically synthesized
gccctggaacattgaactcc

SEQ ID NO: 26953 - DNA, 20 bp, Artificial Sequence
  chemically synthesized
acattgaactccaggttctt

SEQ ID NO: 26954 - DNA, 20 bp, Artificial Sequence
  chemically synthesized
aactccaggttcttcagctt

SEQ ID NO: 26955 - DNA, 20 bp, Artificial Sequence
  chemically synthesized
actccaggttcttcagcttt

SEQ ID NO: 26956 - DNA, 20 bp, Artificial Sequence
  chemically synthesized
ttcagctttgggactccgac

SEQ ID NO: 26957 - DNA, 20 bp, Artificial Sequence
  chemically synthesized
cgactagcttccttgttcct

SEQ ID NO: 26958 - DNA, 20 bp, Artificial Sequence
  chemically synthesized
tagcttccttgttcctcagc

SEQ ID NO: 26959 - DNA, 20 bp, Artificial Sequence
  chemically synthesized
cttccttgttcctcagctgg

SEQ ID NO: 26960 - DNA, 20 bp, Artificial Sequence
  chemically synthesized
cttgttcctcagctggcaga

SEQ ID NO: 26961 - DNA, 20 bp, Artificial Sequence
  chemically synthesized
agctggcagatggcctgttt

SEQ ID NO: 26962 - DNA, 20 bp, Artificial Sequence
  chemically synthesized
gctggcagatggcctgtttt

SEQ ID NO: 26963 - DNA, 20 bp, Artificial Sequence
  chemically synthesized
ttgggaccttgtgaacatgt

SEQ ID NO: 26964 - DNA, 20 bp, Artificial Sequence
  chemically synthesized
ctacataataaactctcata

SEQ ID NO: 26965 - DNA, 20 bp, Artificial Sequence
  chemically synthesized
aataaactctcatatagata

SEQ ID NO: 26966 - DNA, 20 bp, Artificial Sequence
  chemically synthesized
ctctcatatagatatagata

SEQ ID NO: 26967 - DNA, 20 bp, Artificial Sequence
  chemically synthesized
ctcatatagatatagatata

SEQ ID NO: 26968 - DNA, 20 bp, Artificial Sequence
  chemically synthesized
tatagatatagatatagaga

SEQ ID NO: 26969 - DNA, 20 bp, Artificial Sequence
  chemically synthesized
tatagatatagagatagata

SEQ ID NO: 26970 - DNA, 20 bp, Artificial Sequence
  chemically synthesized
tagatatagagatagatata

SEQ ID NO: 26971 - DNA, 20 bp, Artificial Sequence
  chemically synthesized
tatagagatagatatagaga

SEQ ID NO: 26972 - DNA, 20 bp, Artificial Sequence
  chemically synthesized
gatagatatagagatagata

SEQ ID NO: 26973 - DNA, 20 bp, Artificial Sequence
  chemically synthesized
tatagagatagatatagata

SEQ ID NO: 26974 - DNA, 20 bp, Artificial Sequence
  chemically synthesized
gatagatatagatatagata

SEQ ID NO: 26975 - DNA, 20 bp, Artificial Sequence
  chemically synthesized
tatagatatagatatagata

SEQ ID NO: 26976 - DNA, 20 bp, Artificial Sequence
  chemically synthesized
tatagatatagatatagata

SEQ ID NO: 26977 - DNA, 20 bp, Artificial Sequence
  chemically synthesized
tatagatatagatatagata

SEQ ID NO: 26978 - DNA, 20 bp, Artificial Sequence
  chemically synthesized
ctattaattctgtttctctg

SEQ ID NO: 26979 - DNA, 20 bp, Artificial Sequence
  chemically synthesized
ttctctgtagaaccctaata

SEQ ID NO: 26980 - DNA, 20 bp, Artificial Sequence
  chemically synthesized
tagaaccctaatacagattt

SEQ ID NO: 26981 - DNA, 20 bp, Artificial Sequence
  chemically synthesized
cctaatacagattttggtac

SEQ ID NO: 26982 - DNA, 20 bp, Artificial Sequence
  chemically synthesized
ctaatacagattttggtacc

SEQ ID NO: 26983 - DNA, 20 bp, Artificial Sequence
  chemically synthesized
aatacagattttggtaccag

SEQ ID NO: 26984 - DNA, 20 bp, Artificial Sequence
  chemically synthesized
acagattttggtaccaggag

SEQ ID NO: 26985 - DNA, 20 bp, Artificial Sequence
  chemically synthesized
tttggtaccaggagtggttc

SEQ ID NO: 26986 - DNA, 20 bp, Artificial Sequence
  chemically synthesized
tggtaccaggagtggttcta

SEQ ID NO: 26987 - DNA, 20 bp, Artificial Sequence
  chemically synthesized
ggtaccaggagtggttctag

SEQ ID NO: 26988 - DNA, 20 bp, Artificial Sequence
  chemically synthesized
caggagtggttctagaggaa

SEQ ID NO: 26989 - DNA, 20 bp, Artificial Sequence
  chemically synthesized
ttctagaggaacagaatatt

SEQ ID NO: 26990 - DNA, 20 bp, Artificial Sequence
  chemically synthesized
tctagaggaacagaatatta

SEQ ID NO: 26991 - DNA, 20 bp, Artificial Sequence
  chemically synthesized
gaggaacagaatattaagga

SEQ ID NO: 26992 - DNA, 20 bp, Artificial Sequence
  chemically synthesized
ggaacagaatattaaggatg

SEQ ID NO: 26993 - DNA, 20 bp, Artificial Sequence
  chemically synthesized
taaggatggagttctttcat

SEQ ID NO: 26994 - DNA, 20 bp, Artificial Sequence
  chemically synthesized
tggagttctttcattggttt

SEQ ID NO: 26995 - DNA, 20 bp, Artificial Sequence
  chemically synthesized
ggagttctttcattggtttt

SEQ ID NO: 26996 - DNA, 20 bp, Artificial Sequence
  chemically synthesized
gagttctttcattggttttg

SEQ ID NO: 26997 - DNA, 20 bp, Artificial Sequence
  chemically synthesized
ttcattggttttggggtttc

SEQ ID NO: 26998 - DNA, 20 bp, Artificial Sequence
  chemically synthesized
cattggttttggggtttctg

SEQ ID NO: 26999 - DNA, 20 bp, Artificial Sequence
  chemically synthesized
ggttttggggtttctggagt

SEQ ID NO: 27000 - DNA, 20 bp, Artificial Sequence
  chemically synthesized
agttggctgcttaatatgat

SEQ ID NO: 27001 - DNA, 20 bp, Artificial Sequence
  chemically synthesized
tgattagacccaaatatgct

SEQ ID NO: 27002 - DNA, 20 bp, Artificial Sequence
  chemically synthesized
gattagacccaaatatgcta

SEQ ID NO: 27003 - DNA, 20 bp, Artificial Sequence
  chemically synthesized
gctaaggactcttcttctaa

SEQ ID NO: 27004 - DNA, 20 bp, Artificial Sequence
  chemically synthesized
ggactcttcttctaatggta

SEQ ID NO: 27005 - DNA, 20 bp, Artificial Sequence
  chemically synthesized
actcttcttctaatggtatg

SEQ ID NO: 27006 - DNA, 20 bp, Artificial Sequence
  chemically synthesized
tggagaacactgataatcct

SEQ ID NO: 27007 - DNA, 20 bp, Artificial Sequence
  chemically synthesized
aatccttggcatcaattgtt

SEQ ID NO: 27008 - DNA, 20 bp, Artificial Sequence
  chemically synthesized
tccttggcatcaattgttta

SEQ ID NO: 27009 - DNA, 20 bp, Artificial Sequence
  chemically synthesized
cttggcatcaattgtttaga

SEQ ID NO: 27010 - DNA, 20 bp, Artificial Sequence
  chemically synthesized
actcttgattcaacgcttgt

SEQ ID NO: 27011 - DNA, 20 bp, Artificial Sequence
  chemically synthesized
tcttgattcaacgcttgtga

SEQ ID NO: 27012 - DNA, 20 bp, Artificial Sequence
  chemically synthesized
cttgattcaacgcttgtgag

SEQ ID NO: 27013 - DNA, 20 bp, Artificial Sequence
  chemically synthesized
attcaacgcttgtgagaggc

SEQ ID NO: 27014 - DNA, 20 bp, Artificial Sequence
  chemically synthesized
ttcaacgcttgtgagaggca

SEQ ID NO: 27015 - DNA, 20 bp, Artificial Sequence
  chemically synthesized
cttgtgagaggcaaggaatt

SEQ ID NO: 27016 - DNA, 20 bp, Artificial Sequence
  chemically synthesized
ataatacttttgactatatg

SEQ ID NO: 27017 - DNA, 20 bp, Artificial Sequence
  chemically synthesized
aatacttttgactatatgtg

SEQ ID NO: 27018 - DNA, 20 bp, Artificial Sequence
  chemically synthesized
ttgactatatgtggagaatc

SEQ ID NO: 27019 - DNA, 20 bp, Artificial Sequence
  chemically synthesized
tgactatatgtggagaatca

SEQ ID NO: 27020 - DNA, 20 bp, Artificial Sequence
  chemically synthesized
atgtggagaatcaaggaaca

SEQ ID NO: 27021 - DNA, 20 bp, Artificial Sequence
  chemically synthesized
gagaatcaaggaacatagtg

SEQ ID NO: 27022 - DNA, 20 bp, Artificial Sequence
  chemically synthesized
atcaaggaacatagtgaagt

SEQ ID NO: 27023 - DNA, 20 bp, Artificial Sequence
  chemically synthesized
aggaacatagtgaagttggt

SEQ ID NO: 27024 - DNA, 20 bp, Artificial Sequence
  chemically synthesized
gaagttggttggttgcttgt

SEQ ID NO: 27025 - DNA, 20 bp, Artificial Sequence
  chemically synthesized
ttggttgcttgtaagttcgc

SEQ ID NO: 27026 - DNA, 20 bp, Artificial Sequence
  chemically synthesized
gcttgtaagttcgctggaca

SEQ ID NO: 27027 - DNA, 20 bp, Artificial Sequence
  chemically synthesized
ttcgctggacaaagtgatga

SEQ ID NO: 27028 - DNA, 20 bp, Artificial Sequence
  chemically synthesized
atgaaagaaaatgatgaact

SEQ ID NO: 27029 - DNA, 20 bp, Artificial Sequence
  chemically synthesized
tgaaagaaaatgatgaactc

SEQ ID NO: 27030 - DNA, 20 bp, Artificial Sequence
  chemically synthesized
aaagaaaatgatgaactcag

SEQ ID NO: 27031 - DNA, 20 bp, Artificial Sequence
  chemically synthesized
tcaggagtatatcaactctc

SEQ ID NO: 27032 - DNA, 20 bp, Artificial Sequence
  chemically synthesized
ctttgtgccataatcttatt

SEQ ID NO: 27033 - DNA, 20 bp, Artificial Sequence
  chemically synthesized
ttgtgccataatcttatttg

SEQ ID NO: 27034 - DNA, 20 bp, Artificial Sequence
  chemically synthesized
gtgccataatcttatttgga

SEQ ID NO: 27035 - DNA, 20 bp, Artificial Sequence
  chemically synthesized
tgctcacctttcacttccac

SEQ ID NO: 27036 - DNA, 20 bp, Artificial Sequence
  chemically synthesized
ttcacttccacaagatatca

SEQ ID NO: 27037 - DNA, 20 bp, Artificial Sequence
  chemically synthesized
acttccacaagatatcacag

SEQ ID NO: 27038 - DNA, 20 bp, Artificial Sequence
  chemically synthesized
tacattgatgacatgctgac

SEQ ID NO: 27039 - DNA, 20 bp, Artificial Sequence
  chemically synthesized
gatgacatgctgactggaac

SEQ ID NO: 27040 - DNA, 20 bp, Artificial Sequence
  chemically synthesized
acatgctgactggaactagt

SEQ ID NO: 27041 - DNA, 20 bp, Artificial Sequence
  chemically synthesized
gctgactggaactagtgagc

SEQ ID NO: 27042 - DNA, 20 bp, Artificial Sequence
  chemically synthesized
gactggaactagtgagcaag

SEQ ID NO: 27043 - DNA, 20 bp, Artificial Sequence
  chemically synthesized
tggaactagtgagcaagaag

SEQ ID NO: 27044 - DNA, 20 bp, Artificial Sequence
  chemically synthesized
gcaagaagtagcaaacacac

SEQ ID NO: 27045 - DNA, 20 bp, Artificial Sequence
  chemically synthesized
aacacactggatttattgat

SEQ ID NO: 27046 - DNA, 20 bp, Artificial Sequence
  chemically synthesized
atttattgatgagacatttg

SEQ ID NO: 27047 - DNA, 20 bp, Artificial Sequence
  chemically synthesized
tttattgatgagacatttgt

SEQ ID NO: 27048 - DNA, 20 bp, Artificial Sequence
  chemically synthesized
ttgatgagacatttgtggga

SEQ ID NO: 27049 - DNA, 20 bp, Artificial Sequence
  chemically synthesized
gatgagacatttgtgggaca

SEQ ID NO: 27050 - DNA, 20 bp, Artificial Sequence
  chemically synthesized
atgagacatttgtgggacag

SEQ ID NO: 27051 - DNA, 20 bp, Artificial Sequence
  chemically synthesized
gacatttgtgggacagagga

SEQ ID NO: 27052 - DNA, 20 bp, Artificial Sequence
  chemically synthesized
acatttgtgggacagaggat

SEQ ID NO: 27053 - DNA, 20 bp, Artificial Sequence
  chemically synthesized
gaaataaatctgattaaatt

SEQ ID NO: 27054 - DNA, 20 bp, Artificial Sequence
  chemically synthesized
aaataaatctgattaaattc

SEQ ID NO: 27055 - DNA, 20 bp, Artificial Sequence
  chemically synthesized
aataaatctgattaaattca

SEQ ID NO: 27056 - DNA, 20 bp, Artificial Sequence
  chemically synthesized
aattcagggaccttctacct

SEQ ID NO: 27057 - DNA, 20 bp, Artificial Sequence
  chemically synthesized
ttctacctcagtaaaattta

SEQ ID NO: 27058 - DNA, 20 bp, Artificial Sequence
  chemically synthesized
tctacctcagtaaaatttat

SEQ ID NO: 27059 - DNA, 20 bp, Artificial Sequence
  chemically synthesized
ctacctcagtaaaatttata

SEQ ID NO: 27060 - DNA, 20 bp, Artificial Sequence
  chemically synthesized
tacctcagtaaaatttatag

SEQ ID NO: 27061 - DNA, 20 bp, Artificial Sequence
  chemically synthesized
taaaatttataggggtccaa

SEQ ID NO: 27062 - DNA, 20 bp, Artificial Sequence
  chemically synthesized
tttataggggtccaatggtt

SEQ ID NO: 27063 - DNA, 20 bp, Artificial Sequence
  chemically synthesized
ttataggggtccaatggttt

SEQ ID NO: 27064 - DNA, 20 bp, Artificial Sequence
  chemically synthesized
tataggggtccaatggtttg

SEQ ID NO: 27065 - DNA, 20 bp, Artificial Sequence
  chemically synthesized
ccaatggtttggggctcttt

SEQ ID NO: 27066 - DNA, 20 bp, Artificial Sequence
  chemically synthesized
tctttgagatattccttcta

SEQ ID NO: 27067 - DNA, 20 bp, Artificial Sequence
  chemically synthesized
gagatattccttctaaagtg

SEQ ID NO: 27068 - DNA, 20 bp, Artificial Sequence
  chemically synthesized
agatattccttctaaagtga

SEQ ID NO: 27069 - DNA, 20 bp, Artificial Sequence
  chemically synthesized
gaaggataatttgctgcatt

SEQ ID NO: 27070 - DNA, 20 bp, Artificial Sequence
  chemically synthesized
atttggccactcttacaacc

SEQ ID NO: 27071 - DNA, 20 bp, Artificial Sequence
  chemically synthesized
ccactcttacaaccaagaaa

SEQ ID NO: 27072 - DNA, 20 bp, Artificial Sequence
  chemically synthesized
cactcttacaaccaagaaat

SEQ ID NO: 27073 - DNA, 20 bp, Artificial Sequence
  chemically synthesized
caagaaataggcacaacgcc

SEQ ID NO: 27074 - DNA, 20 bp, Artificial Sequence
  chemically synthesized
gaaataggcacaacgcctag

SEQ ID NO: 27075 - DNA, 20 bp, Artificial Sequence
  chemically synthesized
aaataggcacaacgcctagt

SEQ ID NO: 27076 - DNA, 20 bp, Artificial Sequence
  chemically synthesized
caacgcctagtgggcctatt

SEQ ID NO: 27077 - DNA, 20 bp, Artificial Sequence
  chemically synthesized
tagtgggcctatttggattt

SEQ ID NO: 27078 - DNA, 20 bp, Artificial Sequence
  chemically synthesized
gtgggcctatttggattttg

SEQ ID NO: 27079 - DNA, 20 bp, Artificial Sequence
  chemically synthesized
tgggcctatttggattttgg

SEQ ID NO: 27080 - DNA, 20 bp, Artificial Sequence
  chemically synthesized
gaggcaacatattcctgatt

SEQ ID NO: 27081 - DNA, 20 bp, Artificial Sequence
  chemically synthesized
aggcaacatattcctgattt

SEQ ID NO: 27082 - DNA, 20 bp, Artificial Sequence
  chemically synthesized
ctgatttgggtgtgttactc

SEQ ID NO: 27083 - DNA, 20 bp, Artificial Sequence
  chemically synthesized
gttactctggcccatttatc

SEQ ID NO: 27084 - DNA, 20 bp, Artificial Sequence
  chemically synthesized
ccatttatcgagtgatccaa

SEQ ID NO: 27085 - DNA, 20 bp, Artificial Sequence
  chemically synthesized
catttatcgagtgatccaaa

SEQ ID NO: 27086 - DNA, 20 bp, Artificial Sequence
  chemically synthesized
cgagtgatccaaaaggctgc

SEQ ID NO: 27087 - DNA, 20 bp, Artificial Sequence
  chemically synthesized
tccaaaaggctgccagtttt

SEQ ID NO: 27088 - DNA, 20 bp, Artificial Sequence
  chemically synthesized
aaaaggctgccagttttgag

SEQ ID NO: 27089 - DNA, 20 bp, Artificial Sequence
  chemically synthesized
aaggctgccagttttgagtg

SEQ ID NO: 27090 - DNA, 20 bp, Artificial Sequence
  chemically synthesized
tgccagttttgagtggagtc

SEQ ID NO: 27091 - DNA, 20 bp, Artificial Sequence
  chemically synthesized
gttttgagtggagtccagaa

SEQ ID NO: 27092 - DNA, 20 bp, Artificial Sequence
  chemically synthesized
ttgagtggagtccagaacag

SEQ ID NO: 27093 - DNA, 20 bp, Artificial Sequence
  chemically synthesized
tgagtggagtccagaacaga

SEQ ID NO: 27094 - DNA, 20 bp, Artificial Sequence
  chemically synthesized
cagaacagaaggctctgcca

SEQ ID NO: 27095 - DNA, 20 bp, Artificial Sequence
  chemically synthesized
agaacagaaggctctgccac

SEQ ID NO: 27096 - DNA, 20 bp, Artificial Sequence
  chemically synthesized
agaaggctctgccacaggtc

SEQ ID NO: 27097 - DNA, 20 bp, Artificial Sequence
  chemically synthesized
gaaggctctgccacaggtcc

SEQ ID NO: 27098 - DNA, 20 bp, Artificial Sequence
  chemically synthesized
acaggtccaggctgctgtgc

SEQ ID NO: 27099 - DNA, 20 bp, Artificial Sequence
  chemically synthesized
gtgcaagctgctatgccact

SEQ ID NO: 27100 - DNA, 20 bp, Artificial Sequence
  chemically synthesized
tgcaagctgctatgccactt

SEQ ID NO: 27101 - DNA, 20 bp, Artificial Sequence
  chemically synthesized
gccacttgggccatatgacc

SEQ ID NO: 27102 - DNA, 20 bp, Artificial Sequence
  chemically synthesized
acttgggccatatgacctag

SEQ ID NO: 27103 - DNA, 20 bp, Artificial Sequence
  chemically synthesized
tagcagatccaatgatgctt

SEQ ID NO: 27104 - DNA, 20 bp, Artificial Sequence
  chemically synthesized
agcagatccaatgatgcttg

SEQ ID NO: 27105 - DNA, 20 bp, Artificial Sequence
  chemically synthesized
tccaatgatgcttgaggtgt

SEQ ID NO: 27106 - DNA, 20 bp, Artificial Sequence
  chemically synthesized
gatgcttgaggtgtcagtgc

SEQ ID NO: 27107 - DNA, 20 bp, Artificial Sequence
  chemically synthesized
cttgaggtgtcagtgccaga

SEQ ID NO: 27108 - DNA, 20 bp, Artificial Sequence
  chemically synthesized
ttgaggtgtcagtgccagat

SEQ ID NO: 27109 - DNA, 20 bp, Artificial Sequence
  chemically synthesized
tgaggtgtcagtgccagata

SEQ ID NO: 27110 - DNA, 20 bp, Artificial Sequence
  chemically synthesized
tgccagatagggatgctgtt

SEQ ID NO: 27111 - DNA, 20 bp, Artificial Sequence
  chemically synthesized
ccagatagggatgctgtttg

SEQ ID NO: 27112 - DNA, 20 bp, Artificial Sequence
  chemically synthesized
gggatgctgtttggagcatt

SEQ ID NO: 27113 - DNA, 20 bp, Artificial Sequence
  chemically synthesized
atgctgtttggagcatttgg

SEQ ID NO: 27114 - DNA, 20 bp, Artificial Sequence
  chemically synthesized
tgctgtttggagcatttggc

SEQ ID NO: 27115 - DNA, 20 bp, Artificial Sequence
  chemically synthesized
gcatttggcaggctgaatca

SEQ ID NO: 27116 - DNA, 20 bp, Artificial Sequence
  chemically synthesized
tttggcaggctgaatcacag

SEQ ID NO: 27117 - DNA, 20 bp, Artificial Sequence
  chemically synthesized
tggcaggctgaatcacagcg

SEQ ID NO: 27118 - DNA, 20 bp, Artificial Sequence
  chemically synthesized
ggcaggctgaatcacagcgg

SEQ ID NO: 27119 - DNA, 20 bp, Artificial Sequence
  chemically synthesized
tgaatcacagcggaggcctc

SEQ ID NO: 27120 - DNA, 20 bp, Artificial Sequence
  chemically synthesized
gaatcacagcggaggcctct

SEQ ID NO: 27121 - DNA, 20 bp, Artificial Sequence
  chemically synthesized
agcggaggcctctaggattt

SEQ ID NO: 27122 - DNA, 20 bp, Artificial Sequence
  chemically synthesized
cggaggcctctaggattttg

SEQ ID NO: 27123 - DNA, 20 bp, Artificial Sequence
  chemically synthesized
ggcctctaggattttggagc

SEQ ID NO: 27124 - DNA, 20 bp, Artificial Sequence
  chemically synthesized
gcctctaggattttggagca

SEQ ID NO: 27125 - DNA, 20 bp, Artificial Sequence
  chemically synthesized
caaggccctgccatcttctg

SEQ ID NO: 27126 - DNA, 20 bp, Artificial Sequence
  chemically synthesized
tgcagataactactctcttt

SEQ ID NO: 27127 - DNA, 20 bp, Artificial Sequence
  chemically synthesized
gcagataactactctctttt

SEQ ID NO: 27128 - DNA, 20 bp, Artificial Sequence
  chemically synthesized
cagataactactctctttta

SEQ ID NO: 27129 - DNA, 20 bp, Artificial Sequence
  chemically synthesized
gataactactctcttttagg

SEQ ID NO: 27130 - DNA, 20 bp, Artificial Sequence
  chemically synthesized
actactctcttttagggaga

SEQ ID NO: 27131 - DNA, 20 bp, Artificial Sequence
  chemically synthesized
tcttttagggagaaagctct

SEQ ID NO: 27132 - DNA, 20 bp, Artificial Sequence
  chemically synthesized
gaaagctcttggcctgttac

SEQ ID NO: 27133 - DNA, 20 bp, Artificial Sequence
  chemically synthesized
aaagctcttggcctgttact

SEQ ID NO: 27134 - DNA, 20 bp, Artificial Sequence
  chemically synthesized
cttggcctgttactgggctt

SEQ ID NO: 27135 - DNA, 20 bp, Artificial Sequence
  chemically synthesized
ggcctgttactgggctttgg

SEQ ID NO: 27136 - DNA, 20 bp, Artificial Sequence
  chemically synthesized
gaaacgaaatatttgactat

SEQ ID NO: 27137 - DNA, 20 bp, Artificial Sequence
  chemically synthesized
atatttgactatgagtcatc

SEQ ID NO: 27138 - DNA, 20 bp, Artificial Sequence
  chemically synthesized
ctgaactgcctatcatgaac

SEQ ID NO: 27139 - DNA, 20 bp, Artificial Sequence
  chemically synthesized
tgaactgcctatcatgaact

SEQ ID NO: 27140 - DNA, 20 bp, Artificial Sequence
  chemically synthesized
tgggtgctttctgatccatc

SEQ ID NO: 27141 - DNA, 20 bp, Artificial Sequence
  chemically synthesized
ttctgatccatctagccata

SEQ ID NO: 27142 - DNA, 20 bp, Artificial Sequence
  chemically synthesized
tgatccatctagccataaag

SEQ ID NO: 27143 - DNA, 20 bp, Artificial Sequence
  chemically synthesized
gatccatctagccataaagt

SEQ ID NO: 27144 - DNA, 20 bp, Artificial Sequence
  chemically synthesized
gccataaagtgggctgtgca

SEQ ID NO: 27145 - DNA, 20 bp, Artificial Sequence
  chemically synthesized
ataaagtgggctgtgcacag

SEQ ID NO: 27146 - DNA, 20 bp, Artificial Sequence
  chemically synthesized
tgtgcacagcagcattgcat

SEQ ID NO: 27147 - DNA, 20 bp, Artificial Sequence
  chemically synthesized
agcagcattgcatcagcaaa

SEQ ID NO: 27148 - DNA, 20 bp, Artificial Sequence
  chemically synthesized
agcattgcatcagcaaatgg

SEQ ID NO: 27149 - DNA, 20 bp, Artificial Sequence
  chemically synthesized
attgcatcagcaaatggaag

SEQ ID NO: 27150 - DNA, 20 bp, Artificial Sequence
  chemically synthesized
ggaagtggtatatatgcgat

SEQ ID NO: 27151 - DNA, 20 bp, Artificial Sequence
  chemically synthesized
gaagtggtatatatgcgatt

SEQ ID NO: 27152 - DNA, 20 bp, Artificial Sequence
  chemically synthesized
gtatatatgcgattgggctt

SEQ ID NO: 27153 - DNA, 20 bp, Artificial Sequence
  chemically synthesized
tatatgcgattgggcttgag

SEQ ID NO: 27154 - DNA, 20 bp, Artificial Sequence
  chemically synthesized
ttgggcttgagcagatcctg

SEQ ID NO: 27155 - DNA, 20 bp, Artificial Sequence
  chemically synthesized
tgggcttgagcagatcctga

SEQ ID NO: 27156 - DNA, 20 bp, Artificial Sequence
  chemically synthesized
tgagcagatcctgaaggcac

SEQ ID NO: 27157 - DNA, 20 bp, Artificial Sequence
  chemically synthesized
cagatcctgaaggcactagt

SEQ ID NO: 27158 - DNA, 20 bp, Artificial Sequence
  chemically synthesized
aaggcactagtaagttacat

SEQ ID NO: 27159 - DNA, 20 bp, Artificial Sequence
  chemically synthesized
cactagtaagttacatgaga

SEQ ID NO: 27160 - DNA, 20 bp, Artificial Sequence
  chemically synthesized
actagtaagttacatgagaa

SEQ ID NO: 27161 - DNA, 20 bp, Artificial Sequence
  chemically synthesized
ctagtaagttacatgagaaa

SEQ ID NO: 27162 - DNA, 20 bp, Artificial Sequence
  chemically synthesized
tagtaagttacatgagaaag

SEQ ID NO: 27163 - DNA, 20 bp, Artificial Sequence
  chemically synthesized
gaaaggggctcaaatgccca

SEQ ID NO: 27164 - DNA, 20 bp, Artificial Sequence
  chemically synthesized
acacactgctttctctccct

SEQ ID NO: 27165 - DNA, 20 bp, Artificial Sequence
  chemically synthesized
tctccctgagactgcaccga

SEQ ID NO: 27166 - DNA, 20 bp, Artificial Sequence
  chemically synthesized
agactgcaccgatggtctca

SEQ ID NO: 27167 - DNA, 20 bp, Artificial Sequence
  chemically synthesized
gactgcaccgatggtctcat

SEQ ID NO: 27168 - DNA, 20 bp, Artificial Sequence
  chemically synthesized
actgcaccgatggtctcatg

SEQ ID NO: 27169 - DNA, 20 bp, Artificial Sequence
  chemically synthesized
tgcaccgatggtctcatggg

SEQ ID NO: 27170 - DNA, 20 bp, Artificial Sequence
  chemically synthesized
catggggagttccctatgat

SEQ ID NO: 27171 - DNA, 20 bp, Artificial Sequence
  chemically synthesized
agttccctatgatcagctga

SEQ ID NO: 27172 - DNA, 20 bp, Artificial Sequence
  chemically synthesized
ttccctatgatcagctgaca

SEQ ID NO: 27173 - DNA, 20 bp, Artificial Sequence
  chemically synthesized
tccctatgatcagctgacag

SEQ ID NO: 27174 - DNA, 20 bp, Artificial Sequence
  chemically synthesized
ctatgatcagctgacagagg

SEQ ID NO: 27175 - DNA, 20 bp, Artificial Sequence
  chemically synthesized
atgatcagctgacagaggaa

SEQ ID NO: 27176 - DNA, 20 bp, Artificial Sequence
  chemically synthesized
atcagctgacagaggaagag

SEQ ID NO: 27177 - DNA, 20 bp, Artificial Sequence
  chemically synthesized
ctgacagaggaagagaagac

SEQ ID NO: 27178 - DNA, 20 bp, Artificial Sequence
  chemically synthesized
tgacagaggaagagaagact

SEQ ID NO: 27179 - DNA, 20 bp, Artificial Sequence
  chemically synthesized
aggaagagaagactaggtcc

SEQ ID NO: 27180 - DNA, 20 bp, Artificial Sequence
  chemically synthesized
gaagactaggtcctggttca

SEQ ID NO: 27181 - DNA, 20 bp, Artificial Sequence
  chemically synthesized
actaggtcctggttcacaga

SEQ ID NO: 27182 - DNA, 20 bp, Artificial Sequence
  chemically synthesized
agatagttctgcacgatatg

SEQ ID NO: 27183 - DNA, 20 bp, Artificial Sequence
  chemically synthesized
gatagttctgcacgatatgc

SEQ ID NO: 27184 - DNA, 20 bp, Artificial Sequence
  chemically synthesized
gatatgcaggcaccacccaa

SEQ ID NO: 27185 - DNA, 20 bp, Artificial Sequence
  chemically synthesized
atgcaggcaccacccaaaag

SEQ ID NO: 27186 - DNA, 20 bp, Artificial Sequence
  chemically synthesized
aggcaccacccaaaagtgga

SEQ ID NO: 27187 - DNA, 20 bp, Artificial Sequence
  chemically synthesized
cacccaaaagtggacagccg

SEQ ID NO: 27188 - DNA, 20 bp, Artificial Sequence
  chemically synthesized
agtggacagccgcagcacta

SEQ ID NO: 27189 - DNA, 20 bp, Artificial Sequence
  chemically synthesized
gcagcactacagcccctttc

SEQ ID NO: 27190 - DNA, 20 bp, Artificial Sequence
  chemically synthesized
cagcactacagcccctttct

SEQ ID NO: 27191 - DNA, 20 bp, Artificial Sequence
  chemically synthesized
ccctttctaggacatccctg

SEQ ID NO: 27192 - DNA, 20 bp, Artificial Sequence
  chemically synthesized
cctttctaggacatccctga

SEQ ID NO: 27193 - DNA, 20 bp, Artificial Sequence
  chemically synthesized
aggacatccctgaaggacaa

SEQ ID NO: 27194 - DNA, 20 bp, Artificial Sequence
  chemically synthesized
atccctgaaggacaacggtg

SEQ ID NO: 27195 - DNA, 20 bp, Artificial Sequence
  chemically synthesized
tccctgaaggacaacggtga

SEQ ID NO: 27196 - DNA, 20 bp, Artificial Sequence
  chemically synthesized
ccctgaaggacaacggtgaa

SEQ ID NO: 27197 - DNA, 20 bp, Artificial Sequence
  chemically synthesized
acggtgaagggaaatcttcc

SEQ ID NO: 27198 - DNA, 20 bp, Artificial Sequence
  chemically synthesized
tgaagggaaatcttcctagt

SEQ ID NO: 27199 - DNA, 20 bp, Artificial Sequence
  chemically synthesized
agggaaatcttcctagttgg

SEQ ID NO: 27200 - DNA, 20 bp, Artificial Sequence
  chemically synthesized
ttcctagttggcagaacttt

SEQ ID NO: 27201 - DNA, 20 bp, Artificial Sequence
  chemically synthesized
ctagttggcagaactttgag

SEQ ID NO: 27202 - DNA, 20 bp, Artificial Sequence
  chemically synthesized
agaactttgagcagtgtgcc

SEQ ID NO: 27203 - DNA, 20 bp, Artificial Sequence
  chemically synthesized
gcctggttgtgcactttgca

SEQ ID NO: 27204 - DNA, 20 bp, Artificial Sequence
  chemically synthesized
tggttgtgcactttgcacag

SEQ ID NO: 27205 - DNA, 20 bp, Artificial Sequence
  chemically synthesized
ggttgtgcactttgcacaga

SEQ ID NO: 27206 - DNA, 20 bp, Artificial Sequence
  chemically synthesized
ttgtgcactttgcacagaag

SEQ ID NO: 27207 - DNA, 20 bp, Artificial Sequence
  chemically synthesized
actttgcacagaaggagaaa

SEQ ID NO: 27208 - DNA, 20 bp, Artificial Sequence
  chemically synthesized
tgcacagaaggagaaatggc

SEQ ID NO: 27209 - DNA, 20 bp, Artificial Sequence
  chemically synthesized
tgcgattatatacttattca

SEQ ID NO: 27210 - DNA, 20 bp, Artificial Sequence
  chemically synthesized
gcgattatatacttattcat

SEQ ID NO: 27211 - DNA, 20 bp, Artificial Sequence
  chemically synthesized
atatacttattcatgggctg

SEQ ID NO: 27212 - DNA, 20 bp, Artificial Sequence
  chemically synthesized
ttattcatgggctgtagcca

SEQ ID NO: 27213 - DNA, 20 bp, Artificial Sequence
  chemically synthesized
tattcatgggctgtagccaa

SEQ ID NO: 27214 - DNA, 20 bp, Artificial Sequence
  chemically synthesized
atgggctgtagccaaaggtt

SEQ ID NO: 27215 - DNA, 20 bp, Artificial Sequence
  chemically synthesized
gctgtagccaaaggtttggc

SEQ ID NO: 27216 - DNA, 20 bp, Artificial Sequence
  chemically synthesized
tagccaaaggtttggctaga

SEQ ID NO: 27217 - DNA, 20 bp, Artificial Sequence
  chemically synthesized
caaaggtttggctagatggt

SEQ ID NO: 27218 - DNA, 20 bp, Artificial Sequence
  chemically synthesized
aaaggtttggctagatggtc

SEQ ID NO: 27219 - DNA, 20 bp, Artificial Sequence
  chemically synthesized
aaggtttggctagatggtca

SEQ ID NO: 27220 - DNA, 20 bp, Artificial Sequence
  chemically synthesized
tggctagatggtcagggact

SEQ ID NO: 27221 - DNA, 20 bp, Artificial Sequence
  chemically synthesized
gatggtcagggacttggaaa

SEQ ID NO: 27222 - DNA, 20 bp, Artificial Sequence
  chemically synthesized
ggacttggaaaaagcatgac

SEQ ID NO: 27223 - DNA, 20 bp, Artificial Sequence
  chemically synthesized
tgactggaaaattgatgaca

SEQ ID NO: 27224 - DNA, 20 bp, Artificial Sequence
  chemically synthesized
aaattgatgacaaagaaatt

SEQ ID NO: 27225 - DNA, 20 bp, Artificial Sequence
  chemically synthesized
aattgatgacaaagaaattt

SEQ ID NO: 27226 - DNA, 20 bp, Artificial Sequence
  chemically synthesized
attgatgacaaagaaatttg

SEQ ID NO: 27227 - DNA, 20 bp, Artificial Sequence
  chemically synthesized
gatgacaaagaaatttgggg

SEQ ID NO: 27228 - DNA, 20 bp, Artificial Sequence
  chemically synthesized
tgacaaagaaatttggggaa

SEQ ID NO: 27229 - DNA, 20 bp, Artificial Sequence
  chemically synthesized
gacaaagaaatttggggaag

SEQ ID NO: 27230 - DNA, 20 bp, Artificial Sequence
  chemically synthesized
aaatttggggaagaggtatg

SEQ ID NO: 27231 - DNA, 20 bp, Artificial Sequence
  chemically synthesized
ttggggaagaggtatgtgga

SEQ ID NO: 27232 - DNA, 20 bp, Artificial Sequence
  chemically synthesized
tgtggatggacctctatgat

SEQ ID NO: 27233 - DNA, 20 bp, Artificial Sequence
  chemically synthesized
atgattagtcaaaaactaca

SEQ ID NO: 27234 - DNA, 20 bp, Artificial Sequence
  chemically synthesized
aagatattttcatcccatgt

SEQ ID NO: 27235 - DNA, 20 bp, Artificial Sequence
  chemically synthesized
cccatgtgagtgctcaccaa

SEQ ID NO: 27236 - DNA, 20 bp, Artificial Sequence
  chemically synthesized
ccatgtgagtgctcaccaat

SEQ ID NO: 27237 - DNA, 20 bp, Artificial Sequence
  chemically synthesized
tgctcaccaatgggtgacct

SEQ ID NO: 27238 - DNA, 20 bp, Artificial Sequence
  chemically synthesized
tcaccaatgggtgacctcag

SEQ ID NO: 27239 - DNA, 20 bp, Artificial Sequence
  chemically synthesized
ccaatgggtgacctcagcag

SEQ ID NO: 27240 - DNA, 20 bp, Artificial Sequence
  chemically synthesized
aatgggtgacctcagcagaa

SEQ ID NO: 27241 - DNA, 20 bp, Artificial Sequence
  chemically synthesized
atgggtgacctcagcagaag

SEQ ID NO: 27242 - DNA, 20 bp, Artificial Sequence
  chemically synthesized
agaagaggattttaataatc

SEQ ID NO: 27243 - DNA, 20 bp, Artificial Sequence
  chemically synthesized
agaggattttaataatcaag

SEQ ID NO: 27244 - DNA, 20 bp, Artificial Sequence
  chemically synthesized
gattttaataatcaagtgga

SEQ ID NO: 27245 - DNA, 20 bp, Artificial Sequence
  chemically synthesized
attttaataatcaagtggat

SEQ ID NO: 27246 - DNA, 20 bp, Artificial Sequence
  chemically synthesized
ggataggatgatcaattctg

SEQ ID NO: 27247 - DNA, 20 bp, Artificial Sequence
  chemically synthesized
tcaattctgtggacaccact

SEQ ID NO: 27248 - DNA, 20 bp, Artificial Sequence
  chemically synthesized
gacaccactcagccttttcc

SEQ ID NO: 27249 - DNA, 20 bp, Artificial Sequence
  chemically synthesized
acaccactcagccttttccc

SEQ ID NO: 27250 - DNA, 20 bp, Artificial Sequence
  chemically synthesized
ccactcatgtcatcgtccaa

SEQ ID NO: 27251 - DNA, 20 bp, Artificial Sequence
  chemically synthesized
gtccaatggacccatgaaca

SEQ ID NO: 27252 - DNA, 20 bp, Artificial Sequence
  chemically synthesized
caatggacccatgaacaaag

SEQ ID NO: 27253 - DNA, 20 bp, Artificial Sequence
  chemically synthesized
acccatgaacaaagtggcca

SEQ ID NO: 27254 - DNA, 20 bp, Artificial Sequence
  chemically synthesized
gaacaaagtggccacagttg

SEQ ID NO: 27255 - DNA, 20 bp, Artificial Sequence
  chemically synthesized
aacaaagtggccacagttgc

SEQ ID NO: 27256 - DNA, 20 bp, Artificial Sequence
  chemically synthesized
acaaagtggccacagttgca

SEQ ID NO: 27257 - DNA, 20 bp, Artificial Sequence
  chemically synthesized
agtggccacagttgcaggga

SEQ ID NO: 27258 - DNA, 20 bp, Artificial Sequence
  chemically synthesized
ggccacagttgcagggatgg

SEQ ID NO: 27259 - DNA, 20 bp, Artificial Sequence
  chemically synthesized
gcagggatggaagttatgct

SEQ ID NO: 27260 - DNA, 20 bp, Artificial Sequence
  chemically synthesized
cagggatggaagttatgctt

SEQ ID NO: 27261 - DNA, 20 bp, Artificial Sequence
  chemically synthesized
atggaagttatgcttgggct

SEQ ID NO: 27262 - DNA, 20 bp, Artificial Sequence
  chemically synthesized
tatgcttgggctcagcaaca

SEQ ID NO: 27263 - DNA, 20 bp, Artificial Sequence
  chemically synthesized
acatggacttccactcacca

SEQ ID NO: 27264 - DNA, 20 bp, Artificial Sequence
  chemically synthesized
tccactcaccaaagctgacc

SEQ ID NO: 27265 - DNA, 20 bp, Artificial Sequence
  chemically synthesized
caccaaagctgacctggcca

SEQ ID NO: 27266 - DNA, 20 bp, Artificial Sequence
  chemically synthesized
tggccacagccactgcttgc

SEQ ID NO: 27267 - DNA, 20 bp, Artificial Sequence
  chemically synthesized
cagccactgcttgccagcat

SEQ ID NO: 27268 - DNA, 20 bp, Artificial Sequence
  chemically synthesized
gccactgcttgccagcatca

SEQ ID NO: 27269 - DNA, 20 bp, Artificial Sequence
  chemically synthesized
cagcatcagagaccaacact

SEQ ID NO: 27270 - DNA, 20 bp, Artificial Sequence
  chemically synthesized
ccaacactaagcccttgata

SEQ ID NO: 27271 - DNA, 20 bp, Artificial Sequence
  chemically synthesized
cttgatatggcaccattcct

SEQ ID NO: 27272 - DNA, 20 bp, Artificial Sequence
  chemically synthesized
ttgatatggcaccattcctc

SEQ ID NO: 27273 - DNA, 20 bp, Artificial Sequence
  chemically synthesized
tgatatggcaccattcctcg

SEQ ID NO: 27274 - DNA, 20 bp, Artificial Sequence
  chemically synthesized
gcaccattcctcggggtgat

SEQ ID NO: 27275 - DNA, 20 bp, Artificial Sequence
  chemically synthesized
cattcctcggggtgatcagc

SEQ ID NO: 27276 - DNA, 20 bp, Artificial Sequence
  chemically synthesized
ggggtgatcagccagctacc

SEQ ID NO: 27277 - DNA, 20 bp, Artificial Sequence
  chemically synthesized
gtgatcagccagctacctgg

SEQ ID NO: 27278 - DNA, 20 bp, Artificial Sequence
  chemically synthesized
atcagccagctacctggtgg

SEQ ID NO: 27279 - DNA, 20 bp, Artificial Sequence
  chemically synthesized
tcagccagctacctggtggc

SEQ ID NO: 27280 - DNA, 20 bp, Artificial Sequence
  chemically synthesized
tggtggcaggttgattatat

SEQ ID NO: 27281 - DNA, 20 bp, Artificial Sequence
  chemically synthesized
atattggacctcttccatca

SEQ ID NO: 27282 - DNA, 20 bp, Artificial Sequence
  chemically synthesized
tggacctcttccatcatgga

SEQ ID NO: 27283 - DNA, 20 bp, Artificial Sequence
  chemically synthesized
ggacctcttccatcatggaa

SEQ ID NO: 27284 - DNA, 20 bp, Artificial Sequence
  chemically synthesized
gacctcttccatcatggaaa

SEQ ID NO: 27285 - DNA, 20 bp, Artificial Sequence
  chemically synthesized
ctcttccatcatggaaaggg

SEQ ID NO: 27286 - DNA, 20 bp, Artificial Sequence
  chemically synthesized
cttccatcatggaaagggca

SEQ ID NO: 27287 - DNA, 20 bp, Artificial Sequence
  chemically synthesized
ttccatcatggaaagggcag

SEQ ID NO: 27288 - DNA, 20 bp, Artificial Sequence
  chemically synthesized
gggcagaggcttgtcctcac

SEQ ID NO: 27289 - DNA, 20 bp, Artificial Sequence
  chemically synthesized
gaggcttgtcctcactggaa

SEQ ID NO: 27290 - DNA, 20 bp, Artificial Sequence
  chemically synthesized
actggaatagacacttactc

SEQ ID NO: 27291 - DNA, 20 bp, Artificial Sequence
  chemically synthesized
atagacacttactctggata

SEQ ID NO: 27292 - DNA, 20 bp, Artificial Sequence
  chemically synthesized
tagacacttactctggatat

SEQ ID NO: 27293 - DNA, 20 bp, Artificial Sequence
  chemically synthesized
ctgaactcaatgcttatgcc

SEQ ID NO: 27294 - DNA, 20 bp, Artificial Sequence
  chemically synthesized
tatgccaagactaccatcca

SEQ ID NO: 27295 - DNA, 20 bp, Artificial Sequence
  chemically synthesized
gactaccatccatggaatca

SEQ ID NO: 27296 - DNA, 20 bp, Artificial Sequence
  chemically synthesized
gaatgccgtatccactgtca

SEQ ID NO: 27297 - DNA, 20 bp, Artificial Sequence
  chemically synthesized
cactgtcatggtattccaca

SEQ ID NO: 27298 - DNA, 20 bp, Artificial Sequence
  chemically synthesized
acacagcattgcttctgacc

SEQ ID NO: 27299 - DNA, 20 bp, Artificial Sequence
  chemically synthesized
tgaccaagccactcacttta

SEQ ID NO: 27300 - DNA, 20 bp, Artificial Sequence
  chemically synthesized
agccactcactttatggcta

SEQ ID NO: 27301 - DNA, 20 bp, Artificial Sequence
  chemically synthesized
cactcactttatggctaaag

SEQ ID NO: 27302 - DNA, 20 bp, Artificial Sequence
  chemically synthesized
ttatggctaaagaagtgtga

SEQ ID NO: 27303 - DNA, 20 bp, Artificial Sequence
  chemically synthesized
tggctaaagaagtgtgacag

SEQ ID NO: 27304 - DNA, 20 bp, Artificial Sequence
  chemically synthesized
ggctaaagaagtgtgacagt

SEQ ID NO: 27305 - DNA, 20 bp, Artificial Sequence
  chemically synthesized
tgacagtgggctcatgctca

SEQ ID NO: 27306 - DNA, 20 bp, Artificial Sequence
  chemically synthesized
ctcatgctcatggaatttac

SEQ ID NO: 27307 - DNA, 20 bp, Artificial Sequence
  chemically synthesized
ccatgatccctatcatcctg

SEQ ID NO: 27308 - DNA, 20 bp, Artificial Sequence
  chemically synthesized
tgatccctatcatcctgaag

SEQ ID NO: 27309 - DNA, 20 bp, Artificial Sequence
  chemically synthesized
atcctgaagcagcttttgaa

SEQ ID NO: 27310 - DNA, 20 bp, Artificial Sequence
  chemically synthesized
agcttttgaatggccttttg

SEQ ID NO: 27311 - DNA, 20 bp, Artificial Sequence
  chemically synthesized
gtcacgattacaatgccaac

SEQ ID NO: 27312 - DNA, 20 bp, Artificial Sequence
  chemically synthesized
tcacgattacaatgccaact

SEQ ID NO: 27313 - DNA, 20 bp, Artificial Sequence
  chemically synthesized
aactaggtgacaatactttg

SEQ ID NO: 27314 - DNA, 20 bp, Artificial Sequence
  chemically synthesized
actaggtgacaatactttgc

SEQ ID NO: 27315 - DNA, 20 bp, Artificial Sequence
  chemically synthesized
gtgacaatactttgcaggcc

SEQ ID NO: 27316 - DNA, 20 bp, Artificial Sequence
  chemically synthesized
tgacaatactttgcaggcct

SEQ ID NO: 27317 - DNA, 20 bp, Artificial Sequence
  chemically synthesized
gacaatactttgcaggcctg

SEQ ID NO: 27318 - DNA, 20 bp, Artificial Sequence
  chemically synthesized
tactttgcaggcctggggca

SEQ ID NO: 27319 - DNA, 20 bp, Artificial Sequence
  chemically synthesized
aggcctggggcaaagttctc

SEQ ID NO: 27320 - DNA, 20 bp, Artificial Sequence
  chemically synthesized
cctggggcaaagttctccag

SEQ ID NO: 27321 - DNA, 20 bp, Artificial Sequence
  chemically synthesized
ctggggcaaagttctccaga

SEQ ID NO: 27322 - DNA, 20 bp, Artificial Sequence
  chemically synthesized
aggctgtgtatgctctgaat

SEQ ID NO: 27323 - DNA, 20 bp, Artificial Sequence
  chemically synthesized
ctgaatcagtgtccaatata

SEQ ID NO: 27324 - DNA, 20 bp, Artificial Sequence
  chemically synthesized
atatggtactgtttctccca

SEQ ID NO: 27325 - DNA, 20 bp, Artificial Sequence
  chemically synthesized
ggtactgtttctcccataga

SEQ ID NO: 27326 - DNA, 20 bp, Artificial Sequence
  chemically synthesized
gtactgtttctcccatagac

SEQ ID NO: 27327 - DNA, 20 bp, Artificial Sequence
  chemically synthesized
tctcccatagacaggattca

SEQ ID NO: 27328 - DNA, 20 bp, Artificial Sequence
  chemically synthesized
ctcccatagacaggattcac

SEQ ID NO: 27329 - DNA, 20 bp, Artificial Sequence
  chemically synthesized
atagacaggattcacgggtc

SEQ ID NO: 27330 - DNA, 20 bp, Artificial Sequence
  chemically synthesized
tagacaggattcacgggtcc

SEQ ID NO: 27331 - DNA, 20 bp, Artificial Sequence
  chemically synthesized
attcacgggtccaggaatca

SEQ ID NO: 27332 - DNA, 20 bp, Artificial Sequence
  chemically synthesized
ttcacgggtccaggaatcaa

SEQ ID NO: 27333 - DNA, 20 bp, Artificial Sequence
  chemically synthesized
tcacgggtccaggaatcaaa

SEQ ID NO: 27334 - DNA, 20 bp, Artificial Sequence
  chemically synthesized
cgggtccaggaatcaaaggg

SEQ ID NO: 27335 - DNA, 20 bp, Artificial Sequence
  chemically synthesized
gtccaggaatcaaagggtgg

SEQ ID NO: 27336 - DNA, 20 bp, Artificial Sequence
  chemically synthesized
caggaatcaaagggtggaag

SEQ ID NO: 27337 - DNA, 20 bp, Artificial Sequence
  chemically synthesized
gaatcaaagggtggaagtgg

SEQ ID NO: 27338 - DNA, 20 bp, Artificial Sequence
  chemically synthesized
tcaaagggtggaagtggaag

SEQ ID NO: 27339 - DNA, 20 bp, Artificial Sequence
  chemically synthesized
aagggtggaagtggaagtgg

SEQ ID NO: 27340 - DNA, 20 bp, Artificial Sequence
  chemically synthesized
ggtggaagtggaagtggaag

SEQ ID NO: 27341 - DNA, 20 bp, Artificial Sequence
  chemically synthesized
gcaccactcaccatcacccc

SEQ ID NO: 27342 - DNA, 20 bp, Artificial Sequence
  chemically synthesized
catcacccctagtgttccac

SEQ ID NO: 27343 - DNA, 20 bp, Artificial Sequence
  chemically synthesized
atttttgcttcctgttccca

SEQ ID NO: 27344 - DNA, 20 bp, Artificial Sequence
  chemically synthesized
cccatggcattatgttctgc

SEQ ID NO: 27345 - DNA, 20 bp, Artificial Sequence
  chemically synthesized
ggcattatgttctgctggct

SEQ ID NO: 27346 - DNA, 20 bp, Artificial Sequence
  chemically synthesized
cattatgttctgctggctta

SEQ ID NO: 27347 - DNA, 20 bp, Artificial Sequence
  chemically synthesized
attatgttctgctggcttag

SEQ ID NO: 27348 - DNA, 20 bp, Artificial Sequence
  chemically synthesized
ttctgctggcttagaggtct

SEQ ID NO: 27349 - DNA, 20 bp, Artificial Sequence
  chemically synthesized
tggcttagaggtcttagttc

SEQ ID NO: 27350 - DNA, 20 bp, Artificial Sequence
  chemically synthesized
gcttagaggtcttagttcca

SEQ ID NO: 27351 - DNA, 20 bp, Artificial Sequence
  chemically synthesized
cttagaggtcttagttccag

SEQ ID NO: 27352 - DNA, 20 bp, Artificial Sequence
  chemically synthesized
ttagaggtcttagttccaga

SEQ ID NO: 27353 - DNA, 20 bp, Artificial Sequence
  chemically synthesized
agaggtcttagttccagagg

SEQ ID NO: 27354 - DNA, 20 bp, Artificial Sequence
  chemically synthesized
gaggtcttagttccagaggg

SEQ ID NO: 27355 - DNA, 20 bp, Artificial Sequence
  chemically synthesized
agagggaggaacactgccgc

SEQ ID NO: 27356 - DNA, 20 bp, Artificial Sequence
  chemically synthesized
gagggaggaacactgccgcc

SEQ ID NO: 27357 - DNA, 20 bp, Artificial Sequence
  chemically synthesized
attccattaaactgcaaatt

SEQ ID NO: 27358 - DNA, 20 bp, Artificial Sequence
  chemically synthesized
tgcaaattaagattgccacc

SEQ ID NO: 27359 - DNA, 20 bp, Artificial Sequence
  chemically synthesized
agattgccacctggacactt

SEQ ID NO: 27360 - DNA, 20 bp, Artificial Sequence
  chemically synthesized
gattgccacctggacacttt

SEQ ID NO: 27361 - DNA, 20 bp, Artificial Sequence
  chemically synthesized
tttgggctcctcccaccttt

SEQ ID NO: 27362 - DNA, 20 bp, Artificial Sequence
  chemically synthesized
tcctcccacctttaagtcaa

SEQ ID NO: 27363 - DNA, 20 bp, Artificial Sequence
  chemically synthesized
cctcccacctttaagtcaac

SEQ ID NO: 27364 - DNA, 20 bp, Artificial Sequence
  chemically synthesized
cacctttaagtcaacaggct

SEQ ID NO: 27365 - DNA, 20 bp, Artificial Sequence
  chemically synthesized
ctttaagtcaacaggctaag

SEQ ID NO: 27366 - DNA, 20 bp, Artificial Sequence
  chemically synthesized
ttaagtcaacaggctaagaa

SEQ ID NO: 27367 - DNA, 20 bp, Artificial Sequence
  chemically synthesized
aagtcaacaggctaagaaga

SEQ ID NO: 27368 - DNA, 20 bp, Artificial Sequence
  chemically synthesized
acaggctaagaagagagtta

SEQ ID NO: 27369 - DNA, 20 bp, Artificial Sequence
  chemically synthesized
taagaagagagttacagtgt

SEQ ID NO: 27370 - DNA, 20 bp, Artificial Sequence
  chemically synthesized
gagagttacagtgttggctg

SEQ ID NO: 27371 - DNA, 20 bp, Artificial Sequence
  chemically synthesized
gttggctgcggtgattaacc

SEQ ID NO: 27372 - DNA, 20 bp, Artificial Sequence
  chemically synthesized
ggtgattaacccagactatc

SEQ ID NO: 27373 - DNA, 20 bp, Artificial Sequence
  chemically synthesized
ccagactatcaagatgaaat

SEQ ID NO: 27374 - DNA, 20 bp, Artificial Sequence
  chemically synthesized
atcagtctacaactccacaa

SEQ ID NO: 27375 - DNA, 20 bp, Artificial Sequence
  chemically synthesized
cagtctacaactccacaatg

SEQ ID NO: 27376 - DNA, 20 bp, Artificial Sequence
  chemically synthesized
agtctacaactccacaatgg

SEQ ID NO: 27377 - DNA, 20 bp, Artificial Sequence
  chemically synthesized
tacaactccacaatggaggt

SEQ ID NO: 27378 - DNA, 20 bp, Artificial Sequence
  chemically synthesized
acaactccacaatggaggta

SEQ ID NO: 27379 - DNA, 20 bp, Artificial Sequence
  chemically synthesized
actccacaatggaggtaagg

SEQ ID NO: 27380 - DNA, 20 bp, Artificial Sequence
  chemically synthesized
gaggtaaggaagcgtatgca

SEQ ID NO: 27381 - DNA, 20 bp, Artificial Sequence
  chemically synthesized
ggaagcgtatgcatggaata

SEQ ID NO: 27382 - DNA, 20 bp, Artificial Sequence
  chemically synthesized
gaagcgtatgcatggaatat

SEQ ID NO: 27383 - DNA, 20 bp, Artificial Sequence
  chemically synthesized
agcgtatgcatggaatatag

SEQ ID NO: 27384 - DNA, 20 bp, Artificial Sequence
  chemically synthesized
atggaatataggagatccat

SEQ ID NO: 27385 - DNA, 20 bp, Artificial Sequence
  chemically synthesized
tggaatataggagatccatt

SEQ ID NO: 27386 - DNA, 20 bp, Artificial Sequence
  chemically synthesized
ggaatataggagatccatta

SEQ ID NO: 27387 - DNA, 20 bp, Artificial Sequence
  chemically synthesized
agatccattagggtgtctct

SEQ ID NO: 27388 - DNA, 20 bp, Artificial Sequence
  chemically synthesized
ctcttagttttaccatgtcc

SEQ ID NO: 27389 - DNA, 20 bp, Artificial Sequence
  chemically synthesized
ttttaccatgtcctggaatt

SEQ ID NO: 27390 - DNA, 20 bp, Artificial Sequence
  chemically synthesized
tttaccatgtcctggaatta

SEQ ID NO: 27391 - DNA, 20 bp, Artificial Sequence
  chemically synthesized
ccatgtcctggaattaaggt

SEQ ID NO: 27392 - DNA, 20 bp, Artificial Sequence
  chemically synthesized
tgtcctggaattaaggtcag

SEQ ID NO: 27393 - DNA, 20 bp, Artificial Sequence
  chemically synthesized
gtcctggaattaaggtcagt

SEQ ID NO: 27394 - DNA, 20 bp, Artificial Sequence
  chemically synthesized
aggtcagtgggaaactacta

SEQ ID NO: 27395 - DNA, 20 bp, Artificial Sequence
  chemically synthesized
ggtcagtgggaaactactac

SEQ ID NO: 27396 - DNA, 20 bp, Artificial Sequence
  chemically synthesized
gaaactactacaggccattc

SEQ ID NO: 27397 - DNA, 20 bp, Artificial Sequence
  chemically synthesized
aaactactacaggccattcc

SEQ ID NO: 27398 - DNA, 20 bp, Artificial Sequence
  chemically synthesized
ctactacaggccattccagg

SEQ ID NO: 27399 - DNA, 20 bp, Artificial Sequence
  chemically synthesized
tactacaggccattccaggc

SEQ ID NO: 27400 - DNA, 20 bp, Artificial Sequence
  chemically synthesized
tccaggcaggactacaaata

SEQ ID NO: 27401 - DNA, 20 bp, Artificial Sequence
  chemically synthesized
ccaggcaggactacaaataa

SEQ ID NO: 27402 - DNA, 20 bp, Artificial Sequence
  chemically synthesized
caggactacaaataaaggtt

SEQ ID NO: 27403 - DNA, 20 bp, Artificial Sequence
  chemically synthesized
aggactacaaataaaggttt

SEQ ID NO: 27404 - DNA, 20 bp, Artificial Sequence
  chemically synthesized
aaaggtttgggtcactccac

SEQ ID NO: 27405 - DNA, 20 bp, Artificial Sequence
  chemically synthesized
aaggtttgggtcactccacc

SEQ ID NO: 27406 - DNA, 20 bp, Artificial Sequence
  chemically synthesized
caggaaaaaaaaaaaaaaaa

SEQ ID NO: 27407 - DNA, 20 bp, Artificial Sequence
  chemically synthesized
aaaaaaaaaaaaaaaaagac

SEQ ID NO: 27408 - DNA, 20 bp, Artificial Sequence
  chemically synthesized
aaaaaaagacaagacctgct

SEQ ID NO: 27409 - DNA, 20 bp, Artificial Sequence
  chemically synthesized
aaaaaagacaagacctgctg

SEQ ID NO: 27410 - DNA, 20 bp, Artificial Sequence
  chemically synthesized
gacctgctgaggtgcttgct

SEQ ID NO: 27411 - DNA, 20 bp, Artificial Sequence
  chemically synthesized
acctgctgaggtgcttgctg

SEQ ID NO: 27412 - DNA, 20 bp, Artificial Sequence
  chemically synthesized
cctgctgaggtgcttgctga

SEQ ID NO: 27413 - DNA, 20 bp, Artificial Sequence
  chemically synthesized
tgaggtgcttgctgagggca

SEQ ID NO: 27414 - DNA, 20 bp, Artificial Sequence
  chemically synthesized
gaggtgcttgctgagggcaa

SEQ ID NO: 27415 - DNA, 20 bp, Artificial Sequence
  chemically synthesized
aggtgcttgctgagggcaaa

SEQ ID NO: 27416 - DNA, 20 bp, Artificial Sequence
  chemically synthesized
tgctgagggcaaagggaata

SEQ ID NO: 27417 - DNA, 20 bp, Artificial Sequence
  chemically synthesized
caaagggaatacagaatatg

SEQ ID NO: 27418 - DNA, 20 bp, Artificial Sequence
  chemically synthesized
agggaatacagaatatgtag

SEQ ID NO: 27419 - DNA, 20 bp, Artificial Sequence
  chemically synthesized
gaatacagaatatgtagcag

SEQ ID NO: 27420 - DNA, 20 bp, Artificial Sequence
  chemically synthesized
tacagaatatgtagcagaag

SEQ ID NO: 27421 - DNA, 20 bp, Artificial Sequence
  chemically synthesized
acagaatatgtagcagaaga

SEQ ID NO: 27422 - DNA, 20 bp, Artificial Sequence
  chemically synthesized
gaatatgtagcagaagaagg

SEQ ID NO: 27423 - DNA, 20 bp, Artificial Sequence
  chemically synthesized
aagaaggtagtcatcaatac

SEQ ID NO: 27424 - DNA, 20 bp, Artificial Sequence
  chemically synthesized
tacgatcacgtgaccaattg

SEQ ID NO: 27425 - DNA, 20 bp, Artificial Sequence
  chemically synthesized
acgtgaccaattgcagatac

SEQ ID NO: 27426 - DNA, 20 bp, Artificial Sequence
  chemically synthesized
cgtgaccaattgcagataca

SEQ ID NO: 27427 - DNA, 20 bp, Artificial Sequence
  chemically synthesized
acaaggactgtaattgtcat

SEQ ID NO: 27428 - DNA, 20 bp, Artificial Sequence
  chemically synthesized
tgtctgtatacacttgtact

SEQ ID NO: 27429 - DNA, 20 bp, Artificial Sequence
  chemically synthesized
tttcctttatcatgtgacat

SEQ ID NO: 27430 - DNA, 20 bp, Artificial Sequence
  chemically synthesized
aagatttattgacttcatat

SEQ ID NO: 27431 - DNA, 20 bp, Artificial Sequence
  chemically synthesized
ttgacttcatatcagcattt

SEQ ID NO: 27432 - DNA, 20 bp, Artificial Sequence
  chemically synthesized
atcagcatttaagtattgtt

SEQ ID NO: 27433 - DNA, 20 bp, Artificial Sequence
  chemically synthesized
gtattgttaagtttatgtaa

SEQ ID NO: 27434 - DNA, 20 bp, Artificial Sequence
  chemically synthesized
ttatgtaatagcatttgcaa

SEQ ID NO: 27435 - DNA, 20 bp, Artificial Sequence
  chemically synthesized
tatgtaatagcatttgcaat

SEQ ID NO: 27436 - DNA, 20 bp, Artificial Sequence
  chemically synthesized
atgtaatagcatttgcaatg

SEQ ID NO: 27437 - DNA, 20 bp, Artificial Sequence
  chemically synthesized
atagcatttgcaatggggat

SEQ ID NO: 27438 - DNA, 20 bp, Artificial Sequence
  chemically synthesized
ggtgcattttcaattgcacg

SEQ ID NO: 27439 - DNA, 20 bp, Artificial Sequence
  chemically synthesized
gtgcattttcaattgcacga

SEQ ID NO: 27440 - DNA, 20 bp, Artificial Sequence
  chemically synthesized
attttcaattgcacgaagga

SEQ ID NO: 27441 - DNA, 20 bp, Artificial Sequence
  chemically synthesized
aattgcacgaaggatagttt

SEQ ID NO: 27442 - DNA, 20 bp, Artificial Sequence
  chemically synthesized
gaaggatagttttagtatgt

SEQ ID NO: 27443 - DNA, 20 bp, Artificial Sequence
  chemically synthesized
aaggatagttttagtatgtt

SEQ ID NO: 27444 - DNA, 20 bp, Artificial Sequence
  chemically synthesized
cttattgttgtctttatttg

SEQ ID NO: 27445 - DNA, 20 bp, Artificial Sequence
  chemically synthesized
ttgaagataatgtatgacct

SEQ ID NO: 27446 - DNA, 20 bp, Artificial Sequence
  chemically synthesized
tgaagataatgtatgacctc

SEQ ID NO: 27447 - DNA, 20 bp, Artificial Sequence
  chemically synthesized
gaagataatgtatgacctca

SEQ ID NO: 27448 - DNA, 20 bp, Artificial Sequence
  chemically synthesized
aagataatgtatgacctcag

SEQ ID NO: 27449 - DNA, 20 bp, Artificial Sequence
  chemically synthesized
atgacctcaggggatgtgta

SEQ ID NO: 27450 - DNA, 20 bp, Artificial Sequence
  chemically synthesized
tgacctcaggggatgtgtat

SEQ ID NO: 27451 - DNA, 20 bp, Artificial Sequence
  chemically synthesized
caggggatgtgtataggctc

SEQ ID NO: 27452 - DNA, 20 bp, Artificial Sequence
  chemically synthesized
gtgtataggctcaagttgac

SEQ ID NO: 27453 - DNA, 20 bp, Artificial Sequence
  chemically synthesized
aggctcaagttgacaagcga

SEQ ID NO: 27454 - DNA, 20 bp, Artificial Sequence
  chemically synthesized
gacaagcgatggacttgtga

SEQ ID NO: 27455 - DNA, 20 bp, Artificial Sequence
  chemically synthesized
gacttgtgatggttaatact

SEQ ID NO: 27456 - DNA, 20 bp, Artificial Sequence
  chemically synthesized
atactgagtgtcaacttgat

SEQ ID NO: 27457 - DNA, 20 bp, Artificial Sequence
  chemically synthesized
gtgtcaacttgattggattg

SEQ ID NO: 27458 - DNA, 20 bp, Artificial Sequence
  chemically synthesized
tgattggattgaagtgtgca

SEQ ID NO: 27459 - DNA, 20 bp, Artificial Sequence
  chemically synthesized
gtgtgcaaagtattgatcct

SEQ ID NO: 27460 - DNA, 20 bp, Artificial Sequence
  chemically synthesized
ttgatcctgagtgtgtctgt

SEQ ID NO: 27461 - DNA, 20 bp, Artificial Sequence
  chemically synthesized
tgatcctgagtgtgtctgtg

SEQ ID NO: 27462 - DNA, 20 bp, Artificial Sequence
  chemically synthesized
gatcctgagtgtgtctgtga

SEQ ID NO: 27463 - DNA, 20 bp, Artificial Sequence
  chemically synthesized
tgtctgtgagggtattgcca

SEQ ID NO: 27464 - DNA, 20 bp, Artificial Sequence
  chemically synthesized
gtctgtgagggtattgccaa

SEQ ID NO: 27465 - DNA, 20 bp, Artificial Sequence
  chemically synthesized
ctgtgagggtattgccaaag

SEQ ID NO: 27466 - DNA, 20 bp, Artificial Sequence
  chemically synthesized
gccaaaggagattaacattt

SEQ ID NO: 27467 - DNA, 20 bp, Artificial Sequence
  chemically synthesized
aaggagattaacattttagt

SEQ ID NO: 27468 - DNA, 20 bp, Artificial Sequence
  chemically synthesized
gagattaacattttagtcag

SEQ ID NO: 27469 - DNA, 20 bp, Artificial Sequence
  chemically synthesized
agattaacattttagtcagt

SEQ ID NO: 27470 - DNA, 20 bp, Artificial Sequence
  chemically synthesized
taacattttagtcagtgggc

SEQ ID NO: 27471 - DNA, 20 bp, Artificial Sequence
  chemically synthesized
aacattttagtcagtgggct

SEQ ID NO: 27472 - DNA, 20 bp, Artificial Sequence
  chemically synthesized
ttttagtcagtgggctggga

SEQ ID NO: 27473 - DNA, 20 bp, Artificial Sequence
  chemically synthesized
tttagtcagtgggctgggaa

SEQ ID NO: 27474 - DNA, 20 bp, Artificial Sequence
  chemically synthesized
agtcagtgggctgggaaagg

SEQ ID NO: 27475 - DNA, 20 bp, Artificial Sequence
  chemically synthesized
aggcagacccacccttaatc

SEQ ID NO: 27476 - DNA, 20 bp, Artificial Sequence
  chemically synthesized
ggcagacccacccttaatct

SEQ ID NO: 27477 - DNA, 20 bp, Artificial Sequence
  chemically synthesized
agacccacccttaatctggg

SEQ ID NO: 27478 - DNA, 20 bp, Artificial Sequence
  chemically synthesized
gacccacccttaatctgggt

SEQ ID NO: 27479 - DNA, 20 bp, Artificial Sequence
  chemically synthesized
ctgggtgggcaccatctaat

SEQ ID NO: 27480 - DNA, 20 bp, Artificial Sequence
  chemically synthesized
ggcaccatctaatcagttgc

SEQ ID NO: 27481 - DNA, 20 bp, Artificial Sequence
  chemically synthesized
catctaatcagttgccagtg

SEQ ID NO: 27482 - DNA, 20 bp, Artificial Sequence
  chemically synthesized
taatcagttgccagtgtggc

SEQ ID NO: 27483 - DNA, 20 bp, Artificial Sequence
  chemically synthesized
aatcagttgccagtgtggcc

SEQ ID NO: 27484 - DNA, 20 bp, Artificial Sequence
  chemically synthesized
gccagtgtggccaggatata

SEQ ID NO: 27485 - DNA, 20 bp, Artificial Sequence
  chemically synthesized
agtgtggccaggatataaag

SEQ ID NO: 27486 - DNA, 20 bp, Artificial Sequence
  chemically synthesized
gtgtggccaggatataaagc

SEQ ID NO: 27487 - DNA, 20 bp, Artificial Sequence
  chemically synthesized
tggccaggatataaagcagg

SEQ ID NO: 27488 - DNA, 20 bp, Artificial Sequence
  chemically synthesized
aaaaaaacatgtgaaaatcc

SEQ ID NO: 27489 - DNA, 20 bp, Artificial Sequence
  chemically synthesized
aacatgtgaaaatcctggac

SEQ ID NO: 27490 - DNA, 20 bp, Artificial Sequence
  chemically synthesized
gtgaaaatcctggactggct

SEQ ID NO: 27491 - DNA, 20 bp, Artificial Sequence
  chemically synthesized
cctggactggcttagcctcc

SEQ ID NO: 27492 - DNA, 20 bp, Artificial Sequence
  chemically synthesized
cctacatctttctcccatgc

SEQ ID NO: 27493 - DNA, 20 bp, Artificial Sequence
  chemically synthesized
tgcttcctgccctcaaacat

SEQ ID NO: 27494 - DNA, 20 bp, Artificial Sequence
  chemically synthesized
gccctcaaacattggactcc

SEQ ID NO: 27495 - DNA, 20 bp, Artificial Sequence
  chemically synthesized
acattggactccaagtcctt

SEQ ID NO: 27496 - DNA, 20 bp, Artificial Sequence
  chemically synthesized
gactccaagtccttcagctt

SEQ ID NO: 27497 - DNA, 20 bp, Artificial Sequence
  chemically synthesized
actccaagtccttcagcttt

SEQ ID NO: 27498 - DNA, 20 bp, Artificial Sequence
  chemically synthesized
agtccttcagctttgggact

SEQ ID NO: 27499 - DNA, 20 bp, Artificial Sequence
  chemically synthesized
ttcagctttgggacttggac

SEQ ID NO: 27500 - DNA, 20 bp, Artificial Sequence
  chemically synthesized
cttccttgctcctctgcttg

SEQ ID NO: 27501 - DNA, 20 bp, Artificial Sequence
  chemically synthesized
cttgctcctctgcttgcaga

SEQ ID NO: 27502 - DNA, 20 bp, Artificial Sequence
  chemically synthesized
tgcttgcagatggcctattg

SEQ ID NO: 27503 - DNA, 20 bp, Artificial Sequence
  chemically synthesized
gcttgcagatggcctattgt

SEQ ID NO: 27504 - DNA, 20 bp, Artificial Sequence
  chemically synthesized
gtgggaccttgtgattgtgt

SEQ ID NO: 27505 - DNA, 20 bp, Artificial Sequence
  chemically synthesized
tctatctatctatctcctat

SEQ ID NO: 27506 - DNA, 20 bp, Artificial Sequence
  chemically synthesized
tcctattagttctgtctctc

SEQ ID NO: 27507 - DNA, 20 bp, Artificial Sequence
  chemically synthesized
cctattagttctgtctctct

SEQ ID NO: 27508 - DNA, 20 bp, Artificial Sequence
  chemically synthesized
ctattagttctgtctctcta

SEQ ID NO: 27509 - DNA, 20 bp, Artificial Sequence
  chemically synthesized
ctagggaaccctgacaaata

SEQ ID NO: 27510 - DNA, 20 bp, Artificial Sequence
  chemically synthesized
ggaaccctgacaaatacagt

SEQ ID NO: 27511 - DNA, 20 bp, Artificial Sequence
  chemically synthesized
cctgacaaatacagtgagct

SEQ ID NO: 27512 - DNA, 20 bp, Artificial Sequence
  chemically synthesized
ctgacaaatacagtgagctc

SEQ ID NO: 27513 - DNA, 20 bp, Artificial Sequence
  chemically synthesized
atacagtgagctcaggtcct

SEQ ID NO: 27514 - DNA, 20 bp, Artificial Sequence
  chemically synthesized
cagtgagctcaggtcctgag

SEQ ID NO: 27515 - DNA, 20 bp, Artificial Sequence
  chemically synthesized
cctgagcagacattttccaa

SEQ ID NO: 27516 - DNA, 20 bp, Artificial Sequence
  chemically synthesized
gagcagacattttccaaaag

SEQ ID NO: 27517 - DNA, 20 bp, Artificial Sequence
  chemically synthesized
ttttccaaaagaagacatac

SEQ ID NO: 27518 - DNA, 20 bp, Artificial Sequence
  chemically synthesized
tccaaaagaagacatacaag

SEQ ID NO: 27519 - DNA, 20 bp, Artificial Sequence
  chemically synthesized
ggccaataaacgtcaaaaaa

SEQ ID NO: 27520 - DNA, 20 bp, Artificial Sequence
  chemically synthesized
agttcaacatcactaataat

SEQ ID NO: 27521 - DNA, 20 bp, Artificial Sequence
  chemically synthesized
ttcaacatcactaataatca

SEQ ID NO: 27522 - DNA, 20 bp, Artificial Sequence
  chemically synthesized
catatgatacctccttatgc

SEQ ID NO: 27523 - DNA, 20 bp, Artificial Sequence
  chemically synthesized
tgatacctccttatgccagt

SEQ ID NO: 27524 - DNA, 20 bp, Artificial Sequence
  chemically synthesized
cctccttatgccagtcagaa

SEQ ID NO: 27525 - DNA, 20 bp, Artificial Sequence
  chemically synthesized
tcagaatggctatcattata

SEQ ID NO: 27526 - DNA, 20 bp, Artificial Sequence
  chemically synthesized
atcattataaagttcaaaaa

SEQ ID NO: 27527 - DNA, 20 bp, Artificial Sequence
  chemically synthesized
attataaagttcaaaaacag

SEQ ID NO: 27528 - DNA, 20 bp, Artificial Sequence
  chemically synthesized
agttcaaaaacagcagatgt

SEQ ID NO: 27529 - DNA, 20 bp, Artificial Sequence
  chemically synthesized
caaaaacagcagatgttggt

SEQ ID NO: 27530 - DNA, 20 bp, Artificial Sequence
  chemically synthesized
aaaaacagcagatgttggtg

SEQ ID NO: 27531 - DNA, 20 bp, Artificial Sequence
  chemically synthesized
agcagatgttggtgaggatg

SEQ ID NO: 27532 - DNA, 20 bp, Artificial Sequence
  chemically synthesized
cagatgttggtgaggatgtg

SEQ ID NO: 27533 - DNA, 20 bp, Artificial Sequence
  chemically synthesized
gttggtgaggatgtggagac

SEQ ID NO: 27534 - DNA, 20 bp, Artificial Sequence
  chemically synthesized
agaaaatgcttatacactgt

SEQ ID NO: 27535 - DNA, 20 bp, Artificial Sequence
  chemically synthesized
aatgcttatacactgttggt

SEQ ID NO: 27536 - DNA, 20 bp, Artificial Sequence
  chemically synthesized
ctgttggtaagaatgtaaat

SEQ ID NO: 27537 - DNA, 20 bp, Artificial Sequence
  chemically synthesized
gtaaattagtacaaacttta

SEQ ID NO: 27538 - DNA, 20 bp, Artificial Sequence
  chemically synthesized
aattagtacaaactttatgg

SEQ ID NO: 27539 - DNA, 20 bp, Artificial Sequence
  chemically synthesized
agtacaaactttatggaaga

SEQ ID NO: 27540 - DNA, 20 bp, Artificial Sequence
  chemically synthesized
actttatggaagacagcatg

SEQ ID NO: 27541 - DNA, 20 bp, Artificial Sequence
  chemically synthesized
gacagcatgaagatttctta

SEQ ID NO: 27542 - DNA, 20 bp, Artificial Sequence
  chemically synthesized
atgaagatttcttaaagaac

SEQ ID NO: 27543 - DNA, 20 bp, Artificial Sequence
  chemically synthesized
atttcttaaagaactagaaa

SEQ ID NO: 27544 - DNA, 20 bp, Artificial Sequence
  chemically synthesized
caatcctgcaatcccactac

SEQ ID NO: 27545 - DNA, 20 bp, Artificial Sequence
  chemically synthesized
aatcctgcaatcccactact

SEQ ID NO: 27546 - DNA, 20 bp, Artificial Sequence
  chemically synthesized
tgcaatcccactactgggta

SEQ ID NO: 27547 - DNA, 20 bp, Artificial Sequence
  chemically synthesized
cactactgggtatggaccca

SEQ ID NO: 27548 - DNA, 20 bp, Artificial Sequence
  chemically synthesized
tgggtatggacccaaagtga

SEQ ID NO: 27549 - DNA, 20 bp, Artificial Sequence
  chemically synthesized
ggtatggacccaaagtgaaa

SEQ ID NO: 27550 - DNA, 20 bp, Artificial Sequence
  chemically synthesized
tgaaagagatcatattaaaa

SEQ ID NO: 27551 - DNA, 20 bp, Artificial Sequence
  chemically synthesized
attaaaaaagatatctgcat

SEQ ID NO: 27552 - DNA, 20 bp, Artificial Sequence
  chemically synthesized
tatctgcattagtatgttca

SEQ ID NO: 27553 - DNA, 20 bp, Artificial Sequence
  chemically synthesized
ctgcattagtatgttcaaag

SEQ ID NO: 27554 - DNA, 20 bp, Artificial Sequence
  chemically synthesized
caaagtagcactgttcccaa

SEQ ID NO: 27555 - DNA, 20 bp, Artificial Sequence
  chemically synthesized
tagcactgttcccaatagca

SEQ ID NO: 27556 - DNA, 20 bp, Artificial Sequence
  chemically synthesized
tgttcccaatagcaaagata

SEQ ID NO: 27557 - DNA, 20 bp, Artificial Sequence
  chemically synthesized
tcaacctaaatgtctaccaa

SEQ ID NO: 27558 - DNA, 20 bp, Artificial Sequence
  chemically synthesized
aatgtctaccaatggacgat

SEQ ID NO: 27559 - DNA, 20 bp, Artificial Sequence
  chemically synthesized
taccaatggacgattggata

SEQ ID NO: 27560 - DNA, 20 bp, Artificial Sequence
  chemically synthesized
acgattggataaagaaaatg

SEQ ID NO: 27561 - DNA, 20 bp, Artificial Sequence
  chemically synthesized
ttatatacatatatattact

SEQ ID NO: 27562 - DNA, 20 bp, Artificial Sequence
  chemically synthesized
tatattactcagccataaaa

SEQ ID NO: 27563 - DNA, 20 bp, Artificial Sequence
  chemically synthesized
gaatgaaatcatgtcttctc

SEQ ID NO: 27564 - DNA, 20 bp, Artificial Sequence
  chemically synthesized
tcatgtcttctctagaaaca

SEQ ID NO: 27565 - DNA, 20 bp, Artificial Sequence
  chemically synthesized
gtcttctctagaaacatggt

SEQ ID NO: 27566 - DNA, 20 bp, Artificial Sequence
  chemically synthesized
tctagaaacatggttagaac

SEQ ID NO: 27567 - DNA, 20 bp, Artificial Sequence
  chemically synthesized
tagaaacatggttagaactg

SEQ ID NO: 27568 - DNA, 20 bp, Artificial Sequence
  chemically synthesized
agaaacatggttagaactgg

SEQ ID NO: 27569 - DNA, 20 bp, Artificial Sequence
  chemically synthesized
gaactggaggacattatcct

SEQ ID NO: 27570 - DNA, 20 bp, Artificial Sequence
  chemically synthesized
ttatcctcagtgaaataact

SEQ ID NO: 27571 - DNA, 20 bp, Artificial Sequence
  chemically synthesized
tcagtgaaataactcagaaa

SEQ ID NO: 27572 - DNA, 20 bp, Artificial Sequence
  chemically synthesized
tgaaataactcagaaacaga

SEQ ID NO: 27573 - DNA, 20 bp, Artificial Sequence
  chemically synthesized
cagaaacagaaagtcaaaca

SEQ ID NO: 27574 - DNA, 20 bp, Artificial Sequence
  chemically synthesized
aaacacagtatgttctcatt

SEQ ID NO: 27575 - DNA, 20 bp, Artificial Sequence
  chemically synthesized
acagtatgttctcatttagt

SEQ ID NO: 27576 - DNA, 20 bp, Artificial Sequence
  chemically synthesized
agtatgttctcatttagtga

SEQ ID NO: 27577 - DNA, 20 bp, Artificial Sequence
  chemically synthesized
gttctcatttagtgagagcc

SEQ ID NO: 27578 - DNA, 20 bp, Artificial Sequence
  chemically synthesized
ctcatttagtgagagccaag

SEQ ID NO: 27579 - DNA, 20 bp, Artificial Sequence
  chemically synthesized
tcatttagtgagagccaagt

SEQ ID NO: 27580 - DNA, 20 bp, Artificial Sequence
  chemically synthesized
atttagtgagagccaagtgg

SEQ ID NO: 27581 - DNA, 20 bp, Artificial Sequence
  chemically synthesized
ccaagtgggagctaaacgat

SEQ ID NO: 27582 - DNA, 20 bp, Artificial Sequence
  chemically synthesized
gtgggagctaaacgatgagt

SEQ ID NO: 27583 - DNA, 20 bp, Artificial Sequence
  chemically synthesized
agctaaacgatgagtaagca

SEQ ID NO: 27584 - DNA, 20 bp, Artificial Sequence
  chemically synthesized
gatgagtaagcatagacata

SEQ ID NO: 27585 - DNA, 20 bp, Artificial Sequence
  chemically synthesized
agacatatagaatgaaataa

SEQ ID NO: 27586 - DNA, 20 bp, Artificial Sequence
  chemically synthesized
gaatgaaataatagacactt

SEQ ID NO: 27587 - DNA, 20 bp, Artificial Sequence
  chemically synthesized
aaataatagacacttgagac

SEQ ID NO: 27588 - DNA, 20 bp, Artificial Sequence
  chemically synthesized
ataatagacacttgagacta

SEQ ID NO: 27589 - DNA, 20 bp, Artificial Sequence
  chemically synthesized
tagacacttgagactagaga

SEQ ID NO: 27590 - DNA, 20 bp, Artificial Sequence
  chemically synthesized
agacacttgagactagagaa

SEQ ID NO: 27591 - DNA, 20 bp, Artificial Sequence
  chemically synthesized
cacttgagactagagaaagg

SEQ ID NO: 27592 - DNA, 20 bp, Artificial Sequence
  chemically synthesized
acttgagactagagaaaggt

SEQ ID NO: 27593 - DNA, 20 bp, Artificial Sequence
  chemically synthesized
ttgagactagagaaaggtgg

SEQ ID NO: 27594 - DNA, 20 bp, Artificial Sequence
  chemically synthesized
tgagactagagaaaggtggg

SEQ ID NO: 27595 - DNA, 20 bp, Artificial Sequence
  chemically synthesized
actagagaaaggtgggagga

SEQ ID NO: 27596 - DNA, 20 bp, Artificial Sequence
  chemically synthesized
ctagagaaaggtgggaggat

SEQ ID NO: 27597 - DNA, 20 bp, Artificial Sequence
  chemically synthesized
agagaaaggtgggaggatag

SEQ ID NO: 27598 - DNA, 20 bp, Artificial Sequence
  chemically synthesized
aaggtgggaggataggagta

SEQ ID NO: 27599 - DNA, 20 bp, Artificial Sequence
  chemically synthesized
tgggaggataggagtatggt

SEQ ID NO: 27600 - DNA, 20 bp, Artificial Sequence
  chemically synthesized
gggaggataggagtatggtg

SEQ ID NO: 27601 - DNA, 20 bp, Artificial Sequence
  chemically synthesized
tggtgaggactgaaaaacta

SEQ ID NO: 27602 - DNA, 20 bp, Artificial Sequence
  chemically synthesized
aggactgaaaaactacggat

SEQ ID NO: 27603 - DNA, 20 bp, Artificial Sequence
  chemically synthesized
tggatacaacattcactttt

SEQ ID NO: 27604 - DNA, 20 bp, Artificial Sequence
  chemically synthesized
ggatacaacattcacttttc

SEQ ID NO: 27605 - DNA, 20 bp, Artificial Sequence
  chemically synthesized
aacattcacttttcaggtga

SEQ ID NO: 27606 - DNA, 20 bp, Artificial Sequence
  chemically synthesized
ttcaggtgatggtccactaa

SEQ ID NO: 27607 - DNA, 20 bp, Artificial Sequence
  chemically synthesized
gtgatggtccactaaaagct

SEQ ID NO: 27608 - DNA, 20 bp, Artificial Sequence
  chemically synthesized
actatgcaacatacatatgt

SEQ ID NO: 27609 - DNA, 20 bp, Artificial Sequence
  chemically synthesized
ctatgcaacatacatatgta

SEQ ID NO: 27610 - DNA, 20 bp, Artificial Sequence
  chemically synthesized
catacatatgtaaggaaccc

SEQ ID NO: 27611 - DNA, 20 bp, Artificial Sequence
  chemically synthesized
cccgagcttgtaccctgata

SEQ ID NO: 27612 - DNA, 20 bp, Artificial Sequence
  chemically synthesized
ccaaatctcatcttgaattg

SEQ ID NO: 27613 - DNA, 20 bp, Artificial Sequence
  chemically synthesized
cccataatcctcacgtgttg

SEQ ID NO: 27614 - DNA, 20 bp, Artificial Sequence
  chemically synthesized
ccataatcctcacgtgttgt

SEQ ID NO: 27615 - DNA, 20 bp, Artificial Sequence
  chemically synthesized
ataatcctcacgtgttgtgg

SEQ ID NO: 27616 - DNA, 20 bp, Artificial Sequence
  chemically synthesized
taatcctcacgtgttgtggg

SEQ ID NO: 27617 - DNA, 20 bp, Artificial Sequence
  chemically synthesized
aatcctcacgtgttgtggga

SEQ ID NO: 27618 - DNA, 20 bp, Artificial Sequence
  chemically synthesized
cacgtgttgtgggagggatt

SEQ ID NO: 27619 - DNA, 20 bp, Artificial Sequence
  chemically synthesized
cgtgttgtgggagggatttg

SEQ ID NO: 27620 - DNA, 20 bp, Artificial Sequence
  chemically synthesized
gtgttgtgggagggatttgg

SEQ ID NO: 27621 - DNA, 20 bp, Artificial Sequence
  chemically synthesized
tgttgtgggagggatttgga

SEQ ID NO: 27622 - DNA, 20 bp, Artificial Sequence
  chemically synthesized
ttgtgggagggatttggagg

SEQ ID NO: 27623 - DNA, 20 bp, Artificial Sequence
  chemically synthesized
tgtgggagggatttggaggg

SEQ ID NO: 27624 - DNA, 20 bp, Artificial Sequence
  chemically synthesized
ggagggaggtaattgaatca

SEQ ID NO: 27625 - DNA, 20 bp, Artificial Sequence
  chemically synthesized
agggaggtaattgaatcata

SEQ ID NO: 27626 - DNA, 20 bp, Artificial Sequence
  chemically synthesized
gggaggtaattgaatcatag

SEQ ID NO: 27627 - DNA, 20 bp, Artificial Sequence
  chemically synthesized
gaggtaattgaatcatagag

SEQ ID NO: 27628 - DNA, 20 bp, Artificial Sequence
  chemically synthesized
aggtaattgaatcatagagg

SEQ ID NO: 27629 - DNA, 20 bp, Artificial Sequence
  chemically synthesized
ctctcatgctcttctcgtga

SEQ ID NO: 27630 - DNA, 20 bp, Artificial Sequence
  chemically synthesized
catgctcttctcgtgatagt

SEQ ID NO: 27631 - DNA, 20 bp, Artificial Sequence
  chemically synthesized
tcgtgatagtgagttcttac

SEQ ID NO: 27632 - DNA, 20 bp, Artificial Sequence
  chemically synthesized
tgagttcttacaagatctga

SEQ ID NO: 27633 - DNA, 20 bp, Artificial Sequence
  chemically synthesized
acaagatctgatggttttat

SEQ ID NO: 27634 - DNA, 20 bp, Artificial Sequence
  chemically synthesized
agatctgatggttttataag

SEQ ID NO: 27635 - DNA, 20 bp, Artificial Sequence
  chemically synthesized
cggcttttcccccttttgct

SEQ ID NO: 27636 - DNA, 20 bp, Artificial Sequence
  chemically synthesized
ctacttgctgctgccatgtg

SEQ ID NO: 27637 - DNA, 20 bp, Artificial Sequence
  chemically synthesized
cttgctgctgccatgtgaag

SEQ ID NO: 27638 - DNA, 20 bp, Artificial Sequence
  chemically synthesized
ttgctgctgccatgtgaaga

SEQ ID NO: 27639 - DNA, 20 bp, Artificial Sequence
  chemically synthesized
tcttcttctgccatgattgt

SEQ ID NO: 27640 - DNA, 20 bp, Artificial Sequence
  chemically synthesized
gccatgattgtaagtttccc

SEQ ID NO: 27641 - DNA, 20 bp, Artificial Sequence
  chemically synthesized
ccatgattgtaagtttcccg

SEQ ID NO: 27642 - DNA, 20 bp, Artificial Sequence
  chemically synthesized
taagtttcccgaggcctccc

SEQ ID NO: 27643 - DNA, 20 bp, Artificial Sequence
  chemically synthesized
ccgaggcctccccagccctg

SEQ ID NO: 27644 - DNA, 20 bp, Artificial Sequence
  chemically synthesized
ccccagccctgtggaactgt

SEQ ID NO: 27645 - DNA, 20 bp, Artificial Sequence
  chemically synthesized
ttttttccttataaattacc

SEQ ID NO: 27646 - DNA, 20 bp, Artificial Sequence
  chemically synthesized
ccttataaattacccagtct

SEQ ID NO: 27647 - DNA, 20 bp, Artificial Sequence
  chemically synthesized
cttataaattacccagtctc

SEQ ID NO: 27648 - DNA, 20 bp, Artificial Sequence
  chemically synthesized
agtctcaggtatgtctttat

SEQ ID NO: 27649 - DNA, 20 bp, Artificial Sequence
  chemically synthesized
ctcaggtatgtctttataag

SEQ ID NO: 27650 - DNA, 20 bp, Artificial Sequence
  chemically synthesized
taagcagcatgataacgaac

SEQ ID NO: 27651 - DNA, 20 bp, Artificial Sequence
  chemically synthesized
tttaaaaatataaaataaat

SEQ ID NO: 27652 - DNA, 20 bp, Artificial Sequence
  chemically synthesized
ataaattagatctgattgaa

SEQ ID NO: 27653 - DNA, 20 bp, Artificial Sequence
  chemically synthesized
taaattagatctgattgaaa

SEQ ID NO: 27654 - DNA, 20 bp, Artificial Sequence
  chemically synthesized
tgattgaaaaggcaaaaatt

SEQ ID NO: 27655 - DNA, 20 bp, Artificial Sequence
  chemically synthesized
tgaaaaggcaaaaattgagc

SEQ ID NO: 27656 - DNA, 20 bp, Artificial Sequence
  chemically synthesized
gcaagcaaaatatcacttaa

SEQ ID NO: 27657 - DNA, 20 bp, Artificial Sequence
  chemically synthesized
caagcaaaatatcacttaat

SEQ ID NO: 27658 - DNA, 20 bp, Artificial Sequence
  chemically synthesized
aagcaaaatatcacttaatg

SEQ ID NO: 27659 - DNA, 20 bp, Artificial Sequence
  chemically synthesized
tcacttaatggggtaattaa

SEQ ID NO: 27660 - DNA, 20 bp, Artificial Sequence
  chemically synthesized
cacttaatggggtaattaaa

SEQ ID NO: 27661 - DNA, 20 bp, Artificial Sequence
  chemically synthesized
acttaatggggtaattaaaa

SEQ ID NO: 27662 - DNA, 20 bp, Artificial Sequence
  chemically synthesized
atggggtaattaaaagggtg

SEQ ID NO: 27663 - DNA, 20 bp, Artificial Sequence
  chemically synthesized
aattaaaagggtgaagaaat

SEQ ID NO: 27664 - DNA, 20 bp, Artificial Sequence
  chemically synthesized
attaaaagggtgaagaaatt

SEQ ID NO: 27665 - DNA, 20 bp, Artificial Sequence
  chemically synthesized
gggtgaagaaattgggcaaa

SEQ ID NO: 27666 - DNA, 20 bp, Artificial Sequence
  chemically synthesized
attgggcaaatggatgtcat

SEQ ID NO: 27667 - DNA, 20 bp, Artificial Sequence
  chemically synthesized
ttgggcaaatggatgtcatg

SEQ ID NO: 27668 - DNA, 20 bp, Artificial Sequence
  chemically synthesized
gggcaaatggatgtcatgag

SEQ ID NO: 27669 - DNA, 20 bp, Artificial Sequence
  chemically synthesized
ggcaaatggatgtcatgagg

SEQ ID NO: 27670 - DNA, 20 bp, Artificial Sequence
  chemically synthesized
atgtcatgaggaggaatttt

SEQ ID NO: 27671 - DNA, 20 bp, Artificial Sequence
  chemically synthesized
tgtcatgaggaggaattttt

SEQ ID NO: 27672 - DNA, 20 bp, Artificial Sequence
  chemically synthesized
catgaggaggaatttttagg

SEQ ID NO: 27673 - DNA, 20 bp, Artificial Sequence
  chemically synthesized
tgaggaggaatttttaggca

SEQ ID NO: 27674 - DNA, 20 bp, Artificial Sequence
  chemically synthesized
gaggaggaatttttaggcag

SEQ ID NO: 27675 - DNA, 20 bp, Artificial Sequence
  chemically synthesized
gaatttttaggcagaggtaa

SEQ ID NO: 27676 - DNA, 20 bp, Artificial Sequence
  chemically synthesized
ttttaggcagaggtaatggt

SEQ ID NO: 27677 - DNA, 20 bp, Artificial Sequence
  chemically synthesized
ttaggcagaggtaatggtca

SEQ ID NO: 27678 - DNA, 20 bp, Artificial Sequence
  chemically synthesized
cagaggtaatggtcagagcc

SEQ ID NO: 27679 - DNA, 20 bp, Artificial Sequence
  chemically synthesized
agaggtaatggtcagagccc

SEQ ID NO: 27680 - DNA, 20 bp, Artificial Sequence
  chemically synthesized
atggtcagagcccaggccct

SEQ ID NO: 27681 - DNA, 20 bp, Artificial Sequence
  chemically synthesized
tcagagcccaggccctaagc

SEQ ID NO: 27682 - DNA, 20 bp, Artificial Sequence
  chemically synthesized
agagcccaggccctaagctg

SEQ ID NO: 27683 - DNA, 20 bp, Artificial Sequence
  chemically synthesized
gcccaggccctaagctggag

SEQ ID NO: 27684 - DNA, 20 bp, Artificial Sequence
  chemically synthesized
ccaggccctaagctggagta

SEQ ID NO: 27685 - DNA, 20 bp, Artificial Sequence
  chemically synthesized
taagctggagtagagtgtgc

SEQ ID NO: 27686 - DNA, 20 bp, Artificial Sequence
  chemically synthesized
aagctggagtagagtgtgca

SEQ ID NO: 27687 - DNA, 20 bp, Artificial Sequence
  chemically synthesized
tggagtagagtgtgcaagga

SEQ ID NO: 27688 - DNA, 20 bp, Artificial Sequence
  chemically synthesized
gagtagagtgtgcaaggaaa

SEQ ID NO: 27689 - DNA, 20 bp, Artificial Sequence
  chemically synthesized
agtgtgcaaggaaagagtaa

SEQ ID NO: 27690 - DNA, 20 bp, Artificial Sequence
  chemically synthesized
gtgtgcaaggaaagagtaat

SEQ ID NO: 27691 - DNA, 20 bp, Artificial Sequence
  chemically synthesized
gaaagagtaataggattgaa

SEQ ID NO: 27692 - DNA, 20 bp, Artificial Sequence
  chemically synthesized
aaagagtaataggattgaaa

SEQ ID NO: 27693 - DNA, 20 bp, Artificial Sequence
  chemically synthesized
ataggattgaaaaggataac

SEQ ID NO: 27694 - DNA, 20 bp, Artificial Sequence
  chemically synthesized
taggattgaaaaggataacc

SEQ ID NO: 27695 - DNA, 20 bp, Artificial Sequence
  chemically synthesized
gattgaaaaggataaccagg

SEQ ID NO: 27696 - DNA, 20 bp, Artificial Sequence
  chemically synthesized
attgaaaaggataaccaggt

SEQ ID NO: 27697 - DNA, 20 bp, Artificial Sequence
  chemically synthesized
tgaaaaggataaccaggtag

SEQ ID NO: 27698 - DNA, 20 bp, Artificial Sequence
  chemically synthesized
gaaaaggataaccaggtagg

SEQ ID NO: 27699 - DNA, 20 bp, Artificial Sequence
  chemically synthesized
gataaccaggtaggaggaca

SEQ ID NO: 27700 - DNA, 20 bp, Artificial Sequence
  chemically synthesized
ataaccaggtaggaggacat

SEQ ID NO: 27701 - DNA, 20 bp, Artificial Sequence
  chemically synthesized
taaccaggtaggaggacata

SEQ ID NO: 27702 - DNA, 20 bp, Artificial Sequence
  chemically synthesized
accaggtaggaggacatagg

SEQ ID NO: 27703 - DNA, 20 bp, Artificial Sequence
  chemically synthesized
ccaggtaggaggacataggg

SEQ ID NO: 27704 - DNA, 20 bp, Artificial Sequence
  chemically synthesized
caggtaggaggacataggga

SEQ ID NO: 27705 - DNA, 20 bp, Artificial Sequence
  chemically synthesized
aggtaggaggacatagggag

SEQ ID NO: 27706 - DNA, 20 bp, Artificial Sequence
  chemically synthesized
aggaggacatagggaggggt

SEQ ID NO: 27707 - DNA, 20 bp, Artificial Sequence
  chemically synthesized
ggaggacatagggaggggta

SEQ ID NO: 27708 - DNA, 20 bp, Artificial Sequence
  chemically synthesized
gaggacatagggaggggtaa

SEQ ID NO: 27709 - DNA, 20 bp, Artificial Sequence
  chemically synthesized
aggacatagggaggggtaag

SEQ ID NO: 27710 - DNA, 20 bp, Artificial Sequence
  chemically synthesized
gacatagggaggggtaaggg

SEQ ID NO: 27711 - DNA, 20 bp, Artificial Sequence
  chemically synthesized
acatagggaggggtaagggg

SEQ ID NO: 27712 - DNA, 20 bp, Artificial Sequence
  chemically synthesized
tagggaggggtaaggggagg

SEQ ID NO: 27713 - DNA, 20 bp, Artificial Sequence
  chemically synthesized
ggtaaggggaggaagacctc

SEQ ID NO: 27714 - DNA, 20 bp, Artificial Sequence
  chemically synthesized
aggaagacctccagtaaact

SEQ ID NO: 27715 - DNA, 20 bp, Artificial Sequence
  chemically synthesized
ggaagacctccagtaaactt

SEQ ID NO: 27716 - DNA, 20 bp, Artificial Sequence
  chemically synthesized
agacctccagtaaacttagg

SEQ ID NO: 27717 - DNA, 20 bp, Artificial Sequence
  chemically synthesized
gacctccagtaaacttaggc

SEQ ID NO: 27718 - DNA, 20 bp, Artificial Sequence
  chemically synthesized
aggcaggatatttcccgtga

SEQ ID NO: 27719 - DNA, 20 bp, Artificial Sequence
  chemically synthesized
actaaataataatcacatgt

SEQ ID NO: 27720 - DNA, 20 bp, Artificial Sequence
  chemically synthesized
aaataatctgtcgattactt

SEQ ID NO: 27721 - DNA, 20 bp, Artificial Sequence
  chemically synthesized
ttgagcaatactttgttcat

SEQ ID NO: 27722 - DNA, 20 bp, Artificial Sequence
  chemically synthesized
gcaatactttgttcatgagc

SEQ ID NO: 27723 - DNA, 20 bp, Artificial Sequence
  chemically synthesized
aatactttgttcatgagcta

SEQ ID NO: 27724 - DNA, 20 bp, Artificial Sequence
  chemically synthesized
ctttgttcatgagctagagc

SEQ ID NO: 27725 - DNA, 20 bp, Artificial Sequence
  chemically synthesized
tttgttcatgagctagagca

SEQ ID NO: 27726 - DNA, 20 bp, Artificial Sequence
  chemically synthesized
ttgttcatgagctagagcaa

SEQ ID NO: 27727 - DNA, 20 bp, Artificial Sequence
  chemically synthesized
tgttcatgagctagagcaag

SEQ ID NO: 27728 - DNA, 20 bp, Artificial Sequence
  chemically synthesized
ctagagcaaggggatgactc

SEQ ID NO: 27729 - DNA, 20 bp, Artificial Sequence
  chemically synthesized
agaaatcctttgtgaaatcc

SEQ ID NO: 27730 - DNA, 20 bp, Artificial Sequence
  chemically synthesized
aaatcctttgtgaaatcctg

SEQ ID NO: 27731 - DNA, 20 bp, Artificial Sequence
  chemically synthesized
aatcctttgtgaaatcctgg

SEQ ID NO: 27732 - DNA, 20 bp, Artificial Sequence
  chemically synthesized
tgtgaaatcctggaggtaat

SEQ ID NO: 27733 - DNA, 20 bp, Artificial Sequence
  chemically synthesized
tcctggaggtaataagatcc

SEQ ID NO: 27734 - DNA, 20 bp, Artificial Sequence
  chemically synthesized
atcttcaactcaattgcaaa

SEQ ID NO: 27735 - DNA, 20 bp, Artificial Sequence
  chemically synthesized
caaaacatattccatttcat

SEQ ID NO: 27736 - DNA, 20 bp, Artificial Sequence
  chemically synthesized
tattccatttcatcagacta

SEQ ID NO: 27737 - DNA, 20 bp, Artificial Sequence
  chemically synthesized
attccatttcatcagactac

SEQ ID NO: 27738 - DNA, 20 bp, Artificial Sequence
  chemically synthesized
catcagactacaggttttaa

SEQ ID NO: 27739 - DNA, 20 bp, Artificial Sequence
  chemically synthesized
atttcttaaatgtattattc

SEQ ID NO: 27740 - DNA, 20 bp, Artificial Sequence
  chemically synthesized
ccagtaacttatactttaca

SEQ ID NO: 27741 - DNA, 20 bp, Artificial Sequence
  chemically synthesized
tacatagtaaatcttatcaa

SEQ ID NO: 27742 - DNA, 20 bp, Artificial Sequence
  chemically synthesized
ttatcaatagtcacaatcaa

SEQ ID NO: 27743 - DNA, 20 bp, Artificial Sequence
  chemically synthesized
agtcacaatcaatggtcaca

SEQ ID NO: 27744 - DNA, 20 bp, Artificial Sequence
  chemically synthesized
cacaatcaatggtcacaaag

SEQ ID NO: 27745 - DNA, 20 bp, Artificial Sequence
  chemically synthesized
tcacaaagtagaacttcatc

SEQ ID NO: 27746 - DNA, 20 bp, Artificial Sequence
  chemically synthesized
acaaagtagaacttcatctg

SEQ ID NO: 27747 - DNA, 20 bp, Artificial Sequence
  chemically synthesized
tcatctggagacattacttt

SEQ ID NO: 27748 - DNA, 20 bp, Artificial Sequence
  chemically synthesized
ggagacattacttttagcct

SEQ ID NO: 27749 - DNA, 20 bp, Artificial Sequence
  chemically synthesized
gccatgcaaaatatactttt

SEQ ID NO: 27750 - DNA, 20 bp, Artificial Sequence
  chemically synthesized
tttggaaaattgccctttga

SEQ ID NO: 27751 - DNA, 20 bp, Artificial Sequence
  chemically synthesized
ttggaaaattgccctttgaa

SEQ ID NO: 27752 - DNA, 20 bp, Artificial Sequence
  chemically synthesized
aaaattgccctttgaaaggc

SEQ ID NO: 27753 - DNA, 20 bp, Artificial Sequence
  chemically synthesized
ctttgaaaggcgagacacaa

SEQ ID NO: 27754 - DNA, 20 bp, Artificial Sequence
  chemically synthesized
tttgaaaggcgagacacaaa

SEQ ID NO: 27755 - DNA, 20 bp, Artificial Sequence
  chemically synthesized
caaatgttgatgctattata

SEQ ID NO: 27756 - DNA, 20 bp, Artificial Sequence
  chemically synthesized
atgctattatatggtaccaa

SEQ ID NO: 27757 - DNA, 20 bp, Artificial Sequence
  chemically synthesized
tgctattatatggtaccaat

SEQ ID NO: 27758 - DNA, 20 bp, Artificial Sequence
  chemically synthesized
ataggattcattaatttata

SEQ ID NO: 27759 - DNA, 20 bp, Artificial Sequence
  chemically synthesized
taggattcattaatttataa

SEQ ID NO: 27760 - DNA, 20 bp, Artificial Sequence
  chemically synthesized
ggattcattaatttataaag

SEQ ID NO: 27761 - DNA, 20 bp, Artificial Sequence
  chemically synthesized
ttcattaatttataaaggag

SEQ ID NO: 27762 - DNA, 20 bp, Artificial Sequence
  chemically synthesized
cattaatttataaaggagaa

SEQ ID NO: 27763 - DNA, 20 bp, Artificial Sequence
  chemically synthesized
ctaatgtaactccaaaatgc

SEQ ID NO: 27764 - DNA, 20 bp, Artificial Sequence
  chemically synthesized
aatgcaagcaattttcatat

SEQ ID NO: 27765 - DNA, 20 bp, Artificial Sequence
  chemically synthesized
attttcatatgagtctacac

SEQ ID NO: 27766 - DNA, 20 bp, Artificial Sequence
  chemically synthesized
tacacaagctaattgtcctt

SEQ ID NO: 27767 - DNA, 20 bp, Artificial Sequence
  chemically synthesized
tccttaagaatttcatcttt

SEQ ID NO: 27768 - DNA, 20 bp, Artificial Sequence
  chemically synthesized
ccttaagaatttcatcttta

SEQ ID NO: 27769 - DNA, 20 bp, Artificial Sequence
  chemically synthesized
agaatttcatctttaaggaa

SEQ ID NO: 27770 - DNA, 20 bp, Artificial Sequence
  chemically synthesized
aagttttttactgtatcaaa

SEQ ID NO: 27771 - DNA, 20 bp, Artificial Sequence
  chemically synthesized
ttttttactgtatcaaaaag

SEQ ID NO: 27772 - DNA, 20 bp, Artificial Sequence
  chemically synthesized
aagaagtttaaactgtcatt

SEQ ID NO: 27773 - DNA, 20 bp, Artificial Sequence
  chemically synthesized
aagtttaaactgtcattgag

SEQ ID NO: 27774 - DNA, 20 bp, Artificial Sequence
  chemically synthesized
gtttaaactgtcattgagca

SEQ ID NO: 27775 - DNA, 20 bp, Artificial Sequence
  chemically synthesized
attgagcagagtctgataat

SEQ ID NO: 27776 - DNA, 20 bp, Artificial Sequence
  chemically synthesized
ttgagcagagtctgataata

SEQ ID NO: 27777 - DNA, 20 bp, Artificial Sequence
  chemically synthesized
ataaggacactgtcaaatca

SEQ ID NO: 27778 - DNA, 20 bp, Artificial Sequence
  chemically synthesized
gacactgtcaaatcacagtt

SEQ ID NO: 27779 - DNA, 20 bp, Artificial Sequence
  chemically synthesized
cagttcagatgttatgtgat

SEQ ID NO: 27780 - DNA, 20 bp, Artificial Sequence
  chemically synthesized
agttcagatgttatgtgatg

SEQ ID NO: 27781 - DNA, 20 bp, Artificial Sequence
  chemically synthesized
cagatgttatgtgatgagga

SEQ ID NO: 27782 - DNA, 20 bp, Artificial Sequence
  chemically synthesized
gttatgtgatgaggacagaa

SEQ ID NO: 27783 - DNA, 20 bp, Artificial Sequence
  chemically synthesized
gaggacagaatagaacacat

SEQ ID NO: 27784 - DNA, 20 bp, Artificial Sequence
  chemically synthesized
aggacagaatagaacacatg

SEQ ID NO: 27785 - DNA, 20 bp, Artificial Sequence
  chemically synthesized
gacagaatagaacacatgag

SEQ ID NO: 27786 - DNA, 20 bp, Artificial Sequence
  chemically synthesized
acagaatagaacacatgagg

SEQ ID NO: 27787 - DNA, 20 bp, Artificial Sequence
  chemically synthesized
gaatagaacacatgaggagg

SEQ ID NO: 27788 - DNA, 20 bp, Artificial Sequence
  chemically synthesized
tagaacacatgaggaggaag

SEQ ID NO: 27789 - DNA, 20 bp, Artificial Sequence
  chemically synthesized
gaggaggaagcagaaacttc

SEQ ID NO: 27790 - DNA, 20 bp, Artificial Sequence
  chemically synthesized
ggaagcagaaacttctagac

SEQ ID NO: 27791 - DNA, 20 bp, Artificial Sequence
  chemically synthesized
cagaaacttctagactggac

SEQ ID NO: 27792 - DNA, 20 bp, Artificial Sequence
  chemically synthesized
acttctagactggacaagaa

SEQ ID NO: 27793 - DNA, 20 bp, Artificial Sequence
  chemically synthesized
aaccatccaacaataaatct

SEQ ID NO: 27794 - DNA, 20 bp, Artificial Sequence
  chemically synthesized
tgatgtcatctactacatct

SEQ ID NO: 27795 - DNA, 20 bp, Artificial Sequence
  chemically synthesized
ctaagtatttcctcaaattc

SEQ ID NO: 27796 - DNA, 20 bp, Artificial Sequence
  chemically synthesized
cctcaaattctggacaattt

SEQ ID NO: 27797 - DNA, 20 bp, Artificial Sequence
  chemically synthesized
aaccatcaaaattatttgtt

SEQ ID NO: 27798 - DNA, 20 bp, Artificial Sequence
  chemically synthesized
accatcaaaattatttgttg

SEQ ID NO: 27799 - DNA, 20 bp, Artificial Sequence
  chemically synthesized
ttgttgaggaaaaataaact

SEQ ID NO: 27800 - DNA, 20 bp, Artificial Sequence
  chemically synthesized
aataaacttagccaatttgc

SEQ ID NO: 27801 - DNA, 20 bp, Artificial Sequence
  chemically synthesized
ataaacttagccaatttgca

SEQ ID NO: 27802 - DNA, 20 bp, Artificial Sequence
  chemically synthesized
taaacttagccaatttgcaa

SEQ ID NO: 27803 - DNA, 20 bp, Artificial Sequence
  chemically synthesized
ttgcaagggcaactaaaatg

SEQ ID NO: 27804 - DNA, 20 bp, Artificial Sequence
  chemically synthesized
aaatgaagaacttttcttta

SEQ ID NO: 27805 - DNA, 20 bp, Artificial Sequence
  chemically synthesized
aagaacttttctttaaagtg

SEQ ID NO: 27806 - DNA, 20 bp, Artificial Sequence
  chemically synthesized
agaacttttctttaaagtgt

SEQ ID NO: 27807 - DNA, 20 bp, Artificial Sequence
  chemically synthesized
aacttttctttaaagtgtgg

SEQ ID NO: 27808 - DNA, 20 bp, Artificial Sequence
  chemically synthesized
aaagtgtgggagtcacatct

SEQ ID NO: 27809 - DNA, 20 bp, Artificial Sequence
  chemically synthesized
caacatatttaaatatatct

SEQ ID NO: 27810 - DNA, 20 bp, Artificial Sequence
  chemically synthesized
acaaaaatgcaaaatttcca

SEQ ID NO: 27811 - DNA, 20 bp, Artificial Sequence
  chemically synthesized
aaagaatttctcctcttctg

SEQ ID NO: 27812 - DNA, 20 bp, Artificial Sequence
  chemically synthesized
ttcttcatcttcatcttttc

SEQ ID NO: 27813 - DNA, 20 bp, Artificial Sequence
  chemically synthesized
tcttcatcttcatcttttcc

SEQ ID NO: 27814 - DNA, 20 bp, Artificial Sequence
  chemically synthesized
ttcatcttcatcttttccag

SEQ ID NO: 27815 - DNA, 20 bp, Artificial Sequence
  chemically synthesized
tttccaggagaatataccat

SEQ ID NO: 27816 - DNA, 20 bp, Artificial Sequence
  chemically synthesized
aatataccataagtttctga

SEQ ID NO: 27817 - DNA, 20 bp, Artificial Sequence
  chemically synthesized
ttctgatggtacacatttat

SEQ ID NO: 27818 - DNA, 20 bp, Artificial Sequence
  chemically synthesized
ttgcaactatgcatcttact

SEQ ID NO: 27819 - DNA, 20 bp, Artificial Sequence
  chemically synthesized
gcaactatgcatcttactca

SEQ ID NO: 27820 - DNA, 20 bp, Artificial Sequence
  chemically synthesized
cttaaaacatccttgtttgt

SEQ ID NO: 27821 - DNA, 20 bp, Artificial Sequence
  chemically synthesized
tttcaaattcatatacactt

SEQ ID NO: 27822 - DNA, 20 bp, Artificial Sequence
  chemically synthesized
caaattcatatacactttgg

SEQ ID NO: 27823 - DNA, 20 bp, Artificial Sequence
  chemically synthesized
gcaaacatttttatttgctg

SEQ ID NO: 27824 - DNA, 20 bp, Artificial Sequence
  chemically synthesized
ttttatttgctgaagaacat

SEQ ID NO: 27825 - DNA, 20 bp, Artificial Sequence
  chemically synthesized
tttatttgctgaagaacata

SEQ ID NO: 27826 - DNA, 20 bp, Artificial Sequence
  chemically synthesized
ttatttgctgaagaacataa

SEQ ID NO: 27827 - DNA, 20 bp, Artificial Sequence
  chemically synthesized
tatttgctgaagaacataag

SEQ ID NO: 27828 - DNA, 20 bp, Artificial Sequence
  chemically synthesized
atttgctgaagaacataagg

SEQ ID NO: 27829 - DNA, 20 bp, Artificial Sequence
  chemically synthesized
tgaagaacataagggggaaa

SEQ ID NO: 27830 - DNA, 20 bp, Artificial Sequence
  chemically synthesized
aagaacataagggggaaata

SEQ ID NO: 27831 - DNA, 20 bp, Artificial Sequence
  chemically synthesized
aaatagagattctttatttg

SEQ ID NO: 27832 - DNA, 20 bp, Artificial Sequence
  chemically synthesized
aagaaacaaatgatttgatt

SEQ ID NO: 27833 - DNA, 20 bp, Artificial Sequence
  chemically synthesized
agaaacaaatgatttgattt

SEQ ID NO: 27834 - DNA, 20 bp, Artificial Sequence
  chemically synthesized
gatttgggaaatgaaatgaa

SEQ ID NO: 27835 - DNA, 20 bp, Artificial Sequence
  chemically synthesized
atgaaatgaaaagaaaaaca

SEQ ID NO: 27836 - DNA, 20 bp, Artificial Sequence
  chemically synthesized
gctacttcttttactcatct

SEQ ID NO: 27837 - DNA, 20 bp, Artificial Sequence
  chemically synthesized
ctacttcttttactcatctg

SEQ ID NO: 27838 - DNA, 20 bp, Artificial Sequence
  chemically synthesized
ttttactcatctgaggcctt

SEQ ID NO: 27839 - DNA, 20 bp, Artificial Sequence
  chemically synthesized
actcatctgaggccttcaga

SEQ ID NO: 27840 - DNA, 20 bp, Artificial Sequence
  chemically synthesized
ccttcagatagtcccccata

SEQ ID NO: 27841 - DNA, 20 bp, Artificial Sequence
  chemically synthesized
gatagtcccccatatagcct

SEQ ID NO: 27842 - DNA, 20 bp, Artificial Sequence
  chemically synthesized
tagtcccccatatagcctta

SEQ ID NO: 27843 - DNA, 20 bp, Artificial Sequence
  chemically synthesized
aaaatatgattatgctcttt

SEQ ID NO: 27844 - DNA, 20 bp, Artificial Sequence
  chemically synthesized
attatgctctttcagtctat

SEQ ID NO: 27845 - DNA, 20 bp, Artificial Sequence
  chemically synthesized
ctattagaaataaaaacata

SEQ ID NO: 27846 - DNA, 20 bp, Artificial Sequence
  chemically synthesized
cataaagcttaaaaaatttc

SEQ ID NO: 27847 - DNA, 20 bp, Artificial Sequence
  chemically synthesized
ataaagcttaaaaaatttca

SEQ ID NO: 27848 - DNA, 20 bp, Artificial Sequence
  chemically synthesized
taaagcttaaaaaatttcaa

SEQ ID NO: 27849 - DNA, 20 bp, Artificial Sequence
  chemically synthesized
agcttaaaaaatttcaaggg

SEQ ID NO: 27850 - DNA, 20 bp, Artificial Sequence
  chemically synthesized
gcttaaaaaatttcaaggga

SEQ ID NO: 27851 - DNA, 20 bp, Artificial Sequence
  chemically synthesized
cttaaaaaatttcaagggaa

SEQ ID NO: 27852 - DNA, 20 bp, Artificial Sequence
  chemically synthesized
ttaaaaaatttcaagggaag

SEQ ID NO: 27853 - DNA, 20 bp, Artificial Sequence
  chemically synthesized
atttcaagggaaggggcttg

SEQ ID NO: 27854 - DNA, 20 bp, Artificial Sequence
  chemically synthesized
gggcttgaagattactgact

SEQ ID NO: 27855 - DNA, 20 bp, Artificial Sequence
  chemically synthesized
ggcttgaagattactgacta

SEQ ID NO: 27856 - DNA, 20 bp, Artificial Sequence
  chemically synthesized
gcttgaagattactgactaa

SEQ ID NO: 27857 - DNA, 20 bp, Artificial Sequence
  chemically synthesized
tgaagattactgactaaggg

SEQ ID NO: 27858 - DNA, 20 bp, Artificial Sequence
  chemically synthesized
tgacactcacctcctccaca

SEQ ID NO: 27859 - DNA, 20 bp, Artificial Sequence
  chemically synthesized
tcctccacaaagaaccaaaa

SEQ ID NO: 27860 - DNA, 20 bp, Artificial Sequence
  chemically synthesized
ccacaaagaaccaaaatagt

SEQ ID NO: 27861 - DNA, 20 bp, Artificial Sequence
  chemically synthesized
caaagaaccaaaatagtaag

SEQ ID NO: 27862 - DNA, 20 bp, Artificial Sequence
  chemically synthesized
gtaagtagaaaatcccacat

SEQ ID NO: 27863 - DNA, 20 bp, Artificial Sequence
  chemically synthesized
aagtagaaaatcccacataa

SEQ ID NO: 27864 - DNA, 20 bp, Artificial Sequence
  chemically synthesized
gtagaaaatcccacataaga

SEQ ID NO: 27865 - DNA, 20 bp, Artificial Sequence
  chemically synthesized
tcccacataagagagaattc

SEQ ID NO: 27866 - DNA, 20 bp, Artificial Sequence
  chemically synthesized
gagagaattctggaattcaa

SEQ ID NO: 27867 - DNA, 20 bp, Artificial Sequence
  chemically synthesized
gagaattctggaattcaaca

SEQ ID NO: 27868 - DNA, 20 bp, Artificial Sequence
  chemically synthesized
aattctggaattcaacagag

SEQ ID NO: 27869 - DNA, 20 bp, Artificial Sequence
  chemically synthesized
ggaattcaacagagaagtga

SEQ ID NO: 27870 - DNA, 20 bp, Artificial Sequence
  chemically synthesized
gaattcaacagagaagtgac

SEQ ID NO: 27871 - DNA, 20 bp, Artificial Sequence
  chemically synthesized
ttcaacagagaagtgacagg

SEQ ID NO: 27872 - DNA, 20 bp, Artificial Sequence
  chemically synthesized
agaagtgacaggaagcatct

SEQ ID NO: 27873 - DNA, 20 bp, Artificial Sequence
  chemically synthesized
gaagtgacaggaagcatcta

SEQ ID NO: 27874 - DNA, 20 bp, Artificial Sequence
  chemically synthesized
aggaagcatctaaggcaatg

SEQ ID NO: 27875 - DNA, 20 bp, Artificial Sequence
  chemically synthesized
ggaagcatctaaggcaatga

SEQ ID NO: 27876 - DNA, 20 bp, Artificial Sequence
  chemically synthesized
gaagcatctaaggcaatgaa

SEQ ID NO: 27877 - DNA, 20 bp, Artificial Sequence
  chemically synthesized
aagcatctaaggcaatgaag

SEQ ID NO: 27878 - DNA, 20 bp, Artificial Sequence
  chemically synthesized
gcatctaaggcaatgaaggg

SEQ ID NO: 27879 - DNA, 20 bp, Artificial Sequence
  chemically synthesized
catctaaggcaatgaagggg

SEQ ID NO: 27880 - DNA, 20 bp, Artificial Sequence
  chemically synthesized
atctaaggcaatgaagggga

SEQ ID NO: 27881 - DNA, 20 bp, Artificial Sequence
  chemically synthesized
taaggcaatgaaggggaggg

SEQ ID NO: 27882 - DNA, 20 bp, Artificial Sequence
  chemically synthesized
gcaatgaaggggagggaagc

SEQ ID NO: 27883 - DNA, 20 bp, Artificial Sequence
  chemically synthesized
caatgaaggggagggaagca

SEQ ID NO: 27884 - DNA, 20 bp, Artificial Sequence
  chemically synthesized
tgaaggggagggaagcaagg

SEQ ID NO: 27885 - DNA, 20 bp, Artificial Sequence
  chemically synthesized
gggaagcaaggaagcctacc

SEQ ID NO: 27886 - DNA, 20 bp, Artificial Sequence
  chemically synthesized
aagcaaggaagcctacccag

SEQ ID NO: 27887 - DNA, 20 bp, Artificial Sequence
  chemically synthesized
agcaaggaagcctacccagt

SEQ ID NO: 27888 - DNA, 20 bp, Artificial Sequence
  chemically synthesized
gcaaggaagcctacccagta

SEQ ID NO: 27889 - DNA, 20 bp, Artificial Sequence
  chemically synthesized
acccagtagggatcctctgt

SEQ ID NO: 27890 - DNA, 20 bp, Artificial Sequence
  chemically synthesized
cccagtagggatcctctgtg

SEQ ID NO: 27891 - DNA, 20 bp, Artificial Sequence
  chemically synthesized
gtagggatcctctgtgaggc

SEQ ID NO: 27892 - DNA, 20 bp, Artificial Sequence
  chemically synthesized
agggatcctctgtgaggcca

SEQ ID NO: 27893 - DNA, 20 bp, Artificial Sequence
  chemically synthesized
ggatcctctgtgaggccaga

SEQ ID NO: 27894 - DNA, 20 bp, Artificial Sequence
  chemically synthesized
gatcctctgtgaggccagag

SEQ ID NO: 27895 - DNA, 20 bp, Artificial Sequence
  chemically synthesized
gtgaggccagagaggctccc

SEQ ID NO: 27896 - DNA, 20 bp, Artificial Sequence
  chemically synthesized
gaggctccccagtgcatcga

SEQ ID NO: 27897 - DNA, 20 bp, Artificial Sequence
  chemically synthesized
tccccagtgcatcgaaagtt

SEQ ID NO: 27898 - DNA, 20 bp, Artificial Sequence
  chemically synthesized
aaagttaagtgactgactcc

SEQ ID NO: 27899 - DNA, 20 bp, Artificial Sequence
  chemically synthesized
gttaagtgactgactcccag

SEQ ID NO: 27900 - DNA, 20 bp, Artificial Sequence
  chemically synthesized
agtggtccacatctgcatta

SEQ ID NO: 27901 - DNA, 20 bp, Artificial Sequence
  chemically synthesized
cacatctgcattatggactc

SEQ ID NO: 27902 - DNA, 20 bp, Artificial Sequence
  chemically synthesized
acatctgcattatggactcc

SEQ ID NO: 27903 - DNA, 20 bp, Artificial Sequence
  chemically synthesized
attatggactccaggaatcc

SEQ ID NO: 27904 - DNA, 20 bp, Artificial Sequence
  chemically synthesized
gactccaggaatcctagcca

SEQ ID NO: 27905 - DNA, 20 bp, Artificial Sequence
  chemically synthesized
actccaggaatcctagccac

SEQ ID NO: 27906 - DNA, 20 bp, Artificial Sequence
  chemically synthesized
tccaggaatcctagccacag

SEQ ID NO: 27907 - DNA, 20 bp, Artificial Sequence
  chemically synthesized
caggaatcctagccacagga

SEQ ID NO: 27908 - DNA, 20 bp, Artificial Sequence
  chemically synthesized
aggagagtcccttgaccatg

SEQ ID NO: 27909 - DNA, 20 bp, Artificial Sequence
  chemically synthesized
ggagagtcccttgaccatgc

SEQ ID NO: 27910 - DNA, 20 bp, Artificial Sequence
  chemically synthesized
cccttgaccatgcaggcctt

SEQ ID NO: 27911 - DNA, 20 bp, Artificial Sequence
  chemically synthesized
gcaggccttgagactatcat

SEQ ID NO: 27912 - DNA, 20 bp, Artificial Sequence
  chemically synthesized
caggccttgagactatcata

SEQ ID NO: 27913 - DNA, 20 bp, Artificial Sequence
  chemically synthesized
gactatcataaggaactgcc

SEQ ID NO: 27914 - DNA, 20 bp, Artificial Sequence
  chemically synthesized
aactgcccagcaatcgcaca

SEQ ID NO: 27915 - DNA, 20 bp, Artificial Sequence
  chemically synthesized
actgcccagcaatcgcacaa

SEQ ID NO: 27916 - DNA, 20 bp, Artificial Sequence
  chemically synthesized
atcgcacaaaggcattgctc

SEQ ID NO: 27917 - DNA, 20 bp, Artificial Sequence
  chemically synthesized
cgcacaaaggcattgctcca

SEQ ID NO: 27918 - DNA, 20 bp, Artificial Sequence
  chemically synthesized
acaaaggcattgctccagag

SEQ ID NO: 27919 - DNA, 20 bp, Artificial Sequence
  chemically synthesized
caaaggcattgctccagaga

SEQ ID NO: 27920 - DNA, 20 bp, Artificial Sequence
  chemically synthesized
aaggcattgctccagagaag

SEQ ID NO: 27921 - DNA, 20 bp, Artificial Sequence
  chemically synthesized
tccagagaaggagctctcac

SEQ ID NO: 27922 - DNA, 20 bp, Artificial Sequence
  chemically synthesized
ccagagaaggagctctcact

SEQ ID NO: 27923 - DNA, 20 bp, Artificial Sequence
  chemically synthesized
cccctgccatccccattact

SEQ ID NO: 27924 - DNA, 20 bp, Artificial Sequence
  chemically synthesized
ctgccatccccattactgag

SEQ ID NO: 27925 - DNA, 20 bp, Artificial Sequence
  chemically synthesized
catccccattactgagcagc

SEQ ID NO: 27926 - DNA, 20 bp, Artificial Sequence
  chemically synthesized
atccccattactgagcagca

SEQ ID NO: 27927 - DNA, 20 bp, Artificial Sequence
  chemically synthesized
gagcagcaaggtgccatttt

SEQ ID NO: 27928 - DNA, 20 bp, Artificial Sequence
  chemically synthesized
gcagcaaggtgccattttga

SEQ ID NO: 27929 - DNA, 20 bp, Artificial Sequence
  chemically synthesized
tttgagagcccaacacccac

SEQ ID NO: 27930 - DNA, 20 bp, Artificial Sequence
  chemically synthesized
caccagatgacatcgttcct

SEQ ID NO: 27931 - DNA, 20 bp, Artificial Sequence
  chemically synthesized
tctgcatctctacatccctg

SEQ ID NO: 27932 - DNA, 20 bp, Artificial Sequence
  chemically synthesized
ctgctgacatcccccaccca

SEQ ID NO: 27933 - DNA, 20 bp, Artificial Sequence
  chemically synthesized
gacatcccccacccacagct

SEQ ID NO: 27934 - DNA, 20 bp, Artificial Sequence
  chemically synthesized
ccacagctgagtgctactgc

SEQ ID NO: 27935 - DNA, 20 bp, Artificial Sequence
  chemically synthesized
ctactgctggctgctgtcac

SEQ ID NO: 27936 - DNA, 20 bp, Artificial Sequence
  chemically synthesized
tactgctggctgctgtcacc

SEQ ID NO: 27937 - DNA, 20 bp, Artificial Sequence
  chemically synthesized
actgctggctgctgtcacca

SEQ ID NO: 27938 - DNA, 20 bp, Artificial Sequence
  chemically synthesized
ggctgctgtcaccagggata

SEQ ID NO: 27939 - DNA, 20 bp, Artificial Sequence
  chemically synthesized
ccagggataaagtgtgtcat

SEQ ID NO: 27940 - DNA, 20 bp, Artificial Sequence
  chemically synthesized
gggataaagtgtgtcattag

SEQ ID NO: 27941 - DNA, 20 bp, Artificial Sequence
  chemically synthesized
ataaagtgtgtcattagaag

SEQ ID NO: 27942 - DNA, 20 bp, Artificial Sequence
  chemically synthesized
gaagtggactcccccacccc

SEQ ID NO: 27943 - DNA, 20 bp, Artificial Sequence
  chemically synthesized
gtggactcccccacccccag

SEQ ID NO: 27944 - DNA, 20 bp, Artificial Sequence
  chemically synthesized
gactcccccacccccagtag

SEQ ID NO: 27945 - DNA, 20 bp, Artificial Sequence
  chemically synthesized
actcccccacccccagtagc

SEQ ID NO: 27946 - DNA, 20 bp, Artificial Sequence
  chemically synthesized
ctcccccacccccagtagca

SEQ ID NO: 27947 - DNA, 20 bp, Artificial Sequence
  chemically synthesized
cagggctgctacacatttat

SEQ ID NO: 27948 - DNA, 20 bp, Artificial Sequence
  chemically synthesized
tacacatttataagctccct

SEQ ID NO: 27949 - DNA, 20 bp, Artificial Sequence
  chemically synthesized
agaaaatgctaccccacttg

SEQ ID NO: 27950 - DNA, 20 bp, Artificial Sequence
  chemically synthesized
ccccacttgcagccaccatc

SEQ ID NO: 27951 - DNA, 20 bp, Artificial Sequence
  chemically synthesized
cccacttgcagccaccatct

SEQ ID NO: 27952 - DNA, 20 bp, Artificial Sequence
  chemically synthesized
ccacttgcagccaccatctg

SEQ ID NO: 27953 - DNA, 20 bp, Artificial Sequence
  chemically synthesized
gggctgaaacacatgcccac

SEQ ID NO: 27954 - DNA, 20 bp, Artificial Sequence
  chemically synthesized
gcccaccagcaacccattta

SEQ ID NO: 27955 - DNA, 20 bp, Artificial Sequence
  chemically synthesized
tttatagctgctgccactga

SEQ ID NO: 27956 - DNA, 20 bp, Artificial Sequence
  chemically synthesized
aacacaccccgcaccccttc

SEQ ID NO: 27957 - DNA, 20 bp, Artificial Sequence
  chemically synthesized
cacaccccgcaccccttcaa

SEQ ID NO: 27958 - DNA, 20 bp, Artificial Sequence
  chemically synthesized
accccgcaccccttcaagag

SEQ ID NO: 27959 - DNA, 20 bp, Artificial Sequence
  chemically synthesized
ccccgcaccccttcaagagc

SEQ ID NO: 27960 - DNA, 20 bp, Artificial Sequence
  chemically synthesized
cccgcaccccttcaagagca

SEQ ID NO: 27961 - DNA, 20 bp, Artificial Sequence
  chemically synthesized
tcaagagcagggcaacaatg

SEQ ID NO: 27962 - DNA, 20 bp, Artificial Sequence
  chemically synthesized
agagcagggcaacaatgcag

SEQ ID NO: 27963 - DNA, 20 bp, Artificial Sequence
  chemically synthesized
gcagtagctgctaattcact

SEQ ID NO: 27964 - DNA, 20 bp, Artificial Sequence
  chemically synthesized
cagtagctgctaattcactc

SEQ ID NO: 27965 - DNA, 20 bp, Artificial Sequence
  chemically synthesized
aattcactcaggcattctgc

SEQ ID NO: 27966 - DNA, 20 bp, Artificial Sequence
  chemically synthesized
attcactcaggcattctgct

SEQ ID NO: 27967 - DNA, 20 bp, Artificial Sequence
  chemically synthesized
ttcactcaggcattctgctg

SEQ ID NO: 27968 - DNA, 20 bp, Artificial Sequence
  chemically synthesized
tcactcaggcattctgctgg

SEQ ID NO: 27969 - DNA, 20 bp, Artificial Sequence
  chemically synthesized
aggcattctgctgggggcct

SEQ ID NO: 27970 - DNA, 20 bp, Artificial Sequence
  chemically synthesized
ggcattctgctgggggcctg

SEQ ID NO: 27971 - DNA, 20 bp, Artificial Sequence
  chemically synthesized
gcctgaggatcactccactc

SEQ ID NO: 27972 - DNA, 20 bp, Artificial Sequence
  chemically synthesized
cactccactccagcctatga

SEQ ID NO: 27973 - DNA, 20 bp, Artificial Sequence
  chemically synthesized
ccactccagcctatgatagc

SEQ ID NO: 27974 - DNA, 20 bp, Artificial Sequence
  chemically synthesized
cggtgtccacacacaccact

SEQ ID NO: 27975 - DNA, 20 bp, Artificial Sequence
  chemically synthesized
tgtccacacacaccactgag

SEQ ID NO: 27976 - DNA, 20 bp, Artificial Sequence
  chemically synthesized
cacacaccactgagtggcct

SEQ ID NO: 27977 - DNA, 20 bp, Artificial Sequence
  chemically synthesized
acacaccactgagtggcctg

SEQ ID NO: 27978 - DNA, 20 bp, Artificial Sequence
  chemically synthesized
accactgagtggcctgaggt

SEQ ID NO: 27979 - DNA, 20 bp, Artificial Sequence
  chemically synthesized
ccactgagtggcctgaggtc

SEQ ID NO: 27980 - DNA, 20 bp, Artificial Sequence
  chemically synthesized
ggcctgaggtcaggaacacc

SEQ ID NO: 27981 - DNA, 20 bp, Artificial Sequence
  chemically synthesized
gaggtcaggaacacccagcc

SEQ ID NO: 27982 - DNA, 20 bp, Artificial Sequence
  chemically synthesized
ctttgccttcctcaatgcct

SEQ ID NO: 27983 - DNA, 20 bp, Artificial Sequence
  chemically synthesized
gccttcctcaatgcctaagc

SEQ ID NO: 27984 - DNA, 20 bp, Artificial Sequence
  chemically synthesized
caatgcctaagcaagttgtc

SEQ ID NO: 27985 - DNA, 20 bp, Artificial Sequence
  chemically synthesized
aatgcctaagcaagttgtct

SEQ ID NO: 27986 - DNA, 20 bp, Artificial Sequence
  chemically synthesized
aagcaagttgtctgggaacc

SEQ ID NO: 27987 - DNA, 20 bp, Artificial Sequence
  chemically synthesized
gcaagttgtctgggaaccca

SEQ ID NO: 27988 - DNA, 20 bp, Artificial Sequence
  chemically synthesized
gttgtctgggaacccagaga

SEQ ID NO: 27989 - DNA, 20 bp, Artificial Sequence
  chemically synthesized
cttgtgccatccaccatgac

SEQ ID NO: 27990 - DNA, 20 bp, Artificial Sequence
  chemically synthesized
atccaccatgactggtacct

SEQ ID NO: 27991 - DNA, 20 bp, Artificial Sequence
  chemically synthesized
tggtacctaagcaaccctcc

SEQ ID NO: 27992 - DNA, 20 bp, Artificial Sequence
  chemically synthesized
tacctaagcaaccctcccag

SEQ ID NO: 27993 - DNA, 20 bp, Artificial Sequence
  chemically synthesized
ccctcccagaagcctgatga

SEQ ID NO: 27994 - DNA, 20 bp, Artificial Sequence
  chemically synthesized
cctcccagaagcctgatgat

SEQ ID NO: 27995 - DNA, 20 bp, Artificial Sequence
  chemically synthesized
tctgccactgccatcacaac

SEQ ID NO: 27996 - DNA, 20 bp, Artificial Sequence
  chemically synthesized
cctcctgcatgtgccacctg

SEQ ID NO: 27997 - DNA, 20 bp, Artificial Sequence
  chemically synthesized
ctcctgcatgtgccacctgt

SEQ ID NO: 27998 - DNA, 20 bp, Artificial Sequence
  chemically synthesized
atgtgccacctgtgggtctg

SEQ ID NO: 27999 - DNA, 20 bp, Artificial Sequence
  chemically synthesized
ccacctgtgggtctgaagac

SEQ ID NO: 28000 - DNA, 20 bp, Artificial Sequence
  chemically synthesized
ggtctgaagactggctcatt

SEQ ID NO: 28001 - DNA, 20 bp, Artificial Sequence
  chemically synthesized
actggctcattcagcccttg

SEQ ID NO: 28002 - DNA, 20 bp, Artificial Sequence
  chemically synthesized
cttgcagccaccaccaacac

SEQ ID NO: 28003 - DNA, 20 bp, Artificial Sequence
  chemically synthesized
agccaccaccaacaccagtg

SEQ ID NO: 28004 - DNA, 20 bp, Artificial Sequence
  chemically synthesized
caacaccagtgcagactgct

SEQ ID NO: 28005 - DNA, 20 bp, Artificial Sequence
  chemically synthesized
aacaccagtgcagactgctt

SEQ ID NO: 28006 - DNA, 20 bp, Artificial Sequence
  chemically synthesized
caccagtgcagactgcttgg

SEQ ID NO: 28007 - DNA, 20 bp, Artificial Sequence
  chemically synthesized
agtgcagactgcttgggagc

SEQ ID NO: 28008 - DNA, 20 bp, Artificial Sequence
  chemically synthesized
tgcagactgcttgggagcca

SEQ ID NO: 28009 - DNA, 20 bp, Artificial Sequence
  chemically synthesized
gcagactgcttgggagccag

SEQ ID NO: 28010 - DNA, 20 bp, Artificial Sequence
  chemically synthesized
cagactgcttgggagccaga

SEQ ID NO: 28011 - DNA, 20 bp, Artificial Sequence
  chemically synthesized
ggagccagagggttgtcctg

SEQ ID NO: 28012 - DNA, 20 bp, Artificial Sequence
  chemically synthesized
gggttgtcctgcagttgcta

SEQ ID NO: 28013 - DNA, 20 bp, Artificial Sequence
  chemically synthesized
cccacaccacacccactgtc

SEQ ID NO: 28014 - DNA, 20 bp, Artificial Sequence
  chemically synthesized
acaccacacccactgtccag

SEQ ID NO: 28015 - DNA, 20 bp, Artificial Sequence
  chemically synthesized
cacccactgtccagaagcct

SEQ ID NO: 28016 - DNA, 20 bp, Artificial Sequence
  chemically synthesized
acccactgtccagaagcctg

SEQ ID NO: 28017 - DNA, 20 bp, Artificial Sequence
  chemically synthesized
aagcctgaggacccacacac

SEQ ID NO: 28018 - DNA, 20 bp, Artificial Sequence
  chemically synthesized
tgaggacccacacaccagcc

SEQ ID NO: 28019 - DNA, 20 bp, Artificial Sequence
  chemically synthesized
cacaccagcccagtctacta

SEQ ID NO: 28020 - DNA, 20 bp, Artificial Sequence
  chemically synthesized
tatggccactactgacaccc

SEQ ID NO: 28021 - DNA, 20 bp, Artificial Sequence
  chemically synthesized
acacccaagcaaactgcctg

SEQ ID NO: 28022 - DNA, 20 bp, Artificial Sequence
  chemically synthesized
cacccaagcaaactgcctga

SEQ ID NO: 28023 - DNA, 20 bp, Artificial Sequence
  chemically synthesized
agcaaactgcctgaaggcca

SEQ ID NO: 28024 - DNA, 20 bp, Artificial Sequence
  chemically synthesized
ggccaaagaatcaacccaac

SEQ ID NO: 28025 - DNA, 20 bp, Artificial Sequence
  chemically synthesized
ccaactagactcattaccat

SEQ ID NO: 28026 - DNA, 20 bp, Artificial Sequence
  chemically synthesized
accatcagtgccaatgtaca

SEQ ID NO: 28027 - DNA, 20 bp, Artificial Sequence
  chemically synthesized
agtgccaatgtacacagcca

SEQ ID NO: 28028 - DNA, 20 bp, Artificial Sequence
  chemically synthesized
gtgccaatgtacacagccat

SEQ ID NO: 28029 - DNA, 20 bp, Artificial Sequence
  chemically synthesized
tgccaatgtacacagccatg

SEQ ID NO: 28030 - DNA, 20 bp, Artificial Sequence
  chemically synthesized
tgtacacagccatggggccc

SEQ ID NO: 28031 - DNA, 20 bp, Artificial Sequence
  chemically synthesized
gtacacagccatggggccca

SEQ ID NO: 28032 - DNA, 20 bp, Artificial Sequence
  chemically synthesized
acagccatggggcccaagga

SEQ ID NO: 28033 - DNA, 20 bp, Artificial Sequence
  chemically synthesized
cagccatggggcccaaggac

SEQ ID NO: 28034 - DNA, 20 bp, Artificial Sequence
  chemically synthesized
gggcccaaggacaggaatgc

SEQ ID NO: 28035 - DNA, 20 bp, Artificial Sequence
  chemically synthesized
ggcccaaggacaggaatgct

SEQ ID NO: 28036 - DNA, 20 bp, Artificial Sequence
  chemically synthesized
gctaggcccaccaccaccac

SEQ ID NO: 28037 - DNA, 20 bp, Artificial Sequence
  chemically synthesized
ctaggcccaccaccaccact

SEQ ID NO: 28038 - DNA, 20 bp, Artificial Sequence
  chemically synthesized
taggcccaccaccaccactg

SEQ ID NO: 28039 - DNA, 20 bp, Artificial Sequence
  chemically synthesized
ccaccaccaccactggggcc

SEQ ID NO: 28040 - DNA, 20 bp, Artificial Sequence
  chemically synthesized
caccaccaccactggggcca

SEQ ID NO: 28041 - DNA, 20 bp, Artificial Sequence
  chemically synthesized
ccaccactggggccaaggac

SEQ ID NO: 28042 - DNA, 20 bp, Artificial Sequence
  chemically synthesized
ccacttgatattcttgtctc

SEQ ID NO: 28043 - DNA, 20 bp, Artificial Sequence
  chemically synthesized
ttcactaacaaatgcaccct

SEQ ID NO: 28044 - DNA, 20 bp, Artificial Sequence
  chemically synthesized
ctaagccactgaaaaaatca

SEQ ID NO: 28045 - DNA, 20 bp, Artificial Sequence
  chemically synthesized
acagacactgatgatactgt

SEQ ID NO: 28046 - DNA, 20 bp, Artificial Sequence
  chemically synthesized
gacactgatgatactgttgg

SEQ ID NO: 28047 - DNA, 20 bp, Artificial Sequence
  chemically synthesized
agctgaaaaaaaataatatg

SEQ ID NO: 28048 - DNA, 20 bp, Artificial Sequence
  chemically synthesized
actatgctgctgtatgcacc

SEQ ID NO: 28049 - DNA, 20 bp, Artificial Sequence
  chemically synthesized
gcacctagaaatcaaaatca

SEQ ID NO: 28050 - DNA, 20 bp, Artificial Sequence
  chemically synthesized
tgccctactcaatcaacacc

SEQ ID NO: 28051 - DNA, 20 bp, Artificial Sequence
  chemically synthesized
tcaacaccaagatacatctt

SEQ ID NO: 28052 - DNA, 20 bp, Artificial Sequence
  chemically synthesized
caagatacatcttcagaaaa

SEQ ID NO: 28053 - DNA, 20 bp, Artificial Sequence
  chemically synthesized
caaaaacaaatttacaaaac

SEQ ID NO: 28054 - DNA, 20 bp, Artificial Sequence
  chemically synthesized
aaacaaatttacaaaactgg

SEQ ID NO: 28055 - DNA, 20 bp, Artificial Sequence
  chemically synthesized
caaatttacaaaactggaag

SEQ ID NO: 28056 - DNA, 20 bp, Artificial Sequence
  chemically synthesized
ggaagcagcaatcattacac

SEQ ID NO: 28057 - DNA, 20 bp, Artificial Sequence
  chemically synthesized
agcaatcattacaccagatg

SEQ ID NO: 28058 - DNA, 20 bp, Artificial Sequence
  chemically synthesized
caatcattacaccagatgca

SEQ ID NO: 28059 - DNA, 20 bp, Artificial Sequence
  chemically synthesized
agatgcagagatatcaatgc

SEQ ID NO: 28060 - DNA, 20 bp, Artificial Sequence
  chemically synthesized
aagaacaaaataaacataaa

SEQ ID NO: 28061 - DNA, 20 bp, Artificial Sequence
  chemically synthesized
agaacaaaataaacataaaa

SEQ ID NO: 28062 - DNA, 20 bp, Artificial Sequence
  chemically synthesized
aaaataaacataaaaaggtg

SEQ ID NO: 28063 - DNA, 20 bp, Artificial Sequence
  chemically synthesized
gaagaaatatgacacttcca

SEQ ID NO: 28064 - DNA, 20 bp, Artificial Sequence
  chemically synthesized
aagaaatatgacacttccaa

SEQ ID NO: 28065 - DNA, 20 bp, Artificial Sequence
  chemically synthesized
aaaggaatttaataattctt

SEQ ID NO: 28066 - DNA, 20 bp, Artificial Sequence
  chemically synthesized
taataattcttcagcaacat

SEQ ID NO: 28067 - DNA, 20 bp, Artificial Sequence
  chemically synthesized
aattcttcagcaacataagc

SEQ ID NO: 28068 - DNA, 20 bp, Artificial Sequence
  chemically synthesized
tcttcagcaacataagccag

SEQ ID NO: 28069 - DNA, 20 bp, Artificial Sequence
  chemically synthesized
acataagccagtggaaaaaa

SEQ ID NO: 28070 - DNA, 20 bp, Artificial Sequence
  chemically synthesized
aaaagacatttataaaattc

SEQ ID NO: 28071 - DNA, 20 bp, Artificial Sequence
  chemically synthesized
atttataaaattctggaaaa

SEQ ID NO: 28072 - DNA, 20 bp, Artificial Sequence
  chemically synthesized
gaatccaaaatgttgatatt

SEQ ID NO: 28073 - DNA, 20 bp, Artificial Sequence
  chemically synthesized
aatccaaaatgttgatatta

SEQ ID NO: 28074 - DNA, 20 bp, Artificial Sequence
  chemically synthesized
ccaaaatgttgatattaagg

SEQ ID NO: 28075 - DNA, 20 bp, Artificial Sequence
  chemically synthesized
atgttgatattaaggaagct

SEQ ID NO: 28076 - DNA, 20 bp, Artificial Sequence
  chemically synthesized
tgatattaaggaagctcagt

SEQ ID NO: 28077 - DNA, 20 bp, Artificial Sequence
  chemically synthesized
aaggaagctcagtgagacac

SEQ ID NO: 28078 - DNA, 20 bp, Artificial Sequence
  chemically synthesized
ggaagctcagtgagacacaa

SEQ ID NO: 28079 - DNA, 20 bp, Artificial Sequence
  chemically synthesized
cagtgagacacaagagaact

SEQ ID NO: 28080 - DNA, 20 bp, Artificial Sequence
  chemically synthesized
gaactcagataaacaataaa

SEQ ID NO: 28081 - DNA, 20 bp, Artificial Sequence
  chemically synthesized
gataaacaataaaaagaaat

SEQ ID NO: 28082 - DNA, 20 bp, Artificial Sequence
  chemically synthesized
aagaaatcagaaaaacaatt

SEQ ID NO: 28083 - DNA, 20 bp, Artificial Sequence
  chemically synthesized
agaaatcagaaaaacaattc

SEQ ID NO: 28084 - DNA, 20 bp, Artificial Sequence
  chemically synthesized
aaacaattcaggatatgaat

SEQ ID NO: 28085 - DNA, 20 bp, Artificial Sequence
  chemically synthesized
tatgaatgagaaatttaccc

SEQ ID NO: 28086 - DNA, 20 bp, Artificial Sequence
  chemically synthesized
tgaatgagaaatttacccaa

SEQ ID NO: 28087 - DNA, 20 bp, Artificial Sequence
  chemically synthesized
tgagaaatttacccaagaga

SEQ ID NO: 28088 - DNA, 20 bp, Artificial Sequence
  chemically synthesized
acccaagagatagatacaac

SEQ ID NO: 28089 - DNA, 20 bp, Artificial Sequence
  chemically synthesized
tacaacaagaatgaaccaaa

SEQ ID NO: 28090 - DNA, 20 bp, Artificial Sequence
  chemically synthesized
aaacagaaattctgtaactg

SEQ ID NO: 28091 - DNA, 20 bp, Artificial Sequence
  chemically synthesized
acagaaattctgtaactgaa

SEQ ID NO: 28092 - DNA, 20 bp, Artificial Sequence
  chemically synthesized
gtaactgaagagtttattga

SEQ ID NO: 28093 - DNA, 20 bp, Artificial Sequence
  chemically synthesized
acattcaaaaacttcaacaa

SEQ ID NO: 28094 - DNA, 20 bp, Artificial Sequence
  chemically synthesized
caaaaacttcaacaatagat

SEQ ID NO: 28095 - DNA, 20 bp, Artificial Sequence
  chemically synthesized
cttcaacaatagatcagatc

SEQ ID NO: 28096 - DNA, 20 bp, Artificial Sequence
  chemically synthesized
caacaatagatcagatcaag

SEQ ID NO: 28097 - DNA, 20 bp, Artificial Sequence
  chemically synthesized
caatagatcagatcaagcag

SEQ ID NO: 28098 - DNA, 20 bp, Artificial Sequence
  chemically synthesized
atcaagcagaagaaaaattt

SEQ ID NO: 28099 - DNA, 20 bp, Artificial Sequence
  chemically synthesized
aagaaaaatttcagaacttg

SEQ ID NO: 28100 - DNA, 20 bp, Artificial Sequence
  chemically synthesized
aaaatttcagaacttgaaga

SEQ ID NO: 28101 - DNA, 20 bp, Artificial Sequence
  chemically synthesized
aaatttcagaacttgaagac

SEQ ID NO: 28102 - DNA, 20 bp, Artificial Sequence
  chemically synthesized
gaagacaggtcttttaaaat

SEQ ID NO: 28103 - DNA, 20 bp, Artificial Sequence
  chemically synthesized
acaggtcttttaaaattagc

SEQ ID NO: 28104 - DNA, 20 bp, Artificial Sequence
  chemically synthesized
aaaattagctggtcaaatga

SEQ ID NO: 28105 - DNA, 20 bp, Artificial Sequence
  chemically synthesized
ttagctggtcaaatgataga

SEQ ID NO: 28106 - DNA, 20 bp, Artificial Sequence
  chemically synthesized
tagctggtcaaatgatagaa

SEQ ID NO: 28107 - DNA, 20 bp, Artificial Sequence
  chemically synthesized
aatgatagaaaggaaaaaaa

SEQ ID NO: 28108 - DNA, 20 bp, Artificial Sequence
  chemically synthesized
ggaaaaaaaaagaatgaaca

SEQ ID NO: 28109 - DNA, 20 bp, Artificial Sequence
  chemically synthesized
acaaagtgtatgtgacatat

SEQ ID NO: 28110 - DNA, 20 bp, Artificial Sequence
  chemically synthesized
caaagtgtatgtgacatatg

SEQ ID NO: 28111 - DNA, 20 bp, Artificial Sequence
  chemically synthesized
gtgacatatgaggcactata

SEQ ID NO: 28112 - DNA, 20 bp, Artificial Sequence
  chemically synthesized
tgaacaaatattcaaatttg

SEQ ID NO: 28113 - DNA, 20 bp, Artificial Sequence
  chemically synthesized
tattcaaatttgcagtttcc

SEQ ID NO: 28114 - DNA, 20 bp, Artificial Sequence
  chemically synthesized
tcaaatttgcagtttcccag

SEQ ID NO: 28115 - DNA, 20 bp, Artificial Sequence
  chemically synthesized
caaatttgcagtttcccaga

SEQ ID NO: 28116 - DNA, 20 bp, Artificial Sequence
  chemically synthesized
ttgcagtttcccagaaggta

SEQ ID NO: 28117 - DNA, 20 bp, Artificial Sequence
  chemically synthesized
gcagtttcccagaaggtaaa

SEQ ID NO: 28118 - DNA, 20 bp, Artificial Sequence
  chemically synthesized
agaaggtaaagagaacatga

SEQ ID NO: 28119 - DNA, 20 bp, Artificial Sequence
  chemically synthesized
gaaggtaaagagaacatgaa

SEQ ID NO: 28120 - DNA, 20 bp, Artificial Sequence
  chemically synthesized
taaagagaacatgaaaggtg

SEQ ID NO: 28121 - DNA, 20 bp, Artificial Sequence
  chemically synthesized
aaagagaacatgaaaggtgt

SEQ ID NO: 28122 - DNA, 20 bp, Artificial Sequence
  chemically synthesized
aaacctacgtaacaacacaa

SEQ ID NO: 28123 - DNA, 20 bp, Artificial Sequence
  chemically synthesized
acaatagctgaaaacttgtc

SEQ ID NO: 28124 - DNA, 20 bp, Artificial Sequence
  chemically synthesized
agctgaaaacttgtcaagtc

SEQ ID NO: 28125 - DNA, 20 bp, Artificial Sequence
  chemically synthesized
gaaaacttgtcaagtctagc

SEQ ID NO: 28126 - DNA, 20 bp, Artificial Sequence
  chemically synthesized
gtcaagtctagcaagaaatg

SEQ ID NO: 28127 - DNA, 20 bp, Artificial Sequence
  chemically synthesized
tagcaagaaatgtagacatc

SEQ ID NO: 28128 - DNA, 20 bp, Artificial Sequence
  chemically synthesized
acatccagacaaatgaaaat

SEQ ID NO: 28129 - DNA, 20 bp, Artificial Sequence
  chemically synthesized
cccaaataatataatgcaaa

SEQ ID NO: 28130 - DNA, 20 bp, Artificial Sequence
  chemically synthesized
atgcaaaaagctcttctcca

SEQ ID NO: 28131 - DNA, 20 bp, Artificial Sequence
  chemically synthesized
ctcttctccacagcacatta

SEQ ID NO: 28132 - DNA, 20 bp, Artificial Sequence
  chemically synthesized
cattatagtcaaactgtcaa

SEQ ID NO: 28133 - DNA, 20 bp, Artificial Sequence
  chemically synthesized
agtcaaactgtcaaaagcca

SEQ ID NO: 28134 - DNA, 20 bp, Artificial Sequence
  chemically synthesized
tcaaactgtcaaaagccaaa

SEQ ID NO: 28135 - DNA, 20 bp, Artificial Sequence
  chemically synthesized
actgtcaaaagccaaagagt

SEQ ID NO: 28136 - DNA, 20 bp, Artificial Sequence
  chemically synthesized
aaagagtaagaactctaaaa

SEQ ID NO: 28137 - DNA, 20 bp, Artificial Sequence
  chemically synthesized
agtaagaactctaaaacagc

SEQ ID NO: 28138 - DNA, 20 bp, Artificial Sequence
  chemically synthesized
aaaacagcaagcaaaatgtc

SEQ ID NO: 28139 - DNA, 20 bp, Artificial Sequence
  chemically synthesized
caaaatgtctagtcacttat

SEQ ID NO: 28140 - DNA, 20 bp, Artificial Sequence
  chemically synthesized
aaaatgtctagtcacttata

SEQ ID NO: 28141 - DNA, 20 bp, Artificial Sequence
  chemically synthesized
aaatgtctagtcacttataa

SEQ ID NO: 28142 - DNA, 20 bp, Artificial Sequence
  chemically synthesized
acttataagggaacttccac

SEQ ID NO: 28143 - DNA, 20 bp, Artificial Sequence
  chemically synthesized
gggaacttccacaagattaa

SEQ ID NO: 28144 - DNA, 20 bp, Artificial Sequence
  chemically synthesized
ccacaagattaacagattaa

SEQ ID NO: 28145 - DNA, 20 bp, Artificial Sequence
  chemically synthesized
caagattaacagattaacag

SEQ ID NO: 28146 - DNA, 20 bp, Artificial Sequence
  chemically synthesized
cagattaacagcagatttct

SEQ ID NO: 28147 - DNA, 20 bp, Artificial Sequence
  chemically synthesized
attaacagcagatttctcag

SEQ ID NO: 28148 - DNA, 20 bp, Artificial Sequence
  chemically synthesized
atttctcagcagaaacctca

SEQ ID NO: 28149 - DNA, 20 bp, Artificial Sequence
  chemically synthesized
tttctcagcagaaacctcac

SEQ ID NO: 28150 - DNA, 20 bp, Artificial Sequence
  chemically synthesized
tcagcagaaacctcacaggc

SEQ ID NO: 28151 - DNA, 20 bp, Artificial Sequence
  chemically synthesized
cagcagaaacctcacaggcc

SEQ ID NO: 28152 - DNA, 20 bp, Artificial Sequence
  chemically synthesized
gcagaaacctcacaggccag

SEQ ID NO: 28153 - DNA, 20 bp, Artificial Sequence
  chemically synthesized
gaaacctcacaggccaggag

SEQ ID NO: 28154 - DNA, 20 bp, Artificial Sequence
  chemically synthesized
cctcacaggccaggagaaga

SEQ ID NO: 28155 - DNA, 20 bp, Artificial Sequence
  chemically synthesized
ctcacaggccaggagaagat

SEQ ID NO: 28156 - DNA, 20 bp, Artificial Sequence
  chemically synthesized
atgggatgatatattcaaaa

SEQ ID NO: 28157 - DNA, 20 bp, Artificial Sequence
  chemically synthesized
tgatatattcaaaatagtga

SEQ ID NO: 28158 - DNA, 20 bp, Artificial Sequence
  chemically synthesized
tgaaagaaaaaaatgacacc

SEQ ID NO: 28159 - DNA, 20 bp, Artificial Sequence
  chemically synthesized
gaaagaaaaaaatgacacca

SEQ ID NO: 28160 - DNA, 20 bp, Artificial Sequence
  chemically synthesized
gacaccaaggatgttatacc

SEQ ID NO: 28161 - DNA, 20 bp, Artificial Sequence
  chemically synthesized
aacattgttcttcaaaaatg

SEQ ID NO: 28162 - DNA, 20 bp, Artificial Sequence
  chemically synthesized
acattgttcttcaaaaatga

SEQ ID NO: 28163 - DNA, 20 bp, Artificial Sequence
  chemically synthesized
aggataaataaaatcttttc

SEQ ID NO: 28164 - DNA, 20 bp, Artificial Sequence
  chemically synthesized
ggataaataaaatcttttct

SEQ ID NO: 28165 - DNA, 20 bp, Artificial Sequence
  chemically synthesized
aaataaaatcttttctgggc

SEQ ID NO: 28166 - DNA, 20 bp, Artificial Sequence
  chemically synthesized
ttctgggcaagaaaaatttg

SEQ ID NO: 28167 - DNA, 20 bp, Artificial Sequence
  chemically synthesized
tctgggcaagaaaaatttga

SEQ ID NO: 28168 - DNA, 20 bp, Artificial Sequence
  chemically synthesized
ttgaaggaattcactatcac

SEQ ID NO: 28169 - DNA, 20 bp, Artificial Sequence
  chemically synthesized
ggaattcactatcactagac

SEQ ID NO: 28170 - DNA, 20 bp, Artificial Sequence
  chemically synthesized
tatcactagactggctttac

SEQ ID NO: 28171 - DNA, 20 bp, Artificial Sequence
  chemically synthesized
tggctttacaagaaatattt

SEQ ID NO: 28172 - DNA, 20 bp, Artificial Sequence
  chemically synthesized
ggctttacaagaaatattta

SEQ ID NO: 28173 - DNA, 20 bp, Artificial Sequence
  chemically synthesized
gctttacaagaaatatttaa

SEQ ID NO: 28174 - DNA, 20 bp, Artificial Sequence
  chemically synthesized
tttacaagaaatatttaagg

SEQ ID NO: 28175 - DNA, 20 bp, Artificial Sequence
  chemically synthesized
taagggagtcctacacatga

SEQ ID NO: 28176 - DNA, 20 bp, Artificial Sequence
  chemically synthesized
agtcctacacatgaaagtga

SEQ ID NO: 28177 - DNA, 20 bp, Artificial Sequence
  chemically synthesized
gtcctacacatgaaagtgac

SEQ ID NO: 28178 - DNA, 20 bp, Artificial Sequence
  chemically synthesized
gacaggacactgccattatg

SEQ ID NO: 28179 - DNA, 20 bp, Artificial Sequence
  chemically synthesized
tgccattatgaagacacaca

SEQ ID NO: 28180 - DNA, 20 bp, Artificial Sequence
  chemically synthesized
gccattatgaagacacacaa

SEQ ID NO: 28181 - DNA, 20 bp, Artificial Sequence
  chemically synthesized
cacaaaggtatacaactaac

SEQ ID NO: 28182 - DNA, 20 bp, Artificial Sequence
  chemically synthesized
aaaggtatacaactaactgg

SEQ ID NO: 28183 - DNA, 20 bp, Artificial Sequence
  chemically synthesized
aggtatacaactaactggta

SEQ ID NO: 28184 - DNA, 20 bp, Artificial Sequence
  chemically synthesized
ggtagagcaaaacacaaata

SEQ ID NO: 28185 - DNA, 20 bp, Artificial Sequence
  chemically synthesized
agagcaaaacacaaataaag

SEQ ID NO: 28186 - DNA, 20 bp, Artificial Sequence
  chemically synthesized
agcaaaacacaaataaagaa

SEQ ID NO: 28187 - DNA, 20 bp, Artificial Sequence
  chemically synthesized
aaacacaaataaagaagaga

SEQ ID NO: 28188 - DNA, 20 bp, Artificial Sequence
  chemically synthesized
gaactcaaacgttaccacta

SEQ ID NO: 28189 - DNA, 20 bp, Artificial Sequence
  chemically synthesized
aaaccacaatcataaataat

SEQ ID NO: 28190 - DNA, 20 bp, Artificial Sequence
  chemically synthesized
cacaatcataaataataaga

SEQ ID NO: 28191 - DNA, 20 bp, Artificial Sequence
  chemically synthesized
atcataaataataagaaaga

SEQ ID NO: 28192 - DNA, 20 bp, Artificial Sequence
  chemically synthesized
taaataataagaaagaaaga

SEQ ID NO: 28193 - DNA, 20 bp, Artificial Sequence
  chemically synthesized
taataagaaagaaagaaaga

SEQ ID NO: 28194 - DNA, 20 bp, Artificial Sequence
  chemically synthesized
aagaaagaaagaaagaaaga

SEQ ID NO: 28195 - DNA, 20 bp, Artificial Sequence
  chemically synthesized
gaaagaaagaaagaaagaaa

SEQ ID NO: 28196 - DNA, 20 bp, Artificial Sequence
  chemically synthesized
aagaaagaaagaaagaaaga

SEQ ID NO: 28197 - DNA, 20 bp, Artificial Sequence
  chemically synthesized
gaaagaaagaaagaaagaga

SEQ ID NO: 28198 - DNA, 20 bp, Artificial Sequence
  chemically synthesized
aagaaagaaagaaagagaga

SEQ ID NO: 28199 - DNA, 20 bp, Artificial Sequence
  chemically synthesized
gaaagaaagaaagagagaga

SEQ ID NO: 28200 - DNA, 20 bp, Artificial Sequence
  chemically synthesized
aagaaagaaagagagagaga

SEQ ID NO: 28201 - DNA, 20 bp, Artificial Sequence
  chemically synthesized
gaaagaaagagagagagaga

SEQ ID NO: 28202 - DNA, 20 bp, Artificial Sequence
  chemically synthesized
gagagagagagagagaatga

SEQ ID NO: 28203 - DNA, 20 bp, Artificial Sequence
  chemically synthesized
gagagagagagaatgaaaga

SEQ ID NO: 28204 - DNA, 20 bp, Artificial Sequence
  chemically synthesized
agagagaatgaaagaaagaa

SEQ ID NO: 28205 - DNA, 20 bp, Artificial Sequence
  chemically synthesized
gagagaatgaaagaaagaaa

SEQ ID NO: 28206 - DNA, 20 bp, Artificial Sequence
  chemically synthesized
agaatgaaagaaagaaaagg

SEQ ID NO: 28207 - DNA, 20 bp, Artificial Sequence
  chemically synthesized
gaatgaaagaaagaaaagga

SEQ ID NO: 28208 - DNA, 20 bp, Artificial Sequence
  chemically synthesized
tgaaagaaagaaaaggaagg

SEQ ID NO: 28209 - DNA, 20 bp, Artificial Sequence
  chemically synthesized
gaaagaaagaaaaggaagga

SEQ ID NO: 28210 - DNA, 20 bp, Artificial Sequence
  chemically synthesized
agaaagaaaaggaaggaagg

SEQ ID NO: 28211 - DNA, 20 bp, Artificial Sequence
  chemically synthesized
taaaaaaaaaacaaaacaac

SEQ ID NO: 28212 - DNA, 20 bp, Artificial Sequence
  chemically synthesized
aaaaaaaaaacaaaacaacc

SEQ ID NO: 28213 - DNA, 20 bp, Artificial Sequence
  chemically synthesized
ccaggaatcaattaacaaaa

SEQ ID NO: 28214 - DNA, 20 bp, Artificial Sequence
  chemically synthesized
ggaatcaattaacaaaatgg

SEQ ID NO: 28215 - DNA, 20 bp, Artificial Sequence
  chemically synthesized
gaatcaattaacaaaatggc

SEQ ID NO: 28216 - DNA, 20 bp, Artificial Sequence
  chemically synthesized
attaacaaaatggcaggaat

SEQ ID NO: 28217 - DNA, 20 bp, Artificial Sequence
  chemically synthesized
aagctctcacatgtcaataa

SEQ ID NO: 28218 - DNA, 20 bp, Artificial Sequence
  chemically synthesized
ataatagccttgcatgtaaa

SEQ ID NO: 28219 - DNA, 20 bp, Artificial Sequence
  chemically synthesized
tggattaaattgttacttga

SEQ ID NO: 28220 - DNA, 20 bp, Artificial Sequence
  chemically synthesized
aaattgttacttgaaagata

SEQ ID NO: 28221 - DNA, 20 bp, Artificial Sequence
  chemically synthesized
gttacttgaaagatatagac

SEQ ID NO: 28222 - DNA, 20 bp, Artificial Sequence
  chemically synthesized
aaagatatagactggctaaa

SEQ ID NO: 28223 - DNA, 20 bp, Artificial Sequence
  chemically synthesized
tttaaaacaaaaatatgacc

SEQ ID NO: 28224 - DNA, 20 bp, Artificial Sequence
  chemically synthesized
caaaaatatgacccagttgt

SEQ ID NO: 28225 - DNA, 20 bp, Artificial Sequence
  chemically synthesized
cccagttgtaagctgcctat

SEQ ID NO: 28226 - DNA, 20 bp, Artificial Sequence
  chemically synthesized
agaaacttatctcacttgta

SEQ ID NO: 28227 - DNA, 20 bp, Artificial Sequence
  chemically synthesized
ctcacttgtaaagataaata

SEQ ID NO: 28228 - DNA, 20 bp, Artificial Sequence
  chemically synthesized
taaagataaatatagactga

SEQ ID NO: 28229 - DNA, 20 bp, Artificial Sequence
  chemically synthesized
aaatatagactgaaagtaaa

SEQ ID NO: 28230 - DNA, 20 bp, Artificial Sequence
  chemically synthesized
gactgaaagtaaaaagatga

SEQ ID NO: 28231 - DNA, 20 bp, Artificial Sequence
  chemically synthesized
gatgaaagatcttccataca

SEQ ID NO: 28232 - DNA, 20 bp, Artificial Sequence
  chemically synthesized
tgaaagatcttccatacaaa

SEQ ID NO: 28233 - DNA, 20 bp, Artificial Sequence
  chemically synthesized
tacaaagagaaaccaaaaat

SEQ ID NO: 28234 - DNA, 20 bp, Artificial Sequence
  chemically synthesized
gagaaaccaaaaatgagcaa

SEQ ID NO: 28235 - DNA, 20 bp, Artificial Sequence
  chemically synthesized
aaaccaaaaatgagcaaaag

SEQ ID NO: 28236 - DNA, 20 bp, Artificial Sequence
  chemically synthesized
aaaagtagttatacctataa

SEQ ID NO: 28237 - DNA, 20 bp, Artificial Sequence
  chemically synthesized
gactttaaataaaaaacact

SEQ ID NO: 28238 - DNA, 20 bp, Artificial Sequence
  chemically synthesized
ctttaaataaaaaacactaa

SEQ ID NO: 28239 - DNA, 20 bp, Artificial Sequence
  chemically synthesized
taaaaaacactaagagacaa

SEQ ID NO: 28240 - DNA, 20 bp, Artificial Sequence
  chemically synthesized
aagtcattacataatgataa

SEQ ID NO: 28241 - DNA, 20 bp, Artificial Sequence
  chemically synthesized
agtcattacataatgataaa

SEQ ID NO: 28242 - DNA, 20 bp, Artificial Sequence
  chemically synthesized
taatgataaaaggaacaatt

SEQ ID NO: 28243 - DNA, 20 bp, Artificial Sequence
  chemically synthesized
gataaaaggaacaattcagc

SEQ ID NO: 28244 - DNA, 20 bp, Artificial Sequence
  chemically synthesized
taaaaggaacaattcagcaa

SEQ ID NO: 28245 - DNA, 20 bp, Artificial Sequence
  chemically synthesized
taaacattcacactcaacac

SEQ ID NO: 28246 - DNA, 20 bp, Artificial Sequence
  chemically synthesized
aacattcacactcaacacca

SEQ ID NO: 28247 - DNA, 20 bp, Artificial Sequence
  chemically synthesized
acactcaacaccagagcatc

SEQ ID NO: 28248 - DNA, 20 bp, Artificial Sequence
  chemically synthesized
ccagagcatccagatatgta

SEQ ID NO: 28249 - DNA, 20 bp, Artificial Sequence
  chemically synthesized
atatgtaaagcaaatgttat

SEQ ID NO: 28250 - DNA, 20 bp, Artificial Sequence
  chemically synthesized
agcaaatgttattagatata

SEQ ID NO: 28251 - DNA, 20 bp, Artificial Sequence
  chemically synthesized
gcaaatgttattagatataa

SEQ ID NO: 28252 - DNA, 20 bp, Artificial Sequence
  chemically synthesized
caaatgttattagatataaa

SEQ ID NO: 28253 - DNA, 20 bp, Artificial Sequence
  chemically synthesized
attagatataaagggtgaaa

SEQ ID NO: 28254 - DNA, 20 bp, Artificial Sequence
  chemically synthesized
aatagaatccaatacaataa

SEQ ID NO: 28255 - DNA, 20 bp, Artificial Sequence
  chemically synthesized
gaatccaatacaataatagt

SEQ ID NO: 28256 - DNA, 20 bp, Artificial Sequence
  chemically synthesized
aatccaatacaataatagtt

SEQ ID NO: 28257 - DNA, 20 bp, Artificial Sequence
  chemically synthesized
atccaatacaataatagttg

SEQ ID NO: 28258 - DNA, 20 bp, Artificial Sequence
  chemically synthesized
ggatttcaacattctaatct

SEQ ID NO: 28259 - DNA, 20 bp, Artificial Sequence
  chemically synthesized
caacattctaatctcagcat

SEQ ID NO: 28260 - DNA, 20 bp, Artificial Sequence
  chemically synthesized
attctaatctcagcatcaga

SEQ ID NO: 28261 - DNA, 20 bp, Artificial Sequence
  chemically synthesized
tcagcatcagatagatcatc

SEQ ID NO: 28262 - DNA, 20 bp, Artificial Sequence
  chemically synthesized
catcagatagatcatctaga

SEQ ID NO: 28263 - DNA, 20 bp, Artificial Sequence
  chemically synthesized
atctagacagaaaattaaca

SEQ ID NO: 28264 - DNA, 20 bp, Artificial Sequence
  chemically synthesized
gaaaattaacaaagaaacat

SEQ ID NO: 28265 - DNA, 20 bp, Artificial Sequence
  chemically synthesized
attggatttaaacttgactt

SEQ ID NO: 28266 - DNA, 20 bp, Artificial Sequence
  chemically synthesized
aaacttgactttagaccaaa

SEQ ID NO: 28267 - DNA, 20 bp, Artificial Sequence
  chemically synthesized
ttacacaatatttcatccaa

SEQ ID NO: 28268 - DNA, 20 bp, Artificial Sequence
  chemically synthesized
aatatttcatccaacagcta

SEQ ID NO: 28269 - DNA, 20 bp, Artificial Sequence
  chemically synthesized
acagaatatatttatctcat

SEQ ID NO: 28270 - DNA, 20 bp, Artificial Sequence
  chemically synthesized
tcagcacatgacgcattccc

SEQ ID NO: 28271 - DNA, 20 bp, Artificial Sequence
  chemically synthesized
cagcacatgacgcattcccc

SEQ ID NO: 28272 - DNA, 20 bp, Artificial Sequence
  chemically synthesized
ccccaggatacaccatatgt

SEQ ID NO: 28273 - DNA, 20 bp, Artificial Sequence
  chemically synthesized
caccatatgttagaacacaa

SEQ ID NO: 28274 - DNA, 20 bp, Artificial Sequence
  chemically synthesized
catatgttagaacacaaaag

SEQ ID NO: 28275 - DNA, 20 bp, Artificial Sequence
  chemically synthesized
gaaatatttgaaatcatatt

SEQ ID NO: 28276 - DNA, 20 bp, Artificial Sequence
  chemically synthesized
aatcatattaagcatcttct

SEQ ID NO: 28277 - DNA, 20 bp, Artificial Sequence
  chemically synthesized
agcatcttctcagaccacaa

SEQ ID NO: 28278 - DNA, 20 bp, Artificial Sequence
  chemically synthesized
agaccacaatggaataaaac

SEQ ID NO: 28279 - DNA, 20 bp, Artificial Sequence
  chemically synthesized
taaaactagaaatcaataac

SEQ ID NO: 28280 - DNA, 20 bp, Artificial Sequence
  chemically synthesized
ttaaaacctatacaaataca

SEQ ID NO: 28281 - DNA, 20 bp, Artificial Sequence
  chemically synthesized
tcctgaatgaacgttatgtc

SEQ ID NO: 28282 - DNA, 20 bp, Artificial Sequence
  chemically synthesized
tgaatgaacgttatgtcaag

SEQ ID NO: 28283 - DNA, 20 bp, Artificial Sequence
  chemically synthesized
gttatgtcaagaagaaaatt

SEQ ID NO: 28284 - DNA, 20 bp, Artificial Sequence
  chemically synthesized
atgtcaagaagaaaattaag

SEQ ID NO: 28285 - DNA, 20 bp, Artificial Sequence
  chemically synthesized
tgtcaagaagaaaattaaga

SEQ ID NO: 28286 - DNA, 20 bp, Artificial Sequence
  chemically synthesized
atgaaaattgaaatacaaca

SEQ ID NO: 28287 - DNA, 20 bp, Artificial Sequence
  chemically synthesized
tgaaaattgaaatacaacat

SEQ ID NO: 28288 - DNA, 20 bp, Artificial Sequence
  chemically synthesized
attgaaatacaacataggaa

SEQ ID NO: 28289 - DNA, 20 bp, Artificial Sequence
  chemically synthesized
atacaacataggaaaagcca

SEQ ID NO: 28290 - DNA, 20 bp, Artificial Sequence
  chemically synthesized
tacaacataggaaaagccat

SEQ ID NO: 28291 - DNA, 20 bp, Artificial Sequence
  chemically synthesized
ataggaaaagccatgggata

SEQ ID NO: 28292 - DNA, 20 bp, Artificial Sequence
  chemically synthesized
aaagccatgggatacagcaa

SEQ ID NO: 28293 - DNA, 20 bp, Artificial Sequence
  chemically synthesized
gccatgggatacagcaaaag

SEQ ID NO: 28294 - DNA, 20 bp, Artificial Sequence
  chemically synthesized
gatacagcaaaagcagtgct

SEQ ID NO: 28295 - DNA, 20 bp, Artificial Sequence
  chemically synthesized
tacagcaaaagcagtgctaa

SEQ ID NO: 28296 - DNA, 20 bp, Artificial Sequence
  chemically synthesized
cagcaaaagcagtgctaaga

SEQ ID NO: 28297 - DNA, 20 bp, Artificial Sequence
  chemically synthesized
caaaagcagtgctaagagag

SEQ ID NO: 28298 - DNA, 20 bp, Artificial Sequence
  chemically synthesized
aaacacttaaattaaaaaca

SEQ ID NO: 28299 - DNA, 20 bp, Artificial Sequence
  chemically synthesized
acttaaattaaaaacataga

SEQ ID NO: 28300 - DNA, 20 bp, Artificial Sequence
  chemically synthesized
atctaatcatgtacctcaac

SEQ ID NO: 28301 - DNA, 20 bp, Artificial Sequence
  chemically synthesized
aatcatgtacctcaacaagc

SEQ ID NO: 28302 - DNA, 20 bp, Artificial Sequence
  chemically synthesized
tgtacctcaacaagctagaa

SEQ ID NO: 28303 - DNA, 20 bp, Artificial Sequence
  chemically synthesized
cctcaacaagctagaaaagc

SEQ ID NO: 28304 - DNA, 20 bp, Artificial Sequence
  chemically synthesized
gcaagaacaaaacccaaaac

SEQ ID NO: 28305 - DNA, 20 bp, Artificial Sequence
  chemically synthesized
agaacaaaacccaaaactag

SEQ ID NO: 28306 - DNA, 20 bp, Artificial Sequence
  chemically synthesized
acaaaacccaaaactagcag

SEQ ID NO: 28307 - DNA, 20 bp, Artificial Sequence
  chemically synthesized
caaaacccaaaactagcaga

SEQ ID NO: 28308 - DNA, 20 bp, Artificial Sequence
  chemically synthesized
acccaaaactagcagaagga

SEQ ID NO: 28309 - DNA, 20 bp, Artificial Sequence
  chemically synthesized
gcagaaggaaagaaaaaatg

SEQ ID NO: 28310 - DNA, 20 bp, Artificial Sequence
  chemically synthesized
aggaaagaaaaaatgaagaa

SEQ ID NO: 28311 - DNA, 20 bp, Artificial Sequence
  chemically synthesized
aaagaaaaaatgaagaacag

SEQ ID NO: 28312 - DNA, 20 bp, Artificial Sequence
  chemically synthesized
aacagaagaacttaatgaaa

SEQ ID NO: 28313 - DNA, 20 bp, Artificial Sequence
  chemically synthesized
cagaagaacttaatgaaata

SEQ ID NO: 28314 - DNA, 20 bp, Artificial Sequence
  chemically synthesized
aaatagagaaaaacaacaac

SEQ ID NO: 28315 - DNA, 20 bp, Artificial Sequence
  chemically synthesized
aatagagaaaaacaacaaca

SEQ ID NO: 28316 - DNA, 20 bp, Artificial Sequence
  chemically synthesized
atagagaaaaacaacaacaa

SEQ ID NO: 28317 - DNA, 20 bp, Artificial Sequence
  chemically synthesized
gaaaaacaacaacaagggat

SEQ ID NO: 28318 - DNA, 20 bp, Artificial Sequence
  chemically synthesized
caagggattagcaaaatgaa

SEQ ID NO: 28319 - DNA, 20 bp, Artificial Sequence
  chemically synthesized
tgaaaagttgttatttaaaa

SEQ ID NO: 28320 - DNA, 20 bp, Artificial Sequence
  chemically synthesized
gttatttaaaaaagataaaa

SEQ ID NO: 28321 - DNA, 20 bp, Artificial Sequence
  chemically synthesized
taaaaaagataaaatggata

SEQ ID NO: 28322 - DNA, 20 bp, Artificial Sequence
  chemically synthesized
agataaaatggatatagctc

SEQ ID NO: 28323 - DNA, 20 bp, Artificial Sequence
  chemically synthesized
aaaatggatatagctctagc

SEQ ID NO: 28324 - DNA, 20 bp, Artificial Sequence
  chemically synthesized
tagctctagctagactaacc

SEQ ID NO: 28325 - DNA, 20 bp, Artificial Sequence
  chemically synthesized
tagctagactaaccaagaaa

SEQ ID NO: 28326 - DNA, 20 bp, Artificial Sequence
  chemically synthesized
gctagactaaccaagaaaaa

SEQ ID NO: 28327 - DNA, 20 bp, Artificial Sequence
  chemically synthesized
agactaaccaagaaaaagag

SEQ ID NO: 28328 - DNA, 20 bp, Artificial Sequence
  chemically synthesized
actaaccaagaaaaagagaa

SEQ ID NO: 28329 - DNA, 20 bp, Artificial Sequence
  chemically synthesized
aaagagaagagactgaaata

SEQ ID NO: 28330 - DNA, 20 bp, Artificial Sequence
  chemically synthesized
gagactgaaataaagaaaat

SEQ ID NO: 28331 - DNA, 20 bp, Artificial Sequence
  chemically synthesized
aaagaaaatcagaaataaaa

SEQ ID NO: 28332 - DNA, 20 bp, Artificial Sequence
  chemically synthesized
atatattacaaccgatacca

SEQ ID NO: 28333 - DNA, 20 bp, Artificial Sequence
  chemically synthesized
tacaaccgataccacagaaa

SEQ ID NO: 28334 - DNA, 20 bp, Artificial Sequence
  chemically synthesized
ccgataccacagaaatagaa

SEQ ID NO: 28335 - DNA, 20 bp, Artificial Sequence
  chemically synthesized
acagaaatagaaaagattat

SEQ ID NO: 28336 - DNA, 20 bp, Artificial Sequence
  chemically synthesized
agaaatagaaaagattatca

SEQ ID NO: 28337 - DNA, 20 bp, Artificial Sequence
  chemically synthesized
cactaaaaaactgaaaaatc

SEQ ID NO: 28338 - DNA, 20 bp, Artificial Sequence
  chemically synthesized
ctaaaaaactgaaaaatcta

SEQ ID NO: 28339 - DNA, 20 bp, Artificial Sequence
  chemically synthesized
taaaaaactgaaaaatctag

SEQ ID NO: 28340 - DNA, 20 bp, Artificial Sequence
  chemically synthesized
agaggaaattaataaatttc

SEQ ID NO: 28341 - DNA, 20 bp, Artificial Sequence
  chemically synthesized
ctggacacataccacctacc

SEQ ID NO: 28342 - DNA, 20 bp, Artificial Sequence
  chemically synthesized
ccacctaccaagattgaatt

SEQ ID NO: 28343 - DNA, 20 bp, Artificial Sequence
  chemically synthesized
ctaccaagattgaattaaga

SEQ ID NO: 28344 - DNA, 20 bp, Artificial Sequence
  chemically synthesized
aagattgaattaagaaagaa

SEQ ID NO: 28345 - DNA, 20 bp, Artificial Sequence
  chemically synthesized
gaaagaatagaaaacctgaa

SEQ ID NO: 28346 - DNA, 20 bp, Artificial Sequence
  chemically synthesized
aatagaaaacctgaacagac

SEQ ID NO: 28347 - DNA, 20 bp, Artificial Sequence
  chemically synthesized
aatgaataatgaaattgaat

SEQ ID NO: 28348 - DNA, 20 bp, Artificial Sequence
  chemically synthesized
gaataatgaaattgaatcag

SEQ ID NO: 28349 - DNA, 20 bp, Artificial Sequence
  chemically synthesized
gaaattgaatcagtagtaaa

SEQ ID NO: 28350 - DNA, 20 bp, Artificial Sequence
  chemically synthesized
tagtaaaaagtctcccaaaa

SEQ ID NO: 28351 - DNA, 20 bp, Artificial Sequence
  chemically synthesized
ctcccaaaaaagaaaatttc

SEQ ID NO: 28352 - DNA, 20 bp, Artificial Sequence
  chemically synthesized
aaaaaagaaaatttcaagac

SEQ ID NO: 28353 - DNA, 20 bp, Artificial Sequence
  chemically synthesized
aagaaaatttcaagaccaga

SEQ ID NO: 28354 - DNA, 20 bp, Artificial Sequence
  chemically synthesized
caaattttaccaaactttca

SEQ ID NO: 28355 - DNA, 20 bp, Artificial Sequence
  chemically synthesized
aactttcaaagaaaactaac

SEQ ID NO: 28356 - DNA, 20 bp, Artificial Sequence
  chemically synthesized
aaattcttttaaaaattaaa

SEQ ID NO: 28357 - DNA, 20 bp, Artificial Sequence
  chemically synthesized
aattcttttaaaaattaaac

SEQ ID NO: 28358 - DNA, 20 bp, Artificial Sequence
  chemically synthesized
tcttttaaaaattaaacagg

SEQ ID NO: 28359 - DNA, 20 bp, Artificial Sequence
  chemically synthesized
cttttaaaaattaaacagga

SEQ ID NO: 28360 - DNA, 20 bp, Artificial Sequence
  chemically synthesized
ttctccctaactcattctct

SEQ ID NO: 28361 - DNA, 20 bp, Artificial Sequence
  chemically synthesized
tctccctaactcattctctg

SEQ ID NO: 28362 - DNA, 20 bp, Artificial Sequence
  chemically synthesized
cctaactcattctctgaggc

SEQ ID NO: 28363 - DNA, 20 bp, Artificial Sequence
  chemically synthesized
tattatcctgattccataac

SEQ ID NO: 28364 - DNA, 20 bp, Artificial Sequence
  chemically synthesized
tcctgattccataaccagac

SEQ ID NO: 28365 - DNA, 20 bp, Artificial Sequence
  chemically synthesized
cctgattccataaccagaca

SEQ ID NO: 28366 - DNA, 20 bp, Artificial Sequence
  chemically synthesized
ccataaccagacaaggatgc

SEQ ID NO: 28367 - DNA, 20 bp, Artificial Sequence
  chemically synthesized
tgcaagtaaaaataaaactg

SEQ ID NO: 28368 - DNA, 20 bp, Artificial Sequence
  chemically synthesized
gcaagtaaaaataaaactgc

SEQ ID NO: 28369 - DNA, 20 bp, Artificial Sequence
  chemically synthesized
ctgcaggtcaatatccctga

SEQ ID NO: 28370 - DNA, 20 bp, Artificial Sequence
  chemically synthesized
tcaatatccctgatggaaca

SEQ ID NO: 28371 - DNA, 20 bp, Artificial Sequence
  chemically synthesized
caatatccctgatggaacat

SEQ ID NO: 28372 - DNA, 20 bp, Artificial Sequence
  chemically synthesized
gaaaatcctcaacaaaatac

SEQ ID NO: 28373 - DNA, 20 bp, Artificial Sequence
  chemically synthesized
tactagcaaactgaatccaa

SEQ ID NO: 28374 - DNA, 20 bp, Artificial Sequence
  chemically synthesized
gaatccaacagtacatccaa

SEQ ID NO: 28375 - DNA, 20 bp, Artificial Sequence
  chemically synthesized
aaagataatacaccatgatc

SEQ ID NO: 28376 - DNA, 20 bp, Artificial Sequence
  chemically synthesized
gataatacaccatgatcaag

SEQ ID NO: 28377 - DNA, 20 bp, Artificial Sequence
  chemically synthesized
ataatacaccatgatcaagt

SEQ ID NO: 28378 - DNA, 20 bp, Artificial Sequence
  chemically synthesized
tgatcaagtgggatttatac

SEQ ID NO: 28379 - DNA, 20 bp, Artificial Sequence
  chemically synthesized
gatcaagtgggatttatact

SEQ ID NO: 28380 - DNA, 20 bp, Artificial Sequence
  chemically synthesized
atcaagtgggatttatacta

SEQ ID NO: 28381 - DNA, 20 bp, Artificial Sequence
  chemically synthesized
gggatttatactagggttgc

SEQ ID NO: 28382 - DNA, 20 bp, Artificial Sequence
  chemically synthesized
ttatactagggttgcaagaa

SEQ ID NO: 28383 - DNA, 20 bp, Artificial Sequence
  chemically synthesized
tgatacatcacatcaacaaa

SEQ ID NO: 28384 - DNA, 20 bp, Artificial Sequence
  chemically synthesized
aaaccatatgatcatctcaa

SEQ ID NO: 28385 - DNA, 20 bp, Artificial Sequence
  chemically synthesized
tatgatcatctcaatagata

SEQ ID NO: 28386 - DNA, 20 bp, Artificial Sequence
  chemically synthesized
catctcaatagatacagaaa

SEQ ID NO: 28387 - DNA, 20 bp, Artificial Sequence
  chemically synthesized
ttcatgataaaaactatctg

SEQ ID NO: 28388 - DNA, 20 bp, Artificial Sequence
  chemically synthesized
aaactatctgcagccaatca

SEQ ID NO: 28389 - DNA, 20 bp, Artificial Sequence
  chemically synthesized
ctatctgcagccaatcatag

SEQ ID NO: 28390 - DNA, 20 bp, Artificial Sequence
  chemically synthesized
tatctgcagccaatcataga

SEQ ID NO: 28391 - DNA, 20 bp, Artificial Sequence
  chemically synthesized
aacatatctcaatataataa

SEQ ID NO: 28392 - DNA, 20 bp, Artificial Sequence
  chemically synthesized
agtcatatatgacaaaccca

SEQ ID NO: 28393 - DNA, 20 bp, Artificial Sequence
  chemically synthesized
cagctaacatcatactgaat

SEQ ID NO: 28394 - DNA, 20 bp, Artificial Sequence
  chemically synthesized
agctaacatcatactgaatt

SEQ ID NO: 28395 - DNA, 20 bp, Artificial Sequence
  chemically synthesized
acatcatactgaattgggaa

SEQ ID NO: 28396 - DNA, 20 bp, Artificial Sequence
  chemically synthesized
catactgaattgggaaaagc

SEQ ID NO: 28397 - DNA, 20 bp, Artificial Sequence
  chemically synthesized
actgaattgggaaaagctgg

SEQ ID NO: 28398 - DNA, 20 bp, Artificial Sequence
  chemically synthesized
aagctggaagcctttcctct

SEQ ID NO: 28399 - DNA, 20 bp, Artificial Sequence
  chemically synthesized
tctaagaactgaaacaaaat

SEQ ID NO: 28400 - DNA, 20 bp, Artificial Sequence
  chemically synthesized
ctaagaactgaaacaaaata

SEQ ID NO: 28401 - DNA, 20 bp, Artificial Sequence
  chemically synthesized
actcctattcaatataatac

SEQ ID NO: 28402 - DNA, 20 bp, Artificial Sequence
  chemically synthesized
cctattcaatataatactgg

SEQ ID NO: 28403 - DNA, 20 bp, Artificial Sequence
  chemically synthesized
caatataatactggaagtcc

SEQ ID NO: 28404 - DNA, 20 bp, Artificial Sequence
  chemically synthesized
aatactggaagtcctagcca

SEQ ID NO: 28405 - DNA, 20 bp, Artificial Sequence
  chemically synthesized
gaagtcctagccacagcttt

SEQ ID NO: 28406 - DNA, 20 bp, Artificial Sequence
  chemically synthesized
aagtcctagccacagctttc

SEQ ID NO: 28407 - DNA, 20 bp, Artificial Sequence
  chemically synthesized
cctagccacagctttcaggt

SEQ ID NO: 28408 - DNA, 20 bp, Artificial Sequence
  chemically synthesized
tagccacagctttcaggtca

SEQ ID NO: 28409 - DNA, 20 bp, Artificial Sequence
  chemically synthesized
cacagctttcaggtcagaga

SEQ ID NO: 28410 - DNA, 20 bp, Artificial Sequence
  chemically synthesized
gctttcaggtcagagaaaga

SEQ ID NO: 28411 - DNA, 20 bp, Artificial Sequence
  chemically synthesized
tcaggtcagagaaagaaaga

SEQ ID NO: 28412 - DNA, 20 bp, Artificial Sequence
  chemically synthesized
tcagagaaagaaagaaagaa

SEQ ID NO: 28413 - DNA, 20 bp, Artificial Sequence
  chemically synthesized
cagagaaagaaagaaagaaa

SEQ ID NO: 28414 - DNA, 20 bp, Artificial Sequence
  chemically synthesized
agaaagaaaaggcatgcaaa

SEQ ID NO: 28415 - DNA, 20 bp, Artificial Sequence
  chemically synthesized
gaaagaaaaggcatgcaaat

SEQ ID NO: 28416 - DNA, 20 bp, Artificial Sequence
  chemically synthesized
aaaaggcatgcaaataggaa

SEQ ID NO: 28417 - DNA, 20 bp, Artificial Sequence
  chemically synthesized
catgcaaataggaaaagatg

SEQ ID NO: 28418 - DNA, 20 bp, Artificial Sequence
  chemically synthesized
agtcaaactgtccatctttc

SEQ ID NO: 28419 - DNA, 20 bp, Artificial Sequence
  chemically synthesized
agatgacatgattttatacc

SEQ ID NO: 28420 - DNA, 20 bp, Artificial Sequence
  chemically synthesized
attttatacctagaaaaacc

SEQ ID NO: 28421 - DNA, 20 bp, Artificial Sequence
  chemically synthesized
gaaaaaccaagactccacca

SEQ ID NO: 28422 - DNA, 20 bp, Artificial Sequence
  chemically synthesized
agactccaccaaagcactct

SEQ ID NO: 28423 - DNA, 20 bp, Artificial Sequence
  chemically synthesized
ttagcgctgaaaaataaatt

SEQ ID NO: 28424 - DNA, 20 bp, Artificial Sequence
  chemically synthesized
gctgaaaaataaattcagta

SEQ ID NO: 28425 - DNA, 20 bp, Artificial Sequence
  chemically synthesized
aaataaattcagtaaagtta

SEQ ID NO: 28426 - DNA, 20 bp, Artificial Sequence
  chemically synthesized
aataaattcagtaaagttac

SEQ ID NO: 28427 - DNA, 20 bp, Artificial Sequence
  chemically synthesized
taaattcagtaaagttacag

SEQ ID NO: 28428 - DNA, 20 bp, Artificial Sequence
  chemically synthesized
aaagttacaggagacaaaat

SEQ ID NO: 28429 - DNA, 20 bp, Artificial Sequence
  chemically synthesized
acaaaatcagcatatgaaac

SEQ ID NO: 28430 - DNA, 20 bp, Artificial Sequence
  chemically synthesized
tctacacaccaataataaac

SEQ ID NO: 28431 - DNA, 20 bp, Artificial Sequence
  chemically synthesized
acaccaataataaactagct

SEQ ID NO: 28432 - DNA, 20 bp, Artificial Sequence
  chemically synthesized
ccaataataaactagctgag

SEQ ID NO: 28433 - DNA, 20 bp, Artificial Sequence
  chemically synthesized
caataataaactagctgaga

SEQ ID NO: 28434 - DNA, 20 bp, Artificial Sequence
  chemically synthesized
aactagctgagaaggaaatt

SEQ ID NO: 28435 - DNA, 20 bp, Artificial Sequence
  chemically synthesized
tagctgagaaggaaattaag

SEQ ID NO: 28436 - DNA, 20 bp, Artificial Sequence
  chemically synthesized
agctgagaaggaaattaaga

SEQ ID NO: 28437 - DNA, 20 bp, Artificial Sequence
  chemically synthesized
gaaggcaatcccatttacaa

SEQ ID NO: 28438 - DNA, 20 bp, Artificial Sequence
  chemically synthesized
tagctaaaaaataaaatatt

SEQ ID NO: 28439 - DNA, 20 bp, Artificial Sequence
  chemically synthesized
agctaaaaaataaaatattt

SEQ ID NO: 28440 - DNA, 20 bp, Artificial Sequence
  chemically synthesized
gctaaaaaataaaatattta

SEQ ID NO: 28441 - DNA, 20 bp, Artificial Sequence
  chemically synthesized
atttagggataaatttaacc

SEQ ID NO: 28442 - DNA, 20 bp, Artificial Sequence
  chemically synthesized
tttagggataaatttaacca

SEQ ID NO: 28443 - DNA, 20 bp, Artificial Sequence
  chemically synthesized
ggaaccgaaaaacctctatt

SEQ ID NO: 28444 - DNA, 20 bp, Artificial Sequence
  chemically synthesized
aaactacaaaacactgataa

SEQ ID NO: 28445 - DNA, 20 bp, Artificial Sequence
  chemically synthesized
acactgataaaagaattgaa

SEQ ID NO: 28446 - DNA, 20 bp, Artificial Sequence
  chemically synthesized
cactgataaaagaattgaaa

SEQ ID NO: 28447 - DNA, 20 bp, Artificial Sequence
  chemically synthesized
gataaaagaattgaaaagga

SEQ ID NO: 28448 - DNA, 20 bp, Artificial Sequence
  chemically synthesized
ttgaaaaggacagaaacaaa

SEQ ID NO: 28449 - DNA, 20 bp, Artificial Sequence
  chemically synthesized
gaaaaggacagaaacaaatg

SEQ ID NO: 28450 - DNA, 20 bp, Artificial Sequence
  chemically synthesized
aaaggacagaaacaaatgga

SEQ ID NO: 28451 - DNA, 20 bp, Artificial Sequence
  chemically synthesized
ggagagatatcctatgttca

SEQ ID NO: 28452 - DNA, 20 bp, Artificial Sequence
  chemically synthesized
gatatcctatgttcatggat

SEQ ID NO: 28453 - DNA, 20 bp, Artificial Sequence
  chemically synthesized
aaaaattaatattgttaaaa

SEQ ID NO: 28454 - DNA, 20 bp, Artificial Sequence
  chemically synthesized
taaaatggccatactaccca

SEQ ID NO: 28455 - DNA, 20 bp, Artificial Sequence
  chemically synthesized
atactacccaaagcaatcta

SEQ ID NO: 28456 - DNA, 20 bp, Artificial Sequence
  chemically synthesized
ctatatgaccgctatcaaaa

SEQ ID NO: 28457 - DNA, 20 bp, Artificial Sequence
  chemically synthesized
aatagcaatgtcatttttca

SEQ ID NO: 28458 - DNA, 20 bp, Artificial Sequence
  chemically synthesized
aatgtcatttttcacagaaa

SEQ ID NO: 28459 - DNA, 20 bp, Artificial Sequence
  chemically synthesized
atttgtatgaaattaaaaaa

SEQ ID NO: 28460 - DNA, 20 bp, Artificial Sequence
  chemically synthesized
atgaaattaaaaaatagctc

SEQ ID NO: 28461 - DNA, 20 bp, Artificial Sequence
  chemically synthesized
aaattaaaaaatagctccag

SEQ ID NO: 28462 - DNA, 20 bp, Artificial Sequence
  chemically synthesized
aaaaatagctccagtagcca

SEQ ID NO: 28463 - DNA, 20 bp, Artificial Sequence
  chemically synthesized
ccaaagtcatcctgtgaaaa

SEQ ID NO: 28464 - DNA, 20 bp, Artificial Sequence
  chemically synthesized
ctgtgaaaaaagaacaatgc

SEQ ID NO: 28465 - DNA, 20 bp, Artificial Sequence
  chemically synthesized
gtgaaaaaagaacaatgcta

SEQ ID NO: 28466 - DNA, 20 bp, Artificial Sequence
  chemically synthesized
tgaaaaaagaacaatgctag

SEQ ID NO: 28467 - DNA, 20 bp, Artificial Sequence
  chemically synthesized
tatcatactacctgatttca

SEQ ID NO: 28468 - DNA, 20 bp, Artificial Sequence
  chemically synthesized
gatttcaaagtatattacaa

SEQ ID NO: 28469 - DNA, 20 bp, Artificial Sequence
  chemically synthesized
caaagtatattacaaaagta

SEQ ID NO: 28470 - DNA, 20 bp, Artificial Sequence
  chemically synthesized
aaagtatattacaaaagtat

SEQ ID NO: 28471 - DNA, 20 bp, Artificial Sequence
  chemically synthesized
caaaagtataggaacctaaa

SEQ ID NO: 28472 - DNA, 20 bp, Artificial Sequence
  chemically synthesized
aaacagcatgatactgacat

SEQ ID NO: 28473 - DNA, 20 bp, Artificial Sequence
  chemically synthesized
gcatgatactgacattagaa

SEQ ID NO: 28474 - DNA, 20 bp, Artificial Sequence
  chemically synthesized
ctgacattagaacagacact

SEQ ID NO: 28475 - DNA, 20 bp, Artificial Sequence
  chemically synthesized
agaacagacacttagaccaa

SEQ ID NO: 28476 - DNA, 20 bp, Artificial Sequence
  chemically synthesized
acagacacttagaccaatgg

SEQ ID NO: 28477 - DNA, 20 bp, Artificial Sequence
  chemically synthesized
agacacttagaccaatggaa

SEQ ID NO: 28478 - DNA, 20 bp, Artificial Sequence
  chemically synthesized
cttagaccaatggaagagaa

SEQ ID NO: 28479 - DNA, 20 bp, Artificial Sequence
  chemically synthesized
tagaccaatggaagagaata

SEQ ID NO: 28480 - DNA, 20 bp, Artificial Sequence
  chemically synthesized
atggaagagaatagagaacc

SEQ ID NO: 28481 - DNA, 20 bp, Artificial Sequence
  chemically synthesized
gaaatgcatccacatattta

SEQ ID NO: 28482 - DNA, 20 bp, Artificial Sequence
  chemically synthesized
atccacatatttatagccaa

SEQ ID NO: 28483 - DNA, 20 bp, Artificial Sequence
  chemically synthesized
tagccaacagattttcaaca

SEQ ID NO: 28484 - DNA, 20 bp, Artificial Sequence
  chemically synthesized
agccaacagattttcaacaa

SEQ ID NO: 28485 - DNA, 20 bp, Artificial Sequence
  chemically synthesized
agattttcaacaaaggtgac

SEQ ID NO: 28486 - DNA, 20 bp, Artificial Sequence
  chemically synthesized
aggtgacaagaatatacatt

SEQ ID NO: 28487 - DNA, 20 bp, Artificial Sequence
  chemically synthesized
ggtgacaagaatatacattg

SEQ ID NO: 28488 - DNA, 20 bp, Artificial Sequence
  chemically synthesized
acaagaatatacattgagga

SEQ ID NO: 28489 - DNA, 20 bp, Artificial Sequence
  chemically synthesized
caagaatatacattgaggaa

SEQ ID NO: 28490 - DNA, 20 bp, Artificial Sequence
  chemically synthesized
tatacattgaggaaaggaca

SEQ ID NO: 28491 - DNA, 20 bp, Artificial Sequence
  chemically synthesized
gaggaaaggacacagtgttc

SEQ ID NO: 28492 - DNA, 20 bp, Artificial Sequence
  chemically synthesized
aggacacagtgttcaagaaa

SEQ ID NO: 28493 - DNA, 20 bp, Artificial Sequence
  chemically synthesized
agaaatggtgctgaaaaaat

SEQ ID NO: 28494 - DNA, 20 bp, Artificial Sequence
  chemically synthesized
tgaaaaaattggatatccat

SEQ ID NO: 28495 - DNA, 20 bp, Artificial Sequence
  chemically synthesized
cattggatatccatgtgcaa

SEQ ID NO: 28496 - DNA, 20 bp, Artificial Sequence
  chemically synthesized
catgtgcaaaagaataaaac

SEQ ID NO: 28497 - DNA, 20 bp, Artificial Sequence
  chemically synthesized
ataaaactggactgctgata

SEQ ID NO: 28498 - DNA, 20 bp, Artificial Sequence
  chemically synthesized
actggactgctgatatggtt

SEQ ID NO: 28499 - DNA, 20 bp, Artificial Sequence
  chemically synthesized
aaatataatccccaacttct

SEQ ID NO: 28500 - DNA, 20 bp, Artificial Sequence
  chemically synthesized
aatataatccccaacttctc

SEQ ID NO: 28501 - DNA, 20 bp, Artificial Sequence
  chemically synthesized
tccccaacttctcaggatct

SEQ ID NO: 28502 - DNA, 20 bp, Artificial Sequence
  chemically synthesized
ccaacttctcaggatcttgg

SEQ ID NO: 28503 - DNA, 20 bp, Artificial Sequence
  chemically synthesized
cttctcaggatcttggcgga

SEQ ID NO: 28504 - DNA, 20 bp, Artificial Sequence
  chemically synthesized
ttctcaggatcttggcggat

SEQ ID NO: 28505 - DNA, 20 bp, Artificial Sequence
  chemically synthesized
ctcaggatcttggcggatgg

SEQ ID NO: 28506 - DNA, 20 bp, Artificial Sequence
  chemically synthesized
tcaggatcttggcggatggg

SEQ ID NO: 28507 - DNA, 20 bp, Artificial Sequence
  chemically synthesized
ggatcttggcggatgggagg

SEQ ID NO: 28508 - DNA, 20 bp, Artificial Sequence
  chemically synthesized
gatcttggcggatgggaggt

SEQ ID NO: 28509 - DNA, 20 bp, Artificial Sequence
  chemically synthesized
tggcggatgggaggtaggcc

SEQ ID NO: 28510 - DNA, 20 bp, Artificial Sequence
  chemically synthesized
tgggaggtaggcctagattg

SEQ ID NO: 28511 - DNA, 20 bp, Artificial Sequence
  chemically synthesized
cctagattgcagctccaact

SEQ ID NO: 28512 - DNA, 20 bp, Artificial Sequence
  chemically synthesized
gattgcagctccaactcaga

SEQ ID NO: 28513 - DNA, 20 bp, Artificial Sequence
  chemically synthesized
gcagctccaactcagatgga

SEQ ID NO: 28514 - DNA, 20 bp, Artificial Sequence
  chemically synthesized
agctccaactcagatggaca

SEQ ID NO: 28515 - DNA, 20 bp, Artificial Sequence
  chemically synthesized
tccaactcagatggacagag

SEQ ID NO: 28516 - DNA, 20 bp, Artificial Sequence
  chemically synthesized
cagatggacagagcagcatg

SEQ ID NO: 28517 - DNA, 20 bp, Artificial Sequence
  chemically synthesized
gatggacagagcagcatgtg

SEQ ID NO: 28518 - DNA, 20 bp, Artificial Sequence
  chemically synthesized
atggacagagcagcatgtgg

SEQ ID NO: 28519 - DNA, 20 bp, Artificial Sequence
  chemically synthesized
gaggctcgcattgtgaattt

SEQ ID NO: 28520 - DNA, 20 bp, Artificial Sequence
  chemically synthesized
cgcattgtgaattttagctg

SEQ ID NO: 28521 - DNA, 20 bp, Artificial Sequence
  chemically synthesized
ttgtgaattttagctgcaga

SEQ ID NO: 28522 - DNA, 20 bp, Artificial Sequence
  chemically synthesized
tttagctgcagatagactgc

SEQ ID NO: 28523 - DNA, 20 bp, Artificial Sequence
  chemically synthesized
gatagactgcaagaacaaac

SEQ ID NO: 28524 - DNA, 20 bp, Artificial Sequence
  chemically synthesized
aagaacaaaccagcaatcct

SEQ ID NO: 28525 - DNA, 20 bp, Artificial Sequence
  chemically synthesized
gaacaaaccagcaatcctga

SEQ ID NO: 28526 - DNA, 20 bp, Artificial Sequence
  chemically synthesized
aacaaaccagcaatcctgag

SEQ ID NO: 28527 - DNA, 20 bp, Artificial Sequence
  chemically synthesized
agcaatcctgagaggaccca

SEQ ID NO: 28528 - DNA, 20 bp, Artificial Sequence
  chemically synthesized
gaggacccacagaccctctg

SEQ ID NO: 28529 - DNA, 20 bp, Artificial Sequence
  chemically synthesized
aggacccacagaccctctga

SEQ ID NO: 28530 - DNA, 20 bp, Artificial Sequence
  chemically synthesized
acccacagaccctctgaagg

SEQ ID NO: 28531 - DNA, 20 bp, Artificial Sequence
  chemically synthesized
cacagaccctctgaaggaag

SEQ ID NO: 28532 - DNA, 20 bp, Artificial Sequence
  chemically synthesized
aaggaagtagattgctcctg

SEQ ID NO: 28533 - DNA, 20 bp, Artificial Sequence
  chemically synthesized
aggaagtagattgctcctgc

SEQ ID NO: 28534 - DNA, 20 bp, Artificial Sequence
  chemically synthesized
tagattgctcctgcaggacc

SEQ ID NO: 28535 - DNA, 20 bp, Artificial Sequence
  chemically synthesized
agattgctcctgcaggaccc

SEQ ID NO: 28536 - DNA, 20 bp, Artificial Sequence
  chemically synthesized
attgctcctgcaggacccag

SEQ ID NO: 28537 - DNA, 20 bp, Artificial Sequence
  chemically synthesized
ggagacaccccaaatactgt

SEQ ID NO: 28538 - DNA, 20 bp, Artificial Sequence
  chemically synthesized
tactgtgagtgccccaactg

SEQ ID NO: 28539 - DNA, 20 bp, Artificial Sequence
  chemically synthesized
tgtgagtgccccaactgcgg

SEQ ID NO: 28540 - DNA, 20 bp, Artificial Sequence
  chemically synthesized
gagtgccccaactgcggaag

SEQ ID NO: 28541 - DNA, 20 bp, Artificial Sequence
  chemically synthesized
agtgccccaactgcggaagt

SEQ ID NO: 28542 - DNA, 20 bp, Artificial Sequence
  chemically synthesized
ccccaactgcggaagtggga

SEQ ID NO: 28543 - DNA, 20 bp, Artificial Sequence
  chemically synthesized
cccaactgcggaagtgggaa

SEQ ID NO: 28544 - DNA, 20 bp, Artificial Sequence
  chemically synthesized
ccaactgcggaagtgggaaa

SEQ ID NO: 28545 - DNA, 20 bp, Artificial Sequence
  chemically synthesized
aactgcggaagtgggaaagg

SEQ ID NO: 28546 - DNA, 20 bp, Artificial Sequence
  chemically synthesized
tcctaaacacacactcccac

SEQ ID NO: 28547 - DNA, 20 bp, Artificial Sequence
  chemically synthesized
ctaaacacacactcccactg

SEQ ID NO: 28548 - DNA, 20 bp, Artificial Sequence
  chemically synthesized
cactcccactggagaaactg

SEQ ID NO: 28549 - DNA, 20 bp, Artificial Sequence
  chemically synthesized
actcccactggagaaactga

SEQ ID NO: 28550 - DNA, 20 bp, Artificial Sequence
  chemically synthesized
agaaactgaaggtctgtttg

SEQ ID NO: 28551 - DNA, 20 bp, Artificial Sequence
  chemically synthesized
gaaactgaaggtctgtttgt

SEQ ID NO: 28552 - DNA, 20 bp, Artificial Sequence
  chemically synthesized
aactgaaggtctgtttgtgg

SEQ ID NO: 28553 - DNA, 20 bp, Artificial Sequence
  chemically synthesized
tgaaggtctgtttgtgggag

SEQ ID NO: 28554 - DNA, 20 bp, Artificial Sequence
  chemically synthesized
gagaagtttctgaccttacc

SEQ ID NO: 28555 - DNA, 20 bp, Artificial Sequence
  chemically synthesized
gaagtttctgaccttacctg

SEQ ID NO: 28556 - DNA, 20 bp, Artificial Sequence
  chemically synthesized
ttctgaccttacctggagtt

SEQ ID NO: 28557 - DNA, 20 bp, Artificial Sequence
  chemically synthesized
tacctggagttgagttaact

SEQ ID NO: 28558 - DNA, 20 bp, Artificial Sequence
  chemically synthesized
cctggagttgagttaactta

SEQ ID NO: 28559 - DNA, 20 bp, Artificial Sequence
  chemically synthesized
tggagttgagttaacttaga

SEQ ID NO: 28560 - DNA, 20 bp, Artificial Sequence
  chemically synthesized
ttgagttaacttagagagct

SEQ ID NO: 28561 - DNA, 20 bp, Artificial Sequence
  chemically synthesized
ttagagagctgagcaaaata

SEQ ID NO: 28562 - DNA, 20 bp, Artificial Sequence
  chemically synthesized
tagagagctgagcaaaatac

SEQ ID NO: 28563 - DNA, 20 bp, Artificial Sequence
  chemically synthesized
agctgagcaaaatacaggtg

SEQ ID NO: 28564 - DNA, 20 bp, Artificial Sequence
  chemically synthesized
ctgagcaaaatacaggtgta

SEQ ID NO: 28565 - DNA, 20 bp, Artificial Sequence
  chemically synthesized
tgagcaaaatacaggtgtag

SEQ ID NO: 28566 - DNA, 20 bp, Artificial Sequence
  chemically synthesized
gcaaaatacaggtgtagagg

SEQ ID NO: 28567 - DNA, 20 bp, Artificial Sequence
  chemically synthesized
aaatacaggtgtagaggaag

SEQ ID NO: 28568 - DNA, 20 bp, Artificial Sequence
  chemically synthesized
acaggtgtagaggaagcagt

SEQ ID NO: 28569 - DNA, 20 bp, Artificial Sequence
  chemically synthesized
gtgtagaggaagcagtgaga

SEQ ID NO: 28570 - DNA, 20 bp, Artificial Sequence
  chemically synthesized
tgtagaggaagcagtgagaa

SEQ ID NO: 28571 - DNA, 20 bp, Artificial Sequence
  chemically synthesized
ggaagcagtgagaaaggccc

SEQ ID NO: 28572 - DNA, 20 bp, Artificial Sequence
  chemically synthesized
gaagcagtgagaaaggccct

SEQ ID NO: 28573 - DNA, 20 bp, Artificial Sequence
  chemically synthesized
agcagtgagaaaggccctgg

SEQ ID NO: 28574 - DNA, 20 bp, Artificial Sequence
  chemically synthesized
gaaaggccctgggagctcac

SEQ ID NO: 28575 - DNA, 20 bp, Artificial Sequence
  chemically synthesized
aaaggccctgggagctcact

SEQ ID NO: 28576 - DNA, 20 bp, Artificial Sequence
  chemically synthesized
tgggagctcactgggtccct

SEQ ID NO: 28577 - DNA, 20 bp, Artificial Sequence
  chemically synthesized
gagctcactgggtccctgag

SEQ ID NO: 28578 - DNA, 20 bp, Artificial Sequence
  chemically synthesized
agctcactgggtccctgagc

SEQ ID NO: 28579 - DNA, 20 bp, Artificial Sequence
  chemically synthesized
ctgagcaggccattcctgcc

SEQ ID NO: 28580 - DNA, 20 bp, Artificial Sequence
  chemically synthesized
caggccattcctgcctggca

SEQ ID NO: 28581 - DNA, 20 bp, Artificial Sequence
  chemically synthesized
ccattcctgcctggcatagc

SEQ ID NO: 28582 - DNA, 20 bp, Artificial Sequence
  chemically synthesized
cattcctgcctggcatagcc

SEQ ID NO: 28583 - DNA, 20 bp, Artificial Sequence
  chemically synthesized
ttactaacattgaatgtaaa

SEQ ID NO: 28584 - DNA, 20 bp, Artificial Sequence
  chemically synthesized
ggcctaaatgctccacttaa

SEQ ID NO: 28585 - DNA, 20 bp, Artificial Sequence
  chemically synthesized
gcctaaatgctccacttaaa

SEQ ID NO: 28586 - DNA, 20 bp, Artificial Sequence
  chemically synthesized
cctaaatgctccacttaaaa

SEQ ID NO: 28587 - DNA, 20 bp, Artificial Sequence
  chemically synthesized
ctccacttaaaagggtgaaa

SEQ ID NO: 28588 - DNA, 20 bp, Artificial Sequence
  chemically synthesized
tccacttaaaagggtgaaaa

SEQ ID NO: 28589 - DNA, 20 bp, Artificial Sequence
  chemically synthesized
aaaaaggtatttcatgcaaa

SEQ ID NO: 28590 - DNA, 20 bp, Artificial Sequence
  chemically synthesized
ttcatgcaaatggccaccaa

SEQ ID NO: 28591 - DNA, 20 bp, Artificial Sequence
  chemically synthesized
tgcaaatggccaccaaaagt

SEQ ID NO: 28592 - DNA, 20 bp, Artificial Sequence
  chemically synthesized
aaatggccaccaaaagtgag

SEQ ID NO: 28593 - DNA, 20 bp, Artificial Sequence
  chemically synthesized
aatggccaccaaaagtgagt

SEQ ID NO: 28594 - DNA, 20 bp, Artificial Sequence
  chemically synthesized
agtaggcaaaacaaacttta

SEQ ID NO: 28595 - DNA, 20 bp, Artificial Sequence
  chemically synthesized
caaaacaaactttaaagcaa

SEQ ID NO: 28596 - DNA, 20 bp, Artificial Sequence
  chemically synthesized
aacaaactttaaagcaacag

SEQ ID NO: 28597 - DNA, 20 bp, Artificial Sequence
  chemically synthesized
tttaaagcaacagcagttaa

SEQ ID NO: 28598 - DNA, 20 bp, Artificial Sequence
  chemically synthesized
taaagcaacagcagttaaaa

SEQ ID NO: 28599 - DNA, 20 bp, Artificial Sequence
  chemically synthesized
aacagcagttaaaagagaca

SEQ ID NO: 28600 - DNA, 20 bp, Artificial Sequence
  chemically synthesized
cagcagttaaaagagacaaa

SEQ ID NO: 28601 - DNA, 20 bp, Artificial Sequence
  chemically synthesized
agcagttaaaagagacaaag

SEQ ID NO: 28602 - DNA, 20 bp, Artificial Sequence
  chemically synthesized
gcagttaaaagagacaaaga

SEQ ID NO: 28603 - DNA, 20 bp, Artificial Sequence
  chemically synthesized
caaagagggacattatataa

SEQ ID NO: 28604 - DNA, 20 bp, Artificial Sequence
  chemically synthesized
gggacattatataatggtaa

SEQ ID NO: 28605 - DNA, 20 bp, Artificial Sequence
  chemically synthesized
ggacattatataatggtaaa

SEQ ID NO: 28606 - DNA, 20 bp, Artificial Sequence
  chemically synthesized
tggtaaaaggccttgtccaa

SEQ ID NO: 28607 - DNA, 20 bp, Artificial Sequence
  chemically synthesized
ggtaaaaggccttgtccaac

SEQ ID NO: 28608 - DNA, 20 bp, Artificial Sequence
  chemically synthesized
aacatatatgcacctaacac

SEQ ID NO: 28609 - DNA, 20 bp, Artificial Sequence
  chemically synthesized
catatatgcacctaacactg

SEQ ID NO: 28610 - DNA, 20 bp, Artificial Sequence
  chemically synthesized
cactggagctcccaaattta

SEQ ID NO: 28611 - DNA, 20 bp, Artificial Sequence
  chemically synthesized
atttatagaacaattactaa

SEQ ID NO: 28612 - DNA, 20 bp, Artificial Sequence
  chemically synthesized
gaacaattactaatagacct

SEQ ID NO: 28613 - DNA, 20 bp, Artificial Sequence
  chemically synthesized
tactaatagacctaagaaat

SEQ ID NO: 28614 - DNA, 20 bp, Artificial Sequence
  chemically synthesized
aatagacctaagaaatgaga

SEQ ID NO: 28615 - DNA, 20 bp, Artificial Sequence
  chemically synthesized
gacctaagaaatgagataga

SEQ ID NO: 28616 - DNA, 20 bp, Artificial Sequence
  chemically synthesized
gatagacagcaacacaataa

SEQ ID NO: 28617 - DNA, 20 bp, Artificial Sequence
  chemically synthesized
agacagcaacacaataatag

SEQ ID NO: 28618 - DNA, 20 bp, Artificial Sequence
  chemically synthesized
gacagcaacacaataatagt

SEQ ID NO: 28619 - DNA, 20 bp, Artificial Sequence
  chemically synthesized
acagcaacacaataatagtg

SEQ ID NO: 28620 - DNA, 20 bp, Artificial Sequence
  chemically synthesized
cagcaacacaataatagtgg

SEQ ID NO: 28621 - DNA, 20 bp, Artificial Sequence
  chemically synthesized
ggacttcaatacttcattga

SEQ ID NO: 28622 - DNA, 20 bp, Artificial Sequence
  chemically synthesized
caatacttcattgacagcac

SEQ ID NO: 28623 - DNA, 20 bp, Artificial Sequence
  chemically synthesized
acttcattgacagcactaga

SEQ ID NO: 28624 - DNA, 20 bp, Artificial Sequence
  chemically synthesized
acagcactagacagttcatc

SEQ ID NO: 28625 - DNA, 20 bp, Artificial Sequence
  chemically synthesized
cactagacagttcatcaaga

SEQ ID NO: 28626 - DNA, 20 bp, Artificial Sequence
  chemically synthesized
agacagttcatcaagacaga

SEQ ID NO: 28627 - DNA, 20 bp, Artificial Sequence
  chemically synthesized
gaaagtcaacaaaaaaataa

SEQ ID NO: 28628 - DNA, 20 bp, Artificial Sequence
  chemically synthesized
aatggatttaaattatacct

SEQ ID NO: 28629 - DNA, 20 bp, Artificial Sequence
  chemically synthesized
aaattataccttagaacaaa

SEQ ID NO: 28630 - DNA, 20 bp, Artificial Sequence
  chemically synthesized
cttagaacaaatggacttaa

SEQ ID NO: 28631 - DNA, 20 bp, Artificial Sequence
  chemically synthesized
atggacttaacagttatata

SEQ ID NO: 28632 - DNA, 20 bp, Artificial Sequence
  chemically synthesized
aacatttcatccaataacca

SEQ ID NO: 28633 - DNA, 20 bp, Artificial Sequence
  chemically synthesized
agaacacacattctattcaa

SEQ ID NO: 28634 - DNA, 20 bp, Artificial Sequence
  chemically synthesized
acattctattcaacagcgcg

SEQ ID NO: 28635 - DNA, 20 bp, Artificial Sequence
  chemically synthesized
cagcgcgtggaaatttctcc

SEQ ID NO: 28636 - DNA, 20 bp, Artificial Sequence
  chemically synthesized
agcgcgtggaaatttctcca

SEQ ID NO: 28637 - DNA, 20 bp, Artificial Sequence
  chemically synthesized
gcgtggaaatttctccaagg

SEQ ID NO: 28638 - DNA, 20 bp, Artificial Sequence
  chemically synthesized
ctccaaggtagaccatatga

SEQ ID NO: 28639 - DNA, 20 bp, Artificial Sequence
  chemically synthesized
tccaaggtagaccatatgat

SEQ ID NO: 28640 - DNA, 20 bp, Artificial Sequence
  chemically synthesized
catatgataggccatgaaat

SEQ ID NO: 28641 - DNA, 20 bp, Artificial Sequence
  chemically synthesized
agcctcaataaatttactaa

SEQ ID NO: 28642 - DNA, 20 bp, Artificial Sequence
  chemically synthesized
tttactaacagaccaataac

SEQ ID NO: 28643 - DNA, 20 bp, Artificial Sequence
  chemically synthesized
actaacagaccaataacaag

SEQ ID NO: 28644 - DNA, 20 bp, Artificial Sequence
  chemically synthesized
acagaccaataacaagcagt

SEQ ID NO: 28645 - DNA, 20 bp, Artificial Sequence
  chemically synthesized
aacaagcagtgagatttaat

SEQ ID NO: 28646 - DNA, 20 bp, Artificial Sequence
  chemically synthesized
aaaaattaccaaccaaaaaa

SEQ ID NO: 28647 - DNA, 20 bp, Artificial Sequence
  chemically synthesized
ttaccaaccaaaaaaaagtt

SEQ ID NO: 28648 - DNA, 20 bp, Artificial Sequence
  chemically synthesized
taccaaccaaaaaaaagttc

SEQ ID NO: 28649 - DNA, 20 bp, Artificial Sequence
  chemically synthesized
accaaaaaaaagttcaggac

SEQ ID NO: 28650 - DNA, 20 bp, Artificial Sequence
  chemically synthesized
aaaaaaagttcaggaccaga

SEQ ID NO: 28651 - DNA, 20 bp, Artificial Sequence
  chemically synthesized
aggaccagatggattcacaa

SEQ ID NO: 28652 - DNA, 20 bp, Artificial Sequence
  chemically synthesized
gattcacaacagaattctac

SEQ ID NO: 28653 - DNA, 20 bp, Artificial Sequence
  chemically synthesized
agaattctactagacattca

SEQ ID NO: 28654 - DNA, 20 bp, Artificial Sequence
  chemically synthesized
aattctactagacattcaaa

SEQ ID NO: 28655 - DNA, 20 bp, Artificial Sequence
  chemically synthesized
attctactagacattcaaag

SEQ ID NO: 28656 - DNA, 20 bp, Artificial Sequence
  chemically synthesized
ctagacattcaaagaggaat

SEQ ID NO: 28657 - DNA, 20 bp, Artificial Sequence
  chemically synthesized
tctttttgacactattctac

SEQ ID NO: 28658 - DNA, 20 bp, Artificial Sequence
  chemically synthesized
tttgacactattctacaaga

SEQ ID NO: 28659 - DNA, 20 bp, Artificial Sequence
  chemically synthesized
actattctacaagacagata

SEQ ID NO: 28660 - DNA, 20 bp, Artificial Sequence
  chemically synthesized
attctacaagacagataaag

SEQ ID NO: 28661 - DNA, 20 bp, Artificial Sequence
  chemically synthesized
ttctacaagacagataaaga

SEQ ID NO: 28662 - DNA, 20 bp, Artificial Sequence
  chemically synthesized
ctgccctaattcattctatg

SEQ ID NO: 28663 - DNA, 20 bp, Artificial Sequence
  chemically synthesized
cctaattcattctatgaagc

SEQ ID NO: 28664 - DNA, 20 bp, Artificial Sequence
  chemically synthesized
agccagcatcacaccaaaac

SEQ ID NO: 28665 - DNA, 20 bp, Artificial Sequence
  chemically synthesized
gccagcatcacaccaaaacc

SEQ ID NO: 28666 - DNA, 20 bp, Artificial Sequence
  chemically synthesized
ccagcatcacaccaaaacca

SEQ ID NO: 28667 - DNA, 20 bp, Artificial Sequence
  chemically synthesized
gcatcacaccaaaaccaggg

SEQ ID NO: 28668 - DNA, 20 bp, Artificial Sequence
  chemically synthesized
catcacaccaaaaccaggga

SEQ ID NO: 28669 - DNA, 20 bp, Artificial Sequence
  chemically synthesized
agggaaggacataaccaaaa

SEQ ID NO: 28670 - DNA, 20 bp, Artificial Sequence
  chemically synthesized
ataaccaaaaaagaaaacta

SEQ ID NO: 28671 - DNA, 20 bp, Artificial Sequence
  chemically synthesized
aaaagaaaactacagactga

SEQ ID NO: 28672 - DNA, 20 bp, Artificial Sequence
  chemically synthesized
actgatagccttgatgaaca

SEQ ID NO: 28673 - DNA, 20 bp, Artificial Sequence
  chemically synthesized
taaaatccttaacaaaatac

SEQ ID NO: 28674 - DNA, 20 bp, Artificial Sequence
  chemically synthesized
aaattcaacaacataacaaa

SEQ ID NO: 28675 - DNA, 20 bp, Artificial Sequence
  chemically synthesized
aaagataatccaccatgatc

SEQ ID NO: 28676 - DNA, 20 bp, Artificial Sequence
  chemically synthesized
gataatccaccatgatcaag

SEQ ID NO: 28677 - DNA, 20 bp, Artificial Sequence
  chemically synthesized
ataatccaccatgatcaagc

SEQ ID NO: 28678 - DNA, 20 bp, Artificial Sequence
  chemically synthesized
tgatcaagcaggttccatgc

SEQ ID NO: 28679 - DNA, 20 bp, Artificial Sequence
  chemically synthesized
gatcaagcaggttccatgcc

SEQ ID NO: 28680 - DNA, 20 bp, Artificial Sequence
  chemically synthesized
atcaagcaggttccatgcca

SEQ ID NO: 28681 - DNA, 20 bp, Artificial Sequence
  chemically synthesized
caggttccatgccagggatg

SEQ ID NO: 28682 - DNA, 20 bp, Artificial Sequence
  chemically synthesized
aggttccatgccagggatgc

SEQ ID NO: 28683 - DNA, 20 bp, Artificial Sequence
  chemically synthesized
ggttccatgccagggatgca

SEQ ID NO: 28684 - DNA, 20 bp, Artificial Sequence
  chemically synthesized
ccatgccagggatgcagggt

SEQ ID NO: 28685 - DNA, 20 bp, Artificial Sequence
  chemically synthesized
agggttggtttgacatctgc

SEQ ID NO: 28686 - DNA, 20 bp, Artificial Sequence
  chemically synthesized
tttgacatctgcaagtcaat

SEQ ID NO: 28687 - DNA, 20 bp, Artificial Sequence
  chemically synthesized
agtgtgatacaccacataaa

SEQ ID NO: 28688 - DNA, 20 bp, Artificial Sequence
  chemically synthesized
aaattacatgatcatctcaa

SEQ ID NO: 28689 - DNA, 20 bp, Artificial Sequence
  chemically synthesized
catgatcatctcaatagatg

SEQ ID NO: 28690 - DNA, 20 bp, Artificial Sequence
  chemically synthesized
catctcaatagatgcagaaa

SEQ ID NO: 28691 - DNA, 20 bp, Artificial Sequence
  chemically synthesized
aaaaagcattcaacaaaatc

SEQ ID NO: 28692 - DNA, 20 bp, Artificial Sequence
  chemically synthesized
acatttatgattaaaatgct

SEQ ID NO: 28693 - DNA, 20 bp, Artificial Sequence
  chemically synthesized
attaaaatgctcagcaaaat

SEQ ID NO: 28694 - DNA, 20 bp, Artificial Sequence
  chemically synthesized
gctcagcaaaatcagcatac

SEQ ID NO: 28695 - DNA, 20 bp, Artificial Sequence
  chemically synthesized
tcagcaaaatcagcatacaa

SEQ ID NO: 28696 - DNA, 20 bp, Artificial Sequence
  chemically synthesized
agcatacaagagacatacct

SEQ ID NO: 28697 - DNA, 20 bp, Artificial Sequence
  chemically synthesized
gacatacctcagtgtaataa

SEQ ID NO: 28698 - DNA, 20 bp, Artificial Sequence
  chemically synthesized
agccatctgtgacaaaccca

SEQ ID NO: 28699 - DNA, 20 bp, Artificial Sequence
  chemically synthesized
acagccaacataatattgaa

SEQ ID NO: 28700 - DNA, 20 bp, Artificial Sequence
  chemically synthesized
cagccaacataatattgaat

SEQ ID NO: 28701 - DNA, 20 bp, Artificial Sequence
  chemically synthesized
agccaacataatattgaatg

SEQ ID NO: 28702 - DNA, 20 bp, Artificial Sequence
  chemically synthesized
acataatattgaatggggaa

SEQ ID NO: 28703 - DNA, 20 bp, Artificial Sequence
  chemically synthesized
attgaatggggaaaagttga

SEQ ID NO: 28704 - DNA, 20 bp, Artificial Sequence
  chemically synthesized
aagttgaaagcattccctct

SEQ ID NO: 28705 - DNA, 20 bp, Artificial Sequence
  chemically synthesized
aaagcattccctctgagaac

SEQ ID NO: 28706 - DNA, 20 bp, Artificial Sequence
  chemically synthesized
ttccctctgagaactggaac

SEQ ID NO: 28707 - DNA, 20 bp, Artificial Sequence
  chemically synthesized
tctgagaactggaacaagac

SEQ ID NO: 28708 - DNA, 20 bp, Artificial Sequence
  chemically synthesized
ctgagaactggaacaagaca

SEQ ID NO: 28709 - DNA, 20 bp, Artificial Sequence
  chemically synthesized
ctcaccactcctcttcaaca

SEQ ID NO: 28710 - DNA, 20 bp, Artificial Sequence
  chemically synthesized
actcctcttcaacatagtac

SEQ ID NO: 28711 - DNA, 20 bp, Artificial Sequence
  chemically synthesized
cctcttcaacatagtactgg

SEQ ID NO: 28712 - DNA, 20 bp, Artificial Sequence
  chemically synthesized
caacatagtactggaagtcc

SEQ ID NO: 28713 - DNA, 20 bp, Artificial Sequence
  chemically synthesized
atagtactggaagtcctagc

SEQ ID NO: 28714 - DNA, 20 bp, Artificial Sequence
  chemically synthesized
tagtactggaagtcctagcc

SEQ ID NO: 28715 - DNA, 20 bp, Artificial Sequence
  chemically synthesized
agtactggaagtcctagcca

SEQ ID NO: 28716 - DNA, 20 bp, Artificial Sequence
  chemically synthesized
gaagtcctagccagggcaat

SEQ ID NO: 28717 - DNA, 20 bp, Artificial Sequence
  chemically synthesized
cagggcaatcagacaaaaca

SEQ ID NO: 28718 - DNA, 20 bp, Artificial Sequence
  chemically synthesized
tcagacaaaacaaagaaata

SEQ ID NO: 28719 - DNA, 20 bp, Artificial Sequence
  chemically synthesized
cagacaaaacaaagaaataa

SEQ ID NO: 28720 - DNA, 20 bp, Artificial Sequence
  chemically synthesized
agacaaaacaaagaaataaa

SEQ ID NO: 28721 - DNA, 20 bp, Artificial Sequence
  chemically synthesized
gaaataaagggcattcaaat

SEQ ID NO: 28722 - DNA, 20 bp, Artificial Sequence
  chemically synthesized
aaagggcattcaaatcagta

SEQ ID NO: 28723 - DNA, 20 bp, Artificial Sequence
  chemically synthesized
agggcattcaaatcagtaaa

SEQ ID NO: 28724 - DNA, 20 bp, Artificial Sequence
  chemically synthesized
gggcattcaaatcagtaaag

SEQ ID NO: 28725 - DNA, 20 bp, Artificial Sequence
  chemically synthesized
cattcaaatcagtaaagagg

SEQ ID NO: 28726 - DNA, 20 bp, Artificial Sequence
  chemically synthesized
catttacctttaaaacccta

SEQ ID NO: 28727 - DNA, 20 bp, Artificial Sequence
  chemically synthesized
taaaaccctaaagactcctc

SEQ ID NO: 28728 - DNA, 20 bp, Artificial Sequence
  chemically synthesized
accctaaagactcctccaga

SEQ ID NO: 28729 - DNA, 20 bp, Artificial Sequence
  chemically synthesized
agactcctccagaaagctcc

SEQ ID NO: 28730 - DNA, 20 bp, Artificial Sequence
  chemically synthesized
ctagaactgataaaataatt

SEQ ID NO: 28731 - DNA, 20 bp, Artificial Sequence
  chemically synthesized
actgataaaataattcagca

SEQ ID NO: 28732 - DNA, 20 bp, Artificial Sequence
  chemically synthesized
aaataattcagcaaagtttc

SEQ ID NO: 28733 - DNA, 20 bp, Artificial Sequence
  chemically synthesized
tcagcaaagtttccagatac

SEQ ID NO: 28734 - DNA, 20 bp, Artificial Sequence
  chemically synthesized
caagatgaatgcacacaaat

SEQ ID NO: 28735 - DNA, 20 bp, Artificial Sequence
  chemically synthesized
gtaactcttctatacaccaa

SEQ ID NO: 28736 - DNA, 20 bp, Artificial Sequence
  chemically synthesized
atacaccaacagcaaccaaa

SEQ ID NO: 28737 - DNA, 20 bp, Artificial Sequence
  chemically synthesized
acaccaacagcaaccaaatg

SEQ ID NO: 28738 - DNA, 20 bp, Artificial Sequence
  chemically synthesized
accaaatggagaatcaaatc

SEQ ID NO: 28739 - DNA, 20 bp, Artificial Sequence
  chemically synthesized
gaactcaaccccttgtacaa

SEQ ID NO: 28740 - DNA, 20 bp, Artificial Sequence
  chemically synthesized
ttgtacaatagatgcaaaaa

SEQ ID NO: 28741 - DNA, 20 bp, Artificial Sequence
  chemically synthesized
gccatataaaacgtactctc

SEQ ID NO: 28742 - DNA, 20 bp, Artificial Sequence
  chemically synthesized
tataaaacgtactctcaaga

SEQ ID NO: 28743 - DNA, 20 bp, Artificial Sequence
  chemically synthesized
cgtactctcaagatggatta

SEQ ID NO: 28744 - DNA, 20 bp, Artificial Sequence
  chemically synthesized
taaaactataaaactactaa

SEQ ID NO: 28745 - DNA, 20 bp, Artificial Sequence
  chemically synthesized
aaactactaaaagaaaacat

SEQ ID NO: 28746 - DNA, 20 bp, Artificial Sequence
  chemically synthesized
aactactaaaagaaaacata

SEQ ID NO: 28747 - DNA, 20 bp, Artificial Sequence
  chemically synthesized
actactaaaagaaaacataa

SEQ ID NO: 28748 - DNA, 20 bp, Artificial Sequence
  chemically synthesized
tactaaaagaaaacataagg

SEQ ID NO: 28749 - DNA, 20 bp, Artificial Sequence
  chemically synthesized
aaacataagggagacacttc

SEQ ID NO: 28750 - DNA, 20 bp, Artificial Sequence
  chemically synthesized
aagggagacacttcaagaca

SEQ ID NO: 28751 - DNA, 20 bp, Artificial Sequence
  chemically synthesized
gacacttcaagacatggctt

SEQ ID NO: 28752 - DNA, 20 bp, Artificial Sequence
  chemically synthesized
acacttcaagacatggcttt

SEQ ID NO: 28753 - DNA, 20 bp, Artificial Sequence
  chemically synthesized
tcaagacatggctttgggca

SEQ ID NO: 28754 - DNA, 20 bp, Artificial Sequence
  chemically synthesized
ggctttgggcaaagatttta

SEQ ID NO: 28755 - DNA, 20 bp, Artificial Sequence
  chemically synthesized
tgggcaaagattttatggcc

SEQ ID NO: 28756 - DNA, 20 bp, Artificial Sequence
  chemically synthesized
ttttatggccaagacctcaa

SEQ ID NO: 28757 - DNA, 20 bp, Artificial Sequence
  chemically synthesized
tggccaagacctcaaaagca

SEQ ID NO: 28758 - DNA, 20 bp, Artificial Sequence
  chemically synthesized
ggccaagacctcaaaagcac

SEQ ID NO: 28759 - DNA, 20 bp, Artificial Sequence
  chemically synthesized
ctcaaaagcacaggcaacaa

SEQ ID NO: 28760 - DNA, 20 bp, Artificial Sequence
  chemically synthesized
acaggcaacaaaagcaaaaa

SEQ ID NO: 28761 - DNA, 20 bp, Artificial Sequence
  chemically synthesized
caaaagcaaaaatagacaaa

SEQ ID NO: 28762 - DNA, 20 bp, Artificial Sequence
  chemically synthesized
aaaagcaaaaatagacaaat

SEQ ID NO: 28763 - DNA, 20 bp, Artificial Sequence
  chemically synthesized
tagacaaatgggactatatt

SEQ ID NO: 28764 - DNA, 20 bp, Artificial Sequence
  chemically synthesized
taagctaaaatacatctgca

SEQ ID NO: 28765 - DNA, 20 bp, Artificial Sequence
  chemically synthesized
taaaatacatctgcacagta

SEQ ID NO: 28766 - DNA, 20 bp, Artificial Sequence
  chemically synthesized
aaaatacatctgcacagtaa

SEQ ID NO: 28767 - DNA, 20 bp, Artificial Sequence
  chemically synthesized
agtaaaggaaacaatcaaca

SEQ ID NO: 28768 - DNA, 20 bp, Artificial Sequence
  chemically synthesized
aggaaacaatcaacacagtg

SEQ ID NO: 28769 - DNA, 20 bp, Artificial Sequence
  chemically synthesized
gaaacaatcaacacagtgaa

SEQ ID NO: 28770 - DNA, 20 bp, Artificial Sequence
  chemically synthesized
aatcaacacagtgaagagac

SEQ ID NO: 28771 - DNA, 20 bp, Artificial Sequence
  chemically synthesized
agagacaagctgttgaatgc

SEQ ID NO: 28772 - DNA, 20 bp, Artificial Sequence
  chemically synthesized
aatatttgcatacatttgac

SEQ ID NO: 28773 - DNA, 20 bp, Artificial Sequence
  chemically synthesized
atatttgcatacatttgaca

SEQ ID NO: 28774 - DNA, 20 bp, Artificial Sequence
  chemically synthesized
tttgacaaggaattaatctc

SEQ ID NO: 28775 - DNA, 20 bp, Artificial Sequence
  chemically synthesized
aattaatctccagaatatat

SEQ ID NO: 28776 - DNA, 20 bp, Artificial Sequence
  chemically synthesized
aagaaactcaaacaactcaa

SEQ ID NO: 28777 - DNA, 20 bp, Artificial Sequence
  chemically synthesized
aaactcaaacaactcaacag

SEQ ID NO: 28778 - DNA, 20 bp, Artificial Sequence
  chemically synthesized
aaataatctcattaaaaaat

SEQ ID NO: 28779 - DNA, 20 bp, Artificial Sequence
  chemically synthesized
atctcattaaaaaattggca

SEQ ID NO: 28780 - DNA, 20 bp, Artificial Sequence
  chemically synthesized
tctcattaaaaaattggcaa

SEQ ID NO: 28781 - DNA, 20 bp, Artificial Sequence
  chemically synthesized
tggcaaaggatatttttcaa

SEQ ID NO: 28782 - DNA, 20 bp, Artificial Sequence
  chemically synthesized
caaaggatatttttcaaaag

SEQ ID NO: 28783 - DNA, 20 bp, Artificial Sequence
  chemically synthesized
gaagacatacaaatgcacaa

SEQ ID NO: 28784 - DNA, 20 bp, Artificial Sequence
  chemically synthesized
aagacatacaaatgcacaat

SEQ ID NO: 28785 - DNA, 20 bp, Artificial Sequence
  chemically synthesized
atacaaatgcacaatgggta

SEQ ID NO: 28786 - DNA, 20 bp, Artificial Sequence
  chemically synthesized
tacaaatgcacaatgggtat

SEQ ID NO: 28787 - DNA, 20 bp, Artificial Sequence
  chemically synthesized
acaaatgcacaatgggtatg

SEQ ID NO: 28788 - DNA, 20 bp, Artificial Sequence
  chemically synthesized
tgctcaacattactaatcat

SEQ ID NO: 28789 - DNA, 20 bp, Artificial Sequence
  chemically synthesized
ctcaacattactaatcatca

SEQ ID NO: 28790 - DNA, 20 bp, Artificial Sequence
  chemically synthesized
atgcaaatcaaaaccacaat

SEQ ID NO: 28791 - DNA, 20 bp, Artificial Sequence
  chemically synthesized
aatgagatatcatcttatgc

SEQ ID NO: 28792 - DNA, 20 bp, Artificial Sequence
  chemically synthesized
agatatcatcttatgccagt

SEQ ID NO: 28793 - DNA, 20 bp, Artificial Sequence
  chemically synthesized
aataaataaataacacatgc

SEQ ID NO: 28794 - DNA, 20 bp, Artificial Sequence
  chemically synthesized
aataaataacacatgctggc

SEQ ID NO: 28795 - DNA, 20 bp, Artificial Sequence
  chemically synthesized
ataaataacacatgctggca

SEQ ID NO: 28796 - DNA, 20 bp, Artificial Sequence
  chemically synthesized
cacatgctggcaaggatgtg

SEQ ID NO: 28797 - DNA, 20 bp, Artificial Sequence
  chemically synthesized
acatgctggcaaggatgtga

SEQ ID NO: 28798 - DNA, 20 bp, Artificial Sequence
  chemically synthesized
ctggcaaggatgtgaaggaa

SEQ ID NO: 28799 - DNA, 20 bp, Artificial Sequence
  chemically synthesized
tggcaaggatgtgaaggaaa

SEQ ID NO: 28800 - DNA, 20 bp, Artificial Sequence
  chemically synthesized
tgtgaaggaaaaggcactcg

SEQ ID NO: 28801 - DNA, 20 bp, Artificial Sequence
  chemically synthesized
gtgaaggaaaaggcactcgt

SEQ ID NO: 28802 - DNA, 20 bp, Artificial Sequence
  chemically synthesized
aaggcactcgtaggcactat

SEQ ID NO: 28803 - DNA, 20 bp, Artificial Sequence
  chemically synthesized
cactcgtaggcactattggt

SEQ ID NO: 28804 - DNA, 20 bp, Artificial Sequence
  chemically synthesized
ctattggtaagcatgcaaat

SEQ ID NO: 28805 - DNA, 20 bp, Artificial Sequence
  chemically synthesized
ggtaagcatgcaaattagta

SEQ ID NO: 28806 - DNA, 20 bp, Artificial Sequence
  chemically synthesized
gcaaattagtatagccacta

SEQ ID NO: 28807 - DNA, 20 bp, Artificial Sequence
  chemically synthesized
ccactatggaaaacaatatg

SEQ ID NO: 28808 - DNA, 20 bp, Artificial Sequence
  chemically synthesized
caatatgtagatttaccaaa

SEQ ID NO: 28809 - DNA, 20 bp, Artificial Sequence
  chemically synthesized
gctaaaaattgaactatcat

SEQ ID NO: 28810 - DNA, 20 bp, Artificial Sequence
  chemically synthesized
aattgaactatcataagatc

SEQ ID NO: 28811 - DNA, 20 bp, Artificial Sequence
  chemically synthesized
agatccagcaatcttattac

SEQ ID NO: 28812 - DNA, 20 bp, Artificial Sequence
  chemically synthesized
gatccagcaatcttattact

SEQ ID NO: 28813 - DNA, 20 bp, Artificial Sequence
  chemically synthesized
tattactgggtatttatcca

SEQ ID NO: 28814 - DNA, 20 bp, Artificial Sequence
  chemically synthesized
attactgggtatttatccaa

SEQ ID NO: 28815 - DNA, 20 bp, Artificial Sequence
  chemically synthesized
tgggtatttatccaaaggaa

SEQ ID NO: 28816 - DNA, 20 bp, Artificial Sequence
  chemically synthesized
ttatccaaaggaaaagaatt

SEQ ID NO: 28817 - DNA, 20 bp, Artificial Sequence
  chemically synthesized
aaagaattcagaataataaa

SEQ ID NO: 28818 - DNA, 20 bp, Artificial Sequence
  chemically synthesized
tcagaataataaacagatac

SEQ ID NO: 28819 - DNA, 20 bp, Artificial Sequence
  chemically synthesized
tggtaccacactgtttattg

SEQ ID NO: 28820 - DNA, 20 bp, Artificial Sequence
  chemically synthesized
tattgcagcacgattcacat

SEQ ID NO: 28821 - DNA, 20 bp, Artificial Sequence
  chemically synthesized
cagcacgattcacattagca

SEQ ID NO: 28822 - DNA, 20 bp, Artificial Sequence
  chemically synthesized
gattcacattagcaaagata

SEQ ID NO: 28823 - DNA, 20 bp, Artificial Sequence
  chemically synthesized
caaagatatggaatcaacct

SEQ ID NO: 28824 - DNA, 20 bp, Artificial Sequence
  chemically synthesized
tcaacctaagtgtccatcaa

SEQ ID NO: 28825 - DNA, 20 bp, Artificial Sequence
  chemically synthesized
tgtccatcaatggatgaatg

SEQ ID NO: 28826 - DNA, 20 bp, Artificial Sequence
  chemically synthesized
atggatgaatgaagaaaatg

SEQ ID NO: 28827 - DNA, 20 bp, Artificial Sequence
  chemically synthesized
atataaaatcatttcatttg

SEQ ID NO: 28828 - DNA, 20 bp, Artificial Sequence
  chemically synthesized
tcatttcatttgcagcaaca

SEQ ID NO: 28829 - DNA, 20 bp, Artificial Sequence
  chemically synthesized
tgcagcaacatggatgaaac

SEQ ID NO: 28830 - DNA, 20 bp, Artificial Sequence
  chemically synthesized
agcaacatggatgaaactgg

SEQ ID NO: 28831 - DNA, 20 bp, Artificial Sequence
  chemically synthesized
gtcattatgttaaacgaaat

SEQ ID NO: 28832 - DNA, 20 bp, Artificial Sequence
  chemically synthesized
ttatgttaaacgaaataagc

SEQ ID NO: 28833 - DNA, 20 bp, Artificial Sequence
  chemically synthesized
tatgttaaacgaaataagcc

SEQ ID NO: 28834 - DNA, 20 bp, Artificial Sequence
  chemically synthesized
taaacgaaataagccaggca

SEQ ID NO: 28835 - DNA, 20 bp, Artificial Sequence
  chemically synthesized
cgaaataagccaggcataga

SEQ ID NO: 28836 - DNA, 20 bp, Artificial Sequence
  chemically synthesized
tgcatgttctcactgatatg

SEQ ID NO: 28837 - DNA, 20 bp, Artificial Sequence
  chemically synthesized
gcatgttctcactgatatgt

SEQ ID NO: 28838 - DNA, 20 bp, Artificial Sequence
  chemically synthesized
atgttctcactgatatgtgg

SEQ ID NO: 28839 - DNA, 20 bp, Artificial Sequence
  chemically synthesized
ctgatatgtgggagctaaaa

SEQ ID NO: 28840 - DNA, 20 bp, Artificial Sequence
  chemically synthesized
ctaaaaaagttaatatcatg

SEQ ID NO: 28841 - DNA, 20 bp, Artificial Sequence
  chemically synthesized
taaaaaagttaatatcatgt

SEQ ID NO: 28842 - DNA, 20 bp, Artificial Sequence
  chemically synthesized
aaaagttaatatcatgtagg

SEQ ID NO: 28843 - DNA, 20 bp, Artificial Sequence
  chemically synthesized
aagttaatatcatgtaggta

SEQ ID NO: 28844 - DNA, 20 bp, Artificial Sequence
  chemically synthesized
gttaatatcatgtaggtaga

SEQ ID NO: 28845 - DNA, 20 bp, Artificial Sequence
  chemically synthesized
aatatcatgtaggtagagag

SEQ ID NO: 28846 - DNA, 20 bp, Artificial Sequence
  chemically synthesized
gtaggtagagagtagaatga

SEQ ID NO: 28847 - DNA, 20 bp, Artificial Sequence
  chemically synthesized
gagagtagaatgacagaaac

SEQ ID NO: 28848 - DNA, 20 bp, Artificial Sequence
  chemically synthesized
gagtagaatgacagaaacca

SEQ ID NO: 28849 - DNA, 20 bp, Artificial Sequence
  chemically synthesized
agtagaatgacagaaaccag

SEQ ID NO: 28850 - DNA, 20 bp, Artificial Sequence
  chemically synthesized
agaatgacagaaaccagagg

SEQ ID NO: 28851 - DNA, 20 bp, Artificial Sequence
  chemically synthesized
aatgacagaaaccagaggta

SEQ ID NO: 28852 - DNA, 20 bp, Artificial Sequence
  chemically synthesized
acagaaaccagaggtagaga

SEQ ID NO: 28853 - DNA, 20 bp, Artificial Sequence
  chemically synthesized
cagaaaccagaggtagagaa

SEQ ID NO: 28854 - DNA, 20 bp, Artificial Sequence
  chemically synthesized
agagaaaggtgtgtacgtta

SEQ ID NO: 28855 - DNA, 20 bp, Artificial Sequence
  chemically synthesized
gagaaaggtgtgtacgttat

SEQ ID NO: 28856 - DNA, 20 bp, Artificial Sequence
  chemically synthesized
gaaaggtgtgtacgttatgg

SEQ ID NO: 28857 - DNA, 20 bp, Artificial Sequence
  chemically synthesized
aaaggtgtgtacgttatggg

SEQ ID NO: 28858 - DNA, 20 bp, Artificial Sequence
  chemically synthesized
ggtgtgtacgttatgggagg

SEQ ID NO: 28859 - DNA, 20 bp, Artificial Sequence
  chemically synthesized
gtgtgtacgttatgggagga

SEQ ID NO: 28860 - DNA, 20 bp, Artificial Sequence
  chemically synthesized
tgtgtacgttatgggaggaa

SEQ ID NO: 28861 - DNA, 20 bp, Artificial Sequence
  chemically synthesized
tgtacgttatgggaggaagg

SEQ ID NO: 28862 - DNA, 20 bp, Artificial Sequence
  chemically synthesized
ttatgggaggaagggagacg

SEQ ID NO: 28863 - DNA, 20 bp, Artificial Sequence
  chemically synthesized
atgggaggaagggagacgaa

SEQ ID NO: 28864 - DNA, 20 bp, Artificial Sequence
  chemically synthesized
ggaggaagggagacgaagag

SEQ ID NO: 28865 - DNA, 20 bp, Artificial Sequence
  chemically synthesized
gaagggagacgaagagaagt

SEQ ID NO: 28866 - DNA, 20 bp, Artificial Sequence
  chemically synthesized
gacgaagagaagttggttaa

SEQ ID NO: 28867 - DNA, 20 bp, Artificial Sequence
  chemically synthesized
gagaagttggttaatggaaa

SEQ ID NO: 28868 - DNA, 20 bp, Artificial Sequence
  chemically synthesized
agaagttggttaatggaaac

SEQ ID NO: 28869 - DNA, 20 bp, Artificial Sequence
  chemically synthesized
agttggttaatggaaacagg

SEQ ID NO: 28870 - DNA, 20 bp, Artificial Sequence
  chemically synthesized
ggttaatggaaacaggcagt

SEQ ID NO: 28871 - DNA, 20 bp, Artificial Sequence
  chemically synthesized
aatggaaacaggcagttaga

SEQ ID NO: 28872 - DNA, 20 bp, Artificial Sequence
  chemically synthesized
ggaaacaggcagttagatag

SEQ ID NO: 28873 - DNA, 20 bp, Artificial Sequence
  chemically synthesized
gaaacaggcagttagataga

SEQ ID NO: 28874 - DNA, 20 bp, Artificial Sequence
  chemically synthesized
gaatatgttctgatgttcaa

SEQ ID NO: 28875 - DNA, 20 bp, Artificial Sequence
  chemically synthesized
tgttctgatgttcaatagca

SEQ ID NO: 28876 - DNA, 20 bp, Artificial Sequence
  chemically synthesized
tctgatgttcaatagcaaag

SEQ ID NO: 28877 - DNA, 20 bp, Artificial Sequence
  chemically synthesized
ctgatgttcaatagcaaagt

SEQ ID NO: 28878 - DNA, 20 bp, Artificial Sequence
  chemically synthesized
tgatgttcaatagcaaagta

SEQ ID NO: 28879 - DNA, 20 bp, Artificial Sequence
  chemically synthesized
atagcaaagtagggtgatta

SEQ ID NO: 28880 - DNA, 20 bp, Artificial Sequence
  chemically synthesized
atatattgtatatttcaaaa

SEQ ID NO: 28881 - DNA, 20 bp, Artificial Sequence
  chemically synthesized
tattgtatatttcaaaatag

SEQ ID NO: 28882 - DNA, 20 bp, Artificial Sequence
  chemically synthesized
tgtatatttcaaaatagtag

SEQ ID NO: 28883 - DNA, 20 bp, Artificial Sequence
  chemically synthesized
tatttcaaaatagtagaaga

SEQ ID NO: 28884 - DNA, 20 bp, Artificial Sequence
  chemically synthesized
atttcaaaatagtagaagaa

SEQ ID NO: 28885 - DNA, 20 bp, Artificial Sequence
  chemically synthesized
cttgaaatgttcctaacaca

SEQ ID NO: 28886 - DNA, 20 bp, Artificial Sequence
  chemically synthesized
catagaaacgataaatactt

SEQ ID NO: 28887 - DNA, 20 bp, Artificial Sequence
  chemically synthesized
atagaaacgataaatacttg

SEQ ID NO: 28888 - DNA, 20 bp, Artificial Sequence
  chemically synthesized
aacacgtcatatatcaataa

SEQ ID NO: 28889 - DNA, 20 bp, Artificial Sequence
  chemically synthesized
cgtcatatatcaataaaaga

SEQ ID NO: 28890 - DNA, 20 bp, Artificial Sequence
  chemically synthesized
aaagaaagtcgatctcatat

SEQ ID NO: 28891 - DNA, 20 bp, Artificial Sequence
  chemically synthesized
aagtcgatctcatattggtt

SEQ ID NO: 28892 - DNA, 20 bp, Artificial Sequence
  chemically synthesized
agtcgatctcatattggttg

SEQ ID NO: 28893 - DNA, 20 bp, Artificial Sequence
  chemically synthesized
attggttgaggcctgattgt

SEQ ID NO: 28894 - DNA, 20 bp, Artificial Sequence
  chemically synthesized
taagtaaatctttgtccctc

SEQ ID NO: 28895 - DNA, 20 bp, Artificial Sequence
  chemically synthesized
tccctgtactgtcttgctgt

SEQ ID NO: 28896 - DNA, 20 bp, Artificial Sequence
  chemically synthesized
ccctgtactgtcttgctgtg

SEQ ID NO: 28897 - DNA, 20 bp, Artificial Sequence
  chemically synthesized
ctgtactgtcttgctgtgag

SEQ ID NO: 28898 - DNA, 20 bp, Artificial Sequence
  chemically synthesized
cttatattccaacaccattt

SEQ ID NO: 28899 - DNA, 20 bp, Artificial Sequence
  chemically synthesized
tcctccccatatttttacct

SEQ ID NO: 28900 - DNA, 20 bp, Artificial Sequence
  chemically synthesized
ctcggtttttactgtttata

SEQ ID NO: 28901 - DNA, 20 bp, Artificial Sequence
  chemically synthesized
atatagcacactttgtgcta

SEQ ID NO: 28902 - DNA, 20 bp, Artificial Sequence
  chemically synthesized
ctttgtgctatagtttacct

SEQ ID NO: 28903 - DNA, 20 bp, Artificial Sequence
  chemically synthesized
ctcagtttttactatttata

SEQ ID NO: 28904 - DNA, 20 bp, Artificial Sequence
  chemically synthesized
ccccaaacttctctcttaac

SEQ ID NO: 28905 - DNA, 20 bp, Artificial Sequence
  chemically synthesized
aaacttctctcttaacaagc

SEQ ID NO: 28906 - DNA, 20 bp, Artificial Sequence
  chemically synthesized
ctcttaacaagctagaatat

SEQ ID NO: 28907 - DNA, 20 bp, Artificial Sequence
  chemically synthesized
gctagaatataagtgaatgc

SEQ ID NO: 28908 - DNA, 20 bp, Artificial Sequence
  chemically synthesized
tagaatataagtgaatgcaa

SEQ ID NO: 28909 - DNA, 20 bp, Artificial Sequence
  chemically synthesized
tataagtgaatgcaagagca

SEQ ID NO: 28910 - DNA, 20 bp, Artificial Sequence
  chemically synthesized
taagtgaatgcaagagcata

SEQ ID NO: 28911 - DNA, 20 bp, Artificial Sequence
  chemically synthesized
tgaatgcaagagcatagaga

SEQ ID NO: 28912 - DNA, 20 bp, Artificial Sequence
  chemically synthesized
gaatgcaagagcatagagac

SEQ ID NO: 28913 - DNA, 20 bp, Artificial Sequence
  chemically synthesized
aatgcaagagcatagagaca

SEQ ID NO: 28914 - DNA, 20 bp, Artificial Sequence
  chemically synthesized
tcattcctattttcatattt

SEQ ID NO: 28915 - DNA, 20 bp, Artificial Sequence
  chemically synthesized
cattcctattttcatatttg

SEQ ID NO: 28916 - DNA, 20 bp, Artificial Sequence
  chemically synthesized
tcatatttgaggtataaacc

SEQ ID NO: 28917 - DNA, 20 bp, Artificial Sequence
  chemically synthesized
catatttgaggtataaacca

SEQ ID NO: 28918 - DNA, 20 bp, Artificial Sequence
  chemically synthesized
tatttgaggtataaaccaag

SEQ ID NO: 28919 - DNA, 20 bp, Artificial Sequence
  chemically synthesized
tttttaaatctgcaaataaa

SEQ ID NO: 28920 - DNA, 20 bp, Artificial Sequence
  chemically synthesized
gttttattctgacattaaaa

SEQ ID NO: 28921 - DNA, 20 bp, Artificial Sequence
  chemically synthesized
aatgaatgatcgttttacca

SEQ ID NO: 28922 - DNA, 20 bp, Artificial Sequence
  chemically synthesized
atgatcgttttaccacagcg

SEQ ID NO: 28923 - DNA, 20 bp, Artificial Sequence
  chemically synthesized
tgatcgttttaccacagcgt

SEQ ID NO: 28924 - DNA, 20 bp, Artificial Sequence
  chemically synthesized
cttaaccttcactttcaaac

SEQ ID NO: 28925 - DNA, 20 bp, Artificial Sequence
  chemically synthesized
tttattgatctctattttcc

SEQ ID NO: 28926 - DNA, 20 bp, Artificial Sequence
  chemically synthesized
tctattttcctggaacaaca

SEQ ID NO: 28927 - DNA, 20 bp, Artificial Sequence
  chemically synthesized
ctattttcctggaacaacat

SEQ ID NO: 28928 - DNA, 20 bp, Artificial Sequence
  chemically synthesized
tattttcctggaacaacatg

SEQ ID NO: 28929 - DNA, 20 bp, Artificial Sequence
  chemically synthesized
attttcctggaacaacatgg

SEQ ID NO: 28930 - DNA, 20 bp, Artificial Sequence
  chemically synthesized
aacaacatgggggctatgtt

SEQ ID NO: 28931 - DNA, 20 bp, Artificial Sequence
  chemically synthesized
atgggggctatgtttagcgt

SEQ ID NO: 28932 - DNA, 20 bp, Artificial Sequence
  chemically synthesized
tgggggctatgtttagcgtg

SEQ ID NO: 28933 - DNA, 20 bp, Artificial Sequence
  chemically synthesized
ctatgtttagcgtgaggaca

SEQ ID NO: 28934 - DNA, 20 bp, Artificial Sequence
  chemically synthesized
gtatcacaactttcacctga

SEQ ID NO: 28935 - DNA, 20 bp, Artificial Sequence
  chemically synthesized
acaactttcacctgaaagaa

SEQ ID NO: 28936 - DNA, 20 bp, Artificial Sequence
  chemically synthesized
tttcacctgaaagaaaagat

SEQ ID NO: 28937 - DNA, 20 bp, Artificial Sequence
  chemically synthesized
aaagaaaagatgagctacca

SEQ ID NO: 28938 - DNA, 20 bp, Artificial Sequence
  chemically synthesized
accatggtacatataacaat

SEQ ID NO: 28939 - DNA, 20 bp, Artificial Sequence
  chemically synthesized
ccatggtacatataacaatg

SEQ ID NO: 28940 - DNA, 20 bp, Artificial Sequence
  chemically synthesized
tggtacatataacaatgagg

SEQ ID NO: 28941 - DNA, 20 bp, Artificial Sequence
  chemically synthesized
aatgaggtggttaaaactct

SEQ ID NO: 28942 - DNA, 20 bp, Artificial Sequence
  chemically synthesized
taaaactctaagtcgtcatc

SEQ ID NO: 28943 - DNA, 20 bp, Artificial Sequence
  chemically synthesized
tactaaaaatcactatttca

SEQ ID NO: 28944 - DNA, 20 bp, Artificial Sequence
  chemically synthesized
taaaaatcactatttcaaag

SEQ ID NO: 28945 - DNA, 20 bp, Artificial Sequence
  chemically synthesized
atcactatttcaaagaagta

SEQ ID NO: 28946 - DNA, 20 bp, Artificial Sequence
  chemically synthesized
tatttcaaagaagtatagaa

SEQ ID NO: 28947 - DNA, 20 bp, Artificial Sequence
  chemically synthesized
aagaagtatagaatagatat

SEQ ID NO: 28948 - DNA, 20 bp, Artificial Sequence
  chemically synthesized
gaatagatatcagccaaaat

SEQ ID NO: 28949 - DNA, 20 bp, Artificial Sequence
  chemically synthesized
aatagatatcagccaaaata

SEQ ID NO: 28950 - DNA, 20 bp, Artificial Sequence
  chemically synthesized
atatacatattatacacata

SEQ ID NO: 28951 - DNA, 20 bp, Artificial Sequence
  chemically synthesized
atacatattatacacatatg

SEQ ID NO: 28952 - DNA, 20 bp, Artificial Sequence
  chemically synthesized
ttgtatatgcttaaaaatta

SEQ ID NO: 28953 - DNA, 20 bp, Artificial Sequence
  chemically synthesized
tgcttaaaaattacagactt

SEQ ID NO: 28954 - DNA, 20 bp, Artificial Sequence
  chemically synthesized
ttaaaaattacagactttgg

SEQ ID NO: 28955 - DNA, 20 bp, Artificial Sequence
  chemically synthesized
tggaagtcatatgactattt

SEQ ID NO: 28956 - DNA, 20 bp, Artificial Sequence
  chemically synthesized
tatgactatttcagtgtgtg

SEQ ID NO: 28957 - DNA, 20 bp, Artificial Sequence
  chemically synthesized
caccctcctgttccaaaaca

SEQ ID NO: 28958 - DNA, 20 bp, Artificial Sequence
  chemically synthesized
cctgttccaaaacacagttg

SEQ ID NO: 28959 - DNA, 20 bp, Artificial Sequence
  chemically synthesized
gttccaaaacacagttgcag

SEQ ID NO: 28960 - DNA, 20 bp, Artificial Sequence
  chemically synthesized
ccaaaacacagttgcagaag

SEQ ID NO: 28961 - DNA, 20 bp, Artificial Sequence
  chemically synthesized
aaaacacagttgcagaagca

SEQ ID NO: 28962 - DNA, 20 bp, Artificial Sequence
  chemically synthesized
aaacacagttgcagaagcag

SEQ ID NO: 28963 - DNA, 20 bp, Artificial Sequence
  chemically synthesized
cacagttgcagaagcagagg

SEQ ID NO: 28964 - DNA, 20 bp, Artificial Sequence
  chemically synthesized
agaggaagtcattatacact

SEQ ID NO: 28965 - DNA, 20 bp, Artificial Sequence
  chemically synthesized
cacttagaacatcattttat

SEQ ID NO: 28966 - DNA, 20 bp, Artificial Sequence
  chemically synthesized
acttagaacatcattttata

SEQ ID NO: 28967 - DNA, 20 bp, Artificial Sequence
  chemically synthesized
tagaacatcattttataagg

SEQ ID NO: 28968 - DNA, 20 bp, Artificial Sequence
  chemically synthesized
aacatcattttataaggcag

SEQ ID NO: 28969 - DNA, 20 bp, Artificial Sequence
  chemically synthesized
acatcattttataaggcagc

SEQ ID NO: 28970 - DNA, 20 bp, Artificial Sequence
  chemically synthesized
attttataaggcagcaggtc

SEQ ID NO: 28971 - DNA, 20 bp, Artificial Sequence
  chemically synthesized
ttataaggcagcaggtctgg

SEQ ID NO: 28972 - DNA, 20 bp, Artificial Sequence
  chemically synthesized
tataaggcagcaggtctggt

SEQ ID NO: 28973 - DNA, 20 bp, Artificial Sequence
  chemically synthesized
aaggcagcaggtctggtagg

SEQ ID NO: 28974 - DNA, 20 bp, Artificial Sequence
  chemically synthesized
aggcagcaggtctggtagga

SEQ ID NO: 28975 - DNA, 20 bp, Artificial Sequence
  chemically synthesized
gcagcaggtctggtaggaag

SEQ ID NO: 28976 - DNA, 20 bp, Artificial Sequence
  chemically synthesized
aggtctggtaggaaggagat

SEQ ID NO: 28977 - DNA, 20 bp, Artificial Sequence
  chemically synthesized
ggtctggtaggaaggagatt

SEQ ID NO: 28978 - DNA, 20 bp, Artificial Sequence
  chemically synthesized
attaggtgctacttgtgaca

SEQ ID NO: 28979 - DNA, 20 bp, Artificial Sequence
  chemically synthesized
ttaggtgctacttgtgacaa

SEQ ID NO: 28980 - DNA, 20 bp, Artificial Sequence
  chemically synthesized
gtgctacttgtgacaaaggt

SEQ ID NO: 28981 - DNA, 20 bp, Artificial Sequence
  chemically synthesized
tcagcaaatatttgtgttcc

SEQ ID NO: 28982 - DNA, 20 bp, Artificial Sequence
  chemically synthesized
ttgtgttcccagcacttttc

SEQ ID NO: 28983 - DNA, 20 bp, Artificial Sequence
  chemically synthesized
ccagcacttttctagatcct

SEQ ID NO: 28984 - DNA, 20 bp, Artificial Sequence
  chemically synthesized
tagatcctcagttaaaatca

SEQ ID NO: 28985 - DNA, 20 bp, Artificial Sequence
  chemically synthesized
atcctcagttaaaatcaaag

SEQ ID NO: 28986 - DNA, 20 bp, Artificial Sequence
  chemically synthesized
agttaaaatcaaagcagctg

SEQ ID NO: 28987 - DNA, 20 bp, Artificial Sequence
  chemically synthesized
aatcaaagcagctgcagtct

SEQ ID NO: 28988 - DNA, 20 bp, Artificial Sequence
  chemically synthesized
caaagcagctgcagtcttgg

SEQ ID NO: 28989 - DNA, 20 bp, Artificial Sequence
  chemically synthesized
agcagctgcagtcttggcag

SEQ ID NO: 28990 - DNA, 20 bp, Artificial Sequence
  chemically synthesized
gcagctgcagtcttggcagt

SEQ ID NO: 28991 - DNA, 20 bp, Artificial Sequence
  chemically synthesized
agctgcagtcttggcagtgg

SEQ ID NO: 28992 - DNA, 20 bp, Artificial Sequence
  chemically synthesized
gctgcagtcttggcagtggg

SEQ ID NO: 28993 - DNA, 20 bp, Artificial Sequence
  chemically synthesized
gtgatactcacactttgaac

SEQ ID NO: 28994 - DNA, 20 bp, Artificial Sequence
  chemically synthesized
accacctgcactacctacaa

SEQ ID NO: 28995 - DNA, 20 bp, Artificial Sequence
  chemically synthesized
acctgcactacctacaatgg

SEQ ID NO: 28996 - DNA, 20 bp, Artificial Sequence
  chemically synthesized
gctccaaatattttatatga

SEQ ID NO: 28997 - DNA, 20 bp, Artificial Sequence
  chemically synthesized
ctccaaatattttatatgaa

SEQ ID NO: 28998 - DNA, 20 bp, Artificial Sequence
  chemically synthesized
tccaaatattttatatgaaa

SEQ ID NO: 28999 - DNA, 20 bp, Artificial Sequence
  chemically synthesized
ccaaatattttatatgaaag

SEQ ID NO: 29000 - DNA, 20 bp, Artificial Sequence
  chemically synthesized
tattttatatgaaaggggcc

SEQ ID NO: 29001 - DNA, 20 bp, Artificial Sequence
  chemically synthesized
atatgaaaggggcctagaca

SEQ ID NO: 29002 - DNA, 20 bp, Artificial Sequence
  chemically synthesized
gacatagcatgctgaatgaa

SEQ ID NO: 29003 - DNA, 20 bp, Artificial Sequence
  chemically synthesized
acatagcatgctgaatgaaa

SEQ ID NO: 29004 - DNA, 20 bp, Artificial Sequence
  chemically synthesized
tagcatgctgaatgaaaagg

SEQ ID NO: 29005 - DNA, 20 bp, Artificial Sequence
  chemically synthesized
atgctgaatgaaaaggaagt

SEQ ID NO: 29006 - DNA, 20 bp, Artificial Sequence
  chemically synthesized
ctgaatgaaaaggaagtgag

SEQ ID NO: 29007 - DNA, 20 bp, Artificial Sequence
  chemically synthesized
tgaaaaggaagtgagtagac

SEQ ID NO: 29008 - DNA, 20 bp, Artificial Sequence
  chemically synthesized
gtagactagtgctttccttg

SEQ ID NO: 29009 - DNA, 20 bp, Artificial Sequence
  chemically synthesized
ttccttgaagctgtgcaacc

SEQ ID NO: 29010 - DNA, 20 bp, Artificial Sequence
  chemically synthesized
tgaagctgtgcaaccaagca

SEQ ID NO: 29011 - DNA, 20 bp, Artificial Sequence
  chemically synthesized
aaccaagcatagtttttaca

SEQ ID NO: 29012 - DNA, 20 bp, Artificial Sequence
  chemically synthesized
catagatcgtgtgtttcaca

SEQ ID NO: 29013 - DNA, 20 bp, Artificial Sequence
  chemically synthesized
tgtttcacatggtgtgataa

SEQ ID NO: 29014 - DNA, 20 bp, Artificial Sequence
  chemically synthesized
acatggtgtgataacagctt

SEQ ID NO: 29015 - DNA, 20 bp, Artificial Sequence
  chemically synthesized
agcttgagatgccattgaca

SEQ ID NO: 29016 - DNA, 20 bp, Artificial Sequence
  chemically synthesized
atgccattgacatggcccac

SEQ ID NO: 29017 - DNA, 20 bp, Artificial Sequence
  chemically synthesized
gcccaccggcttatccacat

SEQ ID NO: 29018 - DNA, 20 bp, Artificial Sequence
  chemically synthesized
ggcttatccacatcagtaat

SEQ ID NO: 29019 - DNA, 20 bp, Artificial Sequence
  chemically synthesized
gcttatccacatcagtaatt

SEQ ID NO: 29020 - DNA, 20 bp, Artificial Sequence
  chemically synthesized
cttatccacatcagtaatta

SEQ ID NO: 29021 - DNA, 20 bp, Artificial Sequence
  chemically synthesized
ccacatcagtaattagggca

SEQ ID NO: 29022 - DNA, 20 bp, Artificial Sequence
  chemically synthesized
tactatgcatcccgtgattg

SEQ ID NO: 29023 - DNA, 20 bp, Artificial Sequence
  chemically synthesized
tgtgtttaaaaatgcaatta

SEQ ID NO: 29024 - DNA, 20 bp, Artificial Sequence
  chemically synthesized
tgcaattatggactcattca

SEQ ID NO: 29025 - DNA, 20 bp, Artificial Sequence
  chemically synthesized
tatggactcattcaaagtga

SEQ ID NO: 29026 - DNA, 20 bp, Artificial Sequence
  chemically synthesized
gactcattcaaagtgaaagc

SEQ ID NO: 29027 - DNA, 20 bp, Artificial Sequence
  chemically synthesized
aagctggtatgacaatacat

SEQ ID NO: 29028 - DNA, 20 bp, Artificial Sequence
  chemically synthesized
ttttatgaataaattttata

SEQ ID NO: 29029 - DNA, 20 bp, Artificial Sequence
  chemically synthesized
aataaattttataaagaaat

SEQ ID NO: 29030 - DNA, 20 bp, Artificial Sequence
  chemically synthesized
aagaaataagctaataccta

SEQ ID NO: 29031 - DNA, 20 bp, Artificial Sequence
  chemically synthesized
gaaataagctaatacctaca

SEQ ID NO: 29032 - DNA, 20 bp, Artificial Sequence
  chemically synthesized
acagagtgtttattaaatgc

SEQ ID NO: 29033 - DNA, 20 bp, Artificial Sequence
  chemically synthesized
cagagtgtttattaaatgct

SEQ ID NO: 29034 - DNA, 20 bp, Artificial Sequence
  chemically synthesized
tgtttattaaatgctaggca

SEQ ID NO: 29035 - DNA, 20 bp, Artificial Sequence
  chemically synthesized
taaatgctaggcacagttct

SEQ ID NO: 29036 - DNA, 20 bp, Artificial Sequence
  chemically synthesized
agttctgagtgatttacaac

SEQ ID NO: 29037 - DNA, 20 bp, Artificial Sequence
  chemically synthesized
taattttcacaacattatta

SEQ ID NO: 29038 - DNA, 20 bp, Artificial Sequence
  chemically synthesized
aattttcacaacattattac

SEQ ID NO: 29039 - DNA, 20 bp, Artificial Sequence
  chemically synthesized
tttcacaacattattacagg

SEQ ID NO: 29040 - DNA, 20 bp, Artificial Sequence
  chemically synthesized
ttacaggtagattttatata

SEQ ID NO: 29041 - DNA, 20 bp, Artificial Sequence
  chemically synthesized
acaggtagattttatatatg

SEQ ID NO: 29042 - DNA, 20 bp, Artificial Sequence
  chemically synthesized
attttatatatggagaaact

SEQ ID NO: 29043 - DNA, 20 bp, Artificial Sequence
  chemically synthesized
ttttatatatggagaaactg

SEQ ID NO: 29044 - DNA, 20 bp, Artificial Sequence
  chemically synthesized
tatatggagaaactgaggca

SEQ ID NO: 29045 - DNA, 20 bp, Artificial Sequence
  chemically synthesized
tatggagaaactgaggcaca

SEQ ID NO: 29046 - DNA, 20 bp, Artificial Sequence
  chemically synthesized
taataaatctcaacattacc

SEQ ID NO: 29047 - DNA, 20 bp, Artificial Sequence
  chemically synthesized
aataaatctcaacattaccc

SEQ ID NO: 29048 - DNA, 20 bp, Artificial Sequence
  chemically synthesized
tctcaacattacccaggtga

SEQ ID NO: 29049 - DNA, 20 bp, Artificial Sequence
  chemically synthesized
caacattacccaggtgatgg

SEQ ID NO: 29050 - DNA, 20 bp, Artificial Sequence
  chemically synthesized
acattacccaggtgatggtg

SEQ ID NO: 29051 - DNA, 20 bp, Artificial Sequence
  chemically synthesized
tacccaggtgatggtggagt

SEQ ID NO: 29052 - DNA, 20 bp, Artificial Sequence
  chemically synthesized
agttggaattccaaatcatg

SEQ ID NO: 29053 - DNA, 20 bp, Artificial Sequence
  chemically synthesized
caaatcatgcagtctgactt

SEQ ID NO: 29054 - DNA, 20 bp, Artificial Sequence
  chemically synthesized
atgcagtctgactttagctg

SEQ ID NO: 29055 - DNA, 20 bp, Artificial Sequence
  chemically synthesized
agtctgactttagctgtaga

SEQ ID NO: 29056 - DNA, 20 bp, Artificial Sequence
  chemically synthesized
tgactttagctgtagacagc

SEQ ID NO: 29057 - DNA, 20 bp, Artificial Sequence
  chemically synthesized
tttagctgtagacagcaaga

SEQ ID NO: 29058 - DNA, 20 bp, Artificial Sequence
  chemically synthesized
gctgtagacagcaagatagt

SEQ ID NO: 29059 - DNA, 20 bp, Artificial Sequence
  chemically synthesized
agacagcaagatagtaagta

SEQ ID NO: 29060 - DNA, 20 bp, Artificial Sequence
  chemically synthesized
gacagcaagatagtaagtaa

SEQ ID NO: 29061 - DNA, 20 bp, Artificial Sequence
  chemically synthesized
caagatagtaagtaaaggaa

SEQ ID NO: 29062 - DNA, 20 bp, Artificial Sequence
  chemically synthesized
agatagtaagtaaaggaatg

SEQ ID NO: 29063 - DNA, 20 bp, Artificial Sequence
  chemically synthesized
ggaatggagcaacaaattga

SEQ ID NO: 29064 - DNA, 20 bp, Artificial Sequence
  chemically synthesized
ttttgcttgtttgtttgaaa

SEQ ID NO: 29065 - DNA, 20 bp, Artificial Sequence
  chemically synthesized
tttgcttgtttgtttgaaac

SEQ ID NO: 29066 - DNA, 20 bp, Artificial Sequence
  chemically synthesized
ttgcttgtttgtttgaaaca

SEQ ID NO: 29067 - DNA, 20 bp, Artificial Sequence
  chemically synthesized
agggtctcactctgtcaccc

SEQ ID NO: 29068 - DNA, 20 bp, Artificial Sequence
  chemically synthesized
tctcactctgtcaccccggc

SEQ ID NO: 29069 - DNA, 20 bp, Artificial Sequence
  chemically synthesized
tcactctgtcaccccggctg

SEQ ID NO: 29070 - DNA, 20 bp, Artificial Sequence
  chemically synthesized
tcaccccggctggagtgcaa

SEQ ID NO: 29071 - DNA, 20 bp, Artificial Sequence
  chemically synthesized
tggtgcaatcttgctcactg

SEQ ID NO: 29072 - DNA, 20 bp, Artificial Sequence
  chemically synthesized
cttgctcactgaagcctcac

SEQ ID NO: 29073 - DNA, 20 bp, Artificial Sequence
  chemically synthesized
tgaagcctcactagaacgcc

SEQ ID NO: 29074 - DNA, 20 bp, Artificial Sequence
  chemically synthesized
ttcaattgatcctcctgctt

SEQ ID NO: 29075 - DNA, 20 bp, Artificial Sequence
  chemically synthesized
atcctcctgctttagcctct

SEQ ID NO: 29076 - DNA, 20 bp, Artificial Sequence
  chemically synthesized
tcctcctgctttagcctctc

SEQ ID NO: 29077 - DNA, 20 bp, Artificial Sequence
  chemically synthesized
tcctgctttagcctctcagg

SEQ ID NO: 29078 - DNA, 20 bp, Artificial Sequence
  chemically synthesized
gctttagcctctcaggtagc

SEQ ID NO: 29079 - DNA, 20 bp, Artificial Sequence
  chemically synthesized
ctttagcctctcaggtagct

SEQ ID NO: 29080 - DNA, 20 bp, Artificial Sequence
  chemically synthesized
ctctcaggtagctaggacta

SEQ ID NO: 29081 - DNA, 20 bp, Artificial Sequence
  chemically synthesized
tctcaggtagctaggactac

SEQ ID NO: 29082 - DNA, 20 bp, Artificial Sequence
  chemically synthesized
gtagctaggactacaggtgt

SEQ ID NO: 29083 - DNA, 20 bp, Artificial Sequence
  chemically synthesized
actacaggtgtgagcctcca

SEQ ID NO: 29084 - DNA, 20 bp, Artificial Sequence
  chemically synthesized
caggtgtgagcctccatggc

SEQ ID NO: 29085 - DNA, 20 bp, Artificial Sequence
  chemically synthesized
tgtgagcctccatggccagc

SEQ ID NO: 29086 - DNA, 20 bp, Artificial Sequence
  chemically synthesized
tgagcctccatggccagcta

SEQ ID NO: 29087 - DNA, 20 bp, Artificial Sequence
  chemically synthesized
agaaattttttaaatttctg

SEQ ID NO: 29088 - DNA, 20 bp, Artificial Sequence
  chemically synthesized
tttttaaatttctgtagaaa

SEQ ID NO: 29089 - DNA, 20 bp, Artificial Sequence
  chemically synthesized
ttttaaatttctgtagaaac

SEQ ID NO: 29090 - DNA, 20 bp, Artificial Sequence
  chemically synthesized
tttaaatttctgtagaaaca

SEQ ID NO: 29091 - DNA, 20 bp, Artificial Sequence
  chemically synthesized
cagggtctccctatgttccc

SEQ ID NO: 29092 - DNA, 20 bp, Artificial Sequence
  chemically synthesized
agggtctccctatgttcccc

SEQ ID NO: 29093 - DNA, 20 bp, Artificial Sequence
  chemically synthesized
tctccctatgttccccaggc

SEQ ID NO: 29094 - DNA, 20 bp, Artificial Sequence
  chemically synthesized
ccaggctggtatccaactct

SEQ ID NO: 29095 - DNA, 20 bp, Artificial Sequence
  chemically synthesized
ctcaaacaattctcccacct

SEQ ID NO: 29096 - DNA, 20 bp, Artificial Sequence
  chemically synthesized
tctcccacctcagccttgaa

SEQ ID NO: 29097 - DNA, 20 bp, Artificial Sequence
  chemically synthesized
cctcagccttgaaaagtgtt

SEQ ID NO: 29098 - DNA, 20 bp, Artificial Sequence
  chemically synthesized
cttgaaaagtgttgagatta

SEQ ID NO: 29099 - DNA, 20 bp, Artificial Sequence
  chemically synthesized
ttgaaaagtgttgagattac

SEQ ID NO: 29100 - DNA, 20 bp, Artificial Sequence
  chemically synthesized
acaggtgtgaatcaccatgc

SEQ ID NO: 29101 - DNA, 20 bp, Artificial Sequence
  chemically synthesized
caggtgtgaatcaccatgct

SEQ ID NO: 29102 - DNA, 20 bp, Artificial Sequence
  chemically synthesized
atcaccatgctgggccttga

SEQ ID NO: 29103 - DNA, 20 bp, Artificial Sequence
  chemically synthesized
gggccttgatggatctttaa

SEQ ID NO: 29104 - DNA, 20 bp, Artificial Sequence
  chemically synthesized
ccttgatggatctttaaaag

SEQ ID NO: 29105 - DNA, 20 bp, Artificial Sequence
  chemically synthesized
tgatggatctttaaaagtgg

SEQ ID NO: 29106 - DNA, 20 bp, Artificial Sequence
  chemically synthesized
gatggatctttaaaagtggt

SEQ ID NO: 29107 - DNA, 20 bp, Artificial Sequence
  chemically synthesized
atggatctttaaaagtggtg

SEQ ID NO: 29108 - DNA, 20 bp, Artificial Sequence
  chemically synthesized
tggatctttaaaagtggtgg

SEQ ID NO: 29109 - DNA, 20 bp, Artificial Sequence
  chemically synthesized
ggatctttaaaagtggtggg

SEQ ID NO: 29110 - DNA, 20 bp, Artificial Sequence
  chemically synthesized
tctttaaaagtggtgggggg

SEQ ID NO: 29111 - DNA, 20 bp, Artificial Sequence
  chemically synthesized
ctttaaaagtggtggggggt

SEQ ID NO: 29112 - DNA, 20 bp, Artificial Sequence
  chemically synthesized
ttaaaagtggtggggggtag

SEQ ID NO: 29113 - DNA, 20 bp, Artificial Sequence
  chemically synthesized
gtggtggggggtaggagaaa

SEQ ID NO: 29114 - DNA, 20 bp, Artificial Sequence
  chemically synthesized
ggtggggggtaggagaaaaa

SEQ ID NO: 29115 - DNA, 20 bp, Artificial Sequence
  chemically synthesized
gtggggggtaggagaaaaag

SEQ ID NO: 29116 - DNA, 20 bp, Artificial Sequence
  chemically synthesized
gggggtaggagaaaaagagg

SEQ ID NO: 29117 - DNA, 20 bp, Artificial Sequence
  chemically synthesized
aaaaagaggaagaacaaaaa

SEQ ID NO: 29118 - DNA, 20 bp, Artificial Sequence
  chemically synthesized
gaacaaaaacagtatcacga

SEQ ID NO: 29119 - DNA, 20 bp, Artificial Sequence
  chemically synthesized
tcacgaaagataaacatcgt

SEQ ID NO: 29120 - DNA, 20 bp, Artificial Sequence
  chemically synthesized
cacgaaagataaacatcgtt

SEQ ID NO: 29121 - DNA, 20 bp, Artificial Sequence
  chemically synthesized
agataaacatcgttaggtct

SEQ ID NO: 29122 - DNA, 20 bp, Artificial Sequence
  chemically synthesized
gataaacatcgttaggtctc

SEQ ID NO: 29123 - DNA, 20 bp, Artificial Sequence
  chemically synthesized
aaacatcgttaggtctcggg

SEQ ID NO: 29124 - DNA, 20 bp, Artificial Sequence
  chemically synthesized
aacatcgttaggtctcggga

SEQ ID NO: 29125 - DNA, 20 bp, Artificial Sequence
  chemically synthesized
tcgttaggtctcgggaagga

SEQ ID NO: 29126 - DNA, 20 bp, Artificial Sequence
  chemically synthesized
cgttaggtctcgggaaggat

SEQ ID NO: 29127 - DNA, 20 bp, Artificial Sequence
  chemically synthesized
ggatccttttcattttgctc

SEQ ID NO: 29128 - DNA, 20 bp, Artificial Sequence
  chemically synthesized
atccttttcattttgctcta

SEQ ID NO: 29129 - DNA, 20 bp, Artificial Sequence
  chemically synthesized
tttcattttgctctagagaa

SEQ ID NO: 29130 - DNA, 20 bp, Artificial Sequence
  chemically synthesized
tgctctagagaaaagccatt

SEQ ID NO: 29131 - DNA, 20 bp, Artificial Sequence
  chemically synthesized
acttctgtgttaacaaaaaa

SEQ ID NO: 29132 - DNA, 20 bp, Artificial Sequence
  chemically synthesized
tgtgttaacaaaaaacagcc

SEQ ID NO: 29133 - DNA, 20 bp, Artificial Sequence
  chemically synthesized
gttaacaaaaaacagccgag

SEQ ID NO: 29134 - DNA, 20 bp, Artificial Sequence
  chemically synthesized
caaaaaacagccgagtagcc

SEQ ID NO: 29135 - DNA, 20 bp, Artificial Sequence
  chemically synthesized
agtagcctagtattaaactt

SEQ ID NO: 29136 - DNA, 20 bp, Artificial Sequence
  chemically synthesized
tagcctagtattaaacttta

SEQ ID NO: 29137 - DNA, 20 bp, Artificial Sequence
  chemically synthesized
cctagtattaaactttagag

SEQ ID NO: 29138 - DNA, 20 bp, Artificial Sequence
  chemically synthesized
tttagagcagttgttcttta

SEQ ID NO: 29139 - DNA, 20 bp, Artificial Sequence
  chemically synthesized
gttgttctttacggcaatta

SEQ ID NO: 29140 - DNA, 20 bp, Artificial Sequence
  chemically synthesized
ttgttctttacggcaattac

SEQ ID NO: 29141 - DNA, 20 bp, Artificial Sequence
  chemically synthesized
tgttctttacggcaattaca

SEQ ID NO: 29142 - DNA, 20 bp, Artificial Sequence
  chemically synthesized
gttctttacggcaattacag

SEQ ID NO: 29143 - DNA, 20 bp, Artificial Sequence
  chemically synthesized
acggcaattacaggggcctt

SEQ ID NO: 29144 - DNA, 20 bp, Artificial Sequence
  chemically synthesized
cggcaattacaggggccttc

SEQ ID NO: 29145 - DNA, 20 bp, Artificial Sequence
  chemically synthesized
caattacaggggccttcagg

SEQ ID NO: 29146 - DNA, 20 bp, Artificial Sequence
  chemically synthesized
aggggccttcaggaagctga

SEQ ID NO: 29147 - DNA, 20 bp, Artificial Sequence
  chemically synthesized
ggccttcaggaagctgatgg

SEQ ID NO: 29148 - DNA, 20 bp, Artificial Sequence
  chemically synthesized
aggaagctgatggaagtgtg

SEQ ID NO: 29149 - DNA, 20 bp, Artificial Sequence
  chemically synthesized
gaagtgtgaagtcctcttct

SEQ ID NO: 29150 - DNA, 20 bp, Artificial Sequence
  chemically synthesized
agtgtgaagtcctcttctca

SEQ ID NO: 29151 - DNA, 20 bp, Artificial Sequence
  chemically synthesized
gaagtcctcttctcagagaa

SEQ ID NO: 29152 - DNA, 20 bp, Artificial Sequence
  chemically synthesized
atatacgtgcacctaatttt

SEQ ID NO: 29153 - DNA, 20 bp, Artificial Sequence
  chemically synthesized
atttttagatataatttctg

SEQ ID NO: 29154 - DNA, 20 bp, Artificial Sequence
  chemically synthesized
tttttagatataatttctga

SEQ ID NO: 29155 - DNA, 20 bp, Artificial Sequence
  chemically synthesized
agatataatttctgaaggtt

SEQ ID NO: 29156 - DNA, 20 bp, Artificial Sequence
  chemically synthesized
tgaaggtttagaaactcctt

SEQ ID NO: 29157 - DNA, 20 bp, Artificial Sequence
  chemically synthesized
ccttgagttcacttatatca

SEQ ID NO: 29158 - DNA, 20 bp, Artificial Sequence
  chemically synthesized
tatatcaaagtcctcacctt

SEQ ID NO: 29159 - DNA, 20 bp, Artificial Sequence
  chemically synthesized
cacctttagaactcctgtcc

SEQ ID NO: 29160 - DNA, 20 bp, Artificial Sequence
  chemically synthesized
ctttagaactcctgtcctag

SEQ ID NO: 29161 - DNA, 20 bp, Artificial Sequence
  chemically synthesized
ttagaactcctgtcctagaa

SEQ ID NO: 29162 - DNA, 20 bp, Artificial Sequence
  chemically synthesized
gaactcctgtcctagaagag

SEQ ID NO: 29163 - DNA, 20 bp, Artificial Sequence
  chemically synthesized
ttccataaccactttgactc

SEQ ID NO: 29164 - DNA, 20 bp, Artificial Sequence
  chemically synthesized
gccacttgtaccatgtaatt

SEQ ID NO: 29165 - DNA, 20 bp, Artificial Sequence
  chemically synthesized
cacttgtaccatgtaattca

SEQ ID NO: 29166 - DNA, 20 bp, Artificial Sequence
  chemically synthesized
acttgtaccatgtaattcag

SEQ ID NO: 29167 - DNA, 20 bp, Artificial Sequence
  chemically synthesized
taccatgtaattcagaggtg

SEQ ID NO: 29168 - DNA, 20 bp, Artificial Sequence
  chemically synthesized
taattcagaggtgtagtgtc

SEQ ID NO: 29169 - DNA, 20 bp, Artificial Sequence
  chemically synthesized
agaggtgtagtgtcaagact

SEQ ID NO: 29170 - DNA, 20 bp, Artificial Sequence
  chemically synthesized
gaggtgtagtgtcaagactg

SEQ ID NO: 29171 - DNA, 20 bp, Artificial Sequence
  chemically synthesized
ggtgtagtgtcaagactgag

SEQ ID NO: 29172 - DNA, 20 bp, Artificial Sequence
  chemically synthesized
gtgtagtgtcaagactgagg

SEQ ID NO: 29173 - DNA, 20 bp, Artificial Sequence
  chemically synthesized
tagtgtcaagactgaggagg

SEQ ID NO: 29174 - DNA, 20 bp, Artificial Sequence
  chemically synthesized
tgtcaagactgaggaggaag

SEQ ID NO: 29175 - DNA, 20 bp, Artificial Sequence
  chemically synthesized
gtcaagactgaggaggaagc

SEQ ID NO: 29176 - DNA, 20 bp, Artificial Sequence
  chemically synthesized
ggaagcaggtaaattatgtc

SEQ ID NO: 29177 - DNA, 20 bp, Artificial Sequence
  chemically synthesized
aattatgtccagcaatacgt

SEQ ID NO: 29178 - DNA, 20 bp, Artificial Sequence
  chemically synthesized
tgtccagcaatacgttggct

SEQ ID NO: 29179 - DNA, 20 bp, Artificial Sequence
  chemically synthesized
gtccagcaatacgttggctt

SEQ ID NO: 29180 - DNA, 20 bp, Artificial Sequence
  chemically synthesized
aggcaaaaacaaattgtttc

SEQ ID NO: 29181 - DNA, 20 bp, Artificial Sequence
  chemically synthesized
aattgtttctagtccatttt

SEQ ID NO: 29182 - DNA, 20 bp, Artificial Sequence
  chemically synthesized
ttgtttctagtccattttaa

SEQ ID NO: 29183 - DNA, 20 bp, Artificial Sequence
  chemically synthesized
tgtttctagtccattttaag

SEQ ID NO: 29184 - DNA, 20 bp, Artificial Sequence
  chemically synthesized
gtttctagtccattttaaga

SEQ ID NO: 29185 - DNA, 20 bp, Artificial Sequence
  chemically synthesized
tctagtccattttaagaggg

SEQ ID NO: 29186 - DNA, 20 bp, Artificial Sequence
  chemically synthesized
ttaagagggaagcatttatt

SEQ ID NO: 29187 - DNA, 20 bp, Artificial Sequence
  chemically synthesized
taagagggaagcatttattt

SEQ ID NO: 29188 - DNA, 20 bp, Artificial Sequence
  chemically synthesized
aagagggaagcatttattta

SEQ ID NO: 29189 - DNA, 20 bp, Artificial Sequence
  chemically synthesized
atttagggactacatcgctc

SEQ ID NO: 29190 - DNA, 20 bp, Artificial Sequence
  chemically synthesized
ccttaacatgttaatttctc

SEQ ID NO: 29191 - DNA, 20 bp, Artificial Sequence
  chemically synthesized
ttaacatgttaatttctcca

SEQ ID NO: 29192 - DNA, 20 bp, Artificial Sequence
  chemically synthesized
tccagagtttgtaatgttct

SEQ ID NO: 29193 - DNA, 20 bp, Artificial Sequence
  chemically synthesized
gagtttgtaatgttctgagc

SEQ ID NO: 29194 - DNA, 20 bp, Artificial Sequence
  chemically synthesized
atgttctgagcaagtgtgtg

SEQ ID NO: 29195 - DNA, 20 bp, Artificial Sequence
  chemically synthesized
ttctgagcaagtgtgtgcag

SEQ ID NO: 29196 - DNA, 20 bp, Artificial Sequence
  chemically synthesized
gtgtgcagaagaaatgattg

SEQ ID NO: 29197 - DNA, 20 bp, Artificial Sequence
  chemically synthesized
gcagaagaaatgattgtagt

SEQ ID NO: 29198 - DNA, 20 bp, Artificial Sequence
  chemically synthesized
gaaatgattgtagtaagacc

SEQ ID NO: 29199 - DNA, 20 bp, Artificial Sequence
  chemically synthesized
aaatgattgtagtaagacct

SEQ ID NO: 29200 - DNA, 20 bp, Artificial Sequence
  chemically synthesized
attgtagtaagacctgggca

SEQ ID NO: 29201 - DNA, 20 bp, Artificial Sequence
  chemically synthesized
ttgtagtaagacctgggcaa

SEQ ID NO: 29202 - DNA, 20 bp, Artificial Sequence
  chemically synthesized
gtagtaagacctgggcaaag

SEQ ID NO: 29203 - DNA, 20 bp, Artificial Sequence
  chemically synthesized
agtaagacctgggcaaagga

SEQ ID NO: 29204 - DNA, 20 bp, Artificial Sequence
  chemically synthesized
taagacctgggcaaaggaga

SEQ ID NO: 29205 - DNA, 20 bp, Artificial Sequence
  chemically synthesized
aaacatttttcccccacatt

SEQ ID NO: 29206 - DNA, 20 bp, Artificial Sequence
  chemically synthesized
aacatttttcccccacattt

SEQ ID NO: 29207 - DNA, 20 bp, Artificial Sequence
  chemically synthesized
ttgggcaaaactttccatcc

SEQ ID NO: 29208 - DNA, 20 bp, Artificial Sequence
  chemically synthesized
tgggcaaaactttccatcct

SEQ ID NO: 29209 - DNA, 20 bp, Artificial Sequence
  chemically synthesized
ttccatcctgggtcacacca

SEQ ID NO: 29210 - DNA, 20 bp, Artificial Sequence
  chemically synthesized
ctcctctcctctccctcaac

SEQ ID NO: 29211 - DNA, 20 bp, Artificial Sequence
  chemically synthesized
tcctctccctcaactggtaa

SEQ ID NO: 29212 - DNA, 20 bp, Artificial Sequence
  chemically synthesized
ccaaaacatacctgactact

SEQ ID NO: 29213 - DNA, 20 bp, Artificial Sequence
  chemically synthesized
cttagtacttcccactactg

SEQ ID NO: 29214 - DNA, 20 bp, Artificial Sequence
  chemically synthesized
gtacttcccactactgtgga

SEQ ID NO: 29215 - DNA, 20 bp, Artificial Sequence
  chemically synthesized
cactactgtggatagaattt

SEQ ID NO: 29216 - DNA, 20 bp, Artificial Sequence
  chemically synthesized
ctcattcattgttcataccc

SEQ ID NO: 29217 - DNA, 20 bp, Artificial Sequence
  chemically synthesized
cattcattgttcataccctg

SEQ ID NO: 29218 - DNA, 20 bp, Artificial Sequence
  chemically synthesized
ccctggagacaaaactcctt

SEQ ID NO: 29219 - DNA, 20 bp, Artificial Sequence
  chemically synthesized
cctggagacaaaactcctta

SEQ ID NO: 29220 - DNA, 20 bp, Artificial Sequence
  chemically synthesized
taaggctattaactccccct

SEQ ID NO: 29221 - DNA, 20 bp, Artificial Sequence
  chemically synthesized
tccccctgagcttcacaatc

SEQ ID NO: 29222 - DNA, 20 bp, Artificial Sequence
  chemically synthesized
gcttcacaatctagtccctg

SEQ ID NO: 29223 - DNA, 20 bp, Artificial Sequence
  chemically synthesized
cttcacaatctagtccctgc

SEQ ID NO: 29224 - DNA, 20 bp, Artificial Sequence
  chemically synthesized
tcctctccttttccctctct

SEQ ID NO: 29225 - DNA, 20 bp, Artificial Sequence
  chemically synthesized
ttccctctctgagccccgct

SEQ ID NO: 29226 - DNA, 20 bp, Artificial Sequence
  chemically synthesized
gccccgctcagatcttcgaa

SEQ ID NO: 29227 - DNA, 20 bp, Artificial Sequence
  chemically synthesized
cccgctcagatcttcgaaca

SEQ ID NO: 29228 - DNA, 20 bp, Artificial Sequence
  chemically synthesized
cagagaacacttctgcatct

SEQ ID NO: 29229 - DNA, 20 bp, Artificial Sequence
  chemically synthesized
cttctgcatcttggcatata

SEQ ID NO: 29230 - DNA, 20 bp, Artificial Sequence
  chemically synthesized
gcatatatagttctctcaca

SEQ ID NO: 29231 - DNA, 20 bp, Artificial Sequence
  chemically synthesized
atagaacgctttctcccctt

SEQ ID NO: 29232 - DNA, 20 bp, Artificial Sequence
  chemically synthesized
cctttagctatttatccttc

SEQ ID NO: 29233 - DNA, 20 bp, Artificial Sequence
  chemically synthesized
gctatttatccttcaagtgt

SEQ ID NO: 29234 - DNA, 20 bp, Artificial Sequence
  chemically synthesized
cagctcaaacatctcatcat

SEQ ID NO: 29235 - DNA, 20 bp, Artificial Sequence
  chemically synthesized
gctcaaacatctcatcatta

SEQ ID NO: 29236 - DNA, 20 bp, Artificial Sequence
  chemically synthesized
tcaaacatctcatcattaga

SEQ ID NO: 29237 - DNA, 20 bp, Artificial Sequence
  chemically synthesized
caaacatctcatcattagag

SEQ ID NO: 29238 - DNA, 20 bp, Artificial Sequence
  chemically synthesized
agaggtttttcccaaacctc

SEQ ID NO: 29239 - DNA, 20 bp, Artificial Sequence
  chemically synthesized
gaggtttttcccaaacctct

SEQ ID NO: 29240 - DNA, 20 bp, Artificial Sequence
  chemically synthesized
ttcccaaacctctaggtaac

SEQ ID NO: 29241 - DNA, 20 bp, Artificial Sequence
  chemically synthesized
tcccaaacctctaggtaact

SEQ ID NO: 29242 - DNA, 20 bp, Artificial Sequence
  chemically synthesized
aaacctctaggtaactaggt

SEQ ID NO: 29243 - DNA, 20 bp, Artificial Sequence
  chemically synthesized
agaaaccactccccattcca

SEQ ID NO: 29244 - DNA, 20 bp, Artificial Sequence
  chemically synthesized
ccattccacggtacactgta

SEQ ID NO: 29245 - DNA, 20 bp, Artificial Sequence
  chemically synthesized
cacggtacactgtatagtct

SEQ ID NO: 29246 - DNA, 20 bp, Artificial Sequence
  chemically synthesized
acggtacactgtatagtctt

SEQ ID NO: 29247 - DNA, 20 bp, Artificial Sequence
  chemically synthesized
ctgtatagtcttaggacacc

SEQ ID NO: 29248 - DNA, 20 bp, Artificial Sequence
  chemically synthesized
cttaggacacctggttccct

SEQ ID NO: 29249 - DNA, 20 bp, Artificial Sequence
  chemically synthesized
tacaaatttgtcaattcttg

SEQ ID NO: 29250 - DNA, 20 bp, Artificial Sequence
  chemically synthesized
tttgtcaattcttgaagatt

SEQ ID NO: 29251 - DNA, 20 bp, Artificial Sequence
  chemically synthesized
aattcttgaagattaagaat

SEQ ID NO: 29252 - DNA, 20 bp, Artificial Sequence
  chemically synthesized
actctatctccctcgcctct

SEQ ID NO: 29253 - DNA, 20 bp, Artificial Sequence
  chemically synthesized
tctcagtgcctgatacctaa

SEQ ID NO: 29254 - DNA, 20 bp, Artificial Sequence
  chemically synthesized
atccttactgaataataaaa

SEQ ID NO: 29255 - DNA, 20 bp, Artificial Sequence
  chemically synthesized
taaaatggattaatgaataa

SEQ ID NO: 29256 - DNA, 20 bp, Artificial Sequence
  chemically synthesized
gaataaaagcaataaatttc

SEQ ID NO: 29257 - DNA, 20 bp, Artificial Sequence
  chemically synthesized
aataaaagcaataaatttca

SEQ ID NO: 29258 - DNA, 20 bp, Artificial Sequence
  chemically synthesized
gttaatattaataaattaaa

SEQ ID NO: 29259 - DNA, 20 bp, Artificial Sequence
  chemically synthesized
ttaatattaataaattaaaa

SEQ ID NO: 29260 - DNA, 20 bp, Artificial Sequence
  chemically synthesized
aaattaaaaaggttattttg

SEQ ID NO: 29261 - DNA, 20 bp, Artificial Sequence
  chemically synthesized
aaaaggttattttgaagtct

SEQ ID NO: 29262 - DNA, 20 bp, Artificial Sequence
  chemically synthesized
ttattttgaagtctgagaat

SEQ ID NO: 29263 - DNA, 20 bp, Artificial Sequence
  chemically synthesized
tttcacgtttccattgttca

SEQ ID NO: 29264 - DNA, 20 bp, Artificial Sequence
  chemically synthesized
ttcacgtttccattgttcat

SEQ ID NO: 29265 - DNA, 20 bp, Artificial Sequence
  chemically synthesized
attgttcatgggcaaaattc

SEQ ID NO: 29266 - DNA, 20 bp, Artificial Sequence
  chemically synthesized
gttcatgggcaaaattctgg

SEQ ID NO: 29267 - DNA, 20 bp, Artificial Sequence
  chemically synthesized
atgggcaaaattctggcagc

SEQ ID NO: 29268 - DNA, 20 bp, Artificial Sequence
  chemically synthesized
tgggcaaaattctggcagca

SEQ ID NO: 29269 - DNA, 20 bp, Artificial Sequence
  chemically synthesized
gggcaaaattctggcagcaa

SEQ ID NO: 29270 - DNA, 20 bp, Artificial Sequence
  chemically synthesized
cagcaagggattcttctcct

SEQ ID NO: 29271 - DNA, 20 bp, Artificial Sequence
  chemically synthesized
taagaaaccttttgttttct

SEQ ID NO: 29272 - DNA, 20 bp, Artificial Sequence
  chemically synthesized
gaatacatttccttgtttgc

SEQ ID NO: 29273 - DNA, 20 bp, Artificial Sequence
  chemically synthesized
tccttgtttgccagaaaaca

SEQ ID NO: 29274 - DNA, 20 bp, Artificial Sequence
  chemically synthesized
tgtttgccagaaaacatggt

SEQ ID NO: 29275 - DNA, 20 bp, Artificial Sequence
  chemically synthesized
agaaaacatggtaagataac

SEQ ID NO: 29276 - DNA, 20 bp, Artificial Sequence
  chemically synthesized
aaaacatggtaagataactg

SEQ ID NO: 29277 - DNA, 20 bp, Artificial Sequence
  chemically synthesized
aacatggtaagataactgga

SEQ ID NO: 29278 - DNA, 20 bp, Artificial Sequence
  chemically synthesized
taacattcattttattcatg

SEQ ID NO: 29279 - DNA, 20 bp, Artificial Sequence
  chemically synthesized
ttcatgaagaaactgttatt

SEQ ID NO: 29280 - DNA, 20 bp, Artificial Sequence
  chemically synthesized
aagaaactgttattcagttt

SEQ ID NO: 29281 - DNA, 20 bp, Artificial Sequence
  chemically synthesized
agaaactgttattcagttta

SEQ ID NO: 29282 - DNA, 20 bp, Artificial Sequence
  chemically synthesized
gaaactgttattcagtttaa

SEQ ID NO: 29283 - DNA, 20 bp, Artificial Sequence
  chemically synthesized
aaactgttattcagtttaag

SEQ ID NO: 29284 - DNA, 20 bp, Artificial Sequence
  chemically synthesized
cagtttaaggggttcttttt

SEQ ID NO: 29285 - DNA, 20 bp, Artificial Sequence
  chemically synthesized
ttaaggggttctttttcaga

SEQ ID NO: 29286 - DNA, 20 bp, Artificial Sequence
  chemically synthesized
ggttctttttcagaaagttt

SEQ ID NO: 29287 - DNA, 20 bp, Artificial Sequence
  chemically synthesized
tcagaaagtttcagaaatcc

SEQ ID NO: 29288 - DNA, 20 bp, Artificial Sequence
  chemically synthesized
aatccaagacctttgactgc

SEQ ID NO: 29289 - DNA, 20 bp, Artificial Sequence
  chemically synthesized
gtactgtgttctttcatcta

SEQ ID NO: 29290 - DNA, 20 bp, Artificial Sequence
  chemically synthesized
tactgtgttctttcatctat

SEQ ID NO: 29291 - DNA, 20 bp, Artificial Sequence
  chemically synthesized
ggacatttcctttgaaaact

SEQ ID NO: 29292 - DNA, 20 bp, Artificial Sequence
  chemically synthesized
gacatttcctttgaaaactg

SEQ ID NO: 29293 - DNA, 20 bp, Artificial Sequence
  chemically synthesized
aatatttaattcttacataa

SEQ ID NO: 29294 - DNA, 20 bp, Artificial Sequence
  chemically synthesized
attcttacataatagtaaaa

SEQ ID NO: 29295 - DNA, 20 bp, Artificial Sequence
  chemically synthesized
ataatagtaaaaaagtgaat

SEQ ID NO: 29296 - DNA, 20 bp, Artificial Sequence
  chemically synthesized
gtaaaaaagtgaattggcct

SEQ ID NO: 29297 - DNA, 20 bp, Artificial Sequence
  chemically synthesized
aaagtgaattggccttggaa

SEQ ID NO: 29298 - DNA, 20 bp, Artificial Sequence
  chemically synthesized
cttggaaaagacctaaatcc

SEQ ID NO: 29299 - DNA, 20 bp, Artificial Sequence
  chemically synthesized
aatcaatttgctctatgaac

SEQ ID NO: 29300 - DNA, 20 bp, Artificial Sequence
  chemically synthesized
tcaatttgctctatgaactg

SEQ ID NO: 29301 - DNA, 20 bp, Artificial Sequence
  chemically synthesized
caatttgctctatgaactgg

SEQ ID NO: 29302 - DNA, 20 bp, Artificial Sequence
  chemically synthesized
atttgctctatgaactggag

SEQ ID NO: 29303 - DNA, 20 bp, Artificial Sequence
  chemically synthesized
tgctctatgaactggaggag

SEQ ID NO: 29304 - DNA, 20 bp, Artificial Sequence
  chemically synthesized
gctctatgaactggaggagt

SEQ ID NO: 29305 - DNA, 20 bp, Artificial Sequence
  chemically synthesized
gagtgggattcatgatctct

SEQ ID NO: 29306 - DNA, 20 bp, Artificial Sequence
  chemically synthesized
catatcactactatgaaatg

SEQ ID NO: 29307 - DNA, 20 bp, Artificial Sequence
  chemically synthesized
atatcactactatgaaatgc

SEQ ID NO: 29308 - DNA, 20 bp, Artificial Sequence
  chemically synthesized
tatcactactatgaaatgca

SEQ ID NO: 29309 - DNA, 20 bp, Artificial Sequence
  chemically synthesized
cactactatgaaatgcaggg

SEQ ID NO: 29310 - DNA, 20 bp, Artificial Sequence
  chemically synthesized
aattcaaatcattaaattta

SEQ ID NO: 29311 - DNA, 20 bp, Artificial Sequence
  chemically synthesized
cattaaatttaaagaaacta

SEQ ID NO: 29312 - DNA, 20 bp, Artificial Sequence
  chemically synthesized
taaatttaaagaaactatag

SEQ ID NO: 29313 - DNA, 20 bp, Artificial Sequence
  chemically synthesized
ctatagtggcaatgtattat

SEQ ID NO: 29314 - DNA, 20 bp, Artificial Sequence
  chemically synthesized
tatagtggcaatgtattatt

SEQ ID NO: 29315 - DNA, 20 bp, Artificial Sequence
  chemically synthesized
atgaaaatctcaaaccatac

SEQ ID NO: 29316 - DNA, 20 bp, Artificial Sequence
  chemically synthesized
tgaaaatctcaaaccatacc

SEQ ID NO: 29317 - DNA, 20 bp, Artificial Sequence
  chemically synthesized
gctatgataatattaaaata

SEQ ID NO: 29318 - DNA, 20 bp, Artificial Sequence
  chemically synthesized
attaaaataaagatacattg

SEQ ID NO: 29319 - DNA, 20 bp, Artificial Sequence
  chemically synthesized
aacttgtgtaaatcacattg

SEQ ID NO: 29320 - DNA, 20 bp, Artificial Sequence
  chemically synthesized
acttgtgtaaatcacattgt

SEQ ID NO: 29321 - DNA, 20 bp, Artificial Sequence
  chemically synthesized
cttgtgtaaatcacattgtg

SEQ ID NO: 29322 - DNA, 20 bp, Artificial Sequence
  chemically synthesized
aacacttcccttccccttga

SEQ ID NO: 29323 - DNA, 20 bp, Artificial Sequence
  chemically synthesized
acacttcccttccccttgaa

SEQ ID NO: 29324 - DNA, 20 bp, Artificial Sequence
  chemically synthesized
cacttcccttccccttgaaa

SEQ ID NO: 29325 - DNA, 20 bp, Artificial Sequence
  chemically synthesized
tccccttgaaagggaaatga

SEQ ID NO: 29326 - DNA, 20 bp, Artificial Sequence
  chemically synthesized
aaagggaaatgatagaaaat

SEQ ID NO: 29327 - DNA, 20 bp, Artificial Sequence
  chemically synthesized
atgatagaaaataagtatta

SEQ ID NO: 29328 - DNA, 20 bp, Artificial Sequence
  chemically synthesized
tgatagaaaataagtattaa

SEQ ID NO: 29329 - DNA, 20 bp, Artificial Sequence
  chemically synthesized
tagaaaataagtattaaagg

SEQ ID NO: 29330 - DNA, 20 bp, Artificial Sequence
  chemically synthesized
aataagtattaaaggcagct

SEQ ID NO: 29331 - DNA, 20 bp, Artificial Sequence
  chemically synthesized
ataagtattaaaggcagctt

SEQ ID NO: 29332 - DNA, 20 bp, Artificial Sequence
  chemically synthesized
taagtattaaaggcagctta

SEQ ID NO: 29333 - DNA, 20 bp, Artificial Sequence
  chemically synthesized
aagtattaaaggcagcttag

SEQ ID NO: 29334 - DNA, 20 bp, Artificial Sequence
  chemically synthesized
ttttcaaaaaaaaatccatt

SEQ ID NO: 29335 - DNA, 20 bp, Artificial Sequence
  chemically synthesized
attgagcattttctatgtac

SEQ ID NO: 29336 - DNA, 20 bp, Artificial Sequence
  chemically synthesized
ttgagcattttctatgtacc

SEQ ID NO: 29337 - DNA, 20 bp, Artificial Sequence
  chemically synthesized
ctatgtaccaggcactgttc

SEQ ID NO: 29338 - DNA, 20 bp, Artificial Sequence
  chemically synthesized
caggcactgttctagaccct

SEQ ID NO: 29339 - DNA, 20 bp, Artificial Sequence
  chemically synthesized
acacacatgctactgattat

SEQ ID NO: 29340 - DNA, 20 bp, Artificial Sequence
  chemically synthesized
ataagatccataaaataact

SEQ ID NO: 29341 - DNA, 20 bp, Artificial Sequence
  chemically synthesized
ataaaataacttagtttcac

SEQ ID NO: 29342 - DNA, 20 bp, Artificial Sequence
  chemically synthesized
tagtttcactggcgtgttcc

SEQ ID NO: 29343 - DNA, 20 bp, Artificial Sequence
  chemically synthesized
actggcgtgttcccagtgcc

SEQ ID NO: 29344 - DNA, 20 bp, Artificial Sequence
  chemically synthesized
ctggcgtgttcccagtgccc

SEQ ID NO: 29345 - DNA, 20 bp, Artificial Sequence
  chemically synthesized
tgttcccagtgcccaggtaa

SEQ ID NO: 29346 - DNA, 20 bp, Artificial Sequence
  chemically synthesized
attaatgtttgttaaatgat

SEQ ID NO: 29347 - DNA, 20 bp, Artificial Sequence
  chemically synthesized
tgtttgttaaatgatgagaa

SEQ ID NO: 29348 - DNA, 20 bp, Artificial Sequence
  chemically synthesized
tttgttaaatgatgagaaaa

SEQ ID NO: 29349 - DNA, 20 bp, Artificial Sequence
  chemically synthesized
ttgttaaatgatgagaaaag

SEQ ID NO: 29350 - DNA, 20 bp, Artificial Sequence
  chemically synthesized
taaatgatgagaaaagagga

SEQ ID NO: 29351 - DNA, 20 bp, Artificial Sequence
  chemically synthesized
atgatgagaaaagaggaaag

SEQ ID NO: 29352 - DNA, 20 bp, Artificial Sequence
  chemically synthesized
atgagaaaagaggaaagcag

SEQ ID NO: 29353 - DNA, 20 bp, Artificial Sequence
  chemically synthesized
tgagaaaagaggaaagcaga

SEQ ID NO: 29354 - DNA, 20 bp, Artificial Sequence
  chemically synthesized
gagaaaagaggaaagcagaa

SEQ ID NO: 29355 - DNA, 20 bp, Artificial Sequence
  chemically synthesized
agaaaagaggaaagcagaag

SEQ ID NO: 29356 - DNA, 20 bp, Artificial Sequence
  chemically synthesized
aaagcagaaggggctctgct

SEQ ID NO: 29357 - DNA, 20 bp, Artificial Sequence
  chemically synthesized
aagcagaaggggctctgctc

SEQ ID NO: 29358 - DNA, 20 bp, Artificial Sequence
  chemically synthesized
gaaggggctctgctcaggtg

SEQ ID NO: 29359 - DNA, 20 bp, Artificial Sequence
  chemically synthesized
aaggggctctgctcaggtgc

SEQ ID NO: 29360 - DNA, 20 bp, Artificial Sequence
  chemically synthesized
ctcaggtgcaggaacttgtg

SEQ ID NO: 29361 - DNA, 20 bp, Artificial Sequence
  chemically synthesized
caggtgcaggaacttgtgca

SEQ ID NO: 29362 - DNA, 20 bp, Artificial Sequence
  chemically synthesized
gaacttgtgcagagatcttc

SEQ ID NO: 29363 - DNA, 20 bp, Artificial Sequence
  chemically synthesized
agatcttctggactgattcc

SEQ ID NO: 29364 - DNA, 20 bp, Artificial Sequence
  chemically synthesized
gactgattcccagtgctaac

SEQ ID NO: 29365 - DNA, 20 bp, Artificial Sequence
  chemically synthesized
cagtgctaacaagtcccttc

SEQ ID NO: 29366 - DNA, 20 bp, Artificial Sequence
  chemically synthesized
ttccagttttatccaccaat

SEQ ID NO: 29367 - DNA, 20 bp, Artificial Sequence
  chemically synthesized
caccaataagctatgtcctt

SEQ ID NO: 29368 - DNA, 20 bp, Artificial Sequence
  chemically synthesized
ttgagctcctgcccactctc

SEQ ID NO: 29369 - DNA, 20 bp, Artificial Sequence
  chemically synthesized
gagctcctgcccactctcta

SEQ ID NO: 29370 - DNA, 20 bp, Artificial Sequence
  chemically synthesized
ctagagaaaacttttatttc

SEQ ID NO: 29371 - DNA, 20 bp, Artificial Sequence
  chemically synthesized
tagagaaaacttttatttca

SEQ ID NO: 29372 - DNA, 20 bp, Artificial Sequence
  chemically synthesized
ttttatttcaaggcatactc

SEQ ID NO: 29373 - DNA, 20 bp, Artificial Sequence
  chemically synthesized
tttatttcaaggcatactcc

SEQ ID NO: 29374 - DNA, 20 bp, Artificial Sequence
  chemically synthesized
actccgggattcacatgtga

SEQ ID NO: 29375 - DNA, 20 bp, Artificial Sequence
  chemically synthesized
tccgggattcacatgtgata

SEQ ID NO: 29376 - DNA, 20 bp, Artificial Sequence
  chemically synthesized
ggattcacatgtgatagaga

SEQ ID NO: 29377 - DNA, 20 bp, Artificial Sequence
  chemically synthesized
gatagagatggttctgttcc

SEQ ID NO: 29378 - DNA, 20 bp, Artificial Sequence
  chemically synthesized
atagagatggttctgttccc

SEQ ID NO: 29379 - DNA, 20 bp, Artificial Sequence
  chemically synthesized
ggttctgttcccaggaactt

SEQ ID NO: 29380 - DNA, 20 bp, Artificial Sequence
  chemically synthesized
gttctgttcccaggaacttt

SEQ ID NO: 29381 - DNA, 20 bp, Artificial Sequence
  chemically synthesized
ctttgggcatatttaaaaac

SEQ ID NO: 29382 - DNA, 20 bp, Artificial Sequence
  chemically synthesized
ggcatatttaaaaactggac

SEQ ID NO: 29383 - DNA, 20 bp, Artificial Sequence
  chemically synthesized
ggactggaaaaatttgtgac

SEQ ID NO: 29384 - DNA, 20 bp, Artificial Sequence
  chemically synthesized
gaaaaatttgtgactagaaa

SEQ ID NO: 29385 - DNA, 20 bp, Artificial Sequence
  chemically synthesized
aaaaatttgtgactagaaaa

SEQ ID NO: 29386 - DNA, 20 bp, Artificial Sequence
  chemically synthesized
ttaaaaacacatgctcattt

SEQ ID NO: 29387 - DNA, 20 bp, Artificial Sequence
  chemically synthesized
taaaaacacatgctcatttc

SEQ ID NO: 29388 - DNA, 20 bp, Artificial Sequence
  chemically synthesized
cacatgctcatttcaggata

SEQ ID NO: 29389 - DNA, 20 bp, Artificial Sequence
  chemically synthesized
atttcaggataaagatctct

SEQ ID NO: 29390 - DNA, 20 bp, Artificial Sequence
  chemically synthesized
tttcaggataaagatctctg

SEQ ID NO: 29391 - DNA, 20 bp, Artificial Sequence
  chemically synthesized
ggataaagatctctgaggaa

SEQ ID NO: 29392 - DNA, 20 bp, Artificial Sequence
  chemically synthesized
agaatacaaaataatttaaa

SEQ ID NO: 29393 - DNA, 20 bp, Artificial Sequence
  chemically synthesized
aataatttaaaaagaaacaa

SEQ ID NO: 29394 - DNA, 20 bp, Artificial Sequence
  chemically synthesized
ttaaaaagaaacaacagaaa

SEQ ID NO: 29395 - DNA, 20 bp, Artificial Sequence
  chemically synthesized
taaaaagaaacaacagaaac

SEQ ID NO: 29396 - DNA, 20 bp, Artificial Sequence
  chemically synthesized
atacttcacttctctgtaat

SEQ ID NO: 29397 - DNA, 20 bp, Artificial Sequence
  chemically synthesized
tacttcacttctctgtaata

SEQ ID NO: 29398 - DNA, 20 bp, Artificial Sequence
  chemically synthesized
taataaggtttctgtcctcc

SEQ ID NO: 29399 - DNA, 20 bp, Artificial Sequence
  chemically synthesized
gattctttctcactaaacta

SEQ ID NO: 29400 - DNA, 20 bp, Artificial Sequence
  chemically synthesized
ttctttctcactaaactaca

SEQ ID NO: 29401 - DNA, 20 bp, Artificial Sequence
  chemically synthesized
ctcactaaactacagagaat

SEQ ID NO: 29402 - DNA, 20 bp, Artificial Sequence
  chemically synthesized
gcattctgtccacttctaca

SEQ ID NO: 29403 - DNA, 20 bp, Artificial Sequence
  chemically synthesized
cattctgtccacttctacat

SEQ ID NO: 29404 - DNA, 20 bp, Artificial Sequence
  chemically synthesized
ttttatgaatgcatacacac

SEQ ID NO: 29405 - DNA, 20 bp, Artificial Sequence
  chemically synthesized
atacacacgagaactttgaa

SEQ ID NO: 29406 - DNA, 20 bp, Artificial Sequence
  chemically synthesized
acacgagaactttgaacagt

SEQ ID NO: 29407 - DNA, 20 bp, Artificial Sequence
  chemically synthesized
gaactttgaacagttagtat

SEQ ID NO: 29408 - DNA, 20 bp, Artificial Sequence
  chemically synthesized
aactttgaacagttagtata

SEQ ID NO: 29409 - DNA, 20 bp, Artificial Sequence
  chemically synthesized
taaggtgaattctgattttt

SEQ ID NO: 29410 - DNA, 20 bp, Artificial Sequence
  chemically synthesized
tatataatgcatttaatttt

SEQ ID NO: 29411 - DNA, 20 bp, Artificial Sequence
  chemically synthesized
atttaattttgagattatgc

SEQ ID NO: 29412 - DNA, 20 bp, Artificial Sequence
  chemically synthesized
gagattatgctggctctgat

SEQ ID NO: 29413 - DNA, 20 bp, Artificial Sequence
  chemically synthesized
tgctggctctgattagccaa

SEQ ID NO: 29414 - DNA, 20 bp, Artificial Sequence
  chemically synthesized
tggctctgattagccaaaag

SEQ ID NO: 29415 - DNA, 20 bp, Artificial Sequence
  chemically synthesized
ggctctgattagccaaaaga

SEQ ID NO: 29416 - DNA, 20 bp, Artificial Sequence
  chemically synthesized
tctgattagccaaaagaagg

SEQ ID NO: 29417 - DNA, 20 bp, Artificial Sequence
  chemically synthesized
ggaagtaatatatcacattc

SEQ ID NO: 29418 - DNA, 20 bp, Artificial Sequence
  chemically synthesized
tcacattctggttattattt

SEQ ID NO: 29419 - DNA, 20 bp, Artificial Sequence
  chemically synthesized
ggttattatttcagatcctt

SEQ ID NO: 29420 - DNA, 20 bp, Artificial Sequence
  chemically synthesized
gatcctttagattactgtaa

SEQ ID NO: 29421 - DNA, 20 bp, Artificial Sequence
  chemically synthesized
ttactgtaatagacatgaaa

SEQ ID NO: 29422 - DNA, 20 bp, Artificial Sequence
  chemically synthesized
cacaacacatgacataattt

SEQ ID NO: 29423 - DNA, 20 bp, Artificial Sequence
  chemically synthesized
tcagatcgtttaaatcacac

SEQ ID NO: 29424 - DNA, 20 bp, Artificial Sequence
  chemically synthesized
agtcatcactgccatttacc

SEQ ID NO: 29425 - DNA, 20 bp, Artificial Sequence
  chemically synthesized
actgccatttacccagcaat

SEQ ID NO: 29426 - DNA, 20 bp, Artificial Sequence
  chemically synthesized
ccatttacccagcaatcagt

SEQ ID NO: 29427 - DNA, 20 bp, Artificial Sequence
  chemically synthesized
atcagttggcttgattcttc

SEQ ID NO: 29428 - DNA, 20 bp, Artificial Sequence
  chemically synthesized
gcttgattcttcaagatctt

SEQ ID NO: 29429 - DNA, 20 bp, Artificial Sequence
  chemically synthesized
cttgattcttcaagatcttg

SEQ ID NO: 29430 - DNA, 20 bp, Artificial Sequence
  chemically synthesized
cttcaagatcttgaggaact

SEQ ID NO: 29431 - DNA, 20 bp, Artificial Sequence
  chemically synthesized
ctttgctaatgttccttcaa

SEQ ID NO: 29432 - DNA, 20 bp, Artificial Sequence
  chemically synthesized
tagtcttgacacttttaaac

SEQ ID NO: 29433 - DNA, 20 bp, Artificial Sequence
  chemically synthesized
gtcttgacacttttaaacta

SEQ ID NO: 29434 - DNA, 20 bp, Artificial Sequence
  chemically synthesized
cttgacacttttaaactaga

SEQ ID NO: 29435 - DNA, 20 bp, Artificial Sequence
  chemically synthesized
actagagagtataaacccac

SEQ ID NO: 29436 - DNA, 20 bp, Artificial Sequence
  chemically synthesized
ctagagagtataaacccaca

SEQ ID NO: 29437 - DNA, 20 bp, Artificial Sequence
  chemically synthesized
ggaattgttttataatttta

SEQ ID NO: 29438 - DNA, 20 bp, Artificial Sequence
  chemically synthesized
tttcaaaatcatttacattg

SEQ ID NO: 29439 - DNA, 20 bp, Artificial Sequence
  chemically synthesized
ctaccttgccttctcttacc

SEQ ID NO: 29440 - DNA, 20 bp, Artificial Sequence
  chemically synthesized
ttgccttctcttacccagca

SEQ ID NO: 29441 - DNA, 20 bp, Artificial Sequence
  chemically synthesized
ttctcttacccagcacagat

SEQ ID NO: 29442 - DNA, 20 bp, Artificial Sequence
  chemically synthesized
tctcttacccagcacagatg

SEQ ID NO: 29443 - DNA, 20 bp, Artificial Sequence
  chemically synthesized
ttattttataattcctacat

SEQ ID NO: 29444 - DNA, 20 bp, Artificial Sequence
  chemically synthesized
ttataattcctacataagca

SEQ ID NO: 29445 - DNA, 20 bp, Artificial Sequence
  chemically synthesized
cctacataagcatagcattg

SEQ ID NO: 29446 - DNA, 20 bp, Artificial Sequence
  chemically synthesized
aaaaattactttcattctga

SEQ ID NO: 29447 - DNA, 20 bp, Artificial Sequence
  chemically synthesized
aaaattactttcattctgaa

SEQ ID NO: 29448 - DNA, 20 bp, Artificial Sequence
  chemically synthesized
aattactttcattctgaaag

SEQ ID NO: 29449 - DNA, 20 bp, Artificial Sequence
  chemically synthesized
ctttcattctgaaaggagca

SEQ ID NO: 29450 - DNA, 20 bp, Artificial Sequence
  chemically synthesized
agcacagtattttgcctttt

SEQ ID NO: 29451 - DNA, 20 bp, Artificial Sequence
  chemically synthesized
acagtattttgccttttgag

SEQ ID NO: 29452 - DNA, 20 bp, Artificial Sequence
  chemically synthesized
tgaattaaaacattaattcc

SEQ ID NO: 29453 - DNA, 20 bp, Artificial Sequence
  chemically synthesized
tgtgaatatgaaacattctt

SEQ ID NO: 29454 - DNA, 20 bp, Artificial Sequence
  chemically synthesized
gcatttcatataattactaa

SEQ ID NO: 29455 - DNA, 20 bp, Artificial Sequence
  chemically synthesized
atataattactaacagaatg

SEQ ID NO: 29456 - DNA, 20 bp, Artificial Sequence
  chemically synthesized
ataattactaacagaatgta

SEQ ID NO: 29457 - DNA, 20 bp, Artificial Sequence
  chemically synthesized
tactaacagaatgtagagtt

SEQ ID NO: 29458 - DNA, 20 bp, Artificial Sequence
  chemically synthesized
actaacagaatgtagagttg

SEQ ID NO: 29459 - DNA, 20 bp, Artificial Sequence
  chemically synthesized
gtagagttgaggtttccaac

SEQ ID NO: 29460 - DNA, 20 bp, Artificial Sequence
  chemically synthesized
tttaattatactattttgct

SEQ ID NO: 29461 - DNA, 20 bp, Artificial Sequence
  chemically synthesized
atttctatgttgtcataata

SEQ ID NO: 29462 - DNA, 20 bp, Artificial Sequence
  chemically synthesized
taatttaaatgcacattcca

SEQ ID NO: 29463 - DNA, 20 bp, Artificial Sequence
  chemically synthesized
aaatgcacattccatggcaa

SEQ ID NO: 29464 - DNA, 20 bp, Artificial Sequence
  chemically synthesized
tccctcttcaacacatacac

SEQ ID NO: 29465 - DNA, 20 bp, Artificial Sequence
  chemically synthesized
catacacaagtctgtattca

SEQ ID NO: 29466 - DNA, 20 bp, Artificial Sequence
  chemically synthesized
gtattcatagcctgttgtaa

SEQ ID NO: 29467 - DNA, 20 bp, Artificial Sequence
  chemically synthesized
catagcctgttgtaatagac

SEQ ID NO: 29468 - DNA, 20 bp, Artificial Sequence
  chemically synthesized
atagcctgttgtaatagaca

SEQ ID NO: 29469 - DNA, 20 bp, Artificial Sequence
  chemically synthesized
gtaatagacaaggttaaatg

SEQ ID NO: 29470 - DNA, 20 bp, Artificial Sequence
  chemically synthesized
taaatgctttcctcactcac

SEQ ID NO: 29471 - DNA, 20 bp, Artificial Sequence
  chemically synthesized
tttcctcactcactagcaat

SEQ ID NO: 29472 - DNA, 20 bp, Artificial Sequence
  chemically synthesized
cactagcaattggttatcac

SEQ ID NO: 29473 - DNA, 20 bp, Artificial Sequence
  chemically synthesized
ctagcaattggttatcacta

SEQ ID NO: 29474 - DNA, 20 bp, Artificial Sequence
  chemically synthesized
agcaattggttatcactaga

SEQ ID NO: 29475 - DNA, 20 bp, Artificial Sequence
  chemically synthesized
aaatcttactctacattcct

SEQ ID NO: 29476 - DNA, 20 bp, Artificial Sequence
  chemically synthesized
ctctacattcctcagtcacc

SEQ ID NO: 29477 - DNA, 20 bp, Artificial Sequence
  chemically synthesized
cattcctcagtcacctagtg

SEQ ID NO: 29478 - DNA, 20 bp, Artificial Sequence
  chemically synthesized
attcctcagtcacctagtga

SEQ ID NO: 29479 - DNA, 20 bp, Artificial Sequence
  chemically synthesized
aaggtgtactgatccacctt

SEQ ID NO: 29480 - DNA, 20 bp, Artificial Sequence
  chemically synthesized
aggtgtactgatccaccttc

SEQ ID NO: 29481 - DNA, 20 bp, Artificial Sequence
  chemically synthesized
gtgtactgatccaccttcag

SEQ ID NO: 29482 - DNA, 20 bp, Artificial Sequence
  chemically synthesized
tactgatccaccttcaggag

SEQ ID NO: 29483 - DNA, 20 bp, Artificial Sequence
  chemically synthesized
ggagcagtacaaacctttat

SEQ ID NO: 29484 - DNA, 20 bp, Artificial Sequence
  chemically synthesized
acctttattggtcacttccc

SEQ ID NO: 29485 - DNA, 20 bp, Artificial Sequence
  chemically synthesized
tcacttcccaagcaacttca

SEQ ID NO: 29486 - DNA, 20 bp, Artificial Sequence
  chemically synthesized
acttcccaagcaacttcaaa

SEQ ID NO: 29487 - DNA, 20 bp, Artificial Sequence
  chemically synthesized
tcccaagcaacttcaaagag

SEQ ID NO: 29488 - DNA, 20 bp, Artificial Sequence
  chemically synthesized
aaagagcagtaactcctcca

SEQ ID NO: 29489 - DNA, 20 bp, Artificial Sequence
  chemically synthesized
aagagcagtaactcctccac

SEQ ID NO: 29490 - DNA, 20 bp, Artificial Sequence
  chemically synthesized
agcagtaactcctccacagg

SEQ ID NO: 29491 - DNA, 20 bp, Artificial Sequence
  chemically synthesized
gaagttcttcgacttcccac

SEQ ID NO: 29492 - DNA, 20 bp, Artificial Sequence
  chemically synthesized
aagttcttcgacttcccact

SEQ ID NO: 29493 - DNA, 20 bp, Artificial Sequence
  chemically synthesized
agttcttcgacttcccactg

SEQ ID NO: 29494 - DNA, 20 bp, Artificial Sequence
  chemically synthesized
tcttcgacttcccactgggg

SEQ ID NO: 29495 - DNA, 20 bp, Artificial Sequence
  chemically synthesized
tcccactggggaagcccacc

SEQ ID NO: 29496 - DNA, 20 bp, Artificial Sequence
  chemically synthesized
cccactggggaagcccaccc

SEQ ID NO: 29497 - DNA, 20 bp, Artificial Sequence
  chemically synthesized
ccactggggaagcccaccca

SEQ ID NO: 29498 - DNA, 20 bp, Artificial Sequence
  chemically synthesized
aagcccacccagggatgtta

SEQ ID NO: 29499 - DNA, 20 bp, Artificial Sequence
  chemically synthesized
gcccacccagggatgttaca

SEQ ID NO: 29500 - DNA, 20 bp, Artificial Sequence
  chemically synthesized
ccacccagggatgttacaga

SEQ ID NO: 29501 - DNA, 20 bp, Artificial Sequence
  chemically synthesized
cacccagggatgttacagag

SEQ ID NO: 29502 - DNA, 20 bp, Artificial Sequence
  chemically synthesized
acccagggatgttacagaga

SEQ ID NO: 29503 - DNA, 20 bp, Artificial Sequence
  chemically synthesized
gggatgttacagagagggat

SEQ ID NO: 29504 - DNA, 20 bp, Artificial Sequence
  chemically synthesized
acagagagggatcggcctcg

SEQ ID NO: 29505 - DNA, 20 bp, Artificial Sequence
  chemically synthesized
gcctcgaagcattcttctta

SEQ ID NO: 29506 - DNA, 20 bp, Artificial Sequence
  chemically synthesized
cattcttcttacagtcctcc

SEQ ID NO: 29507 - DNA, 20 bp, Artificial Sequence
  chemically synthesized
ctttgaattcctgtttcaat

SEQ ID NO: 29508 - DNA, 20 bp, Artificial Sequence
  chemically synthesized
gtttcaattagttgtaatcc

SEQ ID NO: 29509 - DNA, 20 bp, Artificial Sequence
  chemically synthesized
tttcaattagttgtaatccc

SEQ ID NO: 29510 - DNA, 20 bp, Artificial Sequence
  chemically synthesized
tcaattagttgtaatcccag

SEQ ID NO: 29511 - DNA, 20 bp, Artificial Sequence
  chemically synthesized
attagttgtaatcccaggag

SEQ ID NO: 29512 - DNA, 20 bp, Artificial Sequence
  chemically synthesized
tagttgtaatcccaggagaa

SEQ ID NO: 29513 - DNA, 20 bp, Artificial Sequence
  chemically synthesized
tcccaggagaagagaactta

SEQ ID NO: 29514 - DNA, 20 bp, Artificial Sequence
  chemically synthesized
cccaggagaagagaacttac

SEQ ID NO: 29515 - DNA, 20 bp, Artificial Sequence
  chemically synthesized
aagagaacttacaggcacaa

SEQ ID NO: 29516 - DNA, 20 bp, Artificial Sequence
  chemically synthesized
gaacttacaggcacaaaagt

SEQ ID NO: 29517 - DNA, 20 bp, Artificial Sequence
  chemically synthesized
acttacaggcacaaaagtta

SEQ ID NO: 29518 - DNA, 20 bp, Artificial Sequence
  chemically synthesized
acaggcacaaaagttagagt

SEQ ID NO: 29519 - DNA, 20 bp, Artificial Sequence
  chemically synthesized
ggcacaaaagttagagttgg

SEQ ID NO: 29520 - DNA, 20 bp, Artificial Sequence
  chemically synthesized
cacaaaagttagagttggta

SEQ ID NO: 29521 - DNA, 20 bp, Artificial Sequence
  chemically synthesized
gttagagttggtagagttac

SEQ ID NO: 29522 - DNA, 20 bp, Artificial Sequence
  chemically synthesized
ttagagttggtagagttacc

SEQ ID NO: 29523 - DNA, 20 bp, Artificial Sequence
  chemically synthesized
ttggtagagttaccaggctt

SEQ ID NO: 29524 - DNA, 20 bp, Artificial Sequence
  chemically synthesized
gtagagttaccaggctttgg

SEQ ID NO: 29525 - DNA, 20 bp, Artificial Sequence
  chemically synthesized
caggctttggtagcttctct

SEQ ID NO: 29526 - DNA, 20 bp, Artificial Sequence
  chemically synthesized
aggctttggtagcttctctt

SEQ ID NO: 29527 - DNA, 20 bp, Artificial Sequence
  chemically synthesized
agcttctcttgggaataaac

SEQ ID NO: 29528 - DNA, 20 bp, Artificial Sequence
  chemically synthesized
ttctcttgggaataaactag

SEQ ID NO: 29529 - DNA, 20 bp, Artificial Sequence
  chemically synthesized
gaaatcttatgtgcttccca

SEQ ID NO: 29530 - DNA, 20 bp, Artificial Sequence
  chemically synthesized
tgtgcttcccacagaattcc

SEQ ID NO: 29531 - DNA, 20 bp, Artificial Sequence
  chemically synthesized
gcttcccacagaattcctgg

SEQ ID NO: 29532 - DNA, 20 bp, Artificial Sequence
  chemically synthesized
tcccacagaattcctggtgg

SEQ ID NO: 29533 - DNA, 20 bp, Artificial Sequence
  chemically synthesized
cccacagaattcctggtgga

SEQ ID NO: 29534 - DNA, 20 bp, Artificial Sequence
  chemically synthesized
cacagaattcctggtggaag

SEQ ID NO: 29535 - DNA, 20 bp, Artificial Sequence
  chemically synthesized
acagaattcctggtggaagg

SEQ ID NO: 29536 - DNA, 20 bp, Artificial Sequence
  chemically synthesized
cctcctctttctcgtctttc

SEQ ID NO: 29537 - DNA, 20 bp, Artificial Sequence
  chemically synthesized
ctcctctttctcgtctttct

SEQ ID NO: 29538 - DNA, 20 bp, Artificial Sequence
  chemically synthesized
ctctttctcgtctttctggg

SEQ ID NO: 29539 - DNA, 20 bp, Artificial Sequence
  chemically synthesized
tctttctcgtctttctgggc

SEQ ID NO: 29540 - DNA, 20 bp, Artificial Sequence
  chemically synthesized
tctttctgggcaggtattgt

SEQ ID NO: 29541 - DNA, 20 bp, Artificial Sequence
  chemically synthesized
ctttctgggcaggtattgtg

SEQ ID NO: 29542 - DNA, 20 bp, Artificial Sequence
  chemically synthesized
ctgggcaggtattgtgagga

SEQ ID NO: 29543 - DNA, 20 bp, Artificial Sequence
  chemically synthesized
gaggacggtatctgccctgt

SEQ ID NO: 29544 - DNA, 20 bp, Artificial Sequence
  chemically synthesized
ccgtcctcacaatacctgcc

SEQ ID NO: 29545 - DNA, 20 bp, Artificial Sequence
  chemically synthesized
cctcacaatacctgcccaga

SEQ ID NO: 29546 - DNA, 20 bp, Artificial Sequence
  chemically synthesized
caatacctgcccagaaagac

SEQ ID NO: 29547 - DNA, 20 bp, Artificial Sequence
  chemically synthesized
acctgcccagaaagacgaga

SEQ ID NO: 29548 - DNA, 20 bp, Artificial Sequence
  chemically synthesized
ctgcccagaaagacgagaaa

SEQ ID NO: 29549 - DNA, 20 bp, Artificial Sequence
  chemically synthesized
tgcccagaaagacgagaaag

SEQ ID NO: 29550 - DNA, 20 bp, Artificial Sequence
  chemically synthesized
cccagaaagacgagaaagag

SEQ ID NO: 29551 - DNA, 20 bp, Artificial Sequence
  chemically synthesized
ccagaaagacgagaaagagg

SEQ ID NO: 29552 - DNA, 20 bp, Artificial Sequence
  chemically synthesized
gaaagacgagaaagaggagg

SEQ ID NO: 29553 - DNA, 20 bp, Artificial Sequence
  chemically synthesized
ggaagaattcctccttccac

SEQ ID NO: 29554 - DNA, 20 bp, Artificial Sequence
  chemically synthesized
gaagaattcctccttccacc

SEQ ID NO: 29555 - DNA, 20 bp, Artificial Sequence
  chemically synthesized
tccttccaccaggaattctg

SEQ ID NO: 29556 - DNA, 20 bp, Artificial Sequence
  chemically synthesized
ccttccaccaggaattctgt

SEQ ID NO: 29557 - DNA, 20 bp, Artificial Sequence
  chemically synthesized
tccaccaggaattctgtggg

SEQ ID NO: 29558 - DNA, 20 bp, Artificial Sequence
  chemically synthesized
gaattctgtgggaagcacat

SEQ ID NO: 29559 - DNA, 20 bp, Artificial Sequence
  chemically synthesized
cacataagatttcatgctac

SEQ ID NO: 29560 - DNA, 20 bp, Artificial Sequence
  chemically synthesized
catgctactagtttattccc

SEQ ID NO: 29561 - DNA, 20 bp, Artificial Sequence
  chemically synthesized
tgctactagtttattcccaa

SEQ ID NO: 29562 - DNA, 20 bp, Artificial Sequence
  chemically synthesized
tactagtttattcccaagag

SEQ ID NO: 29563 - DNA, 20 bp, Artificial Sequence
  chemically synthesized
attcccaagagaagctacca

SEQ ID NO: 29564 - DNA, 20 bp, Artificial Sequence
  chemically synthesized
caagagaagctaccaaagcc

SEQ ID NO: 29565 - DNA, 20 bp, Artificial Sequence
  chemically synthesized
actctaacttttgtgcctgt

SEQ ID NO: 29566 - DNA, 20 bp, Artificial Sequence
  chemically synthesized
gcctgtaagttctcttctcc

SEQ ID NO: 29567 - DNA, 20 bp, Artificial Sequence
  chemically synthesized
cctgtaagttctcttctcct

SEQ ID NO: 29568 - DNA, 20 bp, Artificial Sequence
  chemically synthesized
gggattacaactaattgaaa

SEQ ID NO: 29569 - DNA, 20 bp, Artificial Sequence
  chemically synthesized
ggattacaactaattgaaac

SEQ ID NO: 29570 - DNA, 20 bp, Artificial Sequence
  chemically synthesized
ctaattgaaacaggaattca

SEQ ID NO: 29571 - DNA, 20 bp, Artificial Sequence
  chemically synthesized
taattgaaacaggaattcaa

SEQ ID NO: 29572 - DNA, 20 bp, Artificial Sequence
  chemically synthesized
attgaaacaggaattcaaag

SEQ ID NO: 29573 - DNA, 20 bp, Artificial Sequence
  chemically synthesized
acaggaattcaaaggagtct

SEQ ID NO: 29574 - DNA, 20 bp, Artificial Sequence
  chemically synthesized
aggaattcaaaggagtctcg

SEQ ID NO: 29575 - DNA, 20 bp, Artificial Sequence
  chemically synthesized
ggaattcaaaggagtctcgg

SEQ ID NO: 29576 - DNA, 20 bp, Artificial Sequence
  chemically synthesized
aaggagtctcggaggactgt

SEQ ID NO: 29577 - DNA, 20 bp, Artificial Sequence
  chemically synthesized
gagtctcggaggactgtaag

SEQ ID NO: 29578 - DNA, 20 bp, Artificial Sequence
  chemically synthesized
gactgtaagaagaatgcttc

SEQ ID NO: 29579 - DNA, 20 bp, Artificial Sequence
  chemically synthesized
actgtaagaagaatgcttcg

SEQ ID NO: 29580 - DNA, 20 bp, Artificial Sequence
  chemically synthesized
atccctctctgtaacatccc

SEQ ID NO: 29581 - DNA, 20 bp, Artificial Sequence
  chemically synthesized
tccctctctgtaacatccct

SEQ ID NO: 29582 - DNA, 20 bp, Artificial Sequence
  chemically synthesized
ctctctgtaacatccctggg

SEQ ID NO: 29583 - DNA, 20 bp, Artificial Sequence
  chemically synthesized
tctctgtaacatccctgggt

SEQ ID NO: 29584 - DNA, 20 bp, Artificial Sequence
  chemically synthesized
catccctgggtgggcttccc

SEQ ID NO: 29585 - DNA, 20 bp, Artificial Sequence
  chemically synthesized
ccctgggtgggcttccccag

SEQ ID NO: 29586 - DNA, 20 bp, Artificial Sequence
  chemically synthesized
cctgggtgggcttccccagt

SEQ ID NO: 29587 - DNA, 20 bp, Artificial Sequence
  chemically synthesized
gggtgggcttccccagtggg

SEQ ID NO: 29588 - DNA, 20 bp, Artificial Sequence
  chemically synthesized
gcttccccagtgggaagtcg

SEQ ID NO: 29589 - DNA, 20 bp, Artificial Sequence
  chemically synthesized
ggaagtcgaagaacttcctg

SEQ ID NO: 29590 - DNA, 20 bp, Artificial Sequence
  chemically synthesized
aagtcgaagaacttcctgtg

SEQ ID NO: 29591 - DNA, 20 bp, Artificial Sequence
  chemically synthesized
agtcgaagaacttcctgtgg

SEQ ID NO: 29592 - DNA, 20 bp, Artificial Sequence
  chemically synthesized
tcgaagaacttcctgtggag

SEQ ID NO: 29593 - DNA, 20 bp, Artificial Sequence
  chemically synthesized
ggaggagttactgctctttg

SEQ ID NO: 29594 - DNA, 20 bp, Artificial Sequence
  chemically synthesized
tactgctctttgaagttgct

SEQ ID NO: 29595 - DNA, 20 bp, Artificial Sequence
  chemically synthesized
actgctctttgaagttgctt

SEQ ID NO: 29596 - DNA, 20 bp, Artificial Sequence
  chemically synthesized
gctctttgaagttgcttggg

SEQ ID NO: 29597 - DNA, 20 bp, Artificial Sequence
  chemically synthesized
tgcttgggaagtgaccaata

SEQ ID NO: 29598 - DNA, 20 bp, Artificial Sequence
  chemically synthesized
gcttgggaagtgaccaataa

SEQ ID NO: 29599 - DNA, 20 bp, Artificial Sequence
  chemically synthesized
aaaggtttgtactgctcctg

SEQ ID NO: 29600 - DNA, 20 bp, Artificial Sequence
  chemically synthesized
aaggtttgtactgctcctga

SEQ ID NO: 29601 - DNA, 20 bp, Artificial Sequence
  chemically synthesized
gtttgtactgctcctgaagg

SEQ ID NO: 29602 - DNA, 20 bp, Artificial Sequence
  chemically synthesized
tactgctcctgaaggtggat

SEQ ID NO: 29603 - DNA, 20 bp, Artificial Sequence
  chemically synthesized
gtggatcagtacaccttcac

SEQ ID NO: 29604 - DNA, 20 bp, Artificial Sequence
  chemically synthesized
tggatcagtacaccttcact

SEQ ID NO: 29605 - DNA, 20 bp, Artificial Sequence
  chemically synthesized
tacaccttcactaggtgact

SEQ ID NO: 29606 - DNA, 20 bp, Artificial Sequence
  chemically synthesized
acaccttcactaggtgactg

SEQ ID NO: 29607 - DNA, 20 bp, Artificial Sequence
  chemically synthesized
cactaggtgactgaggaatg

SEQ ID NO: 29608 - DNA, 20 bp, Artificial Sequence
  chemically synthesized
ctaggtgactgaggaatgta

SEQ ID NO: 29609 - DNA, 20 bp, Artificial Sequence
  chemically synthesized
gtgactgaggaatgtagagt

SEQ ID NO: 29610 - DNA, 20 bp, Artificial Sequence
  chemically synthesized
gaatgtagagtaagatttca

SEQ ID NO: 29611 - DNA, 20 bp, Artificial Sequence
  chemically synthesized
agatttcacagataactctc

SEQ ID NO: 29612 - DNA, 20 bp, Artificial Sequence
  chemically synthesized
ctctagtgataaccaattgc

SEQ ID NO: 29613 - DNA, 20 bp, Artificial Sequence
  chemically synthesized
agtgataaccaattgctagt

SEQ ID NO: 29614 - DNA, 20 bp, Artificial Sequence
  chemically synthesized
ataaccaattgctagtgagt

SEQ ID NO: 29615 - DNA, 20 bp, Artificial Sequence
  chemically synthesized
taaccaattgctagtgagtg

SEQ ID NO: 29616 - DNA, 20 bp, Artificial Sequence
  chemically synthesized
caattgctagtgagtgagga

SEQ ID NO: 29617 - DNA, 20 bp, Artificial Sequence
  chemically synthesized
gagtgaggaaagcatttaaa

SEQ ID NO: 29618 - DNA, 20 bp, Artificial Sequence
  chemically synthesized
atttaaacggaatatatatt

SEQ ID NO: 29619 - DNA, 20 bp, Artificial Sequence
  chemically synthesized
tttaaacggaatatatattt

SEQ ID NO: 29620 - DNA, 20 bp, Artificial Sequence
  chemically synthesized
tttaaccttgtctattacaa

SEQ ID NO: 29621 - DNA, 20 bp, Artificial Sequence
  chemically synthesized
ttaaccttgtctattacaac

SEQ ID NO: 29622 - DNA, 20 bp, Artificial Sequence
  chemically synthesized
attacaacaggctatgaata

SEQ ID NO: 29623 - DNA, 20 bp, Artificial Sequence
  chemically synthesized
acagacttgtgtatgtgttg

SEQ ID NO: 29624 - DNA, 20 bp, Artificial Sequence
  chemically synthesized
agacttgtgtatgtgttgaa

SEQ ID NO: 29625 - DNA, 20 bp, Artificial Sequence
  chemically synthesized
gacttgtgtatgtgttgaag

SEQ ID NO: 29626 - DNA, 20 bp, Artificial Sequence
  chemically synthesized
acttgtgtatgtgttgaaga

SEQ ID NO: 29627 - DNA, 20 bp, Artificial Sequence
  chemically synthesized
ttgtgtatgtgttgaagagg

SEQ ID NO: 29628 - DNA, 20 bp, Artificial Sequence
  chemically synthesized
gtatgtgttgaagagggaga

SEQ ID NO: 29629 - DNA, 20 bp, Artificial Sequence
  chemically synthesized
agggagaaagttgaaaatat

SEQ ID NO: 29630 - DNA, 20 bp, Artificial Sequence
  chemically synthesized
gaaaatattagccattgcca

SEQ ID NO: 29631 - DNA, 20 bp, Artificial Sequence
  chemically synthesized
aaatccatattatgacaaca

SEQ ID NO: 29632 - DNA, 20 bp, Artificial Sequence
  chemically synthesized
tatgacaacatagaaataaa

SEQ ID NO: 29633 - DNA, 20 bp, Artificial Sequence
  chemically synthesized
ttttgttttaaaatttttct

SEQ ID NO: 29634 - DNA, 20 bp, Artificial Sequence
  chemically synthesized
taaaatttttctcagcaaaa

SEQ ID NO: 29635 - DNA, 20 bp, Artificial Sequence
  chemically synthesized
tataattaaacattttattt

SEQ ID NO: 29636 - DNA, 20 bp, Artificial Sequence
  chemically synthesized
ataattaaacattttatttt

SEQ ID NO: 29637 - DNA, 20 bp, Artificial Sequence
  chemically synthesized
attaaacattttattttagg

SEQ ID NO: 29638 - DNA, 20 bp, Artificial Sequence
  chemically synthesized
taggaagatgtatatgtgat

SEQ ID NO: 29639 - DNA, 20 bp, Artificial Sequence
  chemically synthesized
gatgtatatgtgattagaac

SEQ ID NO: 29640 - DNA, 20 bp, Artificial Sequence
  chemically synthesized
tatatgtgattagaaccagt

SEQ ID NO: 29641 - DNA, 20 bp, Artificial Sequence
  chemically synthesized
acctcaactctacattctgt

SEQ ID NO: 29642 - DNA, 20 bp, Artificial Sequence
  chemically synthesized
agtaattatatgaaatgctt

SEQ ID NO: 29643 - DNA, 20 bp, Artificial Sequence
  chemically synthesized
gaatgtttcatattcacaat

SEQ ID NO: 29644 - DNA, 20 bp, Artificial Sequence
  chemically synthesized
tttcatattcacaattagct

SEQ ID NO: 29645 - DNA, 20 bp, Artificial Sequence
  chemically synthesized
ttggaattaatgttttaatt

SEQ ID NO: 29646 - DNA, 20 bp, Artificial Sequence
  chemically synthesized
tggaattaatgttttaattc

SEQ ID NO: 29647 - DNA, 20 bp, Artificial Sequence
  chemically synthesized
gaattaatgttttaattcag

SEQ ID NO: 29648 - DNA, 20 bp, Artificial Sequence
  chemically synthesized
ttaattcaggagcttctcaa

SEQ ID NO: 29649 - DNA, 20 bp, Artificial Sequence
  chemically synthesized
taattcaggagcttctcaaa

SEQ ID NO: 29650 - DNA, 20 bp, Artificial Sequence
  chemically synthesized
gcaaaatactgtgctccttt

SEQ ID NO: 29651 - DNA, 20 bp, Artificial Sequence
  chemically synthesized
ctgtgctcctttcagaatga

SEQ ID NO: 29652 - DNA, 20 bp, Artificial Sequence
  chemically synthesized
tcttcaatgctatgcttatg

SEQ ID NO: 29653 - DNA, 20 bp, Artificial Sequence
  chemically synthesized
cttcaatgctatgcttatgt

SEQ ID NO: 29654 - DNA, 20 bp, Artificial Sequence
  chemically synthesized
tatgtaggaattataaaata

SEQ ID NO: 29655 - DNA, 20 bp, Artificial Sequence
  chemically synthesized
aaattgataaaacaatttgc

SEQ ID NO: 29656 - DNA, 20 bp, Artificial Sequence
  chemically synthesized
tgataaaacaatttgcgagt

SEQ ID NO: 29657 - DNA, 20 bp, Artificial Sequence
  chemically synthesized
gataaaacaatttgcgagtg

SEQ ID NO: 29658 - DNA, 20 bp, Artificial Sequence
  chemically synthesized
aggtataacctcatctgtgc

SEQ ID NO: 29659 - DNA, 20 bp, Artificial Sequence
  chemically synthesized
ggtataacctcatctgtgct

SEQ ID NO: 29660 - DNA, 20 bp, Artificial Sequence
  chemically synthesized
taacctcatctgtgctgggt

SEQ ID NO: 29661 - DNA, 20 bp, Artificial Sequence
  chemically synthesized
acctcatctgtgctgggtaa

SEQ ID NO: 29662 - DNA, 20 bp, Artificial Sequence
  chemically synthesized
tcatctgtgctgggtaagag

SEQ ID NO: 29663 - DNA, 20 bp, Artificial Sequence
  chemically synthesized
catctgtgctgggtaagaga

SEQ ID NO: 29664 - DNA, 20 bp, Artificial Sequence
  chemically synthesized
tgtgctgggtaagagaaggc

SEQ ID NO: 29665 - DNA, 20 bp, Artificial Sequence
  chemically synthesized
gtgctgggtaagagaaggca

SEQ ID NO: 29666 - DNA, 20 bp, Artificial Sequence
  chemically synthesized
ctgggtaagagaaggcaagg

SEQ ID NO: 29667 - DNA, 20 bp, Artificial Sequence
  chemically synthesized
gggtaagagaaggcaaggta

SEQ ID NO: 29668 - DNA, 20 bp, Artificial Sequence
  chemically synthesized
tgtaaatgattttgaaaata

SEQ ID NO: 29669 - DNA, 20 bp, Artificial Sequence
  chemically synthesized
aattataaaacaattccttg

SEQ ID NO: 29670 - DNA, 20 bp, Artificial Sequence
  chemically synthesized
attataaaacaattccttgt

SEQ ID NO: 29671 - DNA, 20 bp, Artificial Sequence
  chemically synthesized
ccttgtgggtttatactctc

SEQ ID NO: 29672 - DNA, 20 bp, Artificial Sequence
  chemically synthesized
gtttatactctctagtttaa

SEQ ID NO: 29673 - DNA, 20 bp, Artificial Sequence
  chemically synthesized
ctctctagtttaaaagtgtc

SEQ ID NO: 29674 - DNA, 20 bp, Artificial Sequence
  chemically synthesized
taaaagtgtcaagactattg

SEQ ID NO: 29675 - DNA, 20 bp, Artificial Sequence
  chemically synthesized
aaaagtgtcaagactattga

SEQ ID NO: 29676 - DNA, 20 bp, Artificial Sequence
  chemically synthesized
caagactattgaaggaacat

SEQ ID NO: 29677 - DNA, 20 bp, Artificial Sequence
  chemically synthesized
ctattgaaggaacattagca

SEQ ID NO: 29678 - DNA, 20 bp, Artificial Sequence
  chemically synthesized
aaggaacattagcaaagaaa

SEQ ID NO: 29679 - DNA, 20 bp, Artificial Sequence
  chemically synthesized
cattagcaaagaaaaagtca

SEQ ID NO: 29680 - DNA, 20 bp, Artificial Sequence
  chemically synthesized
aagaaaaagtcatggttttg

SEQ ID NO: 29681 - DNA, 20 bp, Artificial Sequence
  chemically synthesized
agaaaaagtcatggttttga

SEQ ID NO: 29682 - DNA, 20 bp, Artificial Sequence
  chemically synthesized
aagtcatggttttgaaggct

SEQ ID NO: 29683 - DNA, 20 bp, Artificial Sequence
  chemically synthesized
ttttgaaggctgagttcctc

SEQ ID NO: 29684 - DNA, 20 bp, Artificial Sequence
  chemically synthesized
ctgagttcctcaagatcttg

SEQ ID NO: 29685 - DNA, 20 bp, Artificial Sequence
  chemically synthesized
cctcaagatcttgaagaatc

SEQ ID NO: 29686 - DNA, 20 bp, Artificial Sequence
  chemically synthesized
gaatcaagccaactgattgc

SEQ ID NO: 29687 - DNA, 20 bp, Artificial Sequence
  chemically synthesized
aatcaagccaactgattgct

SEQ ID NO: 29688 - DNA, 20 bp, Artificial Sequence
  chemically synthesized
ccaactgattgctgggtaaa

SEQ ID NO: 29689 - DNA, 20 bp, Artificial Sequence
  chemically synthesized
actgattgctgggtaaatgg

SEQ ID NO: 29690 - DNA, 20 bp, Artificial Sequence
  chemically synthesized
ttactatttcatgtctatta

SEQ ID NO: 29691 - DNA, 20 bp, Artificial Sequence
  chemically synthesized
atgtctattacagtaatcta

SEQ ID NO: 29692 - DNA, 20 bp, Artificial Sequence
  chemically synthesized
tgtctattacagtaatctaa

SEQ ID NO: 29693 - DNA, 20 bp, Artificial Sequence
  chemically synthesized
aaaggatctgaaataataac

SEQ ID NO: 29694 - DNA, 20 bp, Artificial Sequence
  chemically synthesized
gatatattacttccttcttt

SEQ ID NO: 29695 - DNA, 20 bp, Artificial Sequence
  chemically synthesized
acttccttcttttggctaat

SEQ ID NO: 29696 - DNA, 20 bp, Artificial Sequence
  chemically synthesized
ttccttcttttggctaatca

SEQ ID NO: 29697 - DNA, 20 bp, Artificial Sequence
  chemically synthesized
ttcttttggctaatcagagc

SEQ ID NO: 29698 - DNA, 20 bp, Artificial Sequence
  chemically synthesized
aaaattaaatgcattatata

SEQ ID NO: 29699 - DNA, 20 bp, Artificial Sequence
  chemically synthesized
tggcatgcattctgaaaaat

SEQ ID NO: 29700 - DNA, 20 bp, Artificial Sequence
  chemically synthesized
caccttatactaactgttca

SEQ ID NO: 29701 - DNA, 20 bp, Artificial Sequence
  chemically synthesized
attcataaaatcaaaattaa

SEQ ID NO: 29702 - DNA, 20 bp, Artificial Sequence
  chemically synthesized
aaaagtcaattttgcctatg

SEQ ID NO: 29703 - DNA, 20 bp, Artificial Sequence
  chemically synthesized
agtcaattttgcctatgtag

SEQ ID NO: 29704 - DNA, 20 bp, Artificial Sequence
  chemically synthesized
caattttgcctatgtagaag

SEQ ID NO: 29705 - DNA, 20 bp, Artificial Sequence
  chemically synthesized
tttgcctatgtagaagtgga

SEQ ID NO: 29706 - DNA, 20 bp, Artificial Sequence
  chemically synthesized
gaagtggacagaatgcatat

SEQ ID NO: 29707 - DNA, 20 bp, Artificial Sequence
  chemically synthesized
agtggacagaatgcatataa

SEQ ID NO: 29708 - DNA, 20 bp, Artificial Sequence
  chemically synthesized
agaatgcatataagagaaca

SEQ ID NO: 29709 - DNA, 20 bp, Artificial Sequence
  chemically synthesized
gcatataagagaacaaagca

SEQ ID NO: 29710 - DNA, 20 bp, Artificial Sequence
  chemically synthesized
aagcacggtcttattctctg

SEQ ID NO: 29711 - DNA, 20 bp, Artificial Sequence
  chemically synthesized
cggtcttattctctgtagtt

SEQ ID NO: 29712 - DNA, 20 bp, Artificial Sequence
  chemically synthesized
cttattctctgtagtttagt

SEQ ID NO: 29713 - DNA, 20 bp, Artificial Sequence
  chemically synthesized
ttctctgtagtttagtgaga

SEQ ID NO: 29714 - DNA, 20 bp, Artificial Sequence
  chemically synthesized
tagtttagtgagaaagaatc

SEQ ID NO: 29715 - DNA, 20 bp, Artificial Sequence
  chemically synthesized
agtttagtgagaaagaatct

SEQ ID NO: 29716 - DNA, 20 bp, Artificial Sequence
  chemically synthesized
tttagtgagaaagaatctag

SEQ ID NO: 29717 - DNA, 20 bp, Artificial Sequence
  chemically synthesized
ttagtgagaaagaatctagg

SEQ ID NO: 29718 - DNA, 20 bp, Artificial Sequence
  chemically synthesized
tgagaaagaatctaggagga

SEQ ID NO: 29719 - DNA, 20 bp, Artificial Sequence
  chemically synthesized
ggaggacagaaaccttatta

SEQ ID NO: 29720 - DNA, 20 bp, Artificial Sequence
  chemically synthesized
aggacagaaaccttattaca

SEQ ID NO: 29721 - DNA, 20 bp, Artificial Sequence
  chemically synthesized
acagaaaccttattacagag

SEQ ID NO: 29722 - DNA, 20 bp, Artificial Sequence
  chemically synthesized
aaccttattacagagaagtg

SEQ ID NO: 29723 - DNA, 20 bp, Artificial Sequence
  chemically synthesized
ttattttgtattcttttcct

SEQ ID NO: 29724 - DNA, 20 bp, Artificial Sequence
  chemically synthesized
attttgtattcttttcctca

SEQ ID NO: 29725 - DNA, 20 bp, Artificial Sequence
  chemically synthesized
agagatctttatcctgaaat

SEQ ID NO: 29726 - DNA, 20 bp, Artificial Sequence
  chemically synthesized
tgtttttaatgtcctttttc

SEQ ID NO: 29727 - DNA, 20 bp, Artificial Sequence
  chemically synthesized
tttctagtcacaaatttttc

SEQ ID NO: 29728 - DNA, 20 bp, Artificial Sequence
  chemically synthesized
agtcacaaatttttccagtc

SEQ ID NO: 29729 - DNA, 20 bp, Artificial Sequence
  chemically synthesized
ccagtttttaaatatgccca

SEQ ID NO: 29730 - DNA, 20 bp, Artificial Sequence
  chemically synthesized
ttaaatatgcccaaagttcc

SEQ ID NO: 29731 - DNA, 20 bp, Artificial Sequence
  chemically synthesized
taaatatgcccaaagttcct

SEQ ID NO: 29732 - DNA, 20 bp, Artificial Sequence
  chemically synthesized
atgcccaaagttcctgggaa

SEQ ID NO: 29733 - DNA, 20 bp, Artificial Sequence
  chemically synthesized
tctctatcacatgtgaatcc

SEQ ID NO: 29734 - DNA, 20 bp, Artificial Sequence
  chemically synthesized
tctatcacatgtgaatcccg

SEQ ID NO: 29735 - DNA, 20 bp, Artificial Sequence
  chemically synthesized
cggagtatgccttgaaataa

SEQ ID NO: 29736 - DNA, 20 bp, Artificial Sequence
  chemically synthesized
cttgaaataaaagttttctc

SEQ ID NO: 29737 - DNA, 20 bp, Artificial Sequence
  chemically synthesized
tgaaataaaagttttctcta

SEQ ID NO: 29738 - DNA, 20 bp, Artificial Sequence
  chemically synthesized
aaataaaagttttctctaga

SEQ ID NO: 29739 - DNA, 20 bp, Artificial Sequence
  chemically synthesized
taaaagttttctctagagag

SEQ ID NO: 29740 - DNA, 20 bp, Artificial Sequence
  chemically synthesized
aaaagttttctctagagagt

SEQ ID NO: 29741 - DNA, 20 bp, Artificial Sequence
  chemically synthesized
agttttctctagagagtggg

SEQ ID NO: 29742 - DNA, 20 bp, Artificial Sequence
  chemically synthesized
gttttctctagagagtgggc

SEQ ID NO: 29743 - DNA, 20 bp, Artificial Sequence
  chemically synthesized
tttctctagagagtgggcag

SEQ ID NO: 29744 - DNA, 20 bp, Artificial Sequence
  chemically synthesized
tagagagtgggcaggagctc

SEQ ID NO: 29745 - DNA, 20 bp, Artificial Sequence
  chemically synthesized
agagagtgggcaggagctca

SEQ ID NO: 29746 - DNA, 20 bp, Artificial Sequence
  chemically synthesized
tgggcaggagctcaaggaca

SEQ ID NO: 29747 - DNA, 20 bp, Artificial Sequence
  chemically synthesized
agctcaaggacatagcttat

SEQ ID NO: 29748 - DNA, 20 bp, Artificial Sequence
  chemically synthesized
tcaaggacatagcttattgg

SEQ ID NO: 29749 - DNA, 20 bp, Artificial Sequence
  chemically synthesized
agcttattggtggataaaac

SEQ ID NO: 29750 - DNA, 20 bp, Artificial Sequence
  chemically synthesized
ttattggtggataaaactgg

SEQ ID NO: 29751 - DNA, 20 bp, Artificial Sequence
  chemically synthesized
tattggtggataaaactgga

SEQ ID NO: 29752 - DNA, 20 bp, Artificial Sequence
  chemically synthesized
attggtggataaaactggaa

SEQ ID NO: 29753 - DNA, 20 bp, Artificial Sequence
  chemically synthesized
taaaactggaagggacttgt

SEQ ID NO: 29754 - DNA, 20 bp, Artificial Sequence
  chemically synthesized
tggaagggacttgttagcac

SEQ ID NO: 29755 - DNA, 20 bp, Artificial Sequence
  chemically synthesized
ggaagggacttgttagcact

SEQ ID NO: 29756 - DNA, 20 bp, Artificial Sequence
  chemically synthesized
gacttgttagcactgggaat

SEQ ID NO: 29757 - DNA, 20 bp, Artificial Sequence
  chemically synthesized
gttagcactgggaatcagtc

SEQ ID NO: 29758 - DNA, 20 bp, Artificial Sequence
  chemically synthesized
agcactgggaatcagtccag

SEQ ID NO: 29759 - DNA, 20 bp, Artificial Sequence
  chemically synthesized
agtccagaagatctctgcac

SEQ ID NO: 29760 - DNA, 20 bp, Artificial Sequence
  chemically synthesized
ctgcacaagttcctgcacct

SEQ ID NO: 29761 - DNA, 20 bp, Artificial Sequence
  chemically synthesized
cacaagttcctgcacctgag

SEQ ID NO: 29762 - DNA, 20 bp, Artificial Sequence
  chemically synthesized
caagttcctgcacctgagca

SEQ ID NO: 29763 - DNA, 20 bp, Artificial Sequence
  chemically synthesized
catcatttaacaaacattaa

SEQ ID NO: 29764 - DNA, 20 bp, Artificial Sequence
  chemically synthesized
tcatttaacaaacattaatg

SEQ ID NO: 29765 - DNA, 20 bp, Artificial Sequence
  chemically synthesized
attaatggagcactgttacc

SEQ ID NO: 29766 - DNA, 20 bp, Artificial Sequence
  chemically synthesized
ttaatggagcactgttacct

SEQ ID NO: 29767 - DNA, 20 bp, Artificial Sequence
  chemically synthesized
gagcactgttacctgggcac

SEQ ID NO: 29768 - DNA, 20 bp, Artificial Sequence
  chemically synthesized
agcactgttacctgggcact

SEQ ID NO: 29769 - DNA, 20 bp, Artificial Sequence
  chemically synthesized
cctgggcactgggaacacgc

SEQ ID NO: 29770 - DNA, 20 bp, Artificial Sequence
  chemically synthesized
gggaacacgccagtgaaact

SEQ ID NO: 29771 - DNA, 20 bp, Artificial Sequence
  chemically synthesized
agtgaaactaagttatttta

SEQ ID NO: 29772 - DNA, 20 bp, Artificial Sequence
  chemically synthesized
tattttatggatcttataat

SEQ ID NO: 29773 - DNA, 20 bp, Artificial Sequence
  chemically synthesized
tttatggatcttataatcag

SEQ ID NO: 29774 - DNA, 20 bp, Artificial Sequence
  chemically synthesized
agtagcatgtgtgttgatct

SEQ ID NO: 29775 - DNA, 20 bp, Artificial Sequence
  chemically synthesized
gtagcatgtgtgttgatctc

SEQ ID NO: 29776 - DNA, 20 bp, Artificial Sequence
  chemically synthesized
tagcatgtgtgttgatctca

SEQ ID NO: 29777 - DNA, 20 bp, Artificial Sequence
  chemically synthesized
tgtgtgttgatctcagggtc

SEQ ID NO: 29778 - DNA, 20 bp, Artificial Sequence
  chemically synthesized
gttgatctcagggtctagaa

SEQ ID NO: 29779 - DNA, 20 bp, Artificial Sequence
  chemically synthesized
tcagggtctagaacagtgcc

SEQ ID NO: 29780 - DNA, 20 bp, Artificial Sequence
  chemically synthesized
ctagaacagtgcctggtaca

SEQ ID NO: 29781 - DNA, 20 bp, Artificial Sequence
  chemically synthesized
ggtacatagaaaatgctcaa

SEQ ID NO: 29782 - DNA, 20 bp, Artificial Sequence
  chemically synthesized
aaatttgtttttcaacccct

SEQ ID NO: 29783 - DNA, 20 bp, Artificial Sequence
  chemically synthesized
ttttctatcatttccctttc

SEQ ID NO: 29784 - DNA, 20 bp, Artificial Sequence
  chemically synthesized
tttctatcatttccctttca

SEQ ID NO: 29785 - DNA, 20 bp, Artificial Sequence
  chemically synthesized
ttctatcatttccctttcaa

SEQ ID NO: 29786 - DNA, 20 bp, Artificial Sequence
  chemically synthesized
tctatcatttccctttcaag

SEQ ID NO: 29787 - DNA, 20 bp, Artificial Sequence
  chemically synthesized
atcatttccctttcaagggg

SEQ ID NO: 29788 - DNA, 20 bp, Artificial Sequence
  chemically synthesized
tcatttccctttcaagggga

SEQ ID NO: 29789 - DNA, 20 bp, Artificial Sequence
  chemically synthesized
catttccctttcaaggggaa

SEQ ID NO: 29790 - DNA, 20 bp, Artificial Sequence
  chemically synthesized
ttccctttcaaggggaaggg

SEQ ID NO: 29791 - DNA, 20 bp, Artificial Sequence
  chemically synthesized
ggggaagggaagtgtttttg

SEQ ID NO: 29792 - DNA, 20 bp, Artificial Sequence
  chemically synthesized
ggaagggaagtgtttttgtg

SEQ ID NO: 29793 - DNA, 20 bp, Artificial Sequence
  chemically synthesized
aagggaagtgtttttgtgga

SEQ ID NO: 29794 - DNA, 20 bp, Artificial Sequence
  chemically synthesized
agggaagtgtttttgtggag

SEQ ID NO: 29795 - DNA, 20 bp, Artificial Sequence
  chemically synthesized
ccccacaatgtgatttacac

SEQ ID NO: 29796 - DNA, 20 bp, Artificial Sequence
  chemically synthesized
tctttattttaatattatca

SEQ ID NO: 29797 - DNA, 20 bp, Artificial Sequence
  chemically synthesized
attttaatattatcatagcc

SEQ ID NO: 29798 - DNA, 20 bp, Artificial Sequence
  chemically synthesized
aatattatcatagcctggta

SEQ ID NO: 29799 - DNA, 20 bp, Artificial Sequence
  chemically synthesized
atcatagcctggtatggttt

SEQ ID NO: 29800 - DNA, 20 bp, Artificial Sequence
  chemically synthesized
tatggtttgagattttcata

SEQ ID NO: 29801 - DNA, 20 bp, Artificial Sequence
  chemically synthesized
gtttgagattttcatataga

SEQ ID NO: 29802 - DNA, 20 bp, Artificial Sequence
  chemically synthesized
ctaataatacattgccacta

SEQ ID NO: 29803 - DNA, 20 bp, Artificial Sequence
  chemically synthesized
ttttacttccctgcatttca

SEQ ID NO: 29804 - DNA, 20 bp, Artificial Sequence
  chemically synthesized
tacttccctgcatttcatag

SEQ ID NO: 29805 - DNA, 20 bp, Artificial Sequence
  chemically synthesized
gcatttcatagtagtgatat

SEQ ID NO: 29806 - DNA, 20 bp, Artificial Sequence
  chemically synthesized
catttcatagtagtgatatg

SEQ ID NO: 29807 - DNA, 20 bp, Artificial Sequence
  chemically synthesized
agtagtgatatgaggtatct

SEQ ID NO: 29808 - DNA, 20 bp, Artificial Sequence
  chemically synthesized
tagtgatatgaggtatctta

SEQ ID NO: 29809 - DNA, 20 bp, Artificial Sequence
  chemically synthesized
gatcatgaatcccactcctc

SEQ ID NO: 29810 - DNA, 20 bp, Artificial Sequence
  chemically synthesized
aatcccactcctccagttca

SEQ ID NO: 29811 - DNA, 20 bp, Artificial Sequence
  chemically synthesized
tcccactcctccagttcata

SEQ ID NO: 29812 - DNA, 20 bp, Artificial Sequence
  chemically synthesized
tcatagagcaaattgattcg

SEQ ID NO: 29813 - DNA, 20 bp, Artificial Sequence
  chemically synthesized
atagagcaaattgattcgta

SEQ ID NO: 29814 - DNA, 20 bp, Artificial Sequence
  chemically synthesized
tagagcaaattgattcgtag

SEQ ID NO: 29815 - DNA, 20 bp, Artificial Sequence
  chemically synthesized
cgtagaggtatttaatgatc

SEQ ID NO: 29816 - DNA, 20 bp, Artificial Sequence
  chemically synthesized
gtatttaatgatcaagcaaa

SEQ ID NO: 29817 - DNA, 20 bp, Artificial Sequence
  chemically synthesized
tttaatgatcaagcaaatgg

SEQ ID NO: 29818 - DNA, 20 bp, Artificial Sequence
  chemically synthesized
taatgatcaagcaaatggca

SEQ ID NO: 29819 - DNA, 20 bp, Artificial Sequence
  chemically synthesized
gatcaagcaaatggcagagt

SEQ ID NO: 29820 - DNA, 20 bp, Artificial Sequence
  chemically synthesized
atcaagcaaatggcagagtt

SEQ ID NO: 29821 - DNA, 20 bp, Artificial Sequence
  chemically synthesized
gcaaatggcagagttaggac

SEQ ID NO: 29822 - DNA, 20 bp, Artificial Sequence
  chemically synthesized
caaatggcagagttaggacc

SEQ ID NO: 29823 - DNA, 20 bp, Artificial Sequence
  chemically synthesized
gcagagttaggaccaggatt

SEQ ID NO: 29824 - DNA, 20 bp, Artificial Sequence
  chemically synthesized
cagagttaggaccaggattt

SEQ ID NO: 29825 - DNA, 20 bp, Artificial Sequence
  chemically synthesized
ccaggatttaggtcttttcc

SEQ ID NO: 29826 - DNA, 20 bp, Artificial Sequence
  chemically synthesized
caggatttaggtcttttcca

SEQ ID NO: 29827 - DNA, 20 bp, Artificial Sequence
  chemically synthesized
tcacttttttactattatgt

SEQ ID NO: 29828 - DNA, 20 bp, Artificial Sequence
  chemically synthesized
agaattaaatattaaaacct

SEQ ID NO: 29829 - DNA, 20 bp, Artificial Sequence
  chemically synthesized
tattaaaacctcagttttca

SEQ ID NO: 29830 - DNA, 20 bp, Artificial Sequence
  chemically synthesized
attaaaacctcagttttcaa

SEQ ID NO: 29831 - DNA, 20 bp, Artificial Sequence
  chemically synthesized
ttttcaaaggaaatgtccta

SEQ ID NO: 29832 - DNA, 20 bp, Artificial Sequence
  chemically synthesized
aggaaatgtcctatagatga

SEQ ID NO: 29833 - DNA, 20 bp, Artificial Sequence
  chemically synthesized
gtcctatagatgaaagaaca

SEQ ID NO: 29834 - DNA, 20 bp, Artificial Sequence
  chemically synthesized
atgaaagaacacagtacttg

SEQ ID NO: 29835 - DNA, 20 bp, Artificial Sequence
  chemically synthesized
gaacacagtacttgcagtca

SEQ ID NO: 29836 - DNA, 20 bp, Artificial Sequence
  chemically synthesized
aacacagtacttgcagtcaa

SEQ ID NO: 29837 - DNA, 20 bp, Artificial Sequence
  chemically synthesized
gtacttgcagtcaaaggtct

SEQ ID NO: 29838 - DNA, 20 bp, Artificial Sequence
  chemically synthesized
atttctgaaactttctgaaa

SEQ ID NO: 29839 - DNA, 20 bp, Artificial Sequence
  chemically synthesized
gaaccccttaaactgaataa

SEQ ID NO: 29840 - DNA, 20 bp, Artificial Sequence
  chemically synthesized
aaaatgaatgttatactctc

SEQ ID NO: 29841 - DNA, 20 bp, Artificial Sequence
  chemically synthesized
agttatcttaccatgttttc

SEQ ID NO: 29842 - DNA, 20 bp, Artificial Sequence
  chemically synthesized
taccatgttttctggcaaac

SEQ ID NO: 29843 - DNA, 20 bp, Artificial Sequence
  chemically synthesized
accatgttttctggcaaaca

SEQ ID NO: 29844 - DNA, 20 bp, Artificial Sequence
  chemically synthesized
aaggaaatgtattcacatcc

SEQ ID NO: 29845 - DNA, 20 bp, Artificial Sequence
  chemically synthesized
attcacatccaagaaaacaa

SEQ ID NO: 29846 - DNA, 20 bp, Artificial Sequence
  chemically synthesized
ttcacatccaagaaaacaaa

SEQ ID NO: 29847 - DNA, 20 bp, Artificial Sequence
  chemically synthesized
caagaaaacaaaaggtttct

SEQ ID NO: 29848 - DNA, 20 bp, Artificial Sequence
  chemically synthesized
aagaaaacaaaaggtttctt

SEQ ID NO: 29849 - DNA, 20 bp, Artificial Sequence
  chemically synthesized
gaaaacaaaaggtttcttag

SEQ ID NO: 29850 - DNA, 20 bp, Artificial Sequence
  chemically synthesized
aacaaaaggtttcttaggag

SEQ ID NO: 29851 - DNA, 20 bp, Artificial Sequence
  chemically synthesized
ggagaagaatcccttgctgc

SEQ ID NO: 29852 - DNA, 20 bp, Artificial Sequence
  chemically synthesized
agaattttgcccatgaacaa

SEQ ID NO: 29853 - DNA, 20 bp, Artificial Sequence
  chemically synthesized
tggaaacgtgaaaaacataa

SEQ ID NO: 29854 - DNA, 20 bp, Artificial Sequence
  chemically synthesized
acgtgaaaaacataacagat

SEQ ID NO: 29855 - DNA, 20 bp, Artificial Sequence
  chemically synthesized
gtgaaaaacataacagatga

SEQ ID NO: 29856 - DNA, 20 bp, Artificial Sequence
  chemically synthesized
gaaaaacataacagatgaga

SEQ ID NO: 29857 - DNA, 20 bp, Artificial Sequence
  chemically synthesized
cataacagatgagagagtca

SEQ ID NO: 29858 - DNA, 20 bp, Artificial Sequence
  chemically synthesized
acagatgagagagtcacagt

SEQ ID NO: 29859 - DNA, 20 bp, Artificial Sequence
  chemically synthesized
gagagagtcacagttagttt

SEQ ID NO: 29860 - DNA, 20 bp, Artificial Sequence
  chemically synthesized
agagagtcacagttagtttt

SEQ ID NO: 29861 - DNA, 20 bp, Artificial Sequence
  chemically synthesized
tagttttgggtactaattct

SEQ ID NO: 29862 - DNA, 20 bp, Artificial Sequence
  chemically synthesized
cattaatccattttattatt

SEQ ID NO: 29863 - DNA, 20 bp, Artificial Sequence
  chemically synthesized
aatccattttattattcagt

SEQ ID NO: 29864 - DNA, 20 bp, Artificial Sequence
  chemically synthesized
atccattttattattcagta

SEQ ID NO: 29865 - DNA, 20 bp, Artificial Sequence
  chemically synthesized
ttattcagtaaggattcatc

SEQ ID NO: 29866 - DNA, 20 bp, Artificial Sequence
  chemically synthesized
aggattcatcaagtgtctat

SEQ ID NO: 29867 - DNA, 20 bp, Artificial Sequence
  chemically synthesized
ggattcatcaagtgtctatt

SEQ ID NO: 29868 - DNA, 20 bp, Artificial Sequence
  chemically synthesized
atcaagtgtctattaggtat

SEQ ID NO: 29869 - DNA, 20 bp, Artificial Sequence
  chemically synthesized
tcaagtgtctattaggtatc

SEQ ID NO: 29870 - DNA, 20 bp, Artificial Sequence
  chemically synthesized
tctattaggtatcaggcact

SEQ ID NO: 29871 - DNA, 20 bp, Artificial Sequence
  chemically synthesized
tattaggtatcaggcactga

SEQ ID NO: 29872 - DNA, 20 bp, Artificial Sequence
  chemically synthesized
attaggtatcaggcactgag

SEQ ID NO: 29873 - DNA, 20 bp, Artificial Sequence
  chemically synthesized
ggtatcaggcactgagaggc

SEQ ID NO: 29874 - DNA, 20 bp, Artificial Sequence
  chemically synthesized
gtatcaggcactgagaggcg

SEQ ID NO: 29875 - DNA, 20 bp, Artificial Sequence
  chemically synthesized
tatcaggcactgagaggcga

SEQ ID NO: 29876 - DNA, 20 bp, Artificial Sequence
  chemically synthesized
tcaggcactgagaggcgagg

SEQ ID NO: 29877 - DNA, 20 bp, Artificial Sequence
  chemically synthesized
gcactgagaggcgagggaga

SEQ ID NO: 29878 - DNA, 20 bp, Artificial Sequence
  chemically synthesized
actgagaggcgagggagata

SEQ ID NO: 29879 - DNA, 20 bp, Artificial Sequence
  chemically synthesized
gaggcgagggagatagagtt

SEQ ID NO: 29880 - DNA, 20 bp, Artificial Sequence
  chemically synthesized
gggagatagagttaagaata

SEQ ID NO: 29881 - DNA, 20 bp, Artificial Sequence
  chemically synthesized
agaactgattcttaatcttc

SEQ ID NO: 29882 - DNA, 20 bp, Artificial Sequence
  chemically synthesized
ttcaagaattgacaaatttg

SEQ ID NO: 29883 - DNA, 20 bp, Artificial Sequence
  chemically synthesized
aagaattgacaaatttgtag

SEQ ID NO: 29884 - DNA, 20 bp, Artificial Sequence
  chemically synthesized
agaattgacaaatttgtaga

SEQ ID NO: 29885 - DNA, 20 bp, Artificial Sequence
  chemically synthesized
attgacaaatttgtagaagg

SEQ ID NO: 29886 - DNA, 20 bp, Artificial Sequence
  chemically synthesized
tagacattgaacatacaata

SEQ ID NO: 29887 - DNA, 20 bp, Artificial Sequence
  chemically synthesized
acaatacagtcaaatgtgat

SEQ ID NO: 29888 - DNA, 20 bp, Artificial Sequence
  chemically synthesized
cagtcaaatgtgatgagtgt

SEQ ID NO: 29889 - DNA, 20 bp, Artificial Sequence
  chemically synthesized
aatgtgatgagtgtgagact

SEQ ID NO: 29890 - DNA, 20 bp, Artificial Sequence
  chemically synthesized
atgtgatgagtgtgagacta

SEQ ID NO: 29891 - DNA, 20 bp, Artificial Sequence
  chemically synthesized
tgtgatgagtgtgagactaa

SEQ ID NO: 29892 - DNA, 20 bp, Artificial Sequence
  chemically synthesized
gagtgtgagactaagggaac

SEQ ID NO: 29893 - DNA, 20 bp, Artificial Sequence
  chemically synthesized
agtgtgagactaagggaacc

SEQ ID NO: 29894 - DNA, 20 bp, Artificial Sequence
  chemically synthesized
ctaagggaaccaggtgtcct

SEQ ID NO: 29895 - DNA, 20 bp, Artificial Sequence
  chemically synthesized
ccaggtgtcctaagactata

SEQ ID NO: 29896 - DNA, 20 bp, Artificial Sequence
  chemically synthesized
taagactatacagtgtaccg

SEQ ID NO: 29897 - DNA, 20 bp, Artificial Sequence
  chemically synthesized
ctatacagtgtaccgtggaa

SEQ ID NO: 29898 - DNA, 20 bp, Artificial Sequence
  chemically synthesized
tatacagtgtaccgtggaat

SEQ ID NO: 29899 - DNA, 20 bp, Artificial Sequence
  chemically synthesized
atacagtgtaccgtggaatg

SEQ ID NO: 29900 - DNA, 20 bp, Artificial Sequence
  chemically synthesized
acagtgtaccgtggaatggg

SEQ ID NO: 29901 - DNA, 20 bp, Artificial Sequence
  chemically synthesized
gtgtaccgtggaatggggag

SEQ ID NO: 29902 - DNA, 20 bp, Artificial Sequence
  chemically synthesized
atggggagtggtttctaacc

SEQ ID NO: 29903 - DNA, 20 bp, Artificial Sequence
  chemically synthesized
tggtttctaacctagttacc

SEQ ID NO: 29904 - DNA, 20 bp, Artificial Sequence
  chemically synthesized
gtttctaacctagttaccta

SEQ ID NO: 29905 - DNA, 20 bp, Artificial Sequence
  chemically synthesized
tttctaacctagttacctag

SEQ ID NO: 29906 - DNA, 20 bp, Artificial Sequence
  chemically synthesized
aacctagttacctagaggtt

SEQ ID NO: 29907 - DNA, 20 bp, Artificial Sequence
  chemically synthesized
acctagttacctagaggttt

SEQ ID NO: 29908 - DNA, 20 bp, Artificial Sequence
  chemically synthesized
ggaaaaacctctctaatgat

SEQ ID NO: 29909 - DNA, 20 bp, Artificial Sequence
  chemically synthesized
tctctaatgatgagatgttt

SEQ ID NO: 29910 - DNA, 20 bp, Artificial Sequence
  chemically synthesized
gatgtttgagctgacacttg

SEQ ID NO: 29911 - DNA, 20 bp, Artificial Sequence
  chemically synthesized
atgtttgagctgacacttga

SEQ ID NO: 29912 - DNA, 20 bp, Artificial Sequence
  chemically synthesized
gctgacacttgaaggataaa

SEQ ID NO: 29913 - DNA, 20 bp, Artificial Sequence
  chemically synthesized
acttgaaggataaatagcta

SEQ ID NO: 29914 - DNA, 20 bp, Artificial Sequence
  chemically synthesized
cttgaaggataaatagctaa

SEQ ID NO: 29915 - DNA, 20 bp, Artificial Sequence
  chemically synthesized
ttgaaggataaatagctaaa

SEQ ID NO: 29916 - DNA, 20 bp, Artificial Sequence
  chemically synthesized
tgaaggataaatagctaaag

SEQ ID NO: 29917 - DNA, 20 bp, Artificial Sequence
  chemically synthesized
aaggataaatagctaaaggg

SEQ ID NO: 29918 - DNA, 20 bp, Artificial Sequence
  chemically synthesized
ataaatagctaaaggggaga

SEQ ID NO: 29919 - DNA, 20 bp, Artificial Sequence
  chemically synthesized
ggggagaaagcgttctatgt

SEQ ID NO: 29920 - DNA, 20 bp, Artificial Sequence
  chemically synthesized
ggagaaagcgttctatgtga

SEQ ID NO: 29921 - DNA, 20 bp, Artificial Sequence
  chemically synthesized
gtgagagaactatatatgcc

SEQ ID NO: 29922 - DNA, 20 bp, Artificial Sequence
  chemically synthesized
gaactatatatgccaagatg

SEQ ID NO: 29923 - DNA, 20 bp, Artificial Sequence
  chemically synthesized
ctatatatgccaagatgcag

SEQ ID NO: 29924 - DNA, 20 bp, Artificial Sequence
  chemically synthesized
gcagaagtgttctctgttcg

SEQ ID NO: 29925 - DNA, 20 bp, Artificial Sequence
  chemically synthesized
tgttctctgttcgaagatct

SEQ ID NO: 29926 - DNA, 20 bp, Artificial Sequence
  chemically synthesized
tctctgttcgaagatctgag

SEQ ID NO: 29927 - DNA, 20 bp, Artificial Sequence
  chemically synthesized
ctctgttcgaagatctgagc

SEQ ID NO: 29928 - DNA, 20 bp, Artificial Sequence
  chemically synthesized
tctgttcgaagatctgagcg

SEQ ID NO: 29929 - DNA, 20 bp, Artificial Sequence
  chemically synthesized
tcgaagatctgagcggggct

SEQ ID NO: 29930 - DNA, 20 bp, Artificial Sequence
  chemically synthesized
gaagatctgagcggggctca

SEQ ID NO: 29931 - DNA, 20 bp, Artificial Sequence
  chemically synthesized
agatctgagcggggctcaga

SEQ ID NO: 29932 - DNA, 20 bp, Artificial Sequence
  chemically synthesized
gatctgagcggggctcagag

SEQ ID NO: 29933 - DNA, 20 bp, Artificial Sequence
  chemically synthesized
atctgagcggggctcagaga

SEQ ID NO: 29934 - DNA, 20 bp, Artificial Sequence
  chemically synthesized
agcggggctcagagagggaa

SEQ ID NO: 29935 - DNA, 20 bp, Artificial Sequence
  chemically synthesized
gcggggctcagagagggaaa

SEQ ID NO: 29936 - DNA, 20 bp, Artificial Sequence
  chemically synthesized
ggggctcagagagggaaaag

SEQ ID NO: 29937 - DNA, 20 bp, Artificial Sequence
  chemically synthesized
ggctcagagagggaaaagga

SEQ ID NO: 29938 - DNA, 20 bp, Artificial Sequence
  chemically synthesized
gctcagagagggaaaaggag

SEQ ID NO: 29939 - DNA, 20 bp, Artificial Sequence
  chemically synthesized
tcagagagggaaaaggagag

SEQ ID NO: 29940 - DNA, 20 bp, Artificial Sequence
  chemically synthesized
agggaaaaggagaggagtat

SEQ ID NO: 29941 - DNA, 20 bp, Artificial Sequence
  chemically synthesized
ggaaaaggagaggagtatga

SEQ ID NO: 29942 - DNA, 20 bp, Artificial Sequence
  chemically synthesized
aaaggagaggagtatgagag

SEQ ID NO: 29943 - DNA, 20 bp, Artificial Sequence
  chemically synthesized
gagaggagtatgagagaaga

SEQ ID NO: 29944 - DNA, 20 bp, Artificial Sequence
  chemically synthesized
agaggagtatgagagaagat

SEQ ID NO: 29945 - DNA, 20 bp, Artificial Sequence
  chemically synthesized
aggagtatgagagaagatgg

SEQ ID NO: 29946 - DNA, 20 bp, Artificial Sequence
  chemically synthesized
gagtatgagagaagatggga

SEQ ID NO: 29947 - DNA, 20 bp, Artificial Sequence
  chemically synthesized
gagaagatgggagagacctg

SEQ ID NO: 29948 - DNA, 20 bp, Artificial Sequence
  chemically synthesized
agaagatgggagagacctgc

SEQ ID NO: 29949 - DNA, 20 bp, Artificial Sequence
  chemically synthesized
gaagatgggagagacctgca

SEQ ID NO: 29950 - DNA, 20 bp, Artificial Sequence
  chemically synthesized
tgggagagacctgcagggac

SEQ ID NO: 29951 - DNA, 20 bp, Artificial Sequence
  chemically synthesized
cctgcagggactagattgtg

SEQ ID NO: 29952 - DNA, 20 bp, Artificial Sequence
  chemically synthesized
agggactagattgtgaagct

SEQ ID NO: 29953 - DNA, 20 bp, Artificial Sequence
  chemically synthesized
gggactagattgtgaagctc

SEQ ID NO: 29954 - DNA, 20 bp, Artificial Sequence
  chemically synthesized
ggactagattgtgaagctca

SEQ ID NO: 29955 - DNA, 20 bp, Artificial Sequence
  chemically synthesized
gactagattgtgaagctcag

SEQ ID NO: 29956 - DNA, 20 bp, Artificial Sequence
  chemically synthesized
actagattgtgaagctcagg

SEQ ID NO: 29957 - DNA, 20 bp, Artificial Sequence
  chemically synthesized
tagattgtgaagctcagggg

SEQ ID NO: 29958 - DNA, 20 bp, Artificial Sequence
  chemically synthesized
tgaagctcagggggagttaa

SEQ ID NO: 29959 - DNA, 20 bp, Artificial Sequence
  chemically synthesized
cagggggagttaatagcctt

SEQ ID NO: 29960 - DNA, 20 bp, Artificial Sequence
  chemically synthesized
agggggagttaatagcctta

SEQ ID NO: 29961 - DNA, 20 bp, Artificial Sequence
  chemically synthesized
ggggagttaatagccttaag

SEQ ID NO: 29962 - DNA, 20 bp, Artificial Sequence
  chemically synthesized
gccttaaggagttttgtctc

SEQ ID NO: 29963 - DNA, 20 bp, Artificial Sequence
  chemically synthesized
ccttaaggagttttgtctcc

SEQ ID NO: 29964 - DNA, 20 bp, Artificial Sequence
  chemically synthesized
cttaaggagttttgtctcca

SEQ ID NO: 29965 - DNA, 20 bp, Artificial Sequence
  chemically synthesized
ccagggtatgaacaatgaat

SEQ ID NO: 29966 - DNA, 20 bp, Artificial Sequence
  chemically synthesized
cagggtatgaacaatgaatg

SEQ ID NO: 29967 - DNA, 20 bp, Artificial Sequence
  chemically synthesized
gggtatgaacaatgaatgag

SEQ ID NO: 29968 - DNA, 20 bp, Artificial Sequence
  chemically synthesized
agtcactgaaattctatcca

SEQ ID NO: 29969 - DNA, 20 bp, Artificial Sequence
  chemically synthesized
cactgaaattctatccacag

SEQ ID NO: 29970 - DNA, 20 bp, Artificial Sequence
  chemically synthesized
tgaaattctatccacagtag

SEQ ID NO: 29971 - DNA, 20 bp, Artificial Sequence
  chemically synthesized
gaaattctatccacagtagt

SEQ ID NO: 29972 - DNA, 20 bp, Artificial Sequence
  chemically synthesized
attctatccacagtagtggg

SEQ ID NO: 29973 - DNA, 20 bp, Artificial Sequence
  chemically synthesized
ccacagtagtgggaagtact

SEQ ID NO: 29974 - DNA, 20 bp, Artificial Sequence
  chemically synthesized
cagtagtgggaagtactaag

SEQ ID NO: 29975 - DNA, 20 bp, Artificial Sequence
  chemically synthesized
agtgggaagtactaagtagt

SEQ ID NO: 29976 - DNA, 20 bp, Artificial Sequence
  chemically synthesized
gtgggaagtactaagtagtc

SEQ ID NO: 29977 - DNA, 20 bp, Artificial Sequence
  chemically synthesized
ctaagtagtcaggtatgttt

SEQ ID NO: 29978 - DNA, 20 bp, Artificial Sequence
  chemically synthesized
agtagtcaggtatgttttgg

SEQ ID NO: 29979 - DNA, 20 bp, Artificial Sequence
  chemically synthesized
agtcaggtatgttttggaag

SEQ ID NO: 29980 - DNA, 20 bp, Artificial Sequence
  chemically synthesized
tttggaagaagcactgttac

SEQ ID NO: 29981 - DNA, 20 bp, Artificial Sequence
  chemically synthesized
aagaagcactgttaccagtt

SEQ ID NO: 29982 - DNA, 20 bp, Artificial Sequence
  chemically synthesized
agaagcactgttaccagttg

SEQ ID NO: 29983 - DNA, 20 bp, Artificial Sequence
  chemically synthesized
gaagcactgttaccagttga

SEQ ID NO: 29984 - DNA, 20 bp, Artificial Sequence
  chemically synthesized
agcactgttaccagttgagg

SEQ ID NO: 29985 - DNA, 20 bp, Artificial Sequence
  chemically synthesized
cactgttaccagttgaggga

SEQ ID NO: 29986 - DNA, 20 bp, Artificial Sequence
  chemically synthesized
actgttaccagttgagggag

SEQ ID NO: 29987 - DNA, 20 bp, Artificial Sequence
  chemically synthesized
tgttaccagttgagggagag

SEQ ID NO: 29988 - DNA, 20 bp, Artificial Sequence
  chemically synthesized
ttaccagttgagggagagga

SEQ ID NO: 29989 - DNA, 20 bp, Artificial Sequence
  chemically synthesized
taccagttgagggagaggag

SEQ ID NO: 29990 - DNA, 20 bp, Artificial Sequence
  chemically synthesized
ccagttgagggagaggagag

SEQ ID NO: 29991 - DNA, 20 bp, Artificial Sequence
  chemically synthesized
cagttgagggagaggagagg

SEQ ID NO: 29992 - DNA, 20 bp, Artificial Sequence
  chemically synthesized
agttgagggagaggagagga

SEQ ID NO: 29993 - DNA, 20 bp, Artificial Sequence
  chemically synthesized
ggagaggagaggagggaaat

SEQ ID NO: 29994 - DNA, 20 bp, Artificial Sequence
  chemically synthesized
agaggagggaaattagactg

SEQ ID NO: 29995 - DNA, 20 bp, Artificial Sequence
  chemically synthesized
aattagactgtggtgtgacc

SEQ ID NO: 29996 - DNA, 20 bp, Artificial Sequence
  chemically synthesized
attagactgtggtgtgaccc

SEQ ID NO: 29997 - DNA, 20 bp, Artificial Sequence
  chemically synthesized
gactgtggtgtgacccagga

SEQ ID NO: 29998 - DNA, 20 bp, Artificial Sequence
  chemically synthesized
gtggtgtgacccaggatgga

SEQ ID NO: 29999 - DNA, 20 bp, Artificial Sequence
  chemically synthesized
tggaaagttttgcccaaatg

SEQ ID NO: 30000 - DNA, 20 bp, Artificial Sequence
  chemically synthesized
ggaaagttttgcccaaatgt

SEQ ID NO: 30001 - DNA, 20 bp, Artificial Sequence
  chemically synthesized
gaaagttttgcccaaatgtg

SEQ ID NO: 30002 - DNA, 20 bp, Artificial Sequence
  chemically synthesized
aaagttttgcccaaatgtgg

SEQ ID NO: 30003 - DNA, 20 bp, Artificial Sequence
  chemically synthesized
tgtttactctctcctttgcc

SEQ ID NO: 30004 - DNA, 20 bp, Artificial Sequence
  chemically synthesized
gtttactctctcctttgccc

SEQ ID NO: 30005 - DNA, 20 bp, Artificial Sequence
  chemically synthesized
ttcttctgcacacacttgct

SEQ ID NO: 30006 - DNA, 20 bp, Artificial Sequence
  chemically synthesized
gctcagaacattacaaactc

SEQ ID NO: 30007 - DNA, 20 bp, Artificial Sequence
  chemically synthesized
tcagaacattacaaactctg

SEQ ID NO: 30008 - DNA, 20 bp, Artificial Sequence
  chemically synthesized
tctggagaaattaacatgtt

SEQ ID NO: 30009 - DNA, 20 bp, Artificial Sequence
  chemically synthesized
ctggagaaattaacatgtta

SEQ ID NO: 30010 - DNA, 20 bp, Artificial Sequence
  chemically synthesized
attaacatgttaaggatatt

SEQ ID NO: 30011 - DNA, 20 bp, Artificial Sequence
  chemically synthesized
ttaacatgttaaggatattt

SEQ ID NO: 30012 - DNA, 20 bp, Artificial Sequence
  chemically synthesized
gatatttaggatcattaaaa

SEQ ID NO: 30013 - DNA, 20 bp, Artificial Sequence
  chemically synthesized
aatgttgtcacacataatga

SEQ ID NO: 30014 - DNA, 20 bp, Artificial Sequence
  chemically synthesized
cacataatgaaagttaattt

SEQ ID NO: 30015 - DNA, 20 bp, Artificial Sequence
  chemically synthesized
aagttaatttaagaattgta

SEQ ID NO: 30016 - DNA, 20 bp, Artificial Sequence
  chemically synthesized
tttaagaattgtaaagactt

SEQ ID NO: 30017 - DNA, 20 bp, Artificial Sequence
  chemically synthesized
ttgtaaagacttgagcgatg

SEQ ID NO: 30018 - DNA, 20 bp, Artificial Sequence
  chemically synthesized
taaatgcttccctcttaaaa

SEQ ID NO: 30019 - DNA, 20 bp, Artificial Sequence
  chemically synthesized
gcttccctcttaaaatggac

SEQ ID NO: 30020 - DNA, 20 bp, Artificial Sequence
  chemically synthesized
gaaacaatttgtttttgcct

SEQ ID NO: 30021 - DNA, 20 bp, Artificial Sequence
  chemically synthesized
tgcctaagccaacgtattgc

SEQ ID NO: 30022 - DNA, 20 bp, Artificial Sequence
  chemically synthesized
taatttacctgcttcctcct

SEQ ID NO: 30023 - DNA, 20 bp, Artificial Sequence
  chemically synthesized
cactacacctctgaattaca

SEQ ID NO: 30024 - DNA, 20 bp, Artificial Sequence
  chemically synthesized
acctctgaattacatggtac

SEQ ID NO: 30025 - DNA, 20 bp, Artificial Sequence
  chemically synthesized
tctgaattacatggtacaag

SEQ ID NO: 30026 - DNA, 20 bp, Artificial Sequence
  chemically synthesized
attacatggtacaagtggca

SEQ ID NO: 30027 - DNA, 20 bp, Artificial Sequence
  chemically synthesized
ttacatggtacaagtggcac

SEQ ID NO: 30028 - DNA, 20 bp, Artificial Sequence
  chemically synthesized
tacatggtacaagtggcaca

SEQ ID NO: 30029 - DNA, 20 bp, Artificial Sequence
  chemically synthesized
atggtacaagtggcacaggg

SEQ ID NO: 30030 - DNA, 20 bp, Artificial Sequence
  chemically synthesized
aagtggcacagggaagaatt

SEQ ID NO: 30031 - DNA, 20 bp, Artificial Sequence
  chemically synthesized
cagggaagaattcagaaaac

SEQ ID NO: 30032 - DNA, 20 bp, Artificial Sequence
  chemically synthesized
gggaagaattcagaaaacta

SEQ ID NO: 30033 - DNA, 20 bp, Artificial Sequence
  chemically synthesized
aattcagaaaactagagtca

SEQ ID NO: 30034 - DNA, 20 bp, Artificial Sequence
  chemically synthesized
tcagaaaactagagtcaaag

SEQ ID NO: 30035 - DNA, 20 bp, Artificial Sequence
  chemically synthesized
aactagagtcaaagtggtta

SEQ ID NO: 30036 - DNA, 20 bp, Artificial Sequence
  chemically synthesized
tagagtcaaagtggttatgg

SEQ ID NO: 30037 - DNA, 20 bp, Artificial Sequence
  chemically synthesized
atggaagaaattataataat

SEQ ID NO: 30038 - DNA, 20 bp, Artificial Sequence
  chemically synthesized
taataatgagtccactcttc

SEQ ID NO: 30039 - DNA, 20 bp, Artificial Sequence
  chemically synthesized
aataatgagtccactcttct

SEQ ID NO: 30040 - DNA, 20 bp, Artificial Sequence
  chemically synthesized
atgagtccactcttctagga

SEQ ID NO: 30041 - DNA, 20 bp, Artificial Sequence
  chemically synthesized
tgagtccactcttctaggac

SEQ ID NO: 30042 - DNA, 20 bp, Artificial Sequence
  chemically synthesized
agtccactcttctaggacag

SEQ ID NO: 30043 - DNA, 20 bp, Artificial Sequence
  chemically synthesized
cttctaggacaggagttcta

SEQ ID NO: 30044 - DNA, 20 bp, Artificial Sequence
  chemically synthesized
ttctaggacaggagttctaa

SEQ ID NO: 30045 - DNA, 20 bp, Artificial Sequence
  chemically synthesized
aggacaggagttctaaaggt

SEQ ID NO: 30046 - DNA, 20 bp, Artificial Sequence
  chemically synthesized
ggacaggagttctaaaggtg

SEQ ID NO: 30047 - DNA, 20 bp, Artificial Sequence
  chemically synthesized
aaaggtgaggactttgatat

SEQ ID NO: 30048 - DNA, 20 bp, Artificial Sequence
  chemically synthesized
actttgatataagtgaactc

SEQ ID NO: 30049 - DNA, 20 bp, Artificial Sequence
  chemically synthesized
ctttgatataagtgaactca

SEQ ID NO: 30050 - DNA, 20 bp, Artificial Sequence
  chemically synthesized
ttgatataagtgaactcaag

SEQ ID NO: 30051 - DNA, 20 bp, Artificial Sequence
  chemically synthesized
tcaaggagtttctaaacctt

SEQ ID NO: 30052 - DNA, 20 bp, Artificial Sequence
  chemically synthesized
cagaaattatatctaaaaat

SEQ ID NO: 30053 - DNA, 20 bp, Artificial Sequence
  chemically synthesized
agaaattatatctaaaaatt

SEQ ID NO: 30054 - DNA, 20 bp, Artificial Sequence
  chemically synthesized
aaaaattaggtgcacgtata

SEQ ID NO: 30055 - DNA, 20 bp, Artificial Sequence
  chemically synthesized
aattaggtgcacgtatatag

SEQ ID NO: 30056 - DNA, 20 bp, Artificial Sequence
  chemically synthesized
atatagaagtacttttctct

SEQ ID NO: 30057 - DNA, 20 bp, Artificial Sequence
  chemically synthesized
tagaagtacttttctctgag

SEQ ID NO: 30058 - DNA, 20 bp, Artificial Sequence
  chemically synthesized
gaagtacttttctctgagaa

SEQ ID NO: 30059 - DNA, 20 bp, Artificial Sequence
  chemically synthesized
aagtacttttctctgagaag

SEQ ID NO: 30060 - DNA, 20 bp, Artificial Sequence
  chemically synthesized
agaggacttcacacttccat

SEQ ID NO: 30061 - DNA, 20 bp, Artificial Sequence
  chemically synthesized
acacttccatcagcttcctg

SEQ ID NO: 30062 - DNA, 20 bp, Artificial Sequence
  chemically synthesized
cacttccatcagcttcctga

SEQ ID NO: 30063 - DNA, 20 bp, Artificial Sequence
  chemically synthesized
aggcccctgtaattgccgta

SEQ ID NO: 30064 - DNA, 20 bp, Artificial Sequence
  chemically synthesized
cgtaaagaacaactgctcta

SEQ ID NO: 30065 - DNA, 20 bp, Artificial Sequence
  chemically synthesized
actgctctaaagtttaatac

SEQ ID NO: 30066 - DNA, 20 bp, Artificial Sequence
  chemically synthesized
ctgctctaaagtttaatact

SEQ ID NO: 30067 - DNA, 20 bp, Artificial Sequence
  chemically synthesized
aagtttaatactaggctact

SEQ ID NO: 30068 - DNA, 20 bp, Artificial Sequence
  chemically synthesized
tcggctgttttttgttaaca

SEQ ID NO: 30069 - DNA, 20 bp, Artificial Sequence
  chemically synthesized
gctgttttttgttaacacag

SEQ ID NO: 30070 - DNA, 20 bp, Artificial Sequence
  chemically synthesized
taacacagaagttttccaaa

SEQ ID NO: 30071 - DNA, 20 bp, Artificial Sequence
  chemically synthesized
ttttccaaatggcttttctc

SEQ ID NO: 30072 - DNA, 20 bp, Artificial Sequence
  chemically synthesized
ttccaaatggcttttctcta

SEQ ID NO: 30073 - DNA, 20 bp, Artificial Sequence
  chemically synthesized
tttctctagagcaaaatgaa

SEQ ID NO: 30074 - DNA, 20 bp, Artificial Sequence
  chemically synthesized
ttctctagagcaaaatgaaa

SEQ ID NO: 30075 - DNA, 20 bp, Artificial Sequence
  chemically synthesized
aaaaggatcccatccttccc

SEQ ID NO: 30076 - DNA, 20 bp, Artificial Sequence
  chemically synthesized
cctaccccccaccactttta

SEQ ID NO: 30077 - DNA, 20 bp, Artificial Sequence
  chemically synthesized
accacttttaaagatccatc

SEQ ID NO: 30078 - DNA, 20 bp, Artificial Sequence
  chemically synthesized
ccacttttaaagatccatca

SEQ ID NO: 30079 - DNA, 20 bp, Artificial Sequence
  chemically synthesized
tttaaagatccatcaaggcc

SEQ ID NO: 30080 - DNA, 20 bp, Artificial Sequence
  chemically synthesized
agatccatcaaggcccagca

SEQ ID NO: 30081 - DNA, 20 bp, Artificial Sequence
  chemically synthesized
ctgtaatctcaacacttttc

SEQ ID NO: 30082 - DNA, 20 bp, Artificial Sequence
  chemically synthesized
tgtaatctcaacacttttca

SEQ ID NO: 30083 - DNA, 20 bp, Artificial Sequence
  chemically synthesized
tctcaacacttttcaaggct

SEQ ID NO: 30084 - DNA, 20 bp, Artificial Sequence
  chemically synthesized
ctcaacacttttcaaggctg

SEQ ID NO: 30085 - DNA, 20 bp, Artificial Sequence
  chemically synthesized
aacacttttcaaggctgagg

SEQ ID NO: 30086 - DNA, 20 bp, Artificial Sequence
  chemically synthesized
acacttttcaaggctgaggt

SEQ ID NO: 30087 - DNA, 20 bp, Artificial Sequence
  chemically synthesized
acttttcaaggctgaggtgg

SEQ ID NO: 30088 - DNA, 20 bp, Artificial Sequence
  chemically synthesized
ctgaggtgggagaattgttt

SEQ ID NO: 30089 - DNA, 20 bp, Artificial Sequence
  chemically synthesized
tgggagaattgtttgagacc

SEQ ID NO: 30090 - DNA, 20 bp, Artificial Sequence
  chemically synthesized
ggagaattgtttgagaccaa

SEQ ID NO: 30091 - DNA, 20 bp, Artificial Sequence
  chemically synthesized
aattgtttgagaccaagagt

SEQ ID NO: 30092 - DNA, 20 bp, Artificial Sequence
  chemically synthesized
tgagaccaagagttggatac

SEQ ID NO: 30093 - DNA, 20 bp, Artificial Sequence
  chemically synthesized
ccaagagttggataccagcc

SEQ ID NO: 30094 - DNA, 20 bp, Artificial Sequence
  chemically synthesized
caagagttggataccagcct

SEQ ID NO: 30095 - DNA, 20 bp, Artificial Sequence
  chemically synthesized
aagagttggataccagcctg

SEQ ID NO: 30096 - DNA, 20 bp, Artificial Sequence
  chemically synthesized
ggataccagcctggggaaca

SEQ ID NO: 30097 - DNA, 20 bp, Artificial Sequence
  chemically synthesized
gataccagcctggggaacat

SEQ ID NO: 30098 - DNA, 20 bp, Artificial Sequence
  chemically synthesized
ataccagcctggggaacata

SEQ ID NO: 30099 - DNA, 20 bp, Artificial Sequence
  chemically synthesized
accagcctggggaacatagg

SEQ ID NO: 30100 - DNA, 20 bp, Artificial Sequence
  chemically synthesized
atagggagaccctgtttcta

SEQ ID NO: 30101 - DNA, 20 bp, Artificial Sequence
  chemically synthesized
agaaatttaaaaaatttctc

SEQ ID NO: 30102 - DNA, 20 bp, Artificial Sequence
  chemically synthesized
atttaaaaaatttctctagc

SEQ ID NO: 30103 - DNA, 20 bp, Artificial Sequence
  chemically synthesized
aaaatttctctagctggcca

SEQ ID NO: 30104 - DNA, 20 bp, Artificial Sequence
  chemically synthesized
aatttctctagctggccatg

SEQ ID NO: 30105 - DNA, 20 bp, Artificial Sequence
  chemically synthesized
atttctctagctggccatgg

SEQ ID NO: 30106 - DNA, 20 bp, Artificial Sequence
  chemically synthesized
gccatggaggctcacacctg

SEQ ID NO: 30107 - DNA, 20 bp, Artificial Sequence
  chemically synthesized
gaggctcacacctgtagtcc

SEQ ID NO: 30108 - DNA, 20 bp, Artificial Sequence
  chemically synthesized
acctgtagtcctagctacct

SEQ ID NO: 30109 - DNA, 20 bp, Artificial Sequence
  chemically synthesized
ctgtagtcctagctacctga

SEQ ID NO: 30110 - DNA, 20 bp, Artificial Sequence
  chemically synthesized
tgtagtcctagctacctgag

SEQ ID NO: 30111 - DNA, 20 bp, Artificial Sequence
  chemically synthesized
cctagctacctgagaggcta

SEQ ID NO: 30112 - DNA, 20 bp, Artificial Sequence
  chemically synthesized
agctacctgagaggctaaag

SEQ ID NO: 30113 - DNA, 20 bp, Artificial Sequence
  chemically synthesized
gctacctgagaggctaaagc

SEQ ID NO: 30114 - DNA, 20 bp, Artificial Sequence
  chemically synthesized
tacctgagaggctaaagcag

SEQ ID NO: 30115 - DNA, 20 bp, Artificial Sequence
  chemically synthesized
acctgagaggctaaagcagg

SEQ ID NO: 30116 - DNA, 20 bp, Artificial Sequence
  chemically synthesized
gcaggaggatcaattgaatc

SEQ ID NO: 30117 - DNA, 20 bp, Artificial Sequence
  chemically synthesized
caggaggatcaattgaatcc

SEQ ID NO: 30118 - DNA, 20 bp, Artificial Sequence
  chemically synthesized
tcaattgaatccaggcgttc

SEQ ID NO: 30119 - DNA, 20 bp, Artificial Sequence
  chemically synthesized
ttgaatccaggcgttctagt

SEQ ID NO: 30120 - DNA, 20 bp, Artificial Sequence
  chemically synthesized
tgaatccaggcgttctagtg

SEQ ID NO: 30121 - DNA, 20 bp, Artificial Sequence
  chemically synthesized
caggcgttctagtgaggctt

SEQ ID NO: 30122 - DNA, 20 bp, Artificial Sequence
  chemically synthesized
cgttctagtgaggcttcagt

SEQ ID NO: 30123 - DNA, 20 bp, Artificial Sequence
  chemically synthesized
ctagtgaggcttcagtgagc

SEQ ID NO: 30124 - DNA, 20 bp, Artificial Sequence
  chemically synthesized
aagattgcaccattgcactc

SEQ ID NO: 30125 - DNA, 20 bp, Artificial Sequence
  chemically synthesized
ttgcaccattgcactccagc

SEQ ID NO: 30126 - DNA, 20 bp, Artificial Sequence
  chemically synthesized
tgcaccattgcactccagcc

SEQ ID NO: 30127 - DNA, 20 bp, Artificial Sequence
  chemically synthesized
gcaccattgcactccagccg

SEQ ID NO: 30128 - DNA, 20 bp, Artificial Sequence
  chemically synthesized
ttgcactccagccggggtga

SEQ ID NO: 30129 - DNA, 20 bp, Artificial Sequence
  chemically synthesized
gcactccagccggggtgaca

SEQ ID NO: 30130 - DNA, 20 bp, Artificial Sequence
  chemically synthesized
tccagccggggtgacagagt

SEQ ID NO: 30131 - DNA, 20 bp, Artificial Sequence
  chemically synthesized
agaccctgtttcaaacaaac

SEQ ID NO: 30132 - DNA, 20 bp, Artificial Sequence
  chemically synthesized
tgtttcaaacaaacaagcaa

SEQ ID NO: 30133 - DNA, 20 bp, Artificial Sequence
  chemically synthesized
aacaaacaagcaaaagcaaa

SEQ ID NO: 30134 - DNA, 20 bp, Artificial Sequence
  chemically synthesized
acttactatcttgctgtcta

SEQ ID NO: 30135 - DNA, 20 bp, Artificial Sequence
  chemically synthesized
tatcttgctgtctacagcta

SEQ ID NO: 30136 - DNA, 20 bp, Artificial Sequence
  chemically synthesized
ttgctgtctacagctaaagt

SEQ ID NO: 30137 - DNA, 20 bp, Artificial Sequence
  chemically synthesized
taaagtcagactgcatgatt

SEQ ID NO: 30138 - DNA, 20 bp, Artificial Sequence
  chemically synthesized
attccaactccaccatcacc

SEQ ID NO: 30139 - DNA, 20 bp, Artificial Sequence
  chemically synthesized
ttccaactccaccatcacct

SEQ ID NO: 30140 - DNA, 20 bp, Artificial Sequence
  chemically synthesized
accatcacctgggtaatgtt

SEQ ID NO: 30141 - DNA, 20 bp, Artificial Sequence
  chemically synthesized
taatgttgagatttattaca

SEQ ID NO: 30142 - DNA, 20 bp, Artificial Sequence
  chemically synthesized
tacatagcatctctgtgcct

SEQ ID NO: 30143 - DNA, 20 bp, Artificial Sequence
  chemically synthesized
aataatgttgtgaaaattaa

SEQ ID NO: 30144 - DNA, 20 bp, Artificial Sequence
  chemically synthesized
gtgaaaattaaaagaaatac

SEQ ID NO: 30145 - DNA, 20 bp, Artificial Sequence
  chemically synthesized
aataccagttgtaaatcact

SEQ ID NO: 30146 - DNA, 20 bp, Artificial Sequence
  chemically synthesized
aaatcactcagaactgtgcc

SEQ ID NO: 30147 - DNA, 20 bp, Artificial Sequence
  chemically synthesized
agcatttaataaacactctg

SEQ ID NO: 30148 - DNA, 20 bp, Artificial Sequence
  chemically synthesized
gcatttaataaacactctgt

SEQ ID NO: 30149 - DNA, 20 bp, Artificial Sequence
  chemically synthesized
aataaacactctgtaggtat

SEQ ID NO: 30150 - DNA, 20 bp, Artificial Sequence
  chemically synthesized
ataaaatttattcataaaat

SEQ ID NO: 30151 - DNA, 20 bp, Artificial Sequence
  chemically synthesized
taaaatttattcataaaatg

SEQ ID NO: 30152 - DNA, 20 bp, Artificial Sequence
  chemically synthesized
aatttattcataaaatgagg

SEQ ID NO: 30153 - DNA, 20 bp, Artificial Sequence
  chemically synthesized
tattcataaaatgaggaagt

SEQ ID NO: 30154 - DNA, 20 bp, Artificial Sequence
  chemically synthesized
tagctcatgtattgtcatac

SEQ ID NO: 30155 - DNA, 20 bp, Artificial Sequence
  chemically synthesized
taccagctttcactttgaat

SEQ ID NO: 30156 - DNA, 20 bp, Artificial Sequence
  chemically synthesized
attgcatttttaaacacaaa

SEQ ID NO: 30157 - DNA, 20 bp, Artificial Sequence
  chemically synthesized
tgcatttttaaacacaaaaa

SEQ ID NO: 30158 - DNA, 20 bp, Artificial Sequence
  chemically synthesized
aaacacaaaaagagaaataa

SEQ ID NO: 30159 - DNA, 20 bp, Artificial Sequence
  chemically synthesized
aacacaaaaagagaaataat

SEQ ID NO: 30160 - DNA, 20 bp, Artificial Sequence
  chemically synthesized
catcaatgttacttcaatca

SEQ ID NO: 30161 - DNA, 20 bp, Artificial Sequence
  chemically synthesized
atcaatgttacttcaatcac

SEQ ID NO: 30162 - DNA, 20 bp, Artificial Sequence
  chemically synthesized
tacttcaatcacgggatgca

SEQ ID NO: 30163 - DNA, 20 bp, Artificial Sequence
  chemically synthesized
atcacgggatgcatagtaat

SEQ ID NO: 30164 - DNA, 20 bp, Artificial Sequence
  chemically synthesized
tcacgggatgcatagtaatt

SEQ ID NO: 30165 - DNA, 20 bp, Artificial Sequence
  chemically synthesized
ctttgccctaattactgatg

SEQ ID NO: 30166 - DNA, 20 bp, Artificial Sequence
  chemically synthesized
ccctaattactgatgtggat

SEQ ID NO: 30167 - DNA, 20 bp, Artificial Sequence
  chemically synthesized
aattactgatgtggataagc

SEQ ID NO: 30168 - DNA, 20 bp, Artificial Sequence
  chemically synthesized
tactgatgtggataagccgg

SEQ ID NO: 30169 - DNA, 20 bp, Artificial Sequence
  chemically synthesized
actgatgtggataagccggt

SEQ ID NO: 30170 - DNA, 20 bp, Artificial Sequence
  chemically synthesized
aagccggtgggccatgtcaa

SEQ ID NO: 30171 - DNA, 20 bp, Artificial Sequence
  chemically synthesized
ggccatgtcaatggcatctc

SEQ ID NO: 30172 - DNA, 20 bp, Artificial Sequence
  chemically synthesized
atctatgtaaaaactatgct

SEQ ID NO: 30173 - DNA, 20 bp, Artificial Sequence
  chemically synthesized
aaaaactatgcttggttgca

SEQ ID NO: 30174 - DNA, 20 bp, Artificial Sequence
  chemically synthesized
atgcttggttgcacagcttc

SEQ ID NO: 30175 - DNA, 20 bp, Artificial Sequence
  chemically synthesized
tgcttggttgcacagcttca

SEQ ID NO: 30176 - DNA, 20 bp, Artificial Sequence
  chemically synthesized
tggttgcacagcttcaagga

SEQ ID NO: 30177 - DNA, 20 bp, Artificial Sequence
  chemically synthesized
cacagcttcaaggaaagcac

SEQ ID NO: 30178 - DNA, 20 bp, Artificial Sequence
  chemically synthesized
ctactcacttccttttcatt

SEQ ID NO: 30179 - DNA, 20 bp, Artificial Sequence
  chemically synthesized
ttcattcagcatgctatgtc

SEQ ID NO: 30180 - DNA, 20 bp, Artificial Sequence
  chemically synthesized
tcattcagcatgctatgtct

SEQ ID NO: 30181 - DNA, 20 bp, Artificial Sequence
  chemically synthesized
cccctttcatataaaatatt

SEQ ID NO: 30182 - DNA, 20 bp, Artificial Sequence
  chemically synthesized
cctttcatataaaatatttg

SEQ ID NO: 30183 - DNA, 20 bp, Artificial Sequence
  chemically synthesized
aatatttggagctgccattg

SEQ ID NO: 30184 - DNA, 20 bp, Artificial Sequence
  chemically synthesized
atatttggagctgccattgt

SEQ ID NO: 30185 - DNA, 20 bp, Artificial Sequence
  chemically synthesized
tttggagctgccattgtagg

SEQ ID NO: 30186 - DNA, 20 bp, Artificial Sequence
  chemically synthesized
agctgccattgtaggtagtg

SEQ ID NO: 30187 - DNA, 20 bp, Artificial Sequence
  chemically synthesized
gctgccattgtaggtagtgc

SEQ ID NO: 30188 - DNA, 20 bp, Artificial Sequence
  chemically synthesized
gccattgtaggtagtgcagg

SEQ ID NO: 30189 - DNA, 20 bp, Artificial Sequence
  chemically synthesized
agtgcaggtggtcttgttca

SEQ ID NO: 30190 - DNA, 20 bp, Artificial Sequence
  chemically synthesized
ggtggtcttgttcaaagtgt

SEQ ID NO: 30191 - DNA, 20 bp, Artificial Sequence
  chemically synthesized
gagtatcacctcccactgcc

SEQ ID NO: 30192 - DNA, 20 bp, Artificial Sequence
  chemically synthesized
acctcccactgccaagactg

SEQ ID NO: 30193 - DNA, 20 bp, Artificial Sequence
  chemically synthesized
cagctgctttgattttaact

SEQ ID NO: 30194 - DNA, 20 bp, Artificial Sequence
  chemically synthesized
agctgctttgattttaactg

SEQ ID NO: 30195 - DNA, 20 bp, Artificial Sequence
  chemically synthesized
tttgattttaactgaggatc

SEQ ID NO: 30196 - DNA, 20 bp, Artificial Sequence
  chemically synthesized
ttttaactgaggatctagaa

SEQ ID NO: 30197 - DNA, 20 bp, Artificial Sequence
  chemically synthesized
ctgaggatctagaaaagtgc

SEQ ID NO: 30198 - DNA, 20 bp, Artificial Sequence
  chemically synthesized
tgaggatctagaaaagtgct

SEQ ID NO: 30199 - DNA, 20 bp, Artificial Sequence
  chemically synthesized
tatttgctgacctttgtcac

SEQ ID NO: 30200 - DNA, 20 bp, Artificial Sequence
  chemically synthesized
ttgctgacctttgtcacaag

SEQ ID NO: 30201 - DNA, 20 bp, Artificial Sequence
  chemically synthesized
gcacctaatctccttcctac

SEQ ID NO: 30202 - DNA, 20 bp, Artificial Sequence
  chemically synthesized
gccttataaaatgatgttct

SEQ ID NO: 30203 - DNA, 20 bp, Artificial Sequence
  chemically synthesized
ctgcttctgcaactgtgttt

SEQ ID NO: 30204 - DNA, 20 bp, Artificial Sequence
  chemically synthesized
tctgcaactgtgttttggaa

SEQ ID NO: 30205 - DNA, 20 bp, Artificial Sequence
  chemically synthesized
ctgcaactgtgttttggaac

SEQ ID NO: 30206 - DNA, 20 bp, Artificial Sequence
  chemically synthesized
gcaactgtgttttggaacag

SEQ ID NO: 30207 - DNA, 20 bp, Artificial Sequence
  chemically synthesized
caactgtgttttggaacagg

SEQ ID NO: 30208 - DNA, 20 bp, Artificial Sequence
  chemically synthesized
aactgtgttttggaacagga

SEQ ID NO: 30209 - DNA, 20 bp, Artificial Sequence
  chemically synthesized
gtgttttggaacaggagggt

SEQ ID NO: 30210 - DNA, 20 bp, Artificial Sequence
  chemically synthesized
ttggaacaggagggtgagat

SEQ ID NO: 30211 - DNA, 20 bp, Artificial Sequence
  chemically synthesized
gaacaggagggtgagattag

SEQ ID NO: 30212 - DNA, 20 bp, Artificial Sequence
  chemically synthesized
agtagccacacacactgaaa

SEQ ID NO: 30213 - DNA, 20 bp, Artificial Sequence
  chemically synthesized
aaatagtcatatgacttcca

SEQ ID NO: 30214 - DNA, 20 bp, Artificial Sequence
  chemically synthesized
ttccaaagtctgtaattttt

SEQ ID NO: 30215 - DNA, 20 bp, Artificial Sequence
  chemically synthesized
atttttaagcatatacaaaa

SEQ ID NO: 30216 - DNA, 20 bp, Artificial Sequence
  chemically synthesized
tatgtgtgtatacatatata

SEQ ID NO: 30217 - DNA, 20 bp, Artificial Sequence
  chemically synthesized
tgtgtgtatacatatatata

SEQ ID NO: 30218 - DNA, 20 bp, Artificial Sequence
  chemically synthesized
tgtgtatacatatatataga

SEQ ID NO: 30219 - DNA, 20 bp, Artificial Sequence
  chemically synthesized
tgtatacatatatatagaga

SEQ ID NO: 30220 - DNA, 20 bp, Artificial Sequence
  chemically synthesized
tatacatatatatagagaga

SEQ ID NO: 30221 - DNA, 20 bp, Artificial Sequence
  chemically synthesized
catatatatagagagagaga

SEQ ID NO: 30222 - DNA, 20 bp, Artificial Sequence
  chemically synthesized
tatatatagagagagagaca

SEQ ID NO: 30223 - DNA, 20 bp, Artificial Sequence
  chemically synthesized
tatatagagagagagacaga

SEQ ID NO: 30224 - DNA, 20 bp, Artificial Sequence
  chemically synthesized
tatagagagagagacagaga

SEQ ID NO: 30225 - DNA, 20 bp, Artificial Sequence
  chemically synthesized
gagagagagacagagagaga

SEQ ID NO: 30226 - DNA, 20 bp, Artificial Sequence
  chemically synthesized
agagagagacagagagagat

SEQ ID NO: 30227 - DNA, 20 bp, Artificial Sequence
  chemically synthesized
gagagagacagagagagatg

SEQ ID NO: 30228 - DNA, 20 bp, Artificial Sequence
  chemically synthesized
agagagacagagagagatgg

SEQ ID NO: 30229 - DNA, 20 bp, Artificial Sequence
  chemically synthesized
agagacagagagagatgggg

SEQ ID NO: 30230 - DNA, 20 bp, Artificial Sequence
  chemically synthesized
agacagagagagatggggga

SEQ ID NO: 30231 - DNA, 20 bp, Artificial Sequence
  chemically synthesized
acagagagagatgggggaga

SEQ ID NO: 30232 - DNA, 20 bp, Artificial Sequence
  chemically synthesized
agagagagatgggggagaga

SEQ ID NO: 30233 - DNA, 20 bp, Artificial Sequence
  chemically synthesized
agagagatgggggagagaga

SEQ ID NO: 30234 - DNA, 20 bp, Artificial Sequence
  chemically synthesized
agagatgggggagagagaga

SEQ ID NO: 30235 - DNA, 20 bp, Artificial Sequence
  chemically synthesized
agatgggggagagagagaga

SEQ ID NO: 30236 - DNA, 20 bp, Artificial Sequence
  chemically synthesized
atgggggagagagagagaga

SEQ ID NO: 30237 - DNA, 20 bp, Artificial Sequence
  chemically synthesized
gggagagagagagagagagc

SEQ ID NO: 30238 - DNA, 20 bp, Artificial Sequence
  chemically synthesized
gagagagagagagagagcga

SEQ ID NO: 30239 - DNA, 20 bp, Artificial Sequence
  chemically synthesized
gagagagagagagagcgaga

SEQ ID NO: 30240 - DNA, 20 bp, Artificial Sequence
  chemically synthesized
gagagagagagagcgagaga

SEQ ID NO: 30241 - DNA, 20 bp, Artificial Sequence
  chemically synthesized
agagagagagagcgagagag

SEQ ID NO: 30242 - DNA, 20 bp, Artificial Sequence
  chemically synthesized
gagagagagcgagagagagg

SEQ ID NO: 30243 - DNA, 20 bp, Artificial Sequence
  chemically synthesized
gagagagcgagagagaggca

SEQ ID NO: 30244 - DNA, 20 bp, Artificial Sequence
  chemically synthesized
gagcgagagagaggcagaga

SEQ ID NO: 30245 - DNA, 20 bp, Artificial Sequence
  chemically synthesized
gcgagagagaggcagagaaa

SEQ ID NO: 30246 - DNA, 20 bp, Artificial Sequence
  chemically synthesized
agagaaagagatccttattt

SEQ ID NO: 30247 - DNA, 20 bp, Artificial Sequence
  chemically synthesized
tattctatacttctttgaaa

SEQ ID NO: 30248 - DNA, 20 bp, Artificial Sequence
  chemically synthesized
ttctttgaaatagtgatttt

SEQ ID NO: 30249 - DNA, 20 bp, Artificial Sequence
  chemically synthesized
aatagtgatttttagtaaat

SEQ ID NO: 30250 - DNA, 20 bp, Artificial Sequence
  chemically synthesized
agtgatttttagtaaattgg

SEQ ID NO: 30251 - DNA, 20 bp, Artificial Sequence
  chemically synthesized
tagtaaattggcagtgttgc

SEQ ID NO: 30252 - DNA, 20 bp, Artificial Sequence
  chemically synthesized
agtgttgccagatgacgact

SEQ ID NO: 30253 - DNA, 20 bp, Artificial Sequence
  chemically synthesized
tgttgccagatgacgactta

SEQ ID NO: 30254 - DNA, 20 bp, Artificial Sequence
  chemically synthesized
cctcattgttatatgtacca

SEQ ID NO: 30255 - DNA, 20 bp, Artificial Sequence
  chemically synthesized
cattgttatatgtaccatgg

SEQ ID NO: 30256 - DNA, 20 bp, Artificial Sequence
  chemically synthesized
tggtagctcatcttttcttt

SEQ ID NO: 30257 - DNA, 20 bp, Artificial Sequence
  chemically synthesized
ggtagctcatcttttctttc

SEQ ID NO: 30258 - DNA, 20 bp, Artificial Sequence
  chemically synthesized
tcatcttttctttcaggtga

SEQ ID NO: 30259 - DNA, 20 bp, Artificial Sequence
  chemically synthesized
ctttgtcctcacgctaaaca

SEQ ID NO: 30260 - DNA, 20 bp, Artificial Sequence
  chemically synthesized
acatagcccccatgttgttc

SEQ ID NO: 30261 - DNA, 20 bp, Artificial Sequence
  chemically synthesized
catagcccccatgttgttcc

SEQ ID NO: 30262 - DNA, 20 bp, Artificial Sequence
  chemically synthesized
cccatgttgttccaggaaaa

SEQ ID NO: 30263 - DNA, 20 bp, Artificial Sequence
  chemically synthesized
catgttgttccaggaaaata

SEQ ID NO: 30264 - DNA, 20 bp, Artificial Sequence
  chemically synthesized
atagagatcaataaaataca

SEQ ID NO: 30265 - DNA, 20 bp, Artificial Sequence
  chemically synthesized
aatacaaagtacttgtttga

SEQ ID NO: 30266 - DNA, 20 bp, Artificial Sequence
  chemically synthesized
aaagtacttgtttgaaagtg

SEQ ID NO: 30267 - DNA, 20 bp, Artificial Sequence
  chemically synthesized
aagtacttgtttgaaagtga

SEQ ID NO: 30268 - DNA, 20 bp, Artificial Sequence
  chemically synthesized
cttgtttgaaagtgaaggtt

SEQ ID NO: 30269 - DNA, 20 bp, Artificial Sequence
  chemically synthesized
aaattcaatgacctacgctg

SEQ ID NO: 30270 - DNA, 20 bp, Artificial Sequence
  chemically synthesized
gatcattcattaatgatatt

SEQ ID NO: 30271 - DNA, 20 bp, Artificial Sequence
  chemically synthesized
agtattttcttttttaatgt

SEQ ID NO: 30272 - DNA, 20 bp, Artificial Sequence
  chemically synthesized
agaataaaaccatttatttg

SEQ ID NO: 30273 - DNA, 20 bp, Artificial Sequence
  chemically synthesized
tatgtgtatgtaaatctcct

SEQ ID NO: 30274 - DNA, 20 bp, Artificial Sequence
  chemically synthesized
ttatacctcaaatatgaaaa

SEQ ID NO: 30275 - DNA, 20 bp, Artificial Sequence
  chemically synthesized
tatacctcaaatatgaaaat

SEQ ID NO: 30276 - DNA, 20 bp, Artificial Sequence
  chemically synthesized
tcttgcattcacttatattc

SEQ ID NO: 30277 - DNA, 20 bp, Artificial Sequence
  chemically synthesized
cacttatattctagcttgtt

SEQ ID NO: 30278 - DNA, 20 bp, Artificial Sequence
  chemically synthesized
cttatattctagcttgttaa

SEQ ID NO: 30279 - DNA, 20 bp, Artificial Sequence
  chemically synthesized
tatattctagcttgttaaga

SEQ ID NO: 30280 - DNA, 20 bp, Artificial Sequence
  chemically synthesized
attctagcttgttaagagag

SEQ ID NO: 30281 - DNA, 20 bp, Artificial Sequence
  chemically synthesized
agcttgttaagagagaagtt

SEQ ID NO: 30282 - DNA, 20 bp, Artificial Sequence
  chemically synthesized
gcttgttaagagagaagttt

SEQ ID NO: 30283 - DNA, 20 bp, Artificial Sequence
  chemically synthesized
cttgttaagagagaagtttg

SEQ ID NO: 30284 - DNA, 20 bp, Artificial Sequence
  chemically synthesized
ggcaaaatgtgctttataaa

SEQ ID NO: 30285 - DNA, 20 bp, Artificial Sequence
  chemically synthesized
ctttataaatagtaaaaact

SEQ ID NO: 30286 - DNA, 20 bp, Artificial Sequence
  chemically synthesized
tttataaatagtaaaaactg

SEQ ID NO: 30287 - DNA, 20 bp, Artificial Sequence
  chemically synthesized
gtaaaaactgaggtaaacta

SEQ ID NO: 30288 - DNA, 20 bp, Artificial Sequence
  chemically synthesized
ctgaggtaaactatagcaca

SEQ ID NO: 30289 - DNA, 20 bp, Artificial Sequence
  chemically synthesized
cacaaagtgtgctatataaa

SEQ ID NO: 30290 - DNA, 20 bp, Artificial Sequence
  chemically synthesized
ctatataaacagtaaaaacc

SEQ ID NO: 30291 - DNA, 20 bp, Artificial Sequence
  chemically synthesized
tatataaacagtaaaaaccg

SEQ ID NO: 30292 - DNA, 20 bp, Artificial Sequence
  chemically synthesized
taaaaaccgaggtaaaaata

SEQ ID NO: 30293 - DNA, 20 bp, Artificial Sequence
  chemically synthesized
aaaaaccgaggtaaaaatat

SEQ ID NO: 30294 - DNA, 20 bp, Artificial Sequence
  chemically synthesized
aaaaccgaggtaaaaatatg

SEQ ID NO: 30295 - DNA, 20 bp, Artificial Sequence
  chemically synthesized
aaccgaggtaaaaatatggg

SEQ ID NO: 30296 - DNA, 20 bp, Artificial Sequence
  chemically synthesized
accgaggtaaaaatatgggg

SEQ ID NO: 30297 - DNA, 20 bp, Artificial Sequence
  chemically synthesized
aaaatatggggaggacaaaa

SEQ ID NO: 30298 - DNA, 20 bp, Artificial Sequence
  chemically synthesized
aaatatggggaggacaaaaa

SEQ ID NO: 30299 - DNA, 20 bp, Artificial Sequence
  chemically synthesized
aatatggggaggacaaaaaa

SEQ ID NO: 30300 - DNA, 20 bp, Artificial Sequence
  chemically synthesized
aggacaaaaaagggctaaaa

SEQ ID NO: 30301 - DNA, 20 bp, Artificial Sequence
  chemically synthesized
aaaaagggctaaaatggtgt

SEQ ID NO: 30302 - DNA, 20 bp, Artificial Sequence
  chemically synthesized
ctaaaatggtgttggaatat

SEQ ID NO: 30303 - DNA, 20 bp, Artificial Sequence
  chemically synthesized
tggtgttggaatataagaaa

SEQ ID NO: 30304 - DNA, 20 bp, Artificial Sequence
  chemically synthesized
tgttggaatataagaaatag

SEQ ID NO: 30305 - DNA, 20 bp, Artificial Sequence
  chemically synthesized
aatataagaaatagcagtaa

SEQ ID NO: 30306 - DNA, 20 bp, Artificial Sequence
  chemically synthesized
ataagaaatagcagtaaaag

SEQ ID NO: 30307 - DNA, 20 bp, Artificial Sequence
  chemically synthesized
gcagtaaaagaagctcctca

SEQ ID NO: 30308 - DNA, 20 bp, Artificial Sequence
  chemically synthesized
taaaagaagctcctcacagc

SEQ ID NO: 30309 - DNA, 20 bp, Artificial Sequence
  chemically synthesized
agaagctcctcacagcaaga

SEQ ID NO: 30310 - DNA, 20 bp, Artificial Sequence
  chemically synthesized
ctcctcacagcaagacagta

SEQ ID NO: 30311 - DNA, 20 bp, Artificial Sequence
  chemically synthesized
tcctcacagcaagacagtac

SEQ ID NO: 30312 - DNA, 20 bp, Artificial Sequence
  chemically synthesized
cctcacagcaagacagtaca

SEQ ID NO: 30313 - DNA, 20 bp, Artificial Sequence
  chemically synthesized
agacagtacagggaaatgtc

SEQ ID NO: 30314 - DNA, 20 bp, Artificial Sequence
  chemically synthesized
acagtacagggaaatgtctg

SEQ ID NO: 30315 - DNA, 20 bp, Artificial Sequence
  chemically synthesized
cagtacagggaaatgtctgg

SEQ ID NO: 30316 - DNA, 20 bp, Artificial Sequence
  chemically synthesized
agtacagggaaatgtctgga

SEQ ID NO: 30317 - DNA, 20 bp, Artificial Sequence
  chemically synthesized
gggaaatgtctggagggaca

SEQ ID NO: 30318 - DNA, 20 bp, Artificial Sequence
  chemically synthesized
gacaaagatttacttacaat

SEQ ID NO: 30319 - DNA, 20 bp, Artificial Sequence
  chemically synthesized
acaaagatttacttacaatc

SEQ ID NO: 30320 - DNA, 20 bp, Artificial Sequence
  chemically synthesized
aatcaggcctcaaccaatat

SEQ ID NO: 30321 - DNA, 20 bp, Artificial Sequence
  chemically synthesized
tatgacgtgtttatatgtat

SEQ ID NO: 30322 - DNA, 20 bp, Artificial Sequence
  chemically synthesized
atgacgtgtttatatgtatc

SEQ ID NO: 30323 - DNA, 20 bp, Artificial Sequence
  chemically synthesized
gcatataatgtataatgatc

SEQ ID NO: 30324 - DNA, 20 bp, Artificial Sequence
  chemically synthesized
ataatgtataatgatcaagt

SEQ ID NO: 30325 - DNA, 20 bp, Artificial Sequence
  chemically synthesized
taatgtataatgatcaagtc

SEQ ID NO: 30326 - DNA, 20 bp, Artificial Sequence
  chemically synthesized
taatgatcaagtcaggtatt

SEQ ID NO: 30327 - DNA, 20 bp, Artificial Sequence
  chemically synthesized
aatgatcaagtcaggtattt

SEQ ID NO: 30328 - DNA, 20 bp, Artificial Sequence
  chemically synthesized
atgatcaagtcaggtatttg

SEQ ID NO: 30329 - DNA, 20 bp, Artificial Sequence
  chemically synthesized
tttggggtattcatcacctc

SEQ ID NO: 30330 - DNA, 20 bp, Artificial Sequence
  chemically synthesized
tatttatcgtttctatgtgt

SEQ ID NO: 30331 - DNA, 20 bp, Artificial Sequence
  chemically synthesized
atttatcgtttctatgtgtt

SEQ ID NO: 30332 - DNA, 20 bp, Artificial Sequence
  chemically synthesized
ctatgtgttaggaacatttc

SEQ ID NO: 30333 - DNA, 20 bp, Artificial Sequence
  chemically synthesized
cctactttgctattgaacat

SEQ ID NO: 30334 - DNA, 20 bp, Artificial Sequence
  chemically synthesized
tacacacctttctctacctc

SEQ ID NO: 30335 - DNA, 20 bp, Artificial Sequence
  chemically synthesized
ctacatgatattaacttttt

SEQ ID NO: 30336 - DNA, 20 bp, Artificial Sequence
  chemically synthesized
cttttttagctcccacatat

SEQ ID NO: 30337 - DNA, 20 bp, Artificial Sequence
  chemically synthesized
tttagctcccacatatcagt

SEQ ID NO: 30338 - DNA, 20 bp, Artificial Sequence
  chemically synthesized
aaaatttgtctttctatgcc

SEQ ID NO: 30339 - DNA, 20 bp, Artificial Sequence
  chemically synthesized
tcgtttaacataatgacttc

SEQ ID NO: 30340 - DNA, 20 bp, Artificial Sequence
  chemically synthesized
gaaatgattttatatttgta

SEQ ID NO: 30341 - DNA, 20 bp, Artificial Sequence
  chemically synthesized
tttcttcattcatccattga

SEQ ID NO: 30342 - DNA, 20 bp, Artificial Sequence
  chemically synthesized
ttcatccattgatggacact

SEQ ID NO: 30343 - DNA, 20 bp, Artificial Sequence
  chemically synthesized
tcatccattgatggacactt

SEQ ID NO: 30344 - DNA, 20 bp, Artificial Sequence
  chemically synthesized
gtgaatcgtgctgcaataaa

SEQ ID NO: 30345 - DNA, 20 bp, Artificial Sequence
  chemically synthesized
tcgtgctgcaataaacagtg

SEQ ID NO: 30346 - DNA, 20 bp, Artificial Sequence
  chemically synthesized
tgcaataaacagtgtggtac

SEQ ID NO: 30347 - DNA, 20 bp, Artificial Sequence
  chemically synthesized
tattctgaattcttttcctt

SEQ ID NO: 30348 - DNA, 20 bp, Artificial Sequence
  chemically synthesized
ttttcctttggataaatacc

SEQ ID NO: 30349 - DNA, 20 bp, Artificial Sequence
  chemically synthesized
ttggataaatacccagtaat

SEQ ID NO: 30350 - DNA, 20 bp, Artificial Sequence
  chemically synthesized
atacccagtaataagattgc

SEQ ID NO: 30351 - DNA, 20 bp, Artificial Sequence
  chemically synthesized
aagattgctggatcttatga

SEQ ID NO: 30352 - DNA, 20 bp, Artificial Sequence
  chemically synthesized
tcttatgatagttcaatttt

SEQ ID NO: 30353 - DNA, 20 bp, Artificial Sequence
  chemically synthesized
tagttcaatttttagctttt

SEQ ID NO: 30354 - DNA, 20 bp, Artificial Sequence
  chemically synthesized
aatctacatattgttttcca

SEQ ID NO: 30355 - DNA, 20 bp, Artificial Sequence
  chemically synthesized
ctacatattgttttccatag

SEQ ID NO: 30356 - DNA, 20 bp, Artificial Sequence
  chemically synthesized
ctaatttgcatgcttaccaa

SEQ ID NO: 30357 - DNA, 20 bp, Artificial Sequence
  chemically synthesized
tgcttaccaatagtgcctac

SEQ ID NO: 30358 - DNA, 20 bp, Artificial Sequence
  chemically synthesized
cttttccttcacatccttgc

SEQ ID NO: 30359 - DNA, 20 bp, Artificial Sequence
  chemically synthesized
taaatcatgatgattctaac

SEQ ID NO: 30360 - DNA, 20 bp, Artificial Sequence
  chemically synthesized
atgatgattctaactggcat

SEQ ID NO: 30361 - DNA, 20 bp, Artificial Sequence
  chemically synthesized
cataagatgatatctcattg

SEQ ID NO: 30362 - DNA, 20 bp, Artificial Sequence
  chemically synthesized
atttgcatttctctgatgat

SEQ ID NO: 30363 - DNA, 20 bp, Artificial Sequence
  chemically synthesized
ctctgatgattagtaatgtt

SEQ ID NO: 30364 - DNA, 20 bp, Artificial Sequence
  chemically synthesized
tcctttgccaattttttaat

SEQ ID NO: 30365 - DNA, 20 bp, Artificial Sequence
  chemically synthesized
ttatttgtttttccactgtt

SEQ ID NO: 30366 - DNA, 20 bp, Artificial Sequence
  chemically synthesized
tttccactgttgagttgttt

SEQ ID NO: 30367 - DNA, 20 bp, Artificial Sequence
  chemically synthesized
tttgagtttcttatatattc

SEQ ID NO: 30368 - DNA, 20 bp, Artificial Sequence
  chemically synthesized
tgagtttcttatatattctg

SEQ ID NO: 30369 - DNA, 20 bp, Artificial Sequence
  chemically synthesized
aaatattttctcgcattcaa

SEQ ID NO: 30370 - DNA, 20 bp, Artificial Sequence
  chemically synthesized
tgattgtttcctttactgtg

SEQ ID NO: 30371 - DNA, 20 bp, Artificial Sequence
  chemically synthesized
tttactgtgcagatgtattt

SEQ ID NO: 30372 - DNA, 20 bp, Artificial Sequence
  chemically synthesized
agatgtattttagcttaata

SEQ ID NO: 30373 - DNA, 20 bp, Artificial Sequence
  chemically synthesized
cttttgttgcctgtgctttt

SEQ ID NO: 30374 - DNA, 20 bp, Artificial Sequence
  chemically synthesized
ttttgttgcctgtgcttttg

SEQ ID NO: 30375 - DNA, 20 bp, Artificial Sequence
  chemically synthesized
tgcctgtgcttttgaggtct

SEQ ID NO: 30376 - DNA, 20 bp, Artificial Sequence
  chemically synthesized
ggccataaaatctttgccca

SEQ ID NO: 30377 - DNA, 20 bp, Artificial Sequence
  chemically synthesized
ttgcccaaagccatgtcttg

SEQ ID NO: 30378 - DNA, 20 bp, Artificial Sequence
  chemically synthesized
gtctcccttatgttttcttt

SEQ ID NO: 30379 - DNA, 20 bp, Artificial Sequence
  chemically synthesized
tcccttatgttttcttttag

SEQ ID NO: 30380 - DNA, 20 bp, Artificial Sequence
  chemically synthesized
gttttcttttagtagtttta

SEQ ID NO: 30381 - DNA, 20 bp, Artificial Sequence
  chemically synthesized
tttagtagttttatagtttt

SEQ ID NO: 30382 - DNA, 20 bp, Artificial Sequence
  chemically synthesized
tagttttaagttttatattt

SEQ ID NO: 30383 - DNA, 20 bp, Artificial Sequence
  chemically synthesized
ttaagtctttaatccatctt

SEQ ID NO: 30384 - DNA, 20 bp, Artificial Sequence
  chemically synthesized
aagtctttaatccatcttga

SEQ ID NO: 30385 - DNA, 20 bp, Artificial Sequence
  chemically synthesized
tcttgagagtacgttttata

SEQ ID NO: 30386 - DNA, 20 bp, Artificial Sequence
  chemically synthesized
acgttttatatggcaataaa

SEQ ID NO: 30387 - DNA, 20 bp, Artificial Sequence
  chemically synthesized
cgttttatatggcaataaat

SEQ ID NO: 30388 - DNA, 20 bp, Artificial Sequence
  chemically synthesized
gttttatatggcaataaata

SEQ ID NO: 30389 - DNA, 20 bp, Artificial Sequence
  chemically synthesized
ttttatatggcaataaatag

SEQ ID NO: 30390 - DNA, 20 bp, Artificial Sequence
  chemically synthesized
gcaataaataggggttgtat

SEQ ID NO: 30391 - DNA, 20 bp, Artificial Sequence
  chemically synthesized
caataaataggggttgtatt

SEQ ID NO: 30392 - DNA, 20 bp, Artificial Sequence
  chemically synthesized
catttttgcatctattgtac

SEQ ID NO: 30393 - DNA, 20 bp, Artificial Sequence
  chemically synthesized
atttttgcatctattgtaca

SEQ ID NO: 30394 - DNA, 20 bp, Artificial Sequence
  chemically synthesized
tttttgcatctattgtacaa

SEQ ID NO: 30395 - DNA, 20 bp, Artificial Sequence
  chemically synthesized
ttttgcatctattgtacaag

SEQ ID NO: 30396 - DNA, 20 bp, Artificial Sequence
  chemically synthesized
catctattgtacaaggggtt

SEQ ID NO: 30397 - DNA, 20 bp, Artificial Sequence
  chemically synthesized
tcttgatttgattctccatt

SEQ ID NO: 30398 - DNA, 20 bp, Artificial Sequence
  chemically synthesized
attctccatttggttgctgt

SEQ ID NO: 30399 - DNA, 20 bp, Artificial Sequence
  chemically synthesized
atttggttgctgttggtgta

SEQ ID NO: 30400 - DNA, 20 bp, Artificial Sequence
  chemically synthesized
tggttgctgttggtgtatag

SEQ ID NO: 30401 - DNA, 20 bp, Artificial Sequence
  chemically synthesized
gttgctgttggtgtatagaa

SEQ ID NO: 30402 - DNA, 20 bp, Artificial Sequence
  chemically synthesized
gtgtgcattcatcttgtatc

SEQ ID NO: 30403 - DNA, 20 bp, Artificial Sequence
  chemically synthesized
actttgctgaattattttat

SEQ ID NO: 30404 - DNA, 20 bp, Artificial Sequence
  chemically synthesized
ctgaattattttatcagttc

SEQ ID NO: 30405 - DNA, 20 bp, Artificial Sequence
  chemically synthesized
tgaattattttatcagttct

SEQ ID NO: 30406 - DNA, 20 bp, Artificial Sequence
  chemically synthesized
aattattttatcagttctag

SEQ ID NO: 30407 - DNA, 20 bp, Artificial Sequence
  chemically synthesized
tatcagttctaggagctttc

SEQ ID NO: 30408 - DNA, 20 bp, Artificial Sequence
  chemically synthesized
tcagttctaggagctttctg

SEQ ID NO: 30409 - DNA, 20 bp, Artificial Sequence
  chemically synthesized
cagttctaggagctttctgg

SEQ ID NO: 30410 - DNA, 20 bp, Artificial Sequence
  chemically synthesized
gttctaggagctttctggag

SEQ ID NO: 30411 - DNA, 20 bp, Artificial Sequence
  chemically synthesized
gagctttctggaggagtctt

SEQ ID NO: 30412 - DNA, 20 bp, Artificial Sequence
  chemically synthesized
agctttctggaggagtcttt

SEQ ID NO: 30413 - DNA, 20 bp, Artificial Sequence
  chemically synthesized
gctttctggaggagtcttta

SEQ ID NO: 30414 - DNA, 20 bp, Artificial Sequence
  chemically synthesized
gaggagtctttagggtttta

SEQ ID NO: 30415 - DNA, 20 bp, Artificial Sequence
  chemically synthesized
aggagtctttagggttttaa

SEQ ID NO: 30416 - DNA, 20 bp, Artificial Sequence
  chemically synthesized
aaggtaaatgatcatatcat

SEQ ID NO: 30417 - DNA, 20 bp, Artificial Sequence
  chemically synthesized
atgatcatatcatcagcaaa

SEQ ID NO: 30418 - DNA, 20 bp, Artificial Sequence
  chemically synthesized
atatcatcagcaaacagtga

SEQ ID NO: 30419 - DNA, 20 bp, Artificial Sequence
  chemically synthesized
tttgttttgtctgattgccc

SEQ ID NO: 30420 - DNA, 20 bp, Artificial Sequence
  chemically synthesized
ttttgtctgattgccctggc

SEQ ID NO: 30421 - DNA, 20 bp, Artificial Sequence
  chemically synthesized
tttgtctgattgccctggct

SEQ ID NO: 30422 - DNA, 20 bp, Artificial Sequence
  chemically synthesized
attgccctggctaggacttc

SEQ ID NO: 30423 - DNA, 20 bp, Artificial Sequence
  chemically synthesized
ggacttccagtactatgttg

SEQ ID NO: 30424 - DNA, 20 bp, Artificial Sequence
  chemically synthesized
acttccagtactatgttgaa

SEQ ID NO: 30425 - DNA, 20 bp, Artificial Sequence
  chemically synthesized
cttccagtactatgttgaag

SEQ ID NO: 30426 - DNA, 20 bp, Artificial Sequence
  chemically synthesized
tccagtactatgttgaagag

SEQ ID NO: 30427 - DNA, 20 bp, Artificial Sequence
  chemically synthesized
agtactatgttgaagaggag

SEQ ID NO: 30428 - DNA, 20 bp, Artificial Sequence
  chemically synthesized
ctatgttgaagaggagtggt

SEQ ID NO: 30429 - DNA, 20 bp, Artificial Sequence
  chemically synthesized
atgttgaagaggagtggtga

SEQ ID NO: 30430 - DNA, 20 bp, Artificial Sequence
  chemically synthesized
ttgaagaggagtggtgagag

SEQ ID NO: 30431 - DNA, 20 bp, Artificial Sequence
  chemically synthesized
tgaagaggagtggtgagagt

SEQ ID NO: 30432 - DNA, 20 bp, Artificial Sequence
  chemically synthesized
tgggcatccttgtcttgttc

SEQ ID NO: 30433 - DNA, 20 bp, Artificial Sequence
  chemically synthesized
ccttgtcttgttccagttct

SEQ ID NO: 30434 - DNA, 20 bp, Artificial Sequence
  chemically synthesized
ttgtcttgttccagttctca

SEQ ID NO: 30435 - DNA, 20 bp, Artificial Sequence
  chemically synthesized
tgtcttgttccagttctcag

SEQ ID NO: 30436 - DNA, 20 bp, Artificial Sequence
  chemically synthesized
gtcttgttccagttctcaga

SEQ ID NO: 30437 - DNA, 20 bp, Artificial Sequence
  chemically synthesized
ttccccattcaatattatgt

SEQ ID NO: 30438 - DNA, 20 bp, Artificial Sequence
  chemically synthesized
attcaatattatgttggctg

SEQ ID NO: 30439 - DNA, 20 bp, Artificial Sequence
  chemically synthesized
ttcaatattatgttggctgt

SEQ ID NO: 30440 - DNA, 20 bp, Artificial Sequence
  chemically synthesized
tgttggctgtgggtttgtca

SEQ ID NO: 30441 - DNA, 20 bp, Artificial Sequence
  chemically synthesized
ggctgtgggtttgtcacaga

SEQ ID NO: 30442 - DNA, 20 bp, Artificial Sequence
  chemically synthesized
cagatggcttttattacact

SEQ ID NO: 30443 - DNA, 20 bp, Artificial Sequence
  chemically synthesized
agatggcttttattacactg

SEQ ID NO: 30444 - DNA, 20 bp, Artificial Sequence
  chemically synthesized
tcttgtatgctgattttgct

SEQ ID NO: 30445 - DNA, 20 bp, Artificial Sequence
  chemically synthesized
ttttaatcataaatgtatgc

SEQ ID NO: 30446 - DNA, 20 bp, Artificial Sequence
  chemically synthesized
atgctttttctgcatctatt

SEQ ID NO: 30447 - DNA, 20 bp, Artificial Sequence
  chemically synthesized
tgtttttaaatctgtttatg

SEQ ID NO: 30448 - DNA, 20 bp, Artificial Sequence
  chemically synthesized
gtatcacacttattgacttg

SEQ ID NO: 30449 - DNA, 20 bp, Artificial Sequence
  chemically synthesized
tcaaaccaaccctgcatccc

SEQ ID NO: 30450 - DNA, 20 bp, Artificial Sequence
  chemically synthesized
ccaaccctgcatccctggca

SEQ ID NO: 30451 - DNA, 20 bp, Artificial Sequence
  chemically synthesized
gcatggaacctgcttgatca

SEQ ID NO: 30452 - DNA, 20 bp, Artificial Sequence
  chemically synthesized
tggaacctgcttgatcatgg

SEQ ID NO: 30453 - DNA, 20 bp, Artificial Sequence
  chemically synthesized
ttttgttatgttgttgaatt

SEQ ID NO: 30454 - DNA, 20 bp, Artificial Sequence
  chemically synthesized
tgttgttgaatttggttatc

SEQ ID NO: 30455 - DNA, 20 bp, Artificial Sequence
  chemically synthesized
tggttatctagtattttgtt

SEQ ID NO: 30456 - DNA, 20 bp, Artificial Sequence
  chemically synthesized
ggttatctagtattttgtta

SEQ ID NO: 30457 - DNA, 20 bp, Artificial Sequence
  chemically synthesized
tagtattttgttaaggattt

SEQ ID NO: 30458 - DNA, 20 bp, Artificial Sequence
  chemically synthesized
ttttagcatctatgttcatc

SEQ ID NO: 30459 - DNA, 20 bp, Artificial Sequence
  chemically synthesized
tttagcatctatgttcatca

SEQ ID NO: 30460 - DNA, 20 bp, Artificial Sequence
  chemically synthesized
tctatgttcatcaaggctat

SEQ ID NO: 30461 - DNA, 20 bp, Artificial Sequence
  chemically synthesized
tcatcaaggctatcagtctg

SEQ ID NO: 30462 - DNA, 20 bp, Artificial Sequence
  chemically synthesized
cagtctgtagttttcttttt

SEQ ID NO: 30463 - DNA, 20 bp, Artificial Sequence
  chemically synthesized
tttttggttatgtccttccc

SEQ ID NO: 30464 - DNA, 20 bp, Artificial Sequence
  chemically synthesized
gttatgtccttccctggttt

SEQ ID NO: 30465 - DNA, 20 bp, Artificial Sequence
  chemically synthesized
ccctggttttggtgtgatgc

SEQ ID NO: 30466 - DNA, 20 bp, Artificial Sequence
  chemically synthesized
ttggtgtgatgctggcttca

SEQ ID NO: 30467 - DNA, 20 bp, Artificial Sequence
  chemically synthesized
gctggcttcatagaatgaat

SEQ ID NO: 30468 - DNA, 20 bp, Artificial Sequence
  chemically synthesized
ctggcttcatagaatgaatt

SEQ ID NO: 30469 - DNA, 20 bp, Artificial Sequence
  chemically synthesized
tggcttcatagaatgaatta

SEQ ID NO: 30470 - DNA, 20 bp, Artificial Sequence
  chemically synthesized
cttcatagaatgaattaggg

SEQ ID NO: 30471 - DNA, 20 bp, Artificial Sequence
  chemically synthesized
ttcatagaatgaattagggc

SEQ ID NO: 30472 - DNA, 20 bp, Artificial Sequence
  chemically synthesized
ttccttctttatctgtcttg

SEQ ID NO: 30473 - DNA, 20 bp, Artificial Sequence
  chemically synthesized
tctttatctgtcttgtagaa

SEQ ID NO: 30474 - DNA, 20 bp, Artificial Sequence
  chemically synthesized
tcttgtagaatagtgtcaaa

SEQ ID NO: 30475 - DNA, 20 bp, Artificial Sequence
  chemically synthesized
gtagaatagtgtcaaaaaga

SEQ ID NO: 30476 - DNA, 20 bp, Artificial Sequence
  chemically synthesized
tagaatagtgtcaaaaagat

SEQ ID NO: 30477 - DNA, 20 bp, Artificial Sequence
  chemically synthesized
agaatagtgtcaaaaagatg

SEQ ID NO: 30478 - DNA, 20 bp, Artificial Sequence
  chemically synthesized
ccaattcctctttgaatgtc

SEQ ID NO: 30479 - DNA, 20 bp, Artificial Sequence
  chemically synthesized
attcctctttgaatgtctag

SEQ ID NO: 30480 - DNA, 20 bp, Artificial Sequence
  chemically synthesized
aattctgttgtgaatccatc

SEQ ID NO: 30481 - DNA, 20 bp, Artificial Sequence
  chemically synthesized
tctggtcctgaacttttttt

SEQ ID NO: 30482 - DNA, 20 bp, Artificial Sequence
  chemically synthesized
gtcctgaacttttttttggt

SEQ ID NO: 30483 - DNA, 20 bp, Artificial Sequence
  chemically synthesized
taaatctcactgcttgttat

SEQ ID NO: 30484 - DNA, 20 bp, Artificial Sequence
  chemically synthesized
actgcttgttattggtctgt

SEQ ID NO: 30485 - DNA, 20 bp, Artificial Sequence
  chemically synthesized
ggtctgttagtaaatttatt

SEQ ID NO: 30486 - DNA, 20 bp, Artificial Sequence
  chemically synthesized
gtctgttagtaaatttattg

SEQ ID NO: 30487 - DNA, 20 bp, Artificial Sequence
  chemically synthesized
atttattgaggctcatttca

SEQ ID NO: 30488 - DNA, 20 bp, Artificial Sequence
  chemically synthesized
tcatttcatggcctatcata

SEQ ID NO: 30489 - DNA, 20 bp, Artificial Sequence
  chemically synthesized
gcctatcatatggtctacct

SEQ ID NO: 30490 - DNA, 20 bp, Artificial Sequence
  chemically synthesized
ctatcatatggtctaccttg

SEQ ID NO: 30491 - DNA, 20 bp, Artificial Sequence
  chemically synthesized
aatttccacgcgctgttgaa

SEQ ID NO: 30492 - DNA, 20 bp, Artificial Sequence
  chemically synthesized
tgaatagaatgtgtgttctg

SEQ ID NO: 30493 - DNA, 20 bp, Artificial Sequence
  chemically synthesized
aatgtgtgttctgtggttat

SEQ ID NO: 30494 - DNA, 20 bp, Artificial Sequence
  chemically synthesized
atgttctgtatataactgtt

SEQ ID NO: 30495 - DNA, 20 bp, Artificial Sequence
  chemically synthesized
ctgttaagtccatttgttct

SEQ ID NO: 30496 - DNA, 20 bp, Artificial Sequence
  chemically synthesized
tgttaagtccatttgttcta

SEQ ID NO: 30497 - DNA, 20 bp, Artificial Sequence
  chemically synthesized
ttctgtcttgatgaactgtc

SEQ ID NO: 30498 - DNA, 20 bp, Artificial Sequence
  chemically synthesized
actgtctagtgctgtcaatg

SEQ ID NO: 30499 - DNA, 20 bp, Artificial Sequence
  chemically synthesized
gtgctgtcaatgaagtattg

SEQ ID NO: 30500 - DNA, 20 bp, Artificial Sequence
  chemically synthesized
ttgctgtctatctcatttct

SEQ ID NO: 30501 - DNA, 20 bp, Artificial Sequence
  chemically synthesized
tgctgtctatctcatttctt

SEQ ID NO: 30502 - DNA, 20 bp, Artificial Sequence
  chemically synthesized
atctcatttcttaggtctat

SEQ ID NO: 30503 - DNA, 20 bp, Artificial Sequence
  chemically synthesized
tagtaattgttctataaatt

SEQ ID NO: 30504 - DNA, 20 bp, Artificial Sequence
  chemically synthesized
agtaattgttctataaattt

SEQ ID NO: 30505 - DNA, 20 bp, Artificial Sequence
  chemically synthesized
taattgttctataaatttgg

SEQ ID NO: 30506 - DNA, 20 bp, Artificial Sequence
  chemically synthesized
ttctataaatttgggagctc

SEQ ID NO: 30507 - DNA, 20 bp, Artificial Sequence
  chemically synthesized
aaatttgggagctccagtgt

SEQ ID NO: 30508 - DNA, 20 bp, Artificial Sequence
  chemically synthesized
aatttgggagctccagtgtt

SEQ ID NO: 30509 - DNA, 20 bp, Artificial Sequence
  chemically synthesized
tgttaggtgcatatatgttt

SEQ ID NO: 30510 - DNA, 20 bp, Artificial Sequence
  chemically synthesized
agattgtgatattttcctgt

SEQ ID NO: 30511 - DNA, 20 bp, Artificial Sequence
  chemically synthesized
gtgatattttcctgttggac

SEQ ID NO: 30512 - DNA, 20 bp, Artificial Sequence
  chemically synthesized
tgatattttcctgttggaca

SEQ ID NO: 30513 - DNA, 20 bp, Artificial Sequence
  chemically synthesized
ttttaactgctgttgcttta

SEQ ID NO: 30514 - DNA, 20 bp, Artificial Sequence
  chemically synthesized
ttgttttgcctactcacttt

SEQ ID NO: 30515 - DNA, 20 bp, Artificial Sequence
  chemically synthesized
ttttgcctactcacttttgg

SEQ ID NO: 30516 - DNA, 20 bp, Artificial Sequence
  chemically synthesized
aatacctttttcaccctttt

SEQ ID NO: 30517 - DNA, 20 bp, Artificial Sequence
  chemically synthesized
acctttttcacccttttaag

SEQ ID NO: 30518 - DNA, 20 bp, Artificial Sequence
  chemically synthesized
ctttttcacccttttaagtg

SEQ ID NO: 30519 - DNA, 20 bp, Artificial Sequence
  chemically synthesized
acccttttaagtggagcatt

SEQ ID NO: 30520 - DNA, 20 bp, Artificial Sequence
  chemically synthesized
cccttttaagtggagcattt

SEQ ID NO: 30521 - DNA, 20 bp, Artificial Sequence
  chemically synthesized
aggccatttacattcaatgt

SEQ ID NO: 30522 - DNA, 20 bp, Artificial Sequence
  chemically synthesized
atgttagtaatgtaaatgcc

SEQ ID NO: 30523 - DNA, 20 bp, Artificial Sequence
  chemically synthesized
atgtaaatgcctggctatgc

SEQ ID NO: 30524 - DNA, 20 bp, Artificial Sequence
  chemically synthesized
tgtaaatgcctggctatgcc

SEQ ID NO: 30525 - DNA, 20 bp, Artificial Sequence
  chemically synthesized
aaatgcctggctatgccagg

SEQ ID NO: 30526 - DNA, 20 bp, Artificial Sequence
  chemically synthesized
aatgcctggctatgccaggc

SEQ ID NO: 30527 - DNA, 20 bp, Artificial Sequence
  chemically synthesized
ctggctatgccaggcaggaa

SEQ ID NO: 30528 - DNA, 20 bp, Artificial Sequence
  chemically synthesized
ccaggcaggaatggcctgct

SEQ ID NO: 30529 - DNA, 20 bp, Artificial Sequence
  chemically synthesized
caggcaggaatggcctgctc

SEQ ID NO: 30530 - DNA, 20 bp, Artificial Sequence
  chemically synthesized
aggcaggaatggcctgctca

SEQ ID NO: 30531 - DNA, 20 bp, Artificial Sequence
  chemically synthesized
gaatggcctgctcagggacc

SEQ ID NO: 30532 - DNA, 20 bp, Artificial Sequence
  chemically synthesized
ggcctgctcagggacccagt

SEQ ID NO: 30533 - DNA, 20 bp, Artificial Sequence
  chemically synthesized
tcagggacccagtgagctcc

SEQ ID NO: 30534 - DNA, 20 bp, Artificial Sequence
  chemically synthesized
cagggacccagtgagctccc

SEQ ID NO: 30535 - DNA, 20 bp, Artificial Sequence
  chemically synthesized
agggacccagtgagctccca

SEQ ID NO: 30536 - DNA, 20 bp, Artificial Sequence
  chemically synthesized
ctctacacctgtattttgct

SEQ ID NO: 30537 - DNA, 20 bp, Artificial Sequence
  chemically synthesized
tgtattttgctcagctctct

SEQ ID NO: 30538 - DNA, 20 bp, Artificial Sequence
  chemically synthesized
tctctaagttaactcaactc

SEQ ID NO: 30539 - DNA, 20 bp, Artificial Sequence
  chemically synthesized
ctctaagttaactcaactcc

SEQ ID NO: 30540 - DNA, 20 bp, Artificial Sequence
  chemically synthesized
aagttaactcaactccaggt

SEQ ID NO: 30541 - DNA, 20 bp, Artificial Sequence
  chemically synthesized
agttaactcaactccaggta

SEQ ID NO: 30542 - DNA, 20 bp, Artificial Sequence
  chemically synthesized
aactcaactccaggtaaggt

SEQ ID NO: 30543 - DNA, 20 bp, Artificial Sequence
  chemically synthesized
tcagaaacttctcccacaaa

SEQ ID NO: 30544 - DNA, 20 bp, Artificial Sequence
  chemically synthesized
ttctcccacaaacagacctt

SEQ ID NO: 30545 - DNA, 20 bp, Artificial Sequence
  chemically synthesized
aaacagaccttcagtttctc

SEQ ID NO: 30546 - DNA, 20 bp, Artificial Sequence
  chemically synthesized
cagaccttcagtttctccag

SEQ ID NO: 30547 - DNA, 20 bp, Artificial Sequence
  chemically synthesized
agaccttcagtttctccagt

SEQ ID NO: 30548 - DNA, 20 bp, Artificial Sequence
  chemically synthesized
accttcagtttctccagtgg

SEQ ID NO: 30549 - DNA, 20 bp, Artificial Sequence
  chemically synthesized
ctccagtgggagtgtgtgtt

SEQ ID NO: 30550 - DNA, 20 bp, Artificial Sequence
  chemically synthesized
tccagtgggagtgtgtgttt

SEQ ID NO: 30551 - DNA, 20 bp, Artificial Sequence
  chemically synthesized
cagtgggagtgtgtgtttag

SEQ ID NO: 30552 - DNA, 20 bp, Artificial Sequence
  chemically synthesized
gtgggagtgtgtgtttagga

SEQ ID NO: 30553 - DNA, 20 bp, Artificial Sequence
  chemically synthesized
tgggagtgtgtgtttaggag

SEQ ID NO: 30554 - DNA, 20 bp, Artificial Sequence
  chemically synthesized
ggagtgtgtgtttaggagag

SEQ ID NO: 30555 - DNA, 20 bp, Artificial Sequence
  chemically synthesized
gagtgtgtgtttaggagagg

SEQ ID NO: 30556 - DNA, 20 bp, Artificial Sequence
  chemically synthesized
atctccctttcccacttccg

SEQ ID NO: 30557 - DNA, 20 bp, Artificial Sequence
  chemically synthesized
ccctttcccacttccgcagt

SEQ ID NO: 30558 - DNA, 20 bp, Artificial Sequence
  chemically synthesized
cctttcccacttccgcagtt

SEQ ID NO: 30559 - DNA, 20 bp, Artificial Sequence
  chemically synthesized
ctttcccacttccgcagttg

SEQ ID NO: 30560 - DNA, 20 bp, Artificial Sequence
  chemically synthesized
ttccgcagttggggcactca

SEQ ID NO: 30561 - DNA, 20 bp, Artificial Sequence
  chemically synthesized
gttggggcactcacagtatt

SEQ ID NO: 30562 - DNA, 20 bp, Artificial Sequence
  chemically synthesized
ttggggcactcacagtattt

SEQ ID NO: 30563 - DNA, 20 bp, Artificial Sequence
  chemically synthesized
tggggcactcacagtatttg

SEQ ID NO: 30564 - DNA, 20 bp, Artificial Sequence
  chemically synthesized
acagtatttggggtgtctcc

SEQ ID NO: 30565 - DNA, 20 bp, Artificial Sequence
  chemically synthesized
cagtatttggggtgtctcct

SEQ ID NO: 30566 - DNA, 20 bp, Artificial Sequence
  chemically synthesized
ggggtgtctcctgggtcctg

SEQ ID NO: 30567 - DNA, 20 bp, Artificial Sequence
  chemically synthesized
gggtgtctcctgggtcctgc

SEQ ID NO: 30568 - DNA, 20 bp, Artificial Sequence
  chemically synthesized
gtgtctcctgggtcctgcag

SEQ ID NO: 30569 - DNA, 20 bp, Artificial Sequence
  chemically synthesized
caggagcaatctacttcctt

SEQ ID NO: 30570 - DNA, 20 bp, Artificial Sequence
  chemically synthesized
ggagcaatctacttccttca

SEQ ID NO: 30571 - DNA, 20 bp, Artificial Sequence
  chemically synthesized
gagcaatctacttccttcag

SEQ ID NO: 30572 - DNA, 20 bp, Artificial Sequence
  chemically synthesized
agcaatctacttccttcaga

SEQ ID NO: 30573 - DNA, 20 bp, Artificial Sequence
  chemically synthesized
tacttccttcagagggtctg

SEQ ID NO: 30574 - DNA, 20 bp, Artificial Sequence
  chemically synthesized
acttccttcagagggtctgt

SEQ ID NO: 30575 - DNA, 20 bp, Artificial Sequence
  chemically synthesized
agagggtctgtgggtcctct

SEQ ID NO: 30576 - DNA, 20 bp, Artificial Sequence
  chemically synthesized
gagggtctgtgggtcctctc

SEQ ID NO: 30577 - DNA, 20 bp, Artificial Sequence
  chemically synthesized
gtgggtcctctcaggattgc

SEQ ID NO: 30578 - DNA, 20 bp, Artificial Sequence
  chemically synthesized
ggattgctggtttgttcttg

SEQ ID NO: 30579 - DNA, 20 bp, Artificial Sequence
  chemically synthesized
ttgttcttgcagtctatctg

SEQ ID NO: 30580 - DNA, 20 bp, Artificial Sequence
  chemically synthesized
gcagctaaaattcacaatgc

SEQ ID NO: 30581 - DNA, 20 bp, Artificial Sequence
  chemically synthesized
acatgctgctctgtccatct

SEQ ID NO: 30582 - DNA, 20 bp, Artificial Sequence
  chemically synthesized
gctgctctgtccatctgagt

SEQ ID NO: 30583 - DNA, 20 bp, Artificial Sequence
  chemically synthesized
tgctctgtccatctgagttg

SEQ ID NO: 30584 - DNA, 20 bp, Artificial Sequence
  chemically synthesized
tctgagttggagctgcaatc

SEQ ID NO: 30585 - DNA, 20 bp, Artificial Sequence
  chemically synthesized
ctgagttggagctgcaatct

SEQ ID NO: 30586 - DNA, 20 bp, Artificial Sequence
  chemically synthesized
aggcctacctcccatccgcc

SEQ ID NO: 30587 - DNA, 20 bp, Artificial Sequence
  chemically synthesized
ctcccatccgccaagatcct

SEQ ID NO: 30588 - DNA, 20 bp, Artificial Sequence
  chemically synthesized
ccatccgccaagatcctgag

SEQ ID NO: 30589 - DNA, 20 bp, Artificial Sequence
  chemically synthesized
ccgccaagatcctgagaagt

SEQ ID NO: 30590 - DNA, 20 bp, Artificial Sequence
  chemically synthesized
cgccaagatcctgagaagtt

SEQ ID NO: 30591 - DNA, 20 bp, Artificial Sequence
  chemically synthesized
gccaagatcctgagaagttg

SEQ ID NO: 30592 - DNA, 20 bp, Artificial Sequence
  chemically synthesized
tggggattatatttcaacat

SEQ ID NO: 30593 - DNA, 20 bp, Artificial Sequence
  chemically synthesized
ttatatttcaacatgagatt

SEQ ID NO: 30594 - DNA, 20 bp, Artificial Sequence
  chemically synthesized
atatttcaacatgagatttg

SEQ ID NO: 30595 - DNA, 20 bp, Artificial Sequence
  chemically synthesized
tatttcaacatgagatttgg

SEQ ID NO: 30596 - DNA, 20 bp, Artificial Sequence
  chemically synthesized
atttcaacatgagatttgga

SEQ ID NO: 30597 - DNA, 20 bp, Artificial Sequence
  chemically synthesized
aacaaacatccaaaccatat

SEQ ID NO: 30598 - DNA, 20 bp, Artificial Sequence
  chemically synthesized
aaacatccaaaccatatcag

SEQ ID NO: 30599 - DNA, 20 bp, Artificial Sequence
  chemically synthesized
tccaaaccatatcagcagtc

SEQ ID NO: 30600 - DNA, 20 bp, Artificial Sequence
  chemically synthesized
cagttttattcttttgcaca

SEQ ID NO: 30601 - DNA, 20 bp, Artificial Sequence
  chemically synthesized
ttttgcacatggatatccaa

SEQ ID NO: 30602 - DNA, 20 bp, Artificial Sequence
  chemically synthesized
caatggatatccaatttttt

SEQ ID NO: 30603 - DNA, 20 bp, Artificial Sequence
  chemically synthesized
cacctttgttgaaaatctgt

SEQ ID NO: 30604 - DNA, 20 bp, Artificial Sequence
  chemically synthesized
atctgttggctataaatatg

SEQ ID NO: 30605 - DNA, 20 bp, Artificial Sequence
  chemically synthesized
taaatatgtggatgcatttc

SEQ ID NO: 30606 - DNA, 20 bp, Artificial Sequence
  chemically synthesized
aaatatgtggatgcatttct

SEQ ID NO: 30607 - DNA, 20 bp, Artificial Sequence
  chemically synthesized
ggttctctattctcttccat

SEQ ID NO: 30608 - DNA, 20 bp, Artificial Sequence
  chemically synthesized
ctattctcttccattggtct

SEQ ID NO: 30609 - DNA, 20 bp, Artificial Sequence
  chemically synthesized
ctaagtgtctgttctaatgt

SEQ ID NO: 30610 - DNA, 20 bp, Artificial Sequence
  chemically synthesized
aatgtcagtatcatgctgtt

SEQ ID NO: 30611 - DNA, 20 bp, Artificial Sequence
  chemically synthesized
atgtcagtatcatgctgttt

SEQ ID NO: 30612 - DNA, 20 bp, Artificial Sequence
  chemically synthesized
tttgtaatatactttgaaat

SEQ ID NO: 30613 - DNA, 20 bp, Artificial Sequence
  chemically synthesized
ttgtaatatactttgaaatc

SEQ ID NO: 30614 - DNA, 20 bp, Artificial Sequence
  chemically synthesized
taatatactttgaaatcagg

SEQ ID NO: 30615 - DNA, 20 bp, Artificial Sequence
  chemically synthesized
atcaggtagtatgatacctc

SEQ ID NO: 30616 - DNA, 20 bp, Artificial Sequence
  chemically synthesized
ctagcattgttcttttttca

SEQ ID NO: 30617 - DNA, 20 bp, Artificial Sequence
  chemically synthesized
tagcattgttcttttttcac

SEQ ID NO: 30618 - DNA, 20 bp, Artificial Sequence
  chemically synthesized
cttttttcacaggatgactt

SEQ ID NO: 30619 - DNA, 20 bp, Artificial Sequence
  chemically synthesized
cacaggatgactttggctac

SEQ ID NO: 30620 - DNA, 20 bp, Artificial Sequence
  chemically synthesized
caggatgactttggctactg

SEQ ID NO: 30621 - DNA, 20 bp, Artificial Sequence
  chemically synthesized
ttttaatttcatacaaattt

SEQ ID NO: 30622 - DNA, 20 bp, Artificial Sequence
  chemically synthesized
atttcatacaaattttagat

SEQ ID NO: 30623 - DNA, 20 bp, Artificial Sequence
  chemically synthesized
aaatgacattgctattttga

SEQ ID NO: 30624 - DNA, 20 bp, Artificial Sequence
  chemically synthesized
tgacattgctattttgatag

SEQ ID NO: 30625 - DNA, 20 bp, Artificial Sequence
  chemically synthesized
ctattttgatagcggtcata

SEQ ID NO: 30626 - DNA, 20 bp, Artificial Sequence
  chemically synthesized
tagcggtcatatagaatctg

SEQ ID NO: 30627 - DNA, 20 bp, Artificial Sequence
  chemically synthesized
atagaatctgtagattgctt

SEQ ID NO: 30628 - DNA, 20 bp, Artificial Sequence
  chemically synthesized
tagaatctgtagattgcttt

SEQ ID NO: 30629 - DNA, 20 bp, Artificial Sequence
  chemically synthesized
aatctgtagattgctttggg

SEQ ID NO: 30630 - DNA, 20 bp, Artificial Sequence
  chemically synthesized
gtagattgctttgggtagta

SEQ ID NO: 30631 - DNA, 20 bp, Artificial Sequence
  chemically synthesized
atttttctgatccatgaaca

SEQ ID NO: 30632 - DNA, 20 bp, Artificial Sequence
  chemically synthesized
tttttctgatccatgaacat

SEQ ID NO: 30633 - DNA, 20 bp, Artificial Sequence
  chemically synthesized
gtccttttcaattcttttat

SEQ ID NO: 30634 - DNA, 20 bp, Artificial Sequence
  chemically synthesized
attcttttatcagtgttttg

SEQ ID NO: 30635 - DNA, 20 bp, Artificial Sequence
  chemically synthesized
gtgttttgtagttttccgaa

SEQ ID NO: 30636 - DNA, 20 bp, Artificial Sequence
  chemically synthesized
gttttgtagttttccgaata

SEQ ID NO: 30637 - DNA, 20 bp, Artificial Sequence
  chemically synthesized
ttttgtagttttccgaatag

SEQ ID NO: 30638 - DNA, 20 bp, Artificial Sequence
  chemically synthesized
ttttccgaatagaggttttt

SEQ ID NO: 30639 - DNA, 20 bp, Artificial Sequence
  chemically synthesized
atagaggtttttcggttcct

SEQ ID NO: 30640 - DNA, 20 bp, Artificial Sequence
  chemically synthesized
tccctaaatattttattttt

SEQ ID NO: 30641 - DNA, 20 bp, Artificial Sequence
  chemically synthesized
tattttttagctattgtaaa

SEQ ID NO: 30642 - DNA, 20 bp, Artificial Sequence
  chemically synthesized
attttttagctattgtaaat

SEQ ID NO: 30643 - DNA, 20 bp, Artificial Sequence
  chemically synthesized
tgccttcttaatttccttct

SEQ ID NO: 30644 - DNA, 20 bp, Artificial Sequence
  chemically synthesized
ttcttaatttccttctcagc

SEQ ID NO: 30645 - DNA, 20 bp, Artificial Sequence
  chemically synthesized
cttctcagctagtttattat

SEQ ID NO: 30646 - DNA, 20 bp, Artificial Sequence
  chemically synthesized
gctagtttattattggtgtg

SEQ ID NO: 30647 - DNA, 20 bp, Artificial Sequence
  chemically synthesized
actttactgaatttattttt

SEQ ID NO: 30648 - DNA, 20 bp, Artificial Sequence
  chemically synthesized
tgaatttatttttcagcgct

SEQ ID NO: 30649 - DNA, 20 bp, Artificial Sequence
  chemically synthesized
aatttatttttcagcgctaa

SEQ ID NO: 30650 - DNA, 20 bp, Artificial Sequence
  chemically synthesized
tttcagcgctaagagtgctt

SEQ ID NO: 30651 - DNA, 20 bp, Artificial Sequence
  chemically synthesized
cagcgctaagagtgctttgg

SEQ ID NO: 30652 - DNA, 20 bp, Artificial Sequence
  chemically synthesized
gcgctaagagtgctttggtg

SEQ ID NO: 30653 - DNA, 20 bp, Artificial Sequence
  chemically synthesized
agagtgctttggtggagtct

SEQ ID NO: 30654 - DNA, 20 bp, Artificial Sequence
  chemically synthesized
tggtggagtcttggtttttc

SEQ ID NO: 30655 - DNA, 20 bp, Artificial Sequence
  chemically synthesized
ggtggagtcttggtttttct

SEQ ID NO: 30656 - DNA, 20 bp, Artificial Sequence
  chemically synthesized
aggtataaaatcatgtcatc

SEQ ID NO: 30657 - DNA, 20 bp, Artificial Sequence
  chemically synthesized
ataaaatcatgtcatctgga

SEQ ID NO: 30658 - DNA, 20 bp, Artificial Sequence
  chemically synthesized
aatcatgtcatctggaaaga

SEQ ID NO: 30659 - DNA, 20 bp, Artificial Sequence
  chemically synthesized
atgtcatctggaaagatgga

SEQ ID NO: 30660 - DNA, 20 bp, Artificial Sequence
  chemically synthesized
tctttctttctctgacctga

SEQ ID NO: 30661 - DNA, 20 bp, Artificial Sequence
  chemically synthesized
tttctctgacctgaaagctg

SEQ ID NO: 30662 - DNA, 20 bp, Artificial Sequence
  chemically synthesized
tctgacctgaaagctgtggc

SEQ ID NO: 30663 - DNA, 20 bp, Artificial Sequence
  chemically synthesized
ctgacctgaaagctgtggct

SEQ ID NO: 30664 - DNA, 20 bp, Artificial Sequence
  chemically synthesized
aaagctgtggctaggacttc

SEQ ID NO: 30665 - DNA, 20 bp, Artificial Sequence
  chemically synthesized
acttccagtattatattgaa

SEQ ID NO: 30666 - DNA, 20 bp, Artificial Sequence
  chemically synthesized
cttccagtattatattgaat

SEQ ID NO: 30667 - DNA, 20 bp, Artificial Sequence
  chemically synthesized
tccagtattatattgaatag

SEQ ID NO: 30668 - DNA, 20 bp, Artificial Sequence
  chemically synthesized
attatattgaataggagtga

SEQ ID NO: 30669 - DNA, 20 bp, Artificial Sequence
  chemically synthesized
atattgaataggagtgatgg

SEQ ID NO: 30670 - DNA, 20 bp, Artificial Sequence
  chemically synthesized
ttgaataggagtgatggaag

SEQ ID NO: 30671 - DNA, 20 bp, Artificial Sequence
  chemically synthesized
tgaataggagtgatggaagt

SEQ ID NO: 30672 - DNA, 20 bp, Artificial Sequence
  chemically synthesized
tgggcatccttattttgttt

SEQ ID NO: 30673 - DNA, 20 bp, Artificial Sequence
  chemically synthesized
ccttattttgtttcagttct

SEQ ID NO: 30674 - DNA, 20 bp, Artificial Sequence
  chemically synthesized
ttattttgtttcagttctta

SEQ ID NO: 30675 - DNA, 20 bp, Artificial Sequence
  chemically synthesized
tattttgtttcagttcttag

SEQ ID NO: 30676 - DNA, 20 bp, Artificial Sequence
  chemically synthesized
ttgtttcagttcttagagga

SEQ ID NO: 30677 - DNA, 20 bp, Artificial Sequence
  chemically synthesized
tgtttcagttcttagaggaa

SEQ ID NO: 30678 - DNA, 20 bp, Artificial Sequence
  chemically synthesized
gttcttagaggaaaggcttc

SEQ ID NO: 30679 - DNA, 20 bp, Artificial Sequence
  chemically synthesized
gcttccagcttttcccaatt

SEQ ID NO: 30680 - DNA, 20 bp, Artificial Sequence
  chemically synthesized
ttcccaattcagtatgatgt

SEQ ID NO: 30681 - DNA, 20 bp, Artificial Sequence
  chemically synthesized
attcagtatgatgttagctg

SEQ ID NO: 30682 - DNA, 20 bp, Artificial Sequence
  chemically synthesized
ttcagtatgatgttagctgt

SEQ ID NO: 30683 - DNA, 20 bp, Artificial Sequence
  chemically synthesized
tatatgacttttattatatt

SEQ ID NO: 30684 - DNA, 20 bp, Artificial Sequence
  chemically synthesized
agatatgttccttctatgat

SEQ ID NO: 30685 - DNA, 20 bp, Artificial Sequence
  chemically synthesized
gttccttctatgattggctg

SEQ ID NO: 30686 - DNA, 20 bp, Artificial Sequence
  chemically synthesized
cttctatgattggctgcaga

SEQ ID NO: 30687 - DNA, 20 bp, Artificial Sequence
  chemically synthesized
tgcagatagtttttatcatg

SEQ ID NO: 30688 - DNA, 20 bp, Artificial Sequence
  chemically synthesized
gcagatagtttttatcatga

SEQ ID NO: 30689 - DNA, 20 bp, Artificial Sequence
  chemically synthesized
atactttttctgtatctatt

SEQ ID NO: 30690 - DNA, 20 bp, Artificial Sequence
  chemically synthesized
tatctattgagatgatcata

SEQ ID NO: 30691 - DNA, 20 bp, Artificial Sequence
  chemically synthesized
ttgaactgttcttgcaaccc

SEQ ID NO: 30692 - DNA, 20 bp, Artificial Sequence
  chemically synthesized
gtataaatcccacttgatca

SEQ ID NO: 30693 - DNA, 20 bp, Artificial Sequence
  chemically synthesized
gatcatggtgtattatcttt

SEQ ID NO: 30694 - DNA, 20 bp, Artificial Sequence
  chemically synthesized
ttatcttttggatgtactgt

SEQ ID NO: 30695 - DNA, 20 bp, Artificial Sequence
  chemically synthesized
tttggatgtactgttggatt

SEQ ID NO: 30696 - DNA, 20 bp, Artificial Sequence
  chemically synthesized
tactgttggattcagtttgc

SEQ ID NO: 30697 - DNA, 20 bp, Artificial Sequence
  chemically synthesized
cagtttgctagtattttgtt

SEQ ID NO: 30698 - DNA, 20 bp, Artificial Sequence
  chemically synthesized
agtttgctagtattttgttg

SEQ ID NO: 30699 - DNA, 20 bp, Artificial Sequence
  chemically synthesized
ttttcacacctatgttccat

SEQ ID NO: 30700 - DNA, 20 bp, Artificial Sequence
  chemically synthesized
tttcacacctatgttccatc

SEQ ID NO: 30701 - DNA, 20 bp, Artificial Sequence
  chemically synthesized
ttcacacctatgttccatca

SEQ ID NO: 30702 - DNA, 20 bp, Artificial Sequence
  chemically synthesized
ccatcagggatattgacctg

SEQ ID NO: 30703 - DNA, 20 bp, Artificial Sequence
  chemically synthesized
tttttacttgcatccttgtc

SEQ ID NO: 30704 - DNA, 20 bp, Artificial Sequence
  chemically synthesized
cttgcatccttgtctggtta

SEQ ID NO: 30705 - DNA, 20 bp, Artificial Sequence
  chemically synthesized
tccttgtctggttatggaat

SEQ ID NO: 30706 - DNA, 20 bp, Artificial Sequence
  chemically synthesized
ccttgtctggttatggaatc

SEQ ID NO: 30707 - DNA, 20 bp, Artificial Sequence
  chemically synthesized
ttatggaatcaggataatac

SEQ ID NO: 30708 - DNA, 20 bp, Artificial Sequence
  chemically synthesized
aatcaggataatactggcct

SEQ ID NO: 30709 - DNA, 20 bp, Artificial Sequence
  chemically synthesized
tcaggataatactggcctca

SEQ ID NO: 30710 - DNA, 20 bp, Artificial Sequence
  chemically synthesized
taatactggcctcagagaat

SEQ ID NO: 30711 - DNA, 20 bp, Artificial Sequence
  chemically synthesized
actggcctcagagaatgagt

SEQ ID NO: 30712 - DNA, 20 bp, Artificial Sequence
  chemically synthesized
ctggcctcagagaatgagtt

SEQ ID NO: 30713 - DNA, 20 bp, Artificial Sequence
  chemically synthesized
tggcctcagagaatgagtta

SEQ ID NO: 30714 - DNA, 20 bp, Artificial Sequence
  chemically synthesized
gcctcagagaatgagttagg

SEQ ID NO: 30715 - DNA, 20 bp, Artificial Sequence
  chemically synthesized
ccttcctgtttaatttttaa

SEQ ID NO: 30716 - DNA, 20 bp, Artificial Sequence
  chemically synthesized
tttaatttttaaaagaattt

SEQ ID NO: 30717 - DNA, 20 bp, Artificial Sequence
  chemically synthesized
ttaatttttaaaagaattta

SEQ ID NO: 30718 - DNA, 20 bp, Artificial Sequence
  chemically synthesized
aatttttaaaagaatttaag

SEQ ID NO: 30719 - DNA, 20 bp, Artificial Sequence
  chemically synthesized
aagaatttaaggagacttgt

SEQ ID NO: 30720 - DNA, 20 bp, Artificial Sequence
  chemically synthesized
gacttgttagttttctttga

SEQ ID NO: 30721 - DNA, 20 bp, Artificial Sequence
  chemically synthesized
gttagttttctttgaaagtt

SEQ ID NO: 30722 - DNA, 20 bp, Artificial Sequence
  chemically synthesized
gaaagtttggtaaaatttga

SEQ ID NO: 30723 - DNA, 20 bp, Artificial Sequence
  chemically synthesized
tttggtaaaatttgacagta

SEQ ID NO: 30724 - DNA, 20 bp, Artificial Sequence
  chemically synthesized
aatttgacagtaaagccatc

SEQ ID NO: 30725 - DNA, 20 bp, Artificial Sequence
  chemically synthesized
ggtcttgaaattttcttttt

SEQ ID NO: 30726 - DNA, 20 bp, Artificial Sequence
  chemically synthesized
gtcttgaaattttctttttt

SEQ ID NO: 30727 - DNA, 20 bp, Artificial Sequence
  chemically synthesized
cttgaaattttcttttttgg

SEQ ID NO: 30728 - DNA, 20 bp, Artificial Sequence
  chemically synthesized
tcaatttcattattcattac

SEQ ID NO: 30729 - DNA, 20 bp, Artificial Sequence
  chemically synthesized
ttattcattactggtctgtt

SEQ ID NO: 30730 - DNA, 20 bp, Artificial Sequence
  chemically synthesized
tattcattactggtctgttc

SEQ ID NO: 30731 - DNA, 20 bp, Artificial Sequence
  chemically synthesized
attctttcttaattcaatct

SEQ ID NO: 30732 - DNA, 20 bp, Artificial Sequence
  chemically synthesized
ctttcttaattcaatcttgg

SEQ ID NO: 30733 - DNA, 20 bp, Artificial Sequence
  chemically synthesized
tttcttaattcaatcttggt

SEQ ID NO: 30734 - DNA, 20 bp, Artificial Sequence
  chemically synthesized
cttaattcaatcttggtagg

SEQ ID NO: 30735 - DNA, 20 bp, Artificial Sequence
  chemically synthesized
cttggtaggtggtatgtgtc

SEQ ID NO: 30736 - DNA, 20 bp, Artificial Sequence
  chemically synthesized
agaaatttattaatttcctc

SEQ ID NO: 30737 - DNA, 20 bp, Artificial Sequence
  chemically synthesized
ttaatttcctctagattttt

SEQ ID NO: 30738 - DNA, 20 bp, Artificial Sequence
  chemically synthesized
ctctagatttttcagttttt

SEQ ID NO: 30739 - DNA, 20 bp, Artificial Sequence
  chemically synthesized
tttttcagttttttagtgta

SEQ ID NO: 30740 - DNA, 20 bp, Artificial Sequence
  chemically synthesized
tagtgtatggttgttcataa

SEQ ID NO: 30741 - DNA, 20 bp, Artificial Sequence
  chemically synthesized
gataatcttttctatttctg

SEQ ID NO: 30742 - DNA, 20 bp, Artificial Sequence
  chemically synthesized
cttttctatttctgtggtat

SEQ ID NO: 30743 - DNA, 20 bp, Artificial Sequence
  chemically synthesized
atttctgattttctttattt

SEQ ID NO: 30744 - DNA, 20 bp, Artificial Sequence
  chemically synthesized
tcagtctcttctctttttct

SEQ ID NO: 30745 - DNA, 20 bp, Artificial Sequence
  chemically synthesized
tctcttctctttttcttggt

SEQ ID NO: 30746 - DNA, 20 bp, Artificial Sequence
  chemically synthesized
tctctttttcttggttagtc

SEQ ID NO: 30747 - DNA, 20 bp, Artificial Sequence
  chemically synthesized
tttttcttggttagtctagc

SEQ ID NO: 30748 - DNA, 20 bp, Artificial Sequence
  chemically synthesized
tttcttggttagtctagcta

SEQ ID NO: 30749 - DNA, 20 bp, Artificial Sequence
  chemically synthesized
ttgtttttctctatttcatt

SEQ ID NO: 30750 - DNA, 20 bp, Artificial Sequence
  chemically synthesized
cattttttctttccttctgc

SEQ ID NO: 30751 - DNA, 20 bp, Artificial Sequence
  chemically synthesized
ttctttccttctgctagttt

SEQ ID NO: 30752 - DNA, 20 bp, Artificial Sequence
  chemically synthesized
tctttccttctgctagtttt

SEQ ID NO: 30753 - DNA, 20 bp, Artificial Sequence
  chemically synthesized
gggttttgttcttgcttttc

SEQ ID NO: 30754 - DNA, 20 bp, Artificial Sequence
  chemically synthesized
tcttgcttttctagcttgtt

SEQ ID NO: 30755 - DNA, 20 bp, Artificial Sequence
  chemically synthesized
cttgcttttctagcttgttg

SEQ ID NO: 30756 - DNA, 20 bp, Artificial Sequence
  chemically synthesized
agcttgttgaggtacatgat

SEQ ID NO: 30757 - DNA, 20 bp, Artificial Sequence
  chemically synthesized
tctttctatgtttttaattt

SEQ ID NO: 30758 - DNA, 20 bp, Artificial Sequence
  chemically synthesized
taatttaagtgtttattgat

SEQ ID NO: 30759 - DNA, 20 bp, Artificial Sequence
  chemically synthesized
ttattgataagcttctctct

SEQ ID NO: 30760 - DNA, 20 bp, Artificial Sequence
  chemically synthesized
actgcttttgctgtatccca

SEQ ID NO: 30761 - DNA, 20 bp, Artificial Sequence
  chemically synthesized
ttcttgacataacgttcatt

SEQ ID NO: 30762 - DNA, 20 bp, Artificial Sequence
  chemically synthesized
tcttgacataacgttcattc

SEQ ID NO: 30763 - DNA, 20 bp, Artificial Sequence
  chemically synthesized
ttgacataacgttcattcag

SEQ ID NO: 30764 - DNA, 20 bp, Artificial Sequence
  chemically synthesized
ttaatttccatgtatttgta

SEQ ID NO: 30765 - DNA, 20 bp, Artificial Sequence
  chemically synthesized
taatttccatgtatttgtat

SEQ ID NO: 30766 - DNA, 20 bp, Artificial Sequence
  chemically synthesized
atgtatttgtataggtttta

SEQ ID NO: 30767 - DNA, 20 bp, Artificial Sequence
  chemically synthesized
tttttcttgttattgatttc

SEQ ID NO: 30768 - DNA, 20 bp, Artificial Sequence
  chemically synthesized
tttctagttttattccattg

SEQ ID NO: 30769 - DNA, 20 bp, Artificial Sequence
  chemically synthesized
gttttattccattgtggtct

SEQ ID NO: 30770 - DNA, 20 bp, Artificial Sequence
  chemically synthesized
ttattccattgtggtctgag

SEQ ID NO: 30771 - DNA, 20 bp, Artificial Sequence
  chemically synthesized
tgatttcaaatatttcaaat

SEQ ID NO: 30772 - DNA, 20 bp, Artificial Sequence
  chemically synthesized
tcaaatatttcaaattagtt

SEQ ID NO: 30773 - DNA, 20 bp, Artificial Sequence
  chemically synthesized
ttcttttgtgttctaacata

SEQ ID NO: 30774 - DNA, 20 bp, Artificial Sequence
  chemically synthesized
ttctaacatatggtgtatcc

SEQ ID NO: 30775 - DNA, 20 bp, Artificial Sequence
  chemically synthesized
tctaacatatggtgtatcct

SEQ ID NO: 30776 - DNA, 20 bp, Artificial Sequence
  chemically synthesized
ctaacatatggtgtatcctg

SEQ ID NO: 30777 - DNA, 20 bp, Artificial Sequence
  chemically synthesized
ggaatgcgtcatgtgctgat

SEQ ID NO: 30778 - DNA, 20 bp, Artificial Sequence
  chemically synthesized
gatgagataaatatattctg

SEQ ID NO: 30779 - DNA, 20 bp, Artificial Sequence
  chemically synthesized
taaatatattctgtagctgt

SEQ ID NO: 30780 - DNA, 20 bp, Artificial Sequence
  chemically synthesized
atgaaatattgtgtaaatgt

SEQ ID NO: 30781 - DNA, 20 bp, Artificial Sequence
  chemically synthesized
gtgtaaatgttagatccatt

SEQ ID NO: 30782 - DNA, 20 bp, Artificial Sequence
  chemically synthesized
tgttagatccatttggtcta

SEQ ID NO: 30783 - DNA, 20 bp, Artificial Sequence
  chemically synthesized
gatccatttggtctaaagtc

SEQ ID NO: 30784 - DNA, 20 bp, Artificial Sequence
  chemically synthesized
ttctttgttaattttctgtc

SEQ ID NO: 30785 - DNA, 20 bp, Artificial Sequence
  chemically synthesized
tagatgatctatctgatgct

SEQ ID NO: 30786 - DNA, 20 bp, Artificial Sequence
  chemically synthesized
gatctatctgatgctgagat

SEQ ID NO: 30787 - DNA, 20 bp, Artificial Sequence
  chemically synthesized
atccccaactattattgtat

SEQ ID NO: 30788 - DNA, 20 bp, Artificial Sequence
  chemically synthesized
taacatttgctttacatatc

SEQ ID NO: 30789 - DNA, 20 bp, Artificial Sequence
  chemically synthesized
ctttacatatctggatgctc

SEQ ID NO: 30790 - DNA, 20 bp, Artificial Sequence
  chemically synthesized
tatctggatgctctggtgtt

SEQ ID NO: 30791 - DNA, 20 bp, Artificial Sequence
  chemically synthesized
tggtgttgagtgtgaatgtt

SEQ ID NO: 30792 - DNA, 20 bp, Artificial Sequence
  chemically synthesized
atgtaatgacttttgtctct

SEQ ID NO: 30793 - DNA, 20 bp, Artificial Sequence
  chemically synthesized
ctcttagtgttttttattta

SEQ ID NO: 30794 - DNA, 20 bp, Artificial Sequence
  chemically synthesized
aaagtcaattttatctgtta

SEQ ID NO: 30795 - DNA, 20 bp, Artificial Sequence
  chemically synthesized
aagtcaattttatctgttat

SEQ ID NO: 30796 - DNA, 20 bp, Artificial Sequence
  chemically synthesized
taactacttttgctcatttt

SEQ ID NO: 30797 - DNA, 20 bp, Artificial Sequence
  chemically synthesized
atttttggtttctctttgta

SEQ ID NO: 30798 - DNA, 20 bp, Artificial Sequence
  chemically synthesized
tttggtttctctttgtatgg

SEQ ID NO: 30799 - DNA, 20 bp, Artificial Sequence
  chemically synthesized
atctttcatctttttacttt

SEQ ID NO: 30800 - DNA, 20 bp, Artificial Sequence
  chemically synthesized
cagtctatatttatctttac

SEQ ID NO: 30801 - DNA, 20 bp, Artificial Sequence
  chemically synthesized
ctatatttatctttacaagt

SEQ ID NO: 30802 - DNA, 20 bp, Artificial Sequence
  chemically synthesized
tttatctttacaagtgagat

SEQ ID NO: 30803 - DNA, 20 bp, Artificial Sequence
  chemically synthesized
caagtgagataagtttctta

SEQ ID NO: 30804 - DNA, 20 bp, Artificial Sequence
  chemically synthesized
aagtgagataagtttcttat

SEQ ID NO: 30805 - DNA, 20 bp, Artificial Sequence
  chemically synthesized
tgagataagtttcttatagg

SEQ ID NO: 30806 - DNA, 20 bp, Artificial Sequence
  chemically synthesized
tcttataggcagcttacaac

SEQ ID NO: 30807 - DNA, 20 bp, Artificial Sequence
  chemically synthesized
cttataggcagcttacaact

SEQ ID NO: 30808 - DNA, 20 bp, Artificial Sequence
  chemically synthesized
atttttgttttaaatctatt

SEQ ID NO: 30809 - DNA, 20 bp, Artificial Sequence
  chemically synthesized
ttgttttaaatctatttagc

SEQ ID NO: 30810 - DNA, 20 bp, Artificial Sequence
  chemically synthesized
ttagccagtctatatctttc

SEQ ID NO: 30811 - DNA, 20 bp, Artificial Sequence
  chemically synthesized
aatttaatccatttacatgc

SEQ ID NO: 30812 - DNA, 20 bp, Artificial Sequence
  chemically synthesized
atttaatccatttacatgca

SEQ ID NO: 30813 - DNA, 20 bp, Artificial Sequence
  chemically synthesized
caaggctattattgacatgt

SEQ ID NO: 30814 - DNA, 20 bp, Artificial Sequence
  chemically synthesized
aggctattattgacatgtga

SEQ ID NO: 30815 - DNA, 20 bp, Artificial Sequence
  chemically synthesized
ccattttgttaattgattcc

SEQ ID NO: 30816 - DNA, 20 bp, Artificial Sequence
  chemically synthesized
tggttgttttgttttttttt

SEQ ID NO: 30817 - DNA, 20 bp, Artificial Sequence
  chemically synthesized
tttcttattatttatgattg

SEQ ID NO: 30818 - DNA, 20 bp, Artificial Sequence
  chemically synthesized
tattatttatgattgtggtt

SEQ ID NO: 30819 - DNA, 20 bp, Artificial Sequence
  chemically synthesized
tgtggtttggtgattttctg

SEQ ID NO: 30820 - DNA, 20 bp, Artificial Sequence
  chemically synthesized
ggtttggtgattttctgtag

SEQ ID NO: 30821 - DNA, 20 bp, Artificial Sequence
  chemically synthesized
tttctgtagtggtaacgttt

SEQ ID NO: 30822 - DNA, 20 bp, Artificial Sequence
  chemically synthesized
ttatttgtgttttgctctac

SEQ ID NO: 30823 - DNA, 20 bp, Artificial Sequence
  chemically synthesized
ttgtgttttgctctaccagt

SEQ ID NO: 30824 - DNA, 20 bp, Artificial Sequence
  chemically synthesized
acctttgtgtgtcttcataa

SEQ ID NO: 30825 - DNA, 20 bp, Artificial Sequence
  chemically synthesized
tttgtgtgtcttcataatgg

SEQ ID NO: 30826 - DNA, 20 bp, Artificial Sequence
  chemically synthesized
tgtcctgtcactttcatgtg

SEQ ID NO: 30827 - DNA, 20 bp, Artificial Sequence
  chemically synthesized
gtcctgtcactttcatgtgt

SEQ ID NO: 30828 - DNA, 20 bp, Artificial Sequence
  chemically synthesized
tcccttaaatatttcttgta

SEQ ID NO: 30829 - DNA, 20 bp, Artificial Sequence
  chemically synthesized
ttaaatatttcttgtaaagc

SEQ ID NO: 30830 - DNA, 20 bp, Artificial Sequence
  chemically synthesized
tatttcttgtaaagccagtc

SEQ ID NO: 30831 - DNA, 20 bp, Artificial Sequence
  chemically synthesized
ttgtaaagccagtctagtga

SEQ ID NO: 30832 - DNA, 20 bp, Artificial Sequence
  chemically synthesized
tccttcaaatttttcttgcc

SEQ ID NO: 30833 - DNA, 20 bp, Artificial Sequence
  chemically synthesized
caaatttttcttgcccagaa

SEQ ID NO: 30834 - DNA, 20 bp, Artificial Sequence
  chemically synthesized
ttatttatccttcatttttg

SEQ ID NO: 30835 - DNA, 20 bp, Artificial Sequence
  chemically synthesized
tttttgaagaacaatgttgc

SEQ ID NO: 30836 - DNA, 20 bp, Artificial Sequence
  chemically synthesized
ttttgaagaacaatgttgct

SEQ ID NO: 30837 - DNA, 20 bp, Artificial Sequence
  chemically synthesized
gttgctgggtataacatcct

SEQ ID NO: 30838 - DNA, 20 bp, Artificial Sequence
  chemically synthesized
tatatcatcccatcttctcc

SEQ ID NO: 30839 - DNA, 20 bp, Artificial Sequence
  chemically synthesized
cccatcttctcctggcctgt

SEQ ID NO: 30840 - DNA, 20 bp, Artificial Sequence
  chemically synthesized
ccatcttctcctggcctgtg

SEQ ID NO: 30841 - DNA, 20 bp, Artificial Sequence
  chemically synthesized
tggcctgtgaggtttctgct

SEQ ID NO: 30842 - DNA, 20 bp, Artificial Sequence
  chemically synthesized
ctgttaatctgttaatcttg

SEQ ID NO: 30843 - DNA, 20 bp, Artificial Sequence
  chemically synthesized
ttaatctgttaatcttgtgg

SEQ ID NO: 30844 - DNA, 20 bp, Artificial Sequence
  chemically synthesized
tcttgtggaagttcccttat

SEQ ID NO: 30845 - DNA, 20 bp, Artificial Sequence
  chemically synthesized
gaagttcccttataagtgac

SEQ ID NO: 30846 - DNA, 20 bp, Artificial Sequence
  chemically synthesized
agacattttgcttgctgttt

SEQ ID NO: 30847 - DNA, 20 bp, Artificial Sequence
  chemically synthesized
acattttgcttgctgtttta

SEQ ID NO: 30848 - DNA, 20 bp, Artificial Sequence
  chemically synthesized
gttttagagttcttactctt

SEQ ID NO: 30849 - DNA, 20 bp, Artificial Sequence
  chemically synthesized
tcttactctttggcttttga

SEQ ID NO: 30850 - DNA, 20 bp, Artificial Sequence
  chemically synthesized
agtttgactataatgtgctg

SEQ ID NO: 30851 - DNA, 20 bp, Artificial Sequence
  chemically synthesized
tttgactataatgtgctgtg

SEQ ID NO: 30852 - DNA, 20 bp, Artificial Sequence
  chemically synthesized
gactataatgtgctgtggag

SEQ ID NO: 30853 - DNA, 20 bp, Artificial Sequence
  chemically synthesized
ctataatgtgctgtggagaa

SEQ ID NO: 30854 - DNA, 20 bp, Artificial Sequence
  chemically synthesized
gctttttgcattatattatt

SEQ ID NO: 30855 - DNA, 20 bp, Artificial Sequence
  chemically synthesized
ctttttgcattatattattt

SEQ ID NO: 30856 - DNA, 20 bp, Artificial Sequence
  chemically synthesized
atttctgattttcatttgtc

SEQ ID NO: 30857 - DNA, 20 bp, Artificial Sequence
  chemically synthesized
tggatgtctacatttcttgc

SEQ ID NO: 30858 - DNA, 20 bp, Artificial Sequence
  chemically synthesized
catttcttgctagacttgac

SEQ ID NO: 30859 - DNA, 20 bp, Artificial Sequence
  chemically synthesized
tgctagacttgacaagtttt

SEQ ID NO: 30860 - DNA, 20 bp, Artificial Sequence
  chemically synthesized
tcagctattgtgttgttacg

SEQ ID NO: 30861 - DNA, 20 bp, Artificial Sequence
  chemically synthesized
cagctattgtgttgttacgt

SEQ ID NO: 30862 - DNA, 20 bp, Artificial Sequence
  chemically synthesized
ttcatgttctctttaccttc

SEQ ID NO: 30863 - DNA, 20 bp, Artificial Sequence
  chemically synthesized
tcatgttctctttaccttct

SEQ ID NO: 30864 - DNA, 20 bp, Artificial Sequence
  chemically synthesized
ttgaatatttgttcacttta

SEQ ID NO: 30865 - DNA, 20 bp, Artificial Sequence
  chemically synthesized
tttcctttctatcatttgac

SEQ ID NO: 30866 - DNA, 20 bp, Artificial Sequence
  chemically synthesized
atttgaccagctaattttaa

SEQ ID NO: 30867 - DNA, 20 bp, Artificial Sequence
  chemically synthesized
attttaaaagacctgtcttc

SEQ ID NO: 30868 - DNA, 20 bp, Artificial Sequence
  chemically synthesized
cttgatctgatctattgttg

SEQ ID NO: 30869 - DNA, 20 bp, Artificial Sequence
  chemically synthesized
atttctttcaataaactctt

SEQ ID NO: 30870 - DNA, 20 bp, Artificial Sequence
  chemically synthesized
ttcaataaactcttcagtta

SEQ ID NO: 30871 - DNA, 20 bp, Artificial Sequence
  chemically synthesized
tcagttacagaatttctgtt

SEQ ID NO: 30872 - DNA, 20 bp, Artificial Sequence
  chemically synthesized
ttcttgttgtatctatctct

SEQ ID NO: 30873 - DNA, 20 bp, Artificial Sequence
  chemically synthesized
tcttgttgtatctatctctt

SEQ ID NO: 30874 - DNA, 20 bp, Artificial Sequence
  chemically synthesized
tttctttttattgtttatct

SEQ ID NO: 30875 - DNA, 20 bp, Artificial Sequence
  chemically synthesized
gagttctcttgtgtctcact

SEQ ID NO: 30876 - DNA, 20 bp, Artificial Sequence
  chemically synthesized
cttccttaatatcaacattt

SEQ ID NO: 30877 - DNA, 20 bp, Artificial Sequence
  chemically synthesized
acattttggattcttttttc

SEQ ID NO: 30878 - DNA, 20 bp, Artificial Sequence
  chemically synthesized
taaatgtcttttttttccac

SEQ ID NO: 30879 - DNA, 20 bp, Artificial Sequence
  chemically synthesized
tccactggcttatgttgctg

SEQ ID NO: 30880 - DNA, 20 bp, Artificial Sequence
  chemically synthesized
gaagaattattaaattcctt

SEQ ID NO: 30881 - DNA, 20 bp, Artificial Sequence
  chemically synthesized
gaattattaaattcctttgg

SEQ ID NO: 30882 - DNA, 20 bp, Artificial Sequence
  chemically synthesized
tgcattgatatctctgcatc

SEQ ID NO: 30883 - DNA, 20 bp, Artificial Sequence
  chemically synthesized
ggtgtaatgattgctgcttc

SEQ ID NO: 30884 - DNA, 20 bp, Artificial Sequence
  chemically synthesized
gttttgtaaatttgtttttg

SEQ ID NO: 30885 - DNA, 20 bp, Artificial Sequence
  chemically synthesized
ttttgtaaatttgtttttgt

SEQ ID NO: 30886 - DNA, 20 bp, Artificial Sequence
  chemically synthesized
tttgtaaatttgtttttgta

SEQ ID NO: 30887 - DNA, 20 bp, Artificial Sequence
  chemically synthesized
ttgtaaatttgtttttgtag

SEQ ID NO: 30888 - DNA, 20 bp, Artificial Sequence
  chemically synthesized
taaatttgtttttgtagggg

SEQ ID NO: 30889 - DNA, 20 bp, Artificial Sequence
  chemically synthesized
taggggaagacttttttctg

SEQ ID NO: 30890 - DNA, 20 bp, Artificial Sequence
  chemically synthesized
ttttttctgaagatgtatct

SEQ ID NO: 30891 - DNA, 20 bp, Artificial Sequence
  chemically synthesized
gatgtatcttggtgttgatt

SEQ ID NO: 30892 - DNA, 20 bp, Artificial Sequence
  chemically synthesized
gtatcttggtgttgattgag

SEQ ID NO: 30893 - DNA, 20 bp, Artificial Sequence
  chemically synthesized
tatcttggtgttgattgagt

SEQ ID NO: 30894 - DNA, 20 bp, Artificial Sequence
  chemically synthesized
atcttggtgttgattgagta

SEQ ID NO: 30895 - DNA, 20 bp, Artificial Sequence
  chemically synthesized
ggcactttgattttgatttc

SEQ ID NO: 30896 - DNA, 20 bp, Artificial Sequence
  chemically synthesized
gcactttgattttgatttct

SEQ ID NO: 30897 - DNA, 20 bp, Artificial Sequence
  chemically synthesized
ttttgatttctaggtgcata

SEQ ID NO: 30898 - DNA, 20 bp, Artificial Sequence
  chemically synthesized
tgatttctaggtgcatacag

SEQ ID NO: 30899 - DNA, 20 bp, Artificial Sequence
  chemically synthesized
tctaggtgcatacagcagca

SEQ ID NO: 30900 - DNA, 20 bp, Artificial Sequence
  chemically synthesized
gtcttcatattatttttttt

SEQ ID NO: 30901 - DNA, 20 bp, Artificial Sequence
  chemically synthesized
tattttttttcagctgccaa

SEQ ID NO: 30902 - DNA, 20 bp, Artificial Sequence
  chemically synthesized
tcagctgccaacagtatcat

SEQ ID NO: 30903 - DNA, 20 bp, Artificial Sequence
  chemically synthesized
atcagtgtctgtgatttttt

SEQ ID NO: 30904 - DNA, 20 bp, Artificial Sequence
  chemically synthesized
agtgtctgtgattttttcag

SEQ ID NO: 30905 - DNA, 20 bp, Artificial Sequence
  chemically synthesized
ctgtgattttttcagtggct

SEQ ID NO: 30906 - DNA, 20 bp, Artificial Sequence
  chemically synthesized
tgtgattttttcagtggctt

SEQ ID NO: 30907 - DNA, 20 bp, Artificial Sequence
  chemically synthesized
gtgattttttcagtggctta

SEQ ID NO: 30908 - DNA, 20 bp, Artificial Sequence
  chemically synthesized
gtggcttagggtgcatttgt

SEQ ID NO: 30909 - DNA, 20 bp, Artificial Sequence
  chemically synthesized
ttagggtgcatttgttagtg

SEQ ID NO: 30910 - DNA, 20 bp, Artificial Sequence
  chemically synthesized
tagggtgcatttgttagtga

SEQ ID NO: 30911 - DNA, 20 bp, Artificial Sequence
  chemically synthesized
ggtgcatttgttagtgaagg

SEQ ID NO: 30912 - DNA, 20 bp, Artificial Sequence
  chemically synthesized
ttgttagtgaaggtggtgat

SEQ ID NO: 30913 - DNA, 20 bp, Artificial Sequence
  chemically synthesized
tgttagtgaaggtggtgatg

SEQ ID NO: 30914 - DNA, 20 bp, Artificial Sequence
  chemically synthesized
aggtggtgatgaggttgtgc

SEQ ID NO: 30915 - DNA, 20 bp, Artificial Sequence
  chemically synthesized
gtggtgatgaggttgtgctg

SEQ ID NO: 30916 - DNA, 20 bp, Artificial Sequence
  chemically synthesized
gatgaggttgtgctggagac

SEQ ID NO: 30917 - DNA, 20 bp, Artificial Sequence
  chemically synthesized
gtgctggagacaagaatatc

SEQ ID NO: 30918 - DNA, 20 bp, Artificial Sequence
  chemically synthesized
ctggagacaagaatatcaag

SEQ ID NO: 30919 - DNA, 20 bp, Artificial Sequence
  chemically synthesized
tggagacaagaatatcaagt

SEQ ID NO: 30920 - DNA, 20 bp, Artificial Sequence
  chemically synthesized
gacaagaatatcaagtgggc

SEQ ID NO: 30921 - DNA, 20 bp, Artificial Sequence
  chemically synthesized
atatcaagtgggccagtcct

SEQ ID NO: 30922 - DNA, 20 bp, Artificial Sequence
  chemically synthesized
agtgggccagtccttggccc

SEQ ID NO: 30923 - DNA, 20 bp, Artificial Sequence
  chemically synthesized
gggccagtccttggccccag

SEQ ID NO: 30924 - DNA, 20 bp, Artificial Sequence
  chemically synthesized
ccagtccttggccccagtgg

SEQ ID NO: 30925 - DNA, 20 bp, Artificial Sequence
  chemically synthesized
gtccttggccccagtggtgg

SEQ ID NO: 30926 - DNA, 20 bp, Artificial Sequence
  chemically synthesized
cttggccccagtggtggtgg

SEQ ID NO: 30927 - DNA, 20 bp, Artificial Sequence
  chemically synthesized
ttggccccagtggtggtggt

SEQ ID NO: 30928 - DNA, 20 bp, Artificial Sequence
  chemically synthesized
cccagtggtggtggtgggcc

SEQ ID NO: 30929 - DNA, 20 bp, Artificial Sequence
  chemically synthesized
gggcctagcattcctgtcct

SEQ ID NO: 30930 - DNA, 20 bp, Artificial Sequence
  chemically synthesized
ggcctagcattcctgtcctt

SEQ ID NO: 30931 - DNA, 20 bp, Artificial Sequence
  chemically synthesized
attcctgtccttgggcccca

SEQ ID NO: 30932 - DNA, 20 bp, Artificial Sequence
  chemically synthesized
ggccccatggctgtgtacat

SEQ ID NO: 30933 - DNA, 20 bp, Artificial Sequence
  chemically synthesized
gctgtgtacattggcactga

SEQ ID NO: 30934 - DNA, 20 bp, Artificial Sequence
  chemically synthesized
acattggcactgatggtaat

SEQ ID NO: 30935 - DNA, 20 bp, Artificial Sequence
  chemically synthesized
ggcactgatggtaatgagtc

SEQ ID NO: 30936 - DNA, 20 bp, Artificial Sequence
  chemically synthesized
ctgatggtaatgagtctagt

SEQ ID NO: 30937 - DNA, 20 bp, Artificial Sequence
  chemically synthesized
tgatggtaatgagtctagtt

SEQ ID NO: 30938 - DNA, 20 bp, Artificial Sequence
  chemically synthesized
gtctagttgggttgattctt

SEQ ID NO: 30939 - DNA, 20 bp, Artificial Sequence
  chemically synthesized
tgggttgattctttggcctt

SEQ ID NO: 30940 - DNA, 20 bp, Artificial Sequence
  chemically synthesized
gggttgattctttggccttc

SEQ ID NO: 30941 - DNA, 20 bp, Artificial Sequence
  chemically synthesized
ttgattctttggccttcagg

SEQ ID NO: 30942 - DNA, 20 bp, Artificial Sequence
  chemically synthesized
tggccttcaggcagtttgct

SEQ ID NO: 30943 - DNA, 20 bp, Artificial Sequence
  chemically synthesized
ggccttcaggcagtttgctt

SEQ ID NO: 30944 - DNA, 20 bp, Artificial Sequence
  chemically synthesized
caggcagtttgcttgggtgt

SEQ ID NO: 30945 - DNA, 20 bp, Artificial Sequence
  chemically synthesized
gcagtttgcttgggtgtcag

SEQ ID NO: 30946 - DNA, 20 bp, Artificial Sequence
  chemically synthesized
gtttgcttgggtgtcagtag

SEQ ID NO: 30947 - DNA, 20 bp, Artificial Sequence
  chemically synthesized
ttgggtgtcagtagtggcca

SEQ ID NO: 30948 - DNA, 20 bp, Artificial Sequence
  chemically synthesized
ggtgtcagtagtggccatag

SEQ ID NO: 30949 - DNA, 20 bp, Artificial Sequence
  chemically synthesized
cagtagtggccatagtagac

SEQ ID NO: 30950 - DNA, 20 bp, Artificial Sequence
  chemically synthesized
agtagtggccatagtagact

SEQ ID NO: 30951 - DNA, 20 bp, Artificial Sequence
  chemically synthesized
gtggccatagtagactgggc

SEQ ID NO: 30952 - DNA, 20 bp, Artificial Sequence
  chemically synthesized
tagtagactgggctggtgtg

SEQ ID NO: 30953 - DNA, 20 bp, Artificial Sequence
  chemically synthesized
agtagactgggctggtgtgt

SEQ ID NO: 30954 - DNA, 20 bp, Artificial Sequence
  chemically synthesized
tgggctggtgtgtgggtcct

SEQ ID NO: 30955 - DNA, 20 bp, Artificial Sequence
  chemically synthesized
gggctggtgtgtgggtcctc

SEQ ID NO: 30956 - DNA, 20 bp, Artificial Sequence
  chemically synthesized
tgtgtgggtcctcaggcttc

SEQ ID NO: 30957 - DNA, 20 bp, Artificial Sequence
  chemically synthesized
tgggtcctcaggcttctgga

SEQ ID NO: 30958 - DNA, 20 bp, Artificial Sequence
  chemically synthesized
gtcctcaggcttctggacag

SEQ ID NO: 30959 - DNA, 20 bp, Artificial Sequence
  chemically synthesized
tcctcaggcttctggacagt

SEQ ID NO: 30960 - DNA, 20 bp, Artificial Sequence
  chemically synthesized
aggcttctggacagtgggtg

SEQ ID NO: 30961 - DNA, 20 bp, Artificial Sequence
  chemically synthesized
tctggacagtgggtgtggtg

SEQ ID NO: 30962 - DNA, 20 bp, Artificial Sequence
  chemically synthesized
ctggacagtgggtgtggtgt

SEQ ID NO: 30963 - DNA, 20 bp, Artificial Sequence
  chemically synthesized
agtgggtgtggtgtgggtga

SEQ ID NO: 30964 - DNA, 20 bp, Artificial Sequence
  chemically synthesized
tgtggtgtgggtgatggctg

SEQ ID NO: 30965 - DNA, 20 bp, Artificial Sequence
  chemically synthesized
ggtgatggctgtagcaactg

SEQ ID NO: 30966 - DNA, 20 bp, Artificial Sequence
  chemically synthesized
gtgatggctgtagcaactgc

SEQ ID NO: 30967 - DNA, 20 bp, Artificial Sequence
  chemically synthesized
gcaactgcaggacaaccctc

SEQ ID NO: 30968 - DNA, 20 bp, Artificial Sequence
  chemically synthesized
aggacaaccctctggctccc

SEQ ID NO: 30969 - DNA, 20 bp, Artificial Sequence
  chemically synthesized
acaaccctctggctcccaag

SEQ ID NO: 30970 - DNA, 20 bp, Artificial Sequence
  chemically synthesized
ggctcccaagcagtctgcac

SEQ ID NO: 30971 - DNA, 20 bp, Artificial Sequence
  chemically synthesized
caagcagtctgcactggtgt

SEQ ID NO: 30972 - DNA, 20 bp, Artificial Sequence
  chemically synthesized
gcagtctgcactggtgttgg

SEQ ID NO: 30973 - DNA, 20 bp, Artificial Sequence
  chemically synthesized
gtctgcactggtgttggtgg

SEQ ID NO: 30974 - DNA, 20 bp, Artificial Sequence
  chemically synthesized
ctggtgttggtggtggctgc

SEQ ID NO: 30975 - DNA, 20 bp, Artificial Sequence
  chemically synthesized
tggtgttggtggtggctgca

SEQ ID NO: 30976 - DNA, 20 bp, Artificial Sequence
  chemically synthesized
ggtgttggtggtggctgcaa

SEQ ID NO: 30977 - DNA, 20 bp, Artificial Sequence
  chemically synthesized
ggtggctgcaagggctgaat

SEQ ID NO: 30978 - DNA, 20 bp, Artificial Sequence
  chemically synthesized
gctgcaagggctgaatgagc

SEQ ID NO: 30979 - DNA, 20 bp, Artificial Sequence
  chemically synthesized
gggctgaatgagccagtctt

SEQ ID NO: 30980 - DNA, 20 bp, Artificial Sequence
  chemically synthesized
tgagccagtcttcagaccca

SEQ ID NO: 30981 - DNA, 20 bp, Artificial Sequence
  chemically synthesized
gagccagtcttcagacccac

SEQ ID NO: 30982 - DNA, 20 bp, Artificial Sequence
  chemically synthesized
ccagtcttcagacccacagg

SEQ ID NO: 30983 - DNA, 20 bp, Artificial Sequence
  chemically synthesized
agacccacaggtggcacatg

SEQ ID NO: 30984 - DNA, 20 bp, Artificial Sequence
  chemically synthesized
gacccacaggtggcacatgc

SEQ ID NO: 30985 - DNA, 20 bp, Artificial Sequence
  chemically synthesized
cccacaggtggcacatgcag

SEQ ID NO: 30986 - DNA, 20 bp, Artificial Sequence
  chemically synthesized
ccacaggtggcacatgcagg

SEQ ID NO: 30987 - DNA, 20 bp, Artificial Sequence
  chemically synthesized
gtggcacatgcaggaggtgc

SEQ ID NO: 30988 - DNA, 20 bp, Artificial Sequence
  chemically synthesized
gcaggaggtgccagttgtga

SEQ ID NO: 30989 - DNA, 20 bp, Artificial Sequence
  chemically synthesized
ggaggtgccagttgtgatgg

SEQ ID NO: 30990 - DNA, 20 bp, Artificial Sequence
  chemically synthesized
ggtgccagttgtgatggcag

SEQ ID NO: 30991 - DNA, 20 bp, Artificial Sequence
  chemically synthesized
gccagttgtgatggcagtgg

SEQ ID NO: 30992 - DNA, 20 bp, Artificial Sequence
  chemically synthesized
ttgtgatggcagtggcagat

SEQ ID NO: 30993 - DNA, 20 bp, Artificial Sequence
  chemically synthesized
tgtgatggcagtggcagatt

SEQ ID NO: 30994 - DNA, 20 bp, Artificial Sequence
  chemically synthesized
gatggcagtggcagattggg

SEQ ID NO: 30995 - DNA, 20 bp, Artificial Sequence
  chemically synthesized
atggcagtggcagattgggt

SEQ ID NO: 30996 - DNA, 20 bp, Artificial Sequence
  chemically synthesized
agattgggtaggcccatcat

SEQ ID NO: 30997 - DNA, 20 bp, Artificial Sequence
  chemically synthesized
gattgggtaggcccatcatc

SEQ ID NO: 30998 - DNA, 20 bp, Artificial Sequence
  chemically synthesized
taggcccatcatcaggcttc

SEQ ID NO: 30999 - DNA, 20 bp, Artificial Sequence
  chemically synthesized
aggcccatcatcaggcttct

SEQ ID NO: 31000 - DNA, 20 bp, Artificial Sequence
  chemically synthesized
gcccatcatcaggcttctgg

SEQ ID NO: 31001 - DNA, 20 bp, Artificial Sequence
  chemically synthesized
cccatcatcaggcttctggg

SEQ ID NO: 31002 - DNA, 20 bp, Artificial Sequence
  chemically synthesized
ccatcatcaggcttctggga

SEQ ID NO: 31003 - DNA, 20 bp, Artificial Sequence
  chemically synthesized
aggcttctgggagggttgct

SEQ ID NO: 31004 - DNA, 20 bp, Artificial Sequence
  chemically synthesized
ggcttctgggagggttgctt

SEQ ID NO: 31005 - DNA, 20 bp, Artificial Sequence
  chemically synthesized
tgggagggttgcttaggtac

SEQ ID NO: 31006 - DNA, 20 bp, Artificial Sequence
  chemically synthesized
ggttgcttaggtaccagtca

SEQ ID NO: 31007 - DNA, 20 bp, Artificial Sequence
  chemically synthesized
tgcttaggtaccagtcatgg

SEQ ID NO: 31008 - DNA, 20 bp, Artificial Sequence
  chemically synthesized
taggtaccagtcatggtgga

SEQ ID NO: 31009 - DNA, 20 bp, Artificial Sequence
  chemically synthesized
ccagtcatggtggatggcac

SEQ ID NO: 31010 - DNA, 20 bp, Artificial Sequence
  chemically synthesized
cagtcatggtggatggcaca

SEQ ID NO: 31011 - DNA, 20 bp, Artificial Sequence
  chemically synthesized
ggatggcacaaggctgtctc

SEQ ID NO: 31012 - DNA, 20 bp, Artificial Sequence
  chemically synthesized
gatggcacaaggctgtctct

SEQ ID NO: 31013 - DNA, 20 bp, Artificial Sequence
  chemically synthesized
caaggctgtctctgggttcc

SEQ ID NO: 31014 - DNA, 20 bp, Artificial Sequence
  chemically synthesized
gggttcccagacaacttgct

SEQ ID NO: 31015 - DNA, 20 bp, Artificial Sequence
  chemically synthesized
ggttcccagacaacttgctt

SEQ ID NO: 31016 - DNA, 20 bp, Artificial Sequence
  chemically synthesized
agacaacttgcttaggcatt

SEQ ID NO: 31017 - DNA, 20 bp, Artificial Sequence
  chemically synthesized
gacaacttgcttaggcattg

SEQ ID NO: 31018 - DNA, 20 bp, Artificial Sequence
  chemically synthesized
aacttgcttaggcattgagg

SEQ ID NO: 31019 - DNA, 20 bp, Artificial Sequence
  chemically synthesized
acttgcttaggcattgagga

SEQ ID NO: 31020 - DNA, 20 bp, Artificial Sequence
  chemically synthesized
cttaggcattgaggaaggca

SEQ ID NO: 31021 - DNA, 20 bp, Artificial Sequence
  chemically synthesized
ggcattgaggaaggcaaagc

SEQ ID NO: 31022 - DNA, 20 bp, Artificial Sequence
  chemically synthesized
gcattgaggaaggcaaagcc

SEQ ID NO: 31023 - DNA, 20 bp, Artificial Sequence
  chemically synthesized
tgaggaaggcaaagccaggc

SEQ ID NO: 31024 - DNA, 20 bp, Artificial Sequence
  chemically synthesized
gaggaaggcaaagccaggct

SEQ ID NO: 31025 - DNA, 20 bp, Artificial Sequence
  chemically synthesized
aggctgggtgttcctgacct

SEQ ID NO: 31026 - DNA, 20 bp, Artificial Sequence
  chemically synthesized
ggctgggtgttcctgacctc

SEQ ID NO: 31027 - DNA, 20 bp, Artificial Sequence
  chemically synthesized
gttcctgacctcaggccact

SEQ ID NO: 31028 - DNA, 20 bp, Artificial Sequence
  chemically synthesized
cctgacctcaggccactcag

SEQ ID NO: 31029 - DNA, 20 bp, Artificial Sequence
  chemically synthesized
aggccactcagtggtgtgtg

SEQ ID NO: 31030 - DNA, 20 bp, Artificial Sequence
  chemically synthesized
tcagtggtgtgtgtggacac

SEQ ID NO: 31031 - DNA, 20 bp, Artificial Sequence
  chemically synthesized
tgtgtggacaccggctatca

SEQ ID NO: 31032 - DNA, 20 bp, Artificial Sequence
  chemically synthesized
gtgtggacaccggctatcat

SEQ ID NO: 31033 - DNA, 20 bp, Artificial Sequence
  chemically synthesized
ggacaccggctatcataggc

SEQ ID NO: 31034 - DNA, 20 bp, Artificial Sequence
  chemically synthesized
acaccggctatcataggctg

SEQ ID NO: 31035 - DNA, 20 bp, Artificial Sequence
  chemically synthesized
ccggctatcataggctggag

SEQ ID NO: 31036 - DNA, 20 bp, Artificial Sequence
  chemically synthesized
ggctatcataggctggagtg

SEQ ID NO: 31037 - DNA, 20 bp, Artificial Sequence
  chemically synthesized
ggctggagtggagtgatcct

SEQ ID NO: 31038 - DNA, 20 bp, Artificial Sequence
  chemically synthesized
gctggagtggagtgatcctc

SEQ ID NO: 31039 - DNA, 20 bp, Artificial Sequence
  chemically synthesized
tggagtgatcctcaggcccc

SEQ ID NO: 31040 - DNA, 20 bp, Artificial Sequence
  chemically synthesized
agtgatcctcaggcccccag

SEQ ID NO: 31041 - DNA, 20 bp, Artificial Sequence
  chemically synthesized
aggcccccagcagaatgcct

SEQ ID NO: 31042 - DNA, 20 bp, Artificial Sequence
  chemically synthesized
agcagaatgcctgagtgaat

SEQ ID NO: 31043 - DNA, 20 bp, Artificial Sequence
  chemically synthesized
agaatgcctgagtgaattag

SEQ ID NO: 31044 - DNA, 20 bp, Artificial Sequence
  chemically synthesized
gcattgttgccctgctcttg

SEQ ID NO: 31045 - DNA, 20 bp, Artificial Sequence
  chemically synthesized
cattgttgccctgctcttga

SEQ ID NO: 31046 - DNA, 20 bp, Artificial Sequence
  chemically synthesized
attgttgccctgctcttgaa

SEQ ID NO: 31047 - DNA, 20 bp, Artificial Sequence
  chemically synthesized
ttgttgccctgctcttgaag

SEQ ID NO: 31048 - DNA, 20 bp, Artificial Sequence
  chemically synthesized
gccctgctcttgaaggggtg

SEQ ID NO: 31049 - DNA, 20 bp, Artificial Sequence
  chemically synthesized
ccctgctcttgaaggggtgc

SEQ ID NO: 31050 - DNA, 20 bp, Artificial Sequence
  chemically synthesized
cctgctcttgaaggggtgcg

SEQ ID NO: 31051 - DNA, 20 bp, Artificial Sequence
  chemically synthesized
ggtgcggggtgtgttgcttt

SEQ ID NO: 31052 - DNA, 20 bp, Artificial Sequence
  chemically synthesized
gcggggtgtgttgctttcag

SEQ ID NO: 31053 - DNA, 20 bp, Artificial Sequence
  chemically synthesized
gggtgtgttgctttcagtgg

SEQ ID NO: 31054 - DNA, 20 bp, Artificial Sequence
  chemically synthesized
tgtgttgctttcagtggcag

SEQ ID NO: 31055 - DNA, 20 bp, Artificial Sequence
  chemically synthesized
tcagtggcagcagctataaa

SEQ ID NO: 31056 - DNA, 20 bp, Artificial Sequence
  chemically synthesized
cagtggcagcagctataaat

SEQ ID NO: 31057 - DNA, 20 bp, Artificial Sequence
  chemically synthesized
agcagctataaatgggttgc

SEQ ID NO: 31058 - DNA, 20 bp, Artificial Sequence
  chemically synthesized
agctataaatgggttgctgg

SEQ ID NO: 31059 - DNA, 20 bp, Artificial Sequence
  chemically synthesized
gctataaatgggttgctggt

SEQ ID NO: 31060 - DNA, 20 bp, Artificial Sequence
  chemically synthesized
ttgctggtgggcatgtgttt

SEQ ID NO: 31061 - DNA, 20 bp, Artificial Sequence
  chemically synthesized
gtgggcatgtgtttcagccc

SEQ ID NO: 31062 - DNA, 20 bp, Artificial Sequence
  chemically synthesized
gcatgtgtttcagccccaga

SEQ ID NO: 31063 - DNA, 20 bp, Artificial Sequence
  chemically synthesized
tgtgtttcagccccagatgg

SEQ ID NO: 31064 - DNA, 20 bp, Artificial Sequence
  chemically synthesized
cagccccagatggtggctgc

SEQ ID NO: 31065 - DNA, 20 bp, Artificial Sequence
  chemically synthesized
ccccagatggtggctgcaag

SEQ ID NO: 31066 - DNA, 20 bp, Artificial Sequence
  chemically synthesized
cccagatggtggctgcaagt

SEQ ID NO: 31067 - DNA, 20 bp, Artificial Sequence
  chemically synthesized
ccagatggtggctgcaagtg

SEQ ID NO: 31068 - DNA, 20 bp, Artificial Sequence
  chemically synthesized
gatggtggctgcaagtgggg

SEQ ID NO: 31069 - DNA, 20 bp, Artificial Sequence
  chemically synthesized
caagtggggtagcattttct

SEQ ID NO: 31070 - DNA, 20 bp, Artificial Sequence
  chemically synthesized
aagtggggtagcattttctt

SEQ ID NO: 31071 - DNA, 20 bp, Artificial Sequence
  chemically synthesized
agtggggtagcattttctta

SEQ ID NO: 31072 - DNA, 20 bp, Artificial Sequence
  chemically synthesized
tggggtagcattttcttagg

SEQ ID NO: 31073 - DNA, 20 bp, Artificial Sequence
  chemically synthesized
ttagggagcttataaatgtg

SEQ ID NO: 31074 - DNA, 20 bp, Artificial Sequence
  chemically synthesized
gggagcttataaatgtgtag

SEQ ID NO: 31075 - DNA, 20 bp, Artificial Sequence
  chemically synthesized
atgtgtagcagccctgctac

SEQ ID NO: 31076 - DNA, 20 bp, Artificial Sequence
  chemically synthesized
tgtgtagcagccctgctact

SEQ ID NO: 31077 - DNA, 20 bp, Artificial Sequence
  chemically synthesized
gtgtagcagccctgctactg

SEQ ID NO: 31078 - DNA, 20 bp, Artificial Sequence
  chemically synthesized
tgtagcagccctgctactgg

SEQ ID NO: 31079 - DNA, 20 bp, Artificial Sequence
  chemically synthesized
agcagccctgctactggggg

SEQ ID NO: 31080 - DNA, 20 bp, Artificial Sequence
  chemically synthesized
gcagccctgctactgggggt

SEQ ID NO: 31081 - DNA, 20 bp, Artificial Sequence
  chemically synthesized
cagccctgctactgggggtg

SEQ ID NO: 31082 - DNA, 20 bp, Artificial Sequence
  chemically synthesized
agccctgctactgggggtgg

SEQ ID NO: 31083 - DNA, 20 bp, Artificial Sequence
  chemically synthesized
ccctgctactgggggtgggg

SEQ ID NO: 31084 - DNA, 20 bp, Artificial Sequence
  chemically synthesized
ctaatgacacactttatccc

SEQ ID NO: 31085 - DNA, 20 bp, Artificial Sequence
  chemically synthesized
acacactttatccctggtga

SEQ ID NO: 31086 - DNA, 20 bp, Artificial Sequence
  chemically synthesized
cactttatccctggtgacag

SEQ ID NO: 31087 - DNA, 20 bp, Artificial Sequence
  chemically synthesized
ttatccctggtgacagcagc

SEQ ID NO: 31088 - DNA, 20 bp, Artificial Sequence
  chemically synthesized
tccctggtgacagcagccag

SEQ ID NO: 31089 - DNA, 20 bp, Artificial Sequence
  chemically synthesized
ctggtgacagcagccagcag

SEQ ID NO: 31090 - DNA, 20 bp, Artificial Sequence
  chemically synthesized
cagcagccagcagtagcact

SEQ ID NO: 31091 - DNA, 20 bp, Artificial Sequence
  chemically synthesized
ccagcagtagcactcagctg

SEQ ID NO: 31092 - DNA, 20 bp, Artificial Sequence
  chemically synthesized
cagcagtagcactcagctgt

SEQ ID NO: 31093 - DNA, 20 bp, Artificial Sequence
  chemically synthesized
cagtagcactcagctgtggg

SEQ ID NO: 31094 - DNA, 20 bp, Artificial Sequence
  chemically synthesized
agtagcactcagctgtgggt

SEQ ID NO: 31095 - DNA, 20 bp, Artificial Sequence
  chemically synthesized
gtagcactcagctgtgggtg

SEQ ID NO: 31096 - DNA, 20 bp, Artificial Sequence
  chemically synthesized
tagcactcagctgtgggtgg

SEQ ID NO: 31097 - DNA, 20 bp, Artificial Sequence
  chemically synthesized
cagctgtgggtgggggatgt

SEQ ID NO: 31098 - DNA, 20 bp, Artificial Sequence
  chemically synthesized
ctgtgggtgggggatgtcag

SEQ ID NO: 31099 - DNA, 20 bp, Artificial Sequence
  chemically synthesized
gtgggtgggggatgtcagca

SEQ ID NO: 31100 - DNA, 20 bp, Artificial Sequence
  chemically synthesized
gggggatgtcagcagagctt

SEQ ID NO: 31101 - DNA, 20 bp, Artificial Sequence
  chemically synthesized
ggggatgtcagcagagcttc

SEQ ID NO: 31102 - DNA, 20 bp, Artificial Sequence
  chemically synthesized
gggatgtcagcagagcttca

SEQ ID NO: 31103 - DNA, 20 bp, Artificial Sequence
  chemically synthesized
tcagcagagcttcagggatg

SEQ ID NO: 31104 - DNA, 20 bp, Artificial Sequence
  chemically synthesized
agcagagcttcagggatgta

SEQ ID NO: 31105 - DNA, 20 bp, Artificial Sequence
  chemically synthesized
gcttcagggatgtagagatg

SEQ ID NO: 31106 - DNA, 20 bp, Artificial Sequence
  chemically synthesized
tgtagagatgcagatgatgt

SEQ ID NO: 31107 - DNA, 20 bp, Artificial Sequence
  chemically synthesized
gtagagatgcagatgatgtt

SEQ ID NO: 31108 - DNA, 20 bp, Artificial Sequence
  chemically synthesized
tagagatgcagatgatgttg

SEQ ID NO: 31109 - DNA, 20 bp, Artificial Sequence
  chemically synthesized
tgcagatgatgttggggtct

SEQ ID NO: 31110 - DNA, 20 bp, Artificial Sequence
  chemically synthesized
gcagatgatgttggggtctg

SEQ ID NO: 31111 - DNA, 20 bp, Artificial Sequence
  chemically synthesized
gtctgaggaacgatgtcatc

SEQ ID NO: 31112 - DNA, 20 bp, Artificial Sequence
  chemically synthesized
tgaggaacgatgtcatctgg

SEQ ID NO: 31113 - DNA, 20 bp, Artificial Sequence
  chemically synthesized
gaggaacgatgtcatctggt

SEQ ID NO: 31114 - DNA, 20 bp, Artificial Sequence
  chemically synthesized
cgatgtcatctggtgggtgt

SEQ ID NO: 31115 - DNA, 20 bp, Artificial Sequence
  chemically synthesized
gatgtcatctggtgggtgtt

SEQ ID NO: 31116 - DNA, 20 bp, Artificial Sequence
  chemically synthesized
tgggtgttgggctctcaaaa

SEQ ID NO: 31117 - DNA, 20 bp, Artificial Sequence
  chemically synthesized
caaaatggcaccttgctgct

SEQ ID NO: 31118 - DNA, 20 bp, Artificial Sequence
  chemically synthesized
ggcaccttgctgctcagtaa

SEQ ID NO: 31119 - DNA, 20 bp, Artificial Sequence
  chemically synthesized
gcaccttgctgctcagtaat

SEQ ID NO: 31120 - DNA, 20 bp, Artificial Sequence
  chemically synthesized
caccttgctgctcagtaatg

SEQ ID NO: 31121 - DNA, 20 bp, Artificial Sequence
  chemically synthesized
ttgctgctcagtaatgggga

SEQ ID NO: 31122 - DNA, 20 bp, Artificial Sequence
  chemically synthesized
ctgctcagtaatggggatgg

SEQ ID NO: 31123 - DNA, 20 bp, Artificial Sequence
  chemically synthesized
tgctcagtaatggggatggc

SEQ ID NO: 31124 - DNA, 20 bp, Artificial Sequence
  chemically synthesized
gctcagtaatggggatggca

SEQ ID NO: 31125 - DNA, 20 bp, Artificial Sequence
  chemically synthesized
ctcagtaatggggatggcag

SEQ ID NO: 31126 - DNA, 20 bp, Artificial Sequence
  chemically synthesized
agtaatggggatggcagggg

SEQ ID NO: 31127 - DNA, 20 bp, Artificial Sequence
  chemically synthesized
gtaatggggatggcaggggt

SEQ ID NO: 31128 - DNA, 20 bp, Artificial Sequence
  chemically synthesized
gggatggcaggggtgggacc

SEQ ID NO: 31129 - DNA, 20 bp, Artificial Sequence
  chemically synthesized
tggcaggggtgggacccagt

SEQ ID NO: 31130 - DNA, 20 bp, Artificial Sequence
  chemically synthesized
gcaggggtgggacccagtga

SEQ ID NO: 31131 - DNA, 20 bp, Artificial Sequence
  chemically synthesized
cccagtgagagctccttctc

SEQ ID NO: 31132 - DNA, 20 bp, Artificial Sequence
  chemically synthesized
cagtgagagctccttctctg

SEQ ID NO: 31133 - DNA, 20 bp, Artificial Sequence
  chemically synthesized
caatgcctttgtgcgattgc

SEQ ID NO: 31134 - DNA, 20 bp, Artificial Sequence
  chemically synthesized
aatgcctttgtgcgattgct

SEQ ID NO: 31135 - DNA, 20 bp, Artificial Sequence
  chemically synthesized
gcctttgtgcgattgctggg

SEQ ID NO: 31136 - DNA, 20 bp, Artificial Sequence
  chemically synthesized
tgctgggcagttccttatga

SEQ ID NO: 31137 - DNA, 20 bp, Artificial Sequence
  chemically synthesized
cagttccttatgatagtctc

SEQ ID NO: 31138 - DNA, 20 bp, Artificial Sequence
  chemically synthesized
agttccttatgatagtctca

SEQ ID NO: 31139 - DNA, 20 bp, Artificial Sequence
  chemically synthesized
tgatagtctcaaggcctgca

SEQ ID NO: 31140 - DNA, 20 bp, Artificial Sequence
  chemically synthesized
gtctcaaggcctgcatggtc

SEQ ID NO: 31141 - DNA, 20 bp, Artificial Sequence
  chemically synthesized
tctcaaggcctgcatggtca

SEQ ID NO: 31142 - DNA, 20 bp, Artificial Sequence
  chemically synthesized
ctcaaggcctgcatggtcaa

SEQ ID NO: 31143 - DNA, 20 bp, Artificial Sequence
  chemically synthesized
atggtcaagggactctcctg

SEQ ID NO: 31144 - DNA, 20 bp, Artificial Sequence
  chemically synthesized
tcaagggactctcctgtggc

SEQ ID NO: 31145 - DNA, 20 bp, Artificial Sequence
  chemically synthesized
caagggactctcctgtggct

SEQ ID NO: 31146 - DNA, 20 bp, Artificial Sequence
  chemically synthesized
tctcctgtggctaggattcc

SEQ ID NO: 31147 - DNA, 20 bp, Artificial Sequence
  chemically synthesized
tcctgtggctaggattcctg

SEQ ID NO: 31148 - DNA, 20 bp, Artificial Sequence
  chemically synthesized
gattcctggagtccataatg

SEQ ID NO: 31149 - DNA, 20 bp, Artificial Sequence
  chemically synthesized
tggagtccataatgcagatg

SEQ ID NO: 31150 - DNA, 20 bp, Artificial Sequence
  chemically synthesized
ataatgcagatgtggaccac

SEQ ID NO: 31151 - DNA, 20 bp, Artificial Sequence
  chemically synthesized
taatgcagatgtggaccact

SEQ ID NO: 31152 - DNA, 20 bp, Artificial Sequence
  chemically synthesized
atgcagatgtggaccactgg

SEQ ID NO: 31153 - DNA, 20 bp, Artificial Sequence
  chemically synthesized
agatgtggaccactgggagt

SEQ ID NO: 31154 - DNA, 20 bp, Artificial Sequence
  chemically synthesized
tcacttaactttcgatgcac

SEQ ID NO: 31155 - DNA, 20 bp, Artificial Sequence
  chemically synthesized
cacttaactttcgatgcact

SEQ ID NO: 31156 - DNA, 20 bp, Artificial Sequence
  chemically synthesized
acttaactttcgatgcactg

SEQ ID NO: 31157 - DNA, 20 bp, Artificial Sequence
  chemically synthesized
ttaactttcgatgcactggg

SEQ ID NO: 31158 - DNA, 20 bp, Artificial Sequence
  chemically synthesized
gatgcactggggagcctctc

SEQ ID NO: 31159 - DNA, 20 bp, Artificial Sequence
  chemically synthesized
ggggagcctctctggcctca

SEQ ID NO: 31160 - DNA, 20 bp, Artificial Sequence
  chemically synthesized
ggagcctctctggcctcaca

SEQ ID NO: 31161 - DNA, 20 bp, Artificial Sequence
  chemically synthesized
gagcctctctggcctcacag

SEQ ID NO: 31162 - DNA, 20 bp, Artificial Sequence
  chemically synthesized
gcctcacagaggatccctac

SEQ ID NO: 31163 - DNA, 20 bp, Artificial Sequence
  chemically synthesized
cctcacagaggatccctact

SEQ ID NO: 31164 - DNA, 20 bp, Artificial Sequence
  chemically synthesized
cacagaggatccctactggg

SEQ ID NO: 31165 - DNA, 20 bp, Artificial Sequence
  chemically synthesized
acagaggatccctactgggt

SEQ ID NO: 31166 - DNA, 20 bp, Artificial Sequence
  chemically synthesized
ttccctccccttcattgcct

SEQ ID NO: 31167 - DNA, 20 bp, Artificial Sequence
  chemically synthesized
gtcacttctctgttgaattc

SEQ ID NO: 31168 - DNA, 20 bp, Artificial Sequence
  chemically synthesized
ttccagaattctctcttatg

SEQ ID NO: 31169 - DNA, 20 bp, Artificial Sequence
  chemically synthesized
tccagaattctctcttatgt

SEQ ID NO: 31170 - DNA, 20 bp, Artificial Sequence
  chemically synthesized
ggattttctacttactattt

SEQ ID NO: 31171 - DNA, 20 bp, Artificial Sequence
  chemically synthesized
cttactattttggttctttg

SEQ ID NO: 31172 - DNA, 20 bp, Artificial Sequence
  chemically synthesized
tactattttggttctttgtg

SEQ ID NO: 31173 - DNA, 20 bp, Artificial Sequence
  chemically synthesized
actattttggttctttgtgg

SEQ ID NO: 31174 - DNA, 20 bp, Artificial Sequence
  chemically synthesized
tattttggttctttgtggag

SEQ ID NO: 31175 - DNA, 20 bp, Artificial Sequence
  chemically synthesized
attttggttctttgtggagg

SEQ ID NO: 31176 - DNA, 20 bp, Artificial Sequence
  chemically synthesized
tggttctttgtggaggaggt

SEQ ID NO: 31177 - DNA, 20 bp, Artificial Sequence
  chemically synthesized
tttgtggaggaggtgagtgt

SEQ ID NO: 31178 - DNA, 20 bp, Artificial Sequence
  chemically synthesized
aggtgagtgtcagctgccct

SEQ ID NO: 31179 - DNA, 20 bp, Artificial Sequence
  chemically synthesized
gagtgtcagctgcccttagt

SEQ ID NO: 31180 - DNA, 20 bp, Artificial Sequence
  chemically synthesized
gcccttagtcagtaatcttc

SEQ ID NO: 31181 - DNA, 20 bp, Artificial Sequence
  chemically synthesized
cccttcccttgaaatttttt

SEQ ID NO: 31182 - DNA, 20 bp, Artificial Sequence
  chemically synthesized
ctttatgtttttatttctaa

SEQ ID NO: 31183 - DNA, 20 bp, Artificial Sequence
  chemically synthesized
ttttatttctaatagactga

SEQ ID NO: 31184 - DNA, 20 bp, Artificial Sequence
  chemically synthesized
ttatttctaatagactgaaa

SEQ ID NO: 31185 - DNA, 20 bp, Artificial Sequence
  chemically synthesized
aatcatattttaaacactct

SEQ ID NO: 31186 - DNA, 20 bp, Artificial Sequence
  chemically synthesized
atcatattttaaacactcta

SEQ ID NO: 31187 - DNA, 20 bp, Artificial Sequence
  chemically synthesized
ttaaacactctaaggctata

SEQ ID NO: 31188 - DNA, 20 bp, Artificial Sequence
  chemically synthesized
taaacactctaaggctatat

SEQ ID NO: 31189 - DNA, 20 bp, Artificial Sequence
  chemically synthesized
aaacactctaaggctatatg

SEQ ID NO: 31190 - DNA, 20 bp, Artificial Sequence
  chemically synthesized
aacactctaaggctatatgg

SEQ ID NO: 31191 - DNA, 20 bp, Artificial Sequence
  chemically synthesized
gctatatgggggactatctg

SEQ ID NO: 31192 - DNA, 20 bp, Artificial Sequence
  chemically synthesized
ctatatgggggactatctga

SEQ ID NO: 31193 - DNA, 20 bp, Artificial Sequence
  chemically synthesized
gggggactatctgaaggcct

SEQ ID NO: 31194 - DNA, 20 bp, Artificial Sequence
  chemically synthesized
actatctgaaggcctcagat

SEQ ID NO: 31195 - DNA, 20 bp, Artificial Sequence
  chemically synthesized
tgaaggcctcagatgagtaa

SEQ ID NO: 31196 - DNA, 20 bp, Artificial Sequence
  chemically synthesized
aggcctcagatgagtaaaag

SEQ ID NO: 31197 - DNA, 20 bp, Artificial Sequence
  chemically synthesized
cctcagatgagtaaaagaag

SEQ ID NO: 31198 - DNA, 20 bp, Artificial Sequence
  chemically synthesized
gagtaaaagaagtagcgaat

SEQ ID NO: 31199 - DNA, 20 bp, Artificial Sequence
  chemically synthesized
atcatttgtttcttcaaata

SEQ ID NO: 31200 - DNA, 20 bp, Artificial Sequence
  chemically synthesized
tatttcccccttatgttctt

SEQ ID NO: 31201 - DNA, 20 bp, Artificial Sequence
  chemically synthesized
aaaaatgtttgcatctacca

SEQ ID NO: 31202 - DNA, 20 bp, Artificial Sequence
  chemically synthesized
aaatacgtaatctaacaaac

SEQ ID NO: 31203 - DNA, 20 bp, Artificial Sequence
  chemically synthesized
aatacgtaatctaacaaaca

SEQ ID NO: 31204 - DNA, 20 bp, Artificial Sequence
  chemically synthesized
ctaacaaacaaggatgtttt

SEQ ID NO: 31205 - DNA, 20 bp, Artificial Sequence
  chemically synthesized
aaggatgttttaagatctct

SEQ ID NO: 31206 - DNA, 20 bp, Artificial Sequence
  chemically synthesized
atgttttaagatctctgagt

SEQ ID NO: 31207 - DNA, 20 bp, Artificial Sequence
  chemically synthesized
agatctctgagtaagatgca

SEQ ID NO: 31208 - DNA, 20 bp, Artificial Sequence
  chemically synthesized
agatgcatagttgcaaataa

SEQ ID NO: 31209 - DNA, 20 bp, Artificial Sequence
  chemically synthesized
gatgcatagttgcaaataaa

SEQ ID NO: 31210 - DNA, 20 bp, Artificial Sequence
  chemically synthesized
tgcatagttgcaaataaaag

SEQ ID NO: 31211 - DNA, 20 bp, Artificial Sequence
  chemically synthesized
tgcaaataaaaggagttttc

SEQ ID NO: 31212 - DNA, 20 bp, Artificial Sequence
  chemically synthesized
gcaaataaaaggagttttca

SEQ ID NO: 31213 - DNA, 20 bp, Artificial Sequence
  chemically synthesized
atctaataaatgtgtaccat

SEQ ID NO: 31214 - DNA, 20 bp, Artificial Sequence
  chemically synthesized
tgtgtaccatcagaaactta

SEQ ID NO: 31215 - DNA, 20 bp, Artificial Sequence
  chemically synthesized
aaacttatggtatattctcc

SEQ ID NO: 31216 - DNA, 20 bp, Artificial Sequence
  chemically synthesized
tatggtatattctcctggaa

SEQ ID NO: 31217 - DNA, 20 bp, Artificial Sequence
  chemically synthesized
atattctcctggaaaagatg

SEQ ID NO: 31218 - DNA, 20 bp, Artificial Sequence
  chemically synthesized
tcctggaaaagatgaagatg

SEQ ID NO: 31219 - DNA, 20 bp, Artificial Sequence
  chemically synthesized
aagatgaagatgaagaaaat

SEQ ID NO: 31220 - DNA, 20 bp, Artificial Sequence
  chemically synthesized
agatgaagaaaataagtcta

SEQ ID NO: 31221 - DNA, 20 bp, Artificial Sequence
  chemically synthesized
tgaagaaaataagtctacag

SEQ ID NO: 31222 - DNA, 20 bp, Artificial Sequence
  chemically synthesized
aagaaaataagtctacagaa

SEQ ID NO: 31223 - DNA, 20 bp, Artificial Sequence
  chemically synthesized
agaaaataagtctacagaag

SEQ ID NO: 31224 - DNA, 20 bp, Artificial Sequence
  chemically synthesized
aaaataagtctacagaagag

SEQ ID NO: 31225 - DNA, 20 bp, Artificial Sequence
  chemically synthesized
acagaagaggagaaattctt

SEQ ID NO: 31226 - DNA, 20 bp, Artificial Sequence
  chemically synthesized
ttggaaattttgcatttttg

SEQ ID NO: 31227 - DNA, 20 bp, Artificial Sequence
  chemically synthesized
aaattttgcatttttgtgga

SEQ ID NO: 31228 - DNA, 20 bp, Artificial Sequence
  chemically synthesized
ttttgcatttttgtggatag

SEQ ID NO: 31229 - DNA, 20 bp, Artificial Sequence
  chemically synthesized
ttttgtggatagtggttttg

SEQ ID NO: 31230 - DNA, 20 bp, Artificial Sequence
  chemically synthesized
gtggatagtggttttgaaga

SEQ ID NO: 31231 - DNA, 20 bp, Artificial Sequence
  chemically synthesized
tagtggttttgaagaaagct

SEQ ID NO: 31232 - DNA, 20 bp, Artificial Sequence
  chemically synthesized
atatatttaaatatgttgct

SEQ ID NO: 31233 - DNA, 20 bp, Artificial Sequence
  chemically synthesized
gatgtgactcccacacttta

SEQ ID NO: 31234 - DNA, 20 bp, Artificial Sequence
  chemically synthesized
gactcccacactttaaagaa

SEQ ID NO: 31235 - DNA, 20 bp, Artificial Sequence
  chemically synthesized
taaagaaaagttcttcattt

SEQ ID NO: 31236 - DNA, 20 bp, Artificial Sequence
  chemically synthesized
ttttagttgcccttgcaaat

SEQ ID NO: 31237 - DNA, 20 bp, Artificial Sequence
  chemically synthesized
gttgcccttgcaaattggct

SEQ ID NO: 31238 - DNA, 20 bp, Artificial Sequence
  chemically synthesized
tcctcaacaaataattttga

SEQ ID NO: 31239 - DNA, 20 bp, Artificial Sequence
  chemically synthesized
tgatggtttctaaaattgtc

SEQ ID NO: 31240 - DNA, 20 bp, Artificial Sequence
  chemically synthesized
tctaaaattgtccagaattt

SEQ ID NO: 31241 - DNA, 20 bp, Artificial Sequence
  chemically synthesized
ctaaaattgtccagaatttg

SEQ ID NO: 31242 - DNA, 20 bp, Artificial Sequence
  chemically synthesized
ccagaatttgaggaaatact

SEQ ID NO: 31243 - DNA, 20 bp, Artificial Sequence
  chemically synthesized
tttgaggaaatacttagatg

SEQ ID NO: 31244 - DNA, 20 bp, Artificial Sequence
  chemically synthesized
gaggaaatacttagatgtag

SEQ ID NO: 31245 - DNA, 20 bp, Artificial Sequence
  chemically synthesized
gacatcaatttatgttaact

SEQ ID NO: 31246 - DNA, 20 bp, Artificial Sequence
  chemically synthesized
tgttaacttagatttattgt

SEQ ID NO: 31247 - DNA, 20 bp, Artificial Sequence
  chemically synthesized
aacttagatttattgttgga

SEQ ID NO: 31248 - DNA, 20 bp, Artificial Sequence
  chemically synthesized
agatttattgttggatggtt

SEQ ID NO: 31249 - DNA, 20 bp, Artificial Sequence
  chemically synthesized
taatcatgtctgttcttgtc

SEQ ID NO: 31250 - DNA, 20 bp, Artificial Sequence
  chemically synthesized
atgtctgttcttgtccagtc

SEQ ID NO: 31251 - DNA, 20 bp, Artificial Sequence
  chemically synthesized
tctgttcttgtccagtctag

SEQ ID NO: 31252 - DNA, 20 bp, Artificial Sequence
  chemically synthesized
acatctgaactgtgatttga

SEQ ID NO: 31253 - DNA, 20 bp, Artificial Sequence
  chemically synthesized
tttgacagtgtccttattat

SEQ ID NO: 31254 - DNA, 20 bp, Artificial Sequence
  chemically synthesized
tatcagactctgctcaatga

SEQ ID NO: 31255 - DNA, 20 bp, Artificial Sequence
  chemically synthesized
gtttaaacttctttttgata

SEQ ID NO: 31256 - DNA, 20 bp, Artificial Sequence
  chemically synthesized
cagtaaaaaacttttcctta

SEQ ID NO: 31257 - DNA, 20 bp, Artificial Sequence
  chemically synthesized
tccttaaagatgaaattctt

SEQ ID NO: 31258 - DNA, 20 bp, Artificial Sequence
  chemically synthesized
ccttaaagatgaaattctta

SEQ ID NO: 31259 - DNA, 20 bp, Artificial Sequence
  chemically synthesized
atgaaattcttaaggacaat

SEQ ID NO: 31260 - DNA, 20 bp, Artificial Sequence
  chemically synthesized
ttaaggacaattagcttgtg

SEQ ID NO: 31261 - DNA, 20 bp, Artificial Sequence
  chemically synthesized
tatgaaaattgcttgcattt

SEQ ID NO: 31262 - DNA, 20 bp, Artificial Sequence
  chemically synthesized
tgaaaattgcttgcattttg

SEQ ID NO: 31263 - DNA, 20 bp, Artificial Sequence
  chemically synthesized
cttgcattttggagttacat

SEQ ID NO: 31264 - DNA, 20 bp, Artificial Sequence
  chemically synthesized
tataaattaatgaatcctat

SEQ ID NO: 31265 - DNA, 20 bp, Artificial Sequence
  chemically synthesized
atcctattggtaccatataa

SEQ ID NO: 31266 - DNA, 20 bp, Artificial Sequence
  chemically synthesized
cttttgtgtctcgcctttca

SEQ ID NO: 31267 - DNA, 20 bp, Artificial Sequence
  chemically synthesized
ttttgtgtctcgcctttcaa

SEQ ID NO: 31268 - DNA, 20 bp, Artificial Sequence
  chemically synthesized
tttgtgtctcgcctttcaaa

SEQ ID NO: 31269 - DNA, 20 bp, Artificial Sequence
  chemically synthesized
tcaaagggcaattttccaaa

SEQ ID NO: 31270 - DNA, 20 bp, Artificial Sequence
  chemically synthesized
tccaaaaagtatattttgca

SEQ ID NO: 31271 - DNA, 20 bp, Artificial Sequence
  chemically synthesized
aaagtatattttgcatggct

SEQ ID NO: 31272 - DNA, 20 bp, Artificial Sequence
  chemically synthesized
aagtatattttgcatggctc

SEQ ID NO: 31273 - DNA, 20 bp, Artificial Sequence
  chemically synthesized
ttttgcatggctcaggctaa

SEQ ID NO: 31274 - DNA, 20 bp, Artificial Sequence
  chemically synthesized
caggctaaaagtaatgtctc

SEQ ID NO: 31275 - DNA, 20 bp, Artificial Sequence
  chemically synthesized
aaaagtaatgtctccagatg

SEQ ID NO: 31276 - DNA, 20 bp, Artificial Sequence
  chemically synthesized
cattgattgtgactattgat

SEQ ID NO: 31277 - DNA, 20 bp, Artificial Sequence
  chemically synthesized
ttgataagatttactatgta

SEQ ID NO: 31278 - DNA, 20 bp, Artificial Sequence
  chemically synthesized
agatttactatgtaaagtat

SEQ ID NO: 31279 - DNA, 20 bp, Artificial Sequence
  chemically synthesized
ctatgtaaagtataagttac

SEQ ID NO: 31280 - DNA, 20 bp, Artificial Sequence
  chemically synthesized
gttactggaataatacattt

SEQ ID NO: 31281 - DNA, 20 bp, Artificial Sequence
  chemically synthesized
aataatacatttaagaaata

SEQ ID NO: 31282 - DNA, 20 bp, Artificial Sequence
  chemically synthesized
aatacatttaagaaatatag

SEQ ID NO: 31283 - DNA, 20 bp, Artificial Sequence
  chemically synthesized
atagtagctattaaaacctg

SEQ ID NO: 31284 - DNA, 20 bp, Artificial Sequence
  chemically synthesized
aaacctgtagtctgatgaaa

SEQ ID NO: 31285 - DNA, 20 bp, Artificial Sequence
  chemically synthesized
tgaaatggaatatgttttga

SEQ ID NO: 31286 - DNA, 20 bp, Artificial Sequence
  chemically synthesized
atggaatatgttttgaaaga

SEQ ID NO: 31287 - DNA, 20 bp, Artificial Sequence
  chemically synthesized
gaatatgttttgaaagacag

SEQ ID NO: 31288 - DNA, 20 bp, Artificial Sequence
  chemically synthesized
gaaagacagcagtgaaaaat

SEQ ID NO: 31289 - DNA, 20 bp, Artificial Sequence
  chemically synthesized
agacagcagtgaaaaatgag

SEQ ID NO: 31290 - DNA, 20 bp, Artificial Sequence
  chemically synthesized
aaaaatgagaagtaatatat

SEQ ID NO: 31291 - DNA, 20 bp, Artificial Sequence
  chemically synthesized
taaaattgctttttgcaatt

SEQ ID NO: 31292 - DNA, 20 bp, Artificial Sequence
  chemically synthesized
tgctttttgcaattgagttg

SEQ ID NO: 31293 - DNA, 20 bp, Artificial Sequence
  chemically synthesized
attgagttgaagattgatgc

SEQ ID NO: 31294 - DNA, 20 bp, Artificial Sequence
  chemically synthesized
ttgagttgaagattgatgcc

SEQ ID NO: 31295 - DNA, 20 bp, Artificial Sequence
  chemically synthesized
tgccaggatcttattacctc

SEQ ID NO: 31296 - DNA, 20 bp, Artificial Sequence
  chemically synthesized
gccaggatcttattacctcc

SEQ ID NO: 31297 - DNA, 20 bp, Artificial Sequence
  chemically synthesized
attacctccaggatttcaca

SEQ ID NO: 31298 - DNA, 20 bp, Artificial Sequence
  chemically synthesized
ttacctccaggatttcacaa

SEQ ID NO: 31299 - DNA, 20 bp, Artificial Sequence
  chemically synthesized
gatttcacaaaggatttctt

SEQ ID NO: 31300 - DNA, 20 bp, Artificial Sequence
  chemically synthesized
cttgagtcatccccttgctc

SEQ ID NO: 31301 - DNA, 20 bp, Artificial Sequence
  chemically synthesized
cttgctctagctcatgaaca

SEQ ID NO: 31302 - DNA, 20 bp, Artificial Sequence
  chemically synthesized
tcatgaacaaagtattgctc

SEQ ID NO: 31303 - DNA, 20 bp, Artificial Sequence
  chemically synthesized
agtattgctcaagtaatcga

SEQ ID NO: 31304 - DNA, 20 bp, Artificial Sequence
  chemically synthesized
tctcacatgtgattattatt

SEQ ID NO: 31305 - DNA, 20 bp, Artificial Sequence
  chemically synthesized
attattatttagtgctgtca

SEQ ID NO: 31306 - DNA, 20 bp, Artificial Sequence
  chemically synthesized
ttattatttagtgctgtcac

SEQ ID NO: 31307 - DNA, 20 bp, Artificial Sequence
  chemically synthesized
tcacgggaaatatcctgcct

SEQ ID NO: 31308 - DNA, 20 bp, Artificial Sequence
  chemically synthesized
aatatcctgcctaagtttac

SEQ ID NO: 31309 - DNA, 20 bp, Artificial Sequence
  chemically synthesized
tatcctgcctaagtttactg

SEQ ID NO: 31310 - DNA, 20 bp, Artificial Sequence
  chemically synthesized
atcctgcctaagtttactgg

SEQ ID NO: 31311 - DNA, 20 bp, Artificial Sequence
  chemically synthesized
cctccctatgtcctcctacc

SEQ ID NO: 31312 - DNA, 20 bp, Artificial Sequence
  chemically synthesized
tttccttgcacactctactc

SEQ ID NO: 31313 - DNA, 20 bp, Artificial Sequence
  chemically synthesized
ttgcacactctactccagct

SEQ ID NO: 31314 - DNA, 20 bp, Artificial Sequence
  chemically synthesized
tgcacactctactccagctt

SEQ ID NO: 31315 - DNA, 20 bp, Artificial Sequence
  chemically synthesized
gcacactctactccagctta

SEQ ID NO: 31316 - DNA, 20 bp, Artificial Sequence
  chemically synthesized
ctctactccagcttagggcc

SEQ ID NO: 31317 - DNA, 20 bp, Artificial Sequence
  chemically synthesized
tctactccagcttagggcct

SEQ ID NO: 31318 - DNA, 20 bp, Artificial Sequence
  chemically synthesized
acccttttaattaccccatt

SEQ ID NO: 31319 - DNA, 20 bp, Artificial Sequence
  chemically synthesized
tcaatttttgccttttcaat

SEQ ID NO: 31320 - DNA, 20 bp, Artificial Sequence
  chemically synthesized
aaaatttatttatatatatt

SEQ ID NO: 31321 - DNA, 20 bp, Artificial Sequence
  chemically synthesized
atttatttatatatatttag

SEQ ID NO: 31322 - DNA, 20 bp, Artificial Sequence
  chemically synthesized
tttatttatatatatttaga

SEQ ID NO: 31323 - DNA, 20 bp, Artificial Sequence
  chemically synthesized
tatatttagaaggtatgtac

SEQ ID NO: 31324 - DNA, 20 bp, Artificial Sequence
  chemically synthesized
tcgttatcatgctgcttata

SEQ ID NO: 31325 - DNA, 20 bp, Artificial Sequence
  chemically synthesized
ctgcttataaagacatacct

SEQ ID NO: 31326 - DNA, 20 bp, Artificial Sequence
  chemically synthesized
tataaagacatacctgagac

SEQ ID NO: 31327 - DNA, 20 bp, Artificial Sequence
  chemically synthesized
ataaagacatacctgagact

SEQ ID NO: 31328 - DNA, 20 bp, Artificial Sequence
  chemically synthesized
cctgagactgggtaatttat

SEQ ID NO: 31329 - DNA, 20 bp, Artificial Sequence
  chemically synthesized
ctgagactgggtaatttata

SEQ ID NO: 31330 - DNA, 20 bp, Artificial Sequence
  chemically synthesized
aaaaacgtttaattgtctca

SEQ ID NO: 31331 - DNA, 20 bp, Artificial Sequence
  chemically synthesized
ttaattgtctcacagttcca

SEQ ID NO: 31332 - DNA, 20 bp, Artificial Sequence
  chemically synthesized
taattgtctcacagttccac

SEQ ID NO: 31333 - DNA, 20 bp, Artificial Sequence
  chemically synthesized
aattgtctcacagttccaca

SEQ ID NO: 31334 - DNA, 20 bp, Artificial Sequence
  chemically synthesized
gtctcacagttccacagggc

SEQ ID NO: 31335 - DNA, 20 bp, Artificial Sequence
  chemically synthesized
tctcacagttccacagggct

SEQ ID NO: 31336 - DNA, 20 bp, Artificial Sequence
  chemically synthesized
ctcacagttccacagggctg

SEQ ID NO: 31337 - DNA, 20 bp, Artificial Sequence
  chemically synthesized
cacagttccacagggctggg

SEQ ID NO: 31338 - DNA, 20 bp, Artificial Sequence
  chemically synthesized
acagttccacagggctgggg

SEQ ID NO: 31339 - DNA, 20 bp, Artificial Sequence
  chemically synthesized
ccacagggctggggaggcct

SEQ ID NO: 31340 - DNA, 20 bp, Artificial Sequence
  chemically synthesized
cacagggctggggaggcctc

SEQ ID NO: 31341 - DNA, 20 bp, Artificial Sequence
  chemically synthesized
cctcgggaaacttacaatca

SEQ ID NO: 31342 - DNA, 20 bp, Artificial Sequence
  chemically synthesized
cgggaaacttacaatcatgg

SEQ ID NO: 31343 - DNA, 20 bp, Artificial Sequence
  chemically synthesized
gaaacttacaatcatggcag

SEQ ID NO: 31344 - DNA, 20 bp, Artificial Sequence
  chemically synthesized
acttacaatcatggcagaag

SEQ ID NO: 31345 - DNA, 20 bp, Artificial Sequence
  chemically synthesized
caaacatgtccttcttcaca

SEQ ID NO: 31346 - DNA, 20 bp, Artificial Sequence
  chemically synthesized
acatgtccttcttcacatgg

SEQ ID NO: 31347 - DNA, 20 bp, Artificial Sequence
  chemically synthesized
tgtccttcttcacatggcag

SEQ ID NO: 31348 - DNA, 20 bp, Artificial Sequence
  chemically synthesized
cttcttcacatggcagcagc

SEQ ID NO: 31349 - DNA, 20 bp, Artificial Sequence
  chemically synthesized
cttcacatggcagcagcaag

SEQ ID NO: 31350 - DNA, 20 bp, Artificial Sequence
  chemically synthesized
cacatggcagcagcaagtag

SEQ ID NO: 31351 - DNA, 20 bp, Artificial Sequence
  chemically synthesized
cagcagcaagtagaagtgcc

SEQ ID NO: 31352 - DNA, 20 bp, Artificial Sequence
  chemically synthesized
caagtagaagtgccaagcaa

SEQ ID NO: 31353 - DNA, 20 bp, Artificial Sequence
  chemically synthesized
aagtagaagtgccaagcaaa

SEQ ID NO: 31354 - DNA, 20 bp, Artificial Sequence
  chemically synthesized
agtagaagtgccaagcaaaa

SEQ ID NO: 31355 - DNA, 20 bp, Artificial Sequence
  chemically synthesized
gtagaagtgccaagcaaaag

SEQ ID NO: 31356 - DNA, 20 bp, Artificial Sequence
  chemically synthesized
tagaagtgccaagcaaaagg

SEQ ID NO: 31357 - DNA, 20 bp, Artificial Sequence
  chemically synthesized
gtgccaagcaaaagggggaa

SEQ ID NO: 31358 - DNA, 20 bp, Artificial Sequence
  chemically synthesized
aaagccgcttataaaaccat

SEQ ID NO: 31359 - DNA, 20 bp, Artificial Sequence
  chemically synthesized
ataaaaccatcagatcttgt

SEQ ID NO: 31360 - DNA, 20 bp, Artificial Sequence
  chemically synthesized
ttgtaagaactcactatcac

SEQ ID NO: 31361 - DNA, 20 bp, Artificial Sequence
  chemically synthesized
taagaactcactatcacgag

SEQ ID NO: 31362 - DNA, 20 bp, Artificial Sequence
  chemically synthesized
agaactcactatcacgagaa

SEQ ID NO: 31363 - DNA, 20 bp, Artificial Sequence
  chemically synthesized
cactatcacgagaagagcat

SEQ ID NO: 31364 - DNA, 20 bp, Artificial Sequence
  chemically synthesized
ctatcacgagaagagcatga

SEQ ID NO: 31365 - DNA, 20 bp, Artificial Sequence
  chemically synthesized
aaatccctcccacaacacgt

(The sequence listing continues in the following parts.)

What is claimed is:

1. A method for editing the haemochromatosis (HFE) gene in a human cell by genome editing, the method comprising:
   (i) introducing into the human cell a Cas9 deoxyribonucleic acid (DNA) endonuclease or mRNA encoding the CAS9 DNA endonuclease, to effect one or more single-strand breaks (SSBs) or double-strand breaks (DSBs) within or near the HFE gene or within or near regulatory elements of the HFE gene that results in a permanent deletion, insertion or correction of one or more mutations within or near the HFE gene and results in the restoration of HFE protein activity; and
   (ii) introducing into the cell one or more single-molecule guide ribonucleic acids (sgRNAs) comprising a spacer sequence selected from the group consisting of nucleic acid sequences in SEQ ID NOs: 3610; 973; 378; 1029; 3598; 3634; 1142; 388; 1121; 3678; 1137; 3531; 3654; 1045; 1096; 3558 and 3585.

2. The method of claim 1, wherein the method further comprises: introducing into the human cell a polynucleotide donor template comprising at least a portion of the wild-type HFE gene, at least a portion of DNA sequences that encode wild-type regulatory elements of the HFE gene, or at least a portion of cDNA corresponding to the wild-type HFE gene.

3. The method of claim 1, wherein the method further comprises:
   introducing into the human cell a polynucleotide donor template comprising at least a portion of the wild-type HFE gene or regulatory elements of the HFE gene, and wherein the Cas9 DNA endonuclease effects one single-strand break (SSB) or double-strand break (DSB) at a locus within or near the HFE gene or within or near regulatory elements of the HFE gene, that facilitates the insertion of the at least a portion of the wild-type HFE gene or regulatory elements of the HFE gene into chromosomal DNA that results in a permanent insertion or correction of the HFE gene or regulatory elements of the HFE gene.

4. The method of claim 1, wherein the method further comprises:

introducing into the human cell a polynucleotide donor template comprising at least a portion of the wild-type HFE gene or regulatory elements of the HFE gene, wherein the Cas9 DNA endonuclease effects a pair of single-strand breaks (SSBs) or double-strand breaks (DSBs), the first at a 5' locus and the second at a 3' locus, within or near the HFE gene or within or near the regulatory elements of the HFE gene, that facilitates the insertion of the at least a portion of the wild-type HFE gene or regulatory elements of the HFE gene into chromosomal DNA between the 5' locus and the 3' locus that results in a permanent insertion or correction of the HFE gene or regulatory elements of the HFE gene.

5. The method of 3, wherein the Cas9 DNA endonuclease is pre-complexed with the one or more sgRNAs.

6. The method of claim 1, wherein the method further comprises:

introducing into the human cell two of the one or more sgRNAs, and wherein the Cas9 DNA endonuclease effects a pair of double-strand breaks (DSBs), the first at a 5' DSB locus and the second at a 3' DSB locus, within or near the HFE gene or within or near regulatory elements of the HFE gene, that results in a permanent deletion of the chromosomal DNA between the 5' DSB locus and the 3' DSB locus, wherein the two sgRNAs are modified sgRNAs.

7. The method of claim 1, wherein the Cas9 mRNA and the one or more sgRNAs are either formulated into separate lipid nanoparticles or into the same lipid nanoparticle, or wherein the Cas9 mRNA is formulated into a lipid nanoparticle and the one or more sgRNAs are introduced into the human cell by an adeno-associated virus (AAV), or wherein the Cas9 mRNA is formulated into a lipid nanoparticle and the one or more sgRNAs are introduced into the human cell by electroporation.

8. A single-molecule guide ribonucleic acid (sgRNA) for editing the haemochromatosis (HFE) gene in a cell from a patient with hereditary hemochromatosis (HHC), comprising a spacer sequence selected from the group consisting of the nucleic acids sequences set forth by SEQ ID NOs: 3610; 973; 378; 1029; 3598; 3634; 1142; 388; 1121; 3678; 1137; 3531; 3654; 1045; 1096; 3558 and 3585.

9. The method of claim 2, wherein the Cas9 mRNA, the one or more sgRNAs, and the polynucleotide donor template are either each formulated into separate lipid nanoparticles or into the same lipid nanoparticle.

10. The method of claim 2, wherein the Cas9 mRNA is formulated into a lipid nanoparticle and both the one or more sgRNAs and the polynucleotide donor template are introduced into the human cell by an adeno-associated virus (AAV).

11. The method of claim 2, wherein the Cas9 mRNA is formulated into a lipid nanoparticle, the one or more sgRNAs are introduced into the human cell by electroporation, and the polynucleotide donor template is introduced into the human cell by an adeno-associated virus (AAV).

12. The method of claim 1, wherein the human cell is selected from the group consisting of a liver cell, skin cell, pancreatic cell, heart cell, joint cell, and a cell from the testes.

13. The method of claim 1, wherein the Cas9 DNA endonucleases is pre-complexed with the one or more sgRNAs.

14. The method of claim 2, wherein the at least a portion of the wild-type HFE gene or the at least a portion of cDNA corresponding to the wild-type HFE gene is exon 1, exon 2, exon 3, exon 4, exon 5, exon 6, exon 7, intronic regions, or combinations thereof.

15. The method of claim 2, wherein the polynucleotide donor template is either a single or double stranded polynucleotide.

16. The method of claim 6, wherein the Cas9 DNA endonuclease is pre-complexed with the two sgRNAs.

* * * * *